United States Patent 12,642,819 (COMPOSITIONS AND METHODS FOR TREATING INFLAMMATORY BOWEL DISEASE) - sequence listing, part 88

SEQ ID NO: 44 - DNA, 3033595 bp, Eubacterium eligens (residues 1-1,516,798 of 3,033,595)
  modified_base (52138)..(52234): a, c, t, g, unknown or other
  modified_base (154217)..(154316): a, c, t, g, unknown or other
  modified_base (491158)..(491253): a, c, t, g, unknown or other
  modified_base (492085)..(492182): a, c, t, g, unknown or other
  modified_base (832041)..(832139): a, c, t, g, unknown or other
  modified_base (1110974)..(1111612): a, c, t, g, unknown or other
  modified_base (1187661)..(1187759): a, c, t, g, unknown or other
  modified_base (1805690)..(1805719): a, c, t, g, unknown or other
  modified_base (2330364)..(2330459): a, c, t, g, unknown or other
  modified_base (2464060)..(2464158): a, c, t, g, unknown or other
  modified_base (2677466)..(2677560): a, c, t, g, unknown or other
  modified_base (2838522)..(2838619): a, c, t, g, unknown or other
  modified_base (2860968)..(2861065): a, c, t, g, unknown or other
  modified_base (3000458)..(3000722): a, c, t, g, unknown or other
  modified_base (3012722)..(3013224): a, c, t, g, unknown or other
ataaacattctcatctaatatataattattgacagttattttcttttgatttgctaatatttcatacttttttaatatgtcttctaatgtatcatttattttcaaatattcttcatcattattcaaattttctatagaatgaactgataatatttgagaaatattttttgttaaactatcaacgatttcaatacattcattaatataaatatctctctctttatattttccaatattgtatttcatgttttccagtattattttaagactagcaagaggagttttaagttcatgggatgcacctttaaaaaagtcatattttaacttttctaattttaaaatttctttatttttaaattccaaatcgtcaattgttcttaataaagtagaatacaaatcattaatttgttgttttaattctccaacctcatcattagagctaacttttaaacgcgtttttttatccagtttcatcattttatcagtaacaatttttatttcttgtaaattattttttattgattttgcataaattaaagaaataatagcagaaaataaaattgatattaataatgaatatggtaaaaatttaaggcttaaatctttcgcatctctttgcatatcagctgtagaaacaaattgtagatttatttttttaccatcattaagttttatttctctttcttcaattatcagagaattactatcactttctaaattaacatttatattatctttgatttgtatttcattcatattattttcttcttttataaatgcttttatttcactactcttagaataaagttccaaagtttgttctatatattttatttcttttccattcatattactagaaatttcatttgcaatattataaatcttttcttttctcgtctccaaatatgttttaggaaagataaaaaaaactaatgaatgaactaatataattattattccaagaacagaaaatatttgtatgaacattttgggaaatatctttaattttttcattttctctccaatttatatcctacatttcttatagtagttatacagtctaattgtaatttttttctaagttcttttatatatacatctattactcgatcataaggagtttcttcgctatctttccatacataatcaataatttgcattcttgttaacacttgtccattattatccaataaacattttaatacttctagttcttttgcatttacatctatttcttcaccatttattttagctgtatagctattaaaattaaccgatagatccttatattcaaacttctctaaatgtccataattcttcttaattaaagaatctattctagcctttaagacaggcaatgaaaatggcttttctatatatccatctgccagattagtaaacgcatcaattttatattcttcatcactaaatgcagtcaggattagaattggtaaattgcttttctttctaatttctttcaatacttctaaaccatttataaaaggtatctgtatgtctaagataaccagatttatatcgctattaaattctgacaaggcttctcttccatctttagcttgaataacagtatatccaaattctgaaagatattcacttaatccctctcttatcatattatcatcttcaacaattaatattttcatgtatacctccacttaagcctattcgcttatattgtacagcatattattggatatttaaaagcaaaaaaatttttggtgctaaaaagcaccaaaaattttatttattgtcaattaataattcttttggattccttcttaatatattgaatgaagaaataatcaaagatacaagaagtactaaactcataaatataactacataaaatatgaatttaggtaatacatttatatctaaacttgataatgtcttgttaaatccttcagcttctgccccaccacctaattggctagatgcagattgtctggcaatttgtttagctatatcaccagtaaccttattcaatatattattcccaagcttttcagctgtatacctagctaagaaataagagccaacatatgcggggattgatataaataccatctcaatcaggaattgaccaaaaatttctaattttgatatacctaatgatagtaatactgctatttccttctttctggcattcatccataataataataataatgaaactacaactcctgcaaatattaatgagccagcaaataatttatttgaaattgagtagatacctgatatagattgttgtaatgcaggataatttgatgaacttttaatcaaattatattctctccaatttatatctaatttctcaatctcttttattacactatcaagattcttatcaccttttacaaagaatgttgcatcctggtatacagctgtatcttctgtattaccataaactttagcagctgtatgaacatcagtgattaatgtattttcgtatagttcctgtgctgcacttactccaccgctattatgcccatcgaatagacctttaatttctacttctactgtttcatctgcttgtttctcgttatcagcgtcaaataaattagattttatttttatcttatctccaactttaagattatttttttcagctaaatctttatgcattaagattttatttttatcttcattttctaaatgctttccttctactaatttatatgctcctgatacaaattttgtttcttttgatgagtcgttaaccccggttaacataactgttcttttgaaattcttcgctcttttaggtgattgattcgcaagagtctctttagtttcaataatatcataatcaactaaatctgcaacactgtttattctttttacataggagtctatactatctgtttgagctatctttttaatatcttcaccttttacatttcctccacctctaggtgttcctggatttacttgtctatttatctccatagaaaaactatttgttatattagcaaatgtttcttttgaggctctgtccgtagcatctttaatagataaacttataagacttaaagttgacatagccaaaataactaacataataattattgattttaagctttttctagttatataagcaaatgcattttttatcattattcaacctccaaattcattttatttactttttttaacttcttaccacttagctctaaaatgatatctgcagaatctgctgcttccttactatgtgttacaactattacacatttattcctttctttagctaatgtctttaatatattaattatttctccggcagtaacactatccagattaccagtaggctcatcagccagtattattggagcatctgataccaatgctctggcaatagctactctttgctgctgtccaccagataatttcataacatttctttttatttgttttttatctaagcctagttcaaacaagatactttcatctgctgatttattcactaatctaatattttcaatcggcgataaataatctattaaattatagttttgaaatactaaagatatattattttttctatgattactatatcctttcttttgtatatcttcattcttaaacaatatttgtcctgtttgaggtttatcgagtccagcaagtaaggaaagaagtgtagattttcctgctcctgactttcctactatcgcataaaacttcccaagttcaaatttttgatttactcctgacaaaactttttctttagaattggcataactatatgatacattctttatttctaatatttccatcattttctcctaacttatttttgataatatttctttaggcttcttgattaatattaatgaagaagcaaatacaactgataaaacaataatacttattaatattaaataactttgtccaagtgttgtaatatttaacataaaactatcatttattaaacttccgccagaaatcattgagtcctctgagttaacgattccacctgcaattacttttagtaatacatttcctaaaaataaggaagatattatacttggtatcgatatgaataataactcgaatataaattgcattataatatgtatcttagatgttccaatagataaaaatatacctatttcataaattctttctcttaaccatagaatcaagattaatgaaagaacaaccatcccacctaacataatagaataagtcattatttttattatgtgttttattccactcactgactccaaagactcttcaaacgcattagaatctttttcaacaaaatactttgactcatcaattttaagctcttttaatttgtttaaggctaagtctgtagattctgcactaccagaatacattaaaattttatttgcgattttattattttctgatttatttaatatctcttgacttgttgaataatctacaaacaccatattttcgctaaaatcagaagatagccctgtatatgtttcatgttttttaccagaaaagatccctataattttaaatttatgactttttatttttccacttttttcaatatctagtaattcaagatcaacttcatcacctaattttagattgttttgtttagcaaattcttcatgaacaataattgaatccttatcattttctcctatatttttaccttctttaattgtaaacactccactactaaataaaatatttcttttagtattatttgtagcttcgagtgaaacaacattcttaaattcgtcagataaatcttctctatttattctttgttctccgctaactactttagcatcttttagctttgctaatccatcatattgcattattatttcttcaatttcttttaatttttcaatatctttaaattcattaacattaaaatagttaccatcttttcttgttattgatattgaagaattagaactttcatataaagccttttctatttcatcgcttgatttcattattgttaaacaagaatacaagcaagaaagaactatagttaatatgataaaaattattaaagttctatttctctttcttgtaatatatgctatagcattttttatcactttcctaactactcctttctattttcttactccataactaattgcatctactggacaagcattttttcataaattattcctcctttatttttttcataatagcattttatagctacttttaatatcattctacacaccttttatgaaacgttgatgaaatataattttttatttttcctacactttgaattatacaggaagccagtctgtaatttggtggtatctttgccaatcttgacagtaatacccataattctgttagccacggtcgatacctccttccgtaaaaatgggcataaaaaacagatttcttcaggcatgaaaaaagcaccaaccatttctgattgatgctttcaaattattttgtttttgtaaatctttttaattgcgtatccacatctcttccaccgtacataacatgtataatcgtaaccacttgtgtatcatcatccggaatatatagaacaagataaaatacatgcttcaagcctatcaagctgaccacttgcattttctggtgacttcagttcaaaagcaatgtattcgaagattccacgaaggtctatctcggtctgatatgaaatcacgatatcataaatcataaattgtaatccttgcggatatcagtaaaaacagattttgctggtgcatatttaataatcatatctgcaagaaagctacaccagcgttcaaaatccttgttcattgccaagcctccttaaaatattatcttgtgaataattcgcagaacatattttatctcaagacttactaaaataaaatagattttactgaatggtagttttcaaatatttctatctatcacaaatcatttctttcaatctctccaaaactaagttgttctccaaagcgtagaatgactgcttccctttgttctgatgataaaaaattcaaaaaatagcttatctctgccctatcctctagccgaactatgtcgttatactcatgcactatattttcttcatcttctaatggataaaactcaaccttcctactttcatcaatacataaatgatttgcaatcgtgtatagataagccttaaatttctttttccctttatatccggataaattcttaaacaacttcaaaaatgtttcctgagtcaggtcttctgctttttccagattagagcaatgccacctacagtaacgtaaaatagatgtataatagcgttttatcaattcttctgctacattttcatttccaagtagaatctgttccactaattcgtcatcactcaacacgcatcagactcctttccattgaatatctgtatatatataataacgggttatgcacttaaaatgattaaaagattcctcattttttcttttttgcccatcctagccactgcgataccctccttcaaaatgtgctaaagccttatcccttttgcatagacttatccactttgtcaaggtggctatgtaaacagtaccagagaacgcaaaaaagccgcctactcttaaaatcaataagaataagccgctttgtaatctgccttagacatattcaattttatattggaaagcaggtgaaaggacaaatctctctttatctctgcgatatatgcggcatgtactttcagtcgctcgtcatctatcgtaaatcccttaatcatatattcttttaaccgctttgtcgcccactgcctgaatcttgttgcaatcactgatttaacacggcatccaagagagattatcatatctaaattgtaataagtaacattatatgtttttccatcatctgcagttgttcggaatttccgaacaactgaatccttatccaattctccttcttcgaatatatgctttatatgttcacttatatttgatttgaacagtgtttaagttcattacatattacttgctatccctgataccttattctttcaaccagcgtttcctttttcagattactgcttaaaacgcaggaaagtataatctgcaacagaccaaccaaagaaatcataataaaaattggtacgattggaacatgatagatattcattccaaatattcccatatgttttgcataggaaaaaagtgcatagccgagcggcagaccaatgatcaaagctacgcatatggtgccaaccgtaaacatcagtccctgtaactgcaggcataaatttaattgtttatttgtcatacccacagcctgtaatataccatattcctgcttttttgtcgtaatattcatgatcatggtattcgccatattcataaacccgatgagtcctacaatagccataaacagataacagccaagcttcatcatgctgcttgcaaattcggcagattgtaactgcgcatgataagtatccatttttatatgcgaagtattagaaatcaaagtattcagactttgttctacagatgccacatcttttttatcacagtccacccacagatagccataggctgttcctctcggattcatggaacgatatacaccttccggaatgacaagataagtgtccgcacttacaaaagatcctgcaatctttccctgataggtataggttccacttccattctcaaagtcaaatgcaatggattcacccggagcatatccatcttgttccatccacgttgaccagccaaagaaaatatcaccattctttaccgcctgatcatagtccatagagccaatatccccttcttggcgcataaaatcaaaatcctttttactcacaatagtagcaggaaatcttgttccgttcagatttacagagacaatctctctcgtcataacatctgttactcccggaatgcttttgatttcttcaatcagcgaatcattcaatggatcatccgtcagaatcgtatccagattattctccggatatctttcatcatactcagcagtatagtcaagctgcagttcaaattgtccatgattaacggaaagacgtgcttcatgctccgtgtcaatatttcccacataattagagataatcacaaacaatacgcaagaaaaacccattgtgaggatagtaccaatggttctttttggattacccgttacatttgccattgccatagaaaacacggtgacattttttctgccatttcgttttccttttttttgtgtttctgcattttctaaataccgtgttgcttcgataggtgaaatctgtgaaacaattttcattggtttacgcagtgccaaagcaacggtaagaaatgatacgaaaatacagagaagcataacaggcagggaaaacagagacacctgctgattttgaactcccatagagccagtttgggttgatacaaggttcccctgttctaccagccagttaaaaccgcattttgcaatcagaaagccaaaaagcaatccaactggtattgaaaaaaatgtcaaaaaaatgccctctctgaagatcagttgtttcatctgcttttttgtcgctcccagagccttgatttttccatactcctgtatcttgttggcaataccgacctgaaaaatattataaataaccacaacagagaaaagtacaattgcaagaatcaaaaccccacataccgcaatcgtttcataactcggctgcaagacccattgcaaatagagatcattgactataacgtttttttcttcgatcccacaagctgctgcaatctgctttataaccaaatcaatattattcatagatacatttgcagagtcatttaaagtaaaataaatattatactgtctgtcattctctgcgacgtgctcatcataaaactcctgtgacccgaaagcaacataagatgcctcaatggtatattcatcccgatcatataggattccgctgacaacaaattcttccggcttatattctgactgcatccctgcgcggtaatccagtgtaaccgtatctccgacctttacatcatcatatcccatttcactaaaaaatgctcttcctgcggcaatttcctgcgttcccaccggatactttccttcctttaactcatattccttattatagggaagcatttttcttgcagtctcatccatgcagacaaaaccaccgttttcgtttccttttatgataccttcggtgcacatagtgcctgtagcatctatttccgcacggcggtttacttcttttaactgcgatccgtctgctgcgacaaacaaaccataattgcttccatatgagcctgccgcctgacttttctgtaaacggatcattccattccccacagtactgataatcacaagcagcatcgtggtcaaacatatggacatcataatcagtatacttcttgtcctgttccttttgtcattgctatatgcaatcctgcttattgtcttcatctaaaatccaccacctgtccatcctcaattaccagaatacgatcagcgacctgtgcaatttcgtcatcatgggtaatcattacaattgtctgtccatatttttttgctgtcatcttaagcagagcgatgacctcatcactggtcttagaatcaagatttcctgtcggctcatctgcaaatataatttccggacgattcaccagtgctcttgcaattgctactctctgctgctgtcctccggataactgatttggcagattataaatccggttttcaatcccaagagttgcaataatatcatttacatacgcttcatccacttttcttccatccagccccagtggcagtacaatattttcccagacattaacagatgaaaccagattaaatgcctgaaaaacaaatccgatttttcttctgcggaaaacagcaagggcatcttccttcatcctgtataaatctttccctgctaaagtaacactgccttttgtcggggtgtctagccctccaagcatatgaagtaatgtacttttaccggaacctgactttccaacaattgcgacaaattctccctgctcaatctgaatgtccacctgattgaccgctttgacctgattctcacctgcgccataaaacttacaaagctgcttggtttctaatatcacactcatgtgttgcctccttttcaattctgtaaagcgtaccttttcagcacgctttctttgcctgtttatatatttggtcatttttcaacctacatccaaattgtatcaggacaatctttcatttcactttcaaaaaacgagcagaaatcttacagaattgtaagatttctgctcacttaaaatttaaccaacatatggtaattgaatcacaaacgtgcttccttttttctttttgccggaggttaccatgattgtacctccgtgtttttcgataatttctctcgatagaaaaagtccaattcctgtaccactcttttccatgacctccctggaacttcctctgtaaaatcgttgaaaaattttgtgatactcattctgcggaataccaattccctgatcctcaatttccattcttacaagatcgtttctttcttgtaaccggataaatatttttgaaccatccgggctgtacttgattgcattatctaaaacgttaatcacagcttcaccaagccatcttttatcctgcataaccatgcatgtttccagctcttttgcatagtcaaaaacgaattcaatttctttctcatccgcttttggataagtacagttcacagcagatatgacagtatccataagcggaagttttttcttattaatctgaatcagtccagtttccatcttggatatttcaagaagcgactgcaataatgtctccagtccatccagagcactccgacaacggatacgaaactcctcctgttctgtggcacttaagtcattctgcatcagcacactaaaacatgtatccaaagctgcaaccggtgtctttaactggtgagagatatcagaaaccatttctttcgtgctctctttttcttcccgtgcttcttcctttagcaattgaatatgatgtccgattgcttcaagctggtcattcaatttttccagttctgctggattttccgttttcagtaaagcatcaaatttattttcacggaatctgatcagaatttcttccaactggtctaaaattttctgatgacacgcatcttcttttttcttccaataaagtaaaaaagtcaaaagaagcacgcatatcacagtgcttacagcaccggtcaccataacctgatgccggaattgcatataaaatgcattccctttatttccccagtatccatattgctccaataatcgccttccctgttcgttggtttcaatatcctcatccttaagcaattccgaaacagcatccagcccggaaaattcttcctttgcagcaatctctgtcataagattcattttatatttataatcttcataaaacacatatgtggtaaagcaatttaatattgcaaacaatactatgacaggcaccaccaaggagagcactactgtaatcttcttgcgatatctctttgtcactgccttacctcctgattccatatatacccaagacctctgatattctttatatagaccggtgcagccggattgtcttcaattttctcacggagtcttctgatattgacagcgattgtattttcatccacaaaatccccttccagatcaaacacattttccaatatttgtgttcttgaaagaatctgtttcggattctgaagaaaaaaagtcagcatttttaactctgtttttgtcagactgatttcacgactctttatcaggactttcatttctcctgcgataaatacgatatctcccgaaatcatctttccagcttccgttttctcctgtctgcggcggaaatgtgcttctattttcaaaagaagtaccgaaagactaaacggctttgtaatataatcatctgcccctgcttcatatcccataacctgatccatctcctgatctagtgctgtaaggcagataatgtatgtattataattgcatctcatccaccttacaaattccagtccattcccatctggaagattcacatcacaaatggtaacatccacattattatcacttgcaattcttttcgcatttttcactgattctgctgaaaaaacctcatatccgcatttttccagtgagaatgtaattccacgatttaaattttcatcatcttcaaccacgagtatacctggcatagcatatgcacctctctttattaaaccttcatgccggcattatgttcagccacatacttcttaatctcatcatatgttgccttagtctctgcagatgttatgtccacatcatcaagttcaattgtgacattaatataatcatccggcttttatttcagtcgggacaaaagaacaaccgtctcaagtgtcggaaacttttccaaggtaacagtatgctcatcagactgctctttatccaaagaaataccatcaactcgaactacttccttgccatctctaagaatcggtactggaaattgaaacttgatattcctaatccaattaccatcttctcgtctttcttgaaatatatcaatacgctcaataaatgcctgcataaactgtttcttttcagcatccgtacattctgcatataattcattaaatgcgttcaaaaagccgtatatactgtccgcatcaatctgatttttcttaagttcatatacctgagacttcaaatctgcgatttcctcttccacttcatctattttatcatattgggtatctaatcgtctctgtaaatctgaaatttttttatcgtaatgaatatctgtaacatccagattatccatctgctgttcaagacgtgttttaattatctctgcctgatggagatttgcgtttaatacagataactgcttttccagatcagaagtatcaactgttgccatacattccttttccacaacatggacatttcaatattcctgacaaaatatgtgcatgctccggatcatgaatcttttctcttctgtaattatttttagagcgtttctcctgtgcaagattccagtcctcctcagaaataattgcttcatgaattccctcatatacagggaactccgattgttccactacatgcatttcattacgtgttcctgttttcttttcggtgcgcctgcgtccgtatgctatcttccccatatacactgggttatcaataatctttttgagaaaataatcatcatatgcttcacttttatcgccctgcttaaaacaaaagtattcggaaaaagacaagggaagcacatgaacttcatctcctcttccctcaaactcagtcaatatatctttagataagaaagtatatccattttatataaaatatgcaatcatatcatttaatttttttgccgtatgaggcatttttataaaccatgtaaatttttctttcaaccttaaagatatctacagcctcaccaccctgtcaaacctctcaactccagtcattctatgtgacaccataataaccgttttatccttcataggcgaatctagtaccttaagaaatacattttcactgtgcgtatcaagagctgaagatggctcgtccatcagaataacaggtgaatccttaagcattgccctcgcaatcgctatccgctggcgctgaccacctgacagattcattccaccggcggtcagccttgtgtcatatccatcaggcagttcactgataaattcatctgcatatgcctgttttgccgctctgacgatcatatccatatccggactgcctgctttattccaaccatattcaatattctcccgaatcgtaccctcaaacagataactttcctgcggtacataagtaatcatattcctcaactgcattaaagaatactcattcaactccctgccatataatctgacactgccactttgggcaggatagaacctcagtaatagttttaaaaatgtgcttttaccacaacctgattctcctaccagcagaattttttcaccattcttaaccttaagtccatcataataaatcttagcgtcttcattatatgaaaaatgtagtttgtaaagttctatagcaacattacatttatcatgcaaatccaccgtatcaacctgtgtctgcgtattccagcccacacattcttcctgctccaattcgaggaaatcaaacacatgccctgctctcacaaccgatgttgaaaatgccgccagtgaactcccgaacctctgcattgatgaactcatactcatctgcaatgtgactacagccataactattccgaaattcagctttccatctgccacaagcagtgcgcccacaataattgtaccaaagcttccgataatccccaataaaaatgctgccatctcaagtaacgcttccattcttaccctcgacctttctgcctgtgctgattcttcattttctttgtaaaaatatttcagcacaattgacgctcccggattcatctttaatgtaacaaagcctgatattatatcgctgaacaaggctgccaattttgcagatttcttctgtacattttttgcatgtttcttaatagaattatttatcctgatggacacaaatgcagtaagcacactgattatcagcgcaatgcatgtcagaatcgtactgtaaaaacacattgcaataaccgacgcaataacaatcacaatctttcctgacacccagtatacatgtgaaaaccatgccgtttttaaagagtcagcgtccatattaagagttctcatcgcttctgcgctatgtgtatcatcataaaatttcatattcatatccagcagtttttcaaatagtcttaacttaaggtcatacaccattcttcttacaagatgaatatgaaaataccgcagatatggaaaaagacatttgcatatgactataatcacacatactattaccgctgtcctaaacatctgcatattctgaaattcaatcgcattaatcgtctgtttggtgacataagaatacagaacctgcaaagctgactcggtaattaatgtgataatcagaatcagccagtagcggaatctgtatttcccaatatattgcaaaaatcttctggtatctttcatactctgtccctcatttccttgttaataaattccttgtacatatgtgcatatcttccatgcatgatcatcagttcagaatgtgttccctgttccacaatttctcccctgtccagcacatagattctgtcgtaatcacggattgtatttagtctgtgtgcaactgtaattacagtacagtctttggaaatttcatcaattgttttgcagatattaatttcagtcttggaatccaaagcggaagttggttcatcaagcagaagaatctctgcacctttcactattgcgcgggctattgaaattctctgcctctgcccgcctgaaagattgcctccgttctcggtcaagacagtttcaatcccttcaggaagttgttttacaaatatttcacagcctgccatactcaaagctttcataatatcatcatgcatagcctgcggatttccaattcttacattatctgcaacagacaacggaaaaagtgtggtctcctgtgaaatcagtgcaatcctttctgtagcaaactgtcttaaaatcagctttaaaatagtactttttccgctcccgctttctcctgcaaatgcaattctttcgccaggtttcacgctaaaacttacattatgtaaaacattttcatcattatatgcaaatgacacattttcaaagctgattagtgaattgccttctttttcaacacatttttctttataatcagtcttttcaggcttgatttcaattatttcaaacactctagaaactgacacaagtgctgtctgaaaacgcacaaccaactgatatgtgtatgacaatgggtcaatcagtttcttaattatgctcatatatgcgattaacacgccaattgtaattacatttctgaatacaaatacacctccgacacatattgcaagtgccagcggaatctcctgaattgcccttgaaagcggttcaagattatactgtgccagatcagttttatcagatgtcacaaatgttttataaagtgcgttttcataccggttcatcatacatttctgaagattgtatgatttgataacttctacccctgcaaatgcttcttctatattattgttagtctgccccagctcccttgcatactggtgctggcgcaattttattggttttaaaagctttatattgattggaactataattgcaagcggcatcagacatattgccgccaatggcggattcattaaaaataaatatactgaatatacaatcgtaataaccggcacatataaacaatccttgaaatatcccgacatgaaccctgccaatccctcaatatcctcagtaatgcgctccatcatgtcaccataattacatttattgatgtattcaggtgatgccttcatcagcgcatttaccgcatcatttctaagatcctgcagcaaacctgctccaacaaagccagtcatcgcaacaaccatgtaattagacacaattcctgcgcatattacaatcagcattttaattacaataaaatgaattgtctgtttaagcgtaccaccggcaatcatgtctattatctgctttaaaatatcaataatcattaccgtagacacagacgccgtcacacttgatactgcggcaagtgtaatctgtatccaatactttttgctgtactttaataattttcccatatagacattttccactcctttatatatactatatgcaagtataacttgtgtaaaatgtgctaacaatggaatttatgcagcggatttttatactatttgcaatctatgtttgcagatagtgtataattaatcattaaaaatatttacagaaatgagggataacatgccacagacggacagacataaaaaaagagagattccaattgaatttaatttctataatacattagataagcttcctttagaaaagagatgtactatcattatgatttcgtgtggcagtacaactattaagataaatgaacattttcagactgtgaatgctcctgctgtgctttgcatttcacaatatgataagtttcaatgtatagaaaagacacatttaagcgccaaggcgtttcattttgacccttggtatattaaagcatgccttagatttgaaaatcttgatgacgacatcagtattgatgagaaatatgtttatgaaagaaatatgctttacatgtttaccaagcattctggaaattttcagggaatatttcatttaacaccacagcagtatattcacattaatgaattaatgctgatgattggtgctgaaacctatgcgcagagtgatgattactggacctgccgcataaggagaatgctgcgtcagacgataaactgcatatatgatatctatgtcgaccagcgcaaattaagattctacgaattgtctgaaaatactaacccagtaacaatatgtacagactatattcatgccaattaccagaatgatattaccttaaattccctgtgcgaactcgttcaccttaaccgcaccacattgaaccagcgctttaaacagcagctaaaccgcacctgtatagaatatctgcttcactaccgcttaaagattgcgcaggagctgctatccaataccaaccttaaaatcgaagaaatctccagtcagtgcggcttcaaatatggctcgtactttaaccgccagttcacgaaatgcttaggtatttcaccgtctgaatttcgcaagaacccaactggatatagttcgtttgaaggtgggaaggtgcggaaattgtgaatggtatgttatttttcattattcctacccattttcaataatatataactcaagtcattttcataatctctagcaataaactttcgcctattaaaaattttataaatcttaggataaataaaccaatataagcctaaaaaaaccgaaatagcaactattaataataacattatatatgtagctgtaataaaatttgttttttgcgtaattaaagatatataactcataattattggaataataatagaagaaattatatttcctacactgaatctatgactttcttcttgataatactttttactttgttcaattaaccataatatatctttttcactatacatttgtaaggattttattctttcaatataatcatttatttgtttctgcttattgtctttattattttcattccatcttttattatttaagatataaataaatgcctcaattagatataaaatcaaaacaaaaagtatattaataataagataatattgtgtcctttttaattgatataatatcattgttacaataaccaaaaacattgatattagcaggcttattaattgaataaattcagctttcgtaattttttttagttttcttatatccacacttgacatagcagatatataatctgataaaaaatatgtatacattactatttcttgattaaataaccaaattctcctattctataattatctgtaaagtatcgctattcactcttagtactctcttctaattccaacatatatttatcgaaatcagacataaacaatctgtcctgaatgacacgatatttctcaaattcagtctcagcatgaagctttgcaatctcagcagacacctttcctgaatcctgcaaaatcccataatcaaacatttcaataaaactattaagacgcttttcccaatcctccatagtcaatgggatatgcctcagtgtcatattttcagcgaaatctaaatacgcagtaaccatacgatttaattgtttcatttcatcctgacttaaatagtttttagcaattgtaacatcgcttttcttaatcttgccatctggagcatctgcccatgttgttaatcccatatgttctttggtatggtctgctctttctacaatcagctctgatgccgtatgtccatgaaccgcaaaatgcatcttattctgaacagtagcataaaatctttttgttgcaactgaatttttatcataatctattgcagtagcataaaggtctgtaattttctgataaaactttctttcacttgctcttatttcgcgaatgcgctctaactgctcgtcaaagtacttttctgtcagataagttcctctttttaacctttcatcgtccatgacccagcctttgatggtgtaatcttttgcaatctgattcacccattttctgaactgaacagcacgctcggaattgaccttaaaacctacagcaataatcatttgaagattataatgttttgtatcacgagcaacctgacgggaaccttccatttgaactattcggaattttcgaatagttgccgcttcttccaattcactatctgcataaacttttttaatatgctcatttatcgttggtaaaccaacgtcatataatgtagccatcatcttctgtgtcagccatatattctcgtcctcataacgcatctcaacgctgtcctgctgttcaccaacagaagcaacataggtcaaatattctgctgcgctggaacggattgttatttcttcttttttctttttcaaacaaaatccccctttttattatcttactgagatatgagataaattgctgatgttttatatatcttttctccccagcagacacaccgtctccacatgtcatgagtgcgcaataaagatgcacatcccatgacttatccgtcaagtttgggctctaaaatgatacaacagtcccctatcggacctgcaaaaataaagcaagatgcatcactttgcacctgccatagaaaaagattagatttgtttttgagatacaggtctaactgacctgcgcgtgatttgtgctctgctctttctctatggtccacttaccccattgataatttctaggatattgtaccatagattgtttgtttcggaaattactttcctctaaaaatgggcagactcaaataactaaacctcatccttttagatacttgagtctaccattttcatcaaatttcttcacttttatcagcctcttctgattttaacattttacaaataataatgttcttctttctcctcctatatgtgaacaatacctttaatttactacctcttgcacataacaattcttgttctccccctctattactaatcaagtctatgtataaccccttagttcccttcggtatcataatttttagcaatgtgttgtatgaaccaaattcttctttcaatgacgattttacaagaccgactcccatgtatcctttatcttctattattgcaccccagttaatataacgtctattcgtacttatacacagttctctataatccaaaaatctatatccccaaatattctctgggacatacgatttatttagacgtttatccataactgcttgcatttcctcaagttcatcttctggaaaagtaaagcccgtataaccatatctgttttttttattaatggccaatccccaatttccaccacaataaaatgaaaaccatttattttcaagtgcatctactcttaattcttgtatctcctcttcagaaaaatctccttttaaatatatttcaggattttctgtatcataatttctccttaactttccaccaagttgatactccggcaaccaatatgaataatttttattcccccaatctcttgcttcatcaatgctagaaaatcttctatatatctctctcatatttttctccaaacgtactaccgcattccttaatctgcatctggatcaatcctaatatcaattggtctaacacgcctatttttcttattttccacaatactgcatcagaacaaccgtctccacatgccccgtattaggaaacatatccacgcaacaacacttctccaccttataccctctctcctgcagagtaacaaggtctcttgcaagcgaagtaggcttgcatgaaatatacaccattctgtcaacaccataatcaataatcttctcaagtgccttagggtgaattccgtcacgaggtgggtcaagtacgatgaaatcaggcttaatctcaatattatcaagtgcctttaagacatcgtctgcaatgaattcacagttagtaagaccattctgggctgcattcttcttggcagcctcaacagcttccgcaacaatctcaacaccgataaccttgcttgcaacaggcgataacatctgcgcaatcgtacccgtacctgtatacaggtcatatataaccggtttgctgccagccacatctccaaatccgccagaaagcacatactcacgtgccttagagtaaagcacttccgctccaagagaattagtctggaagaatgagaacggagttatcttgaaacgtaagcccagaagttcctcctcaatataatcctgaccatacagaagctcagttttctcgttaattactgcatctgcaaggctgtcgttaaatgtatggagaacacctgtaagagtgcccttatattcaattgatgtcaggcggtttacaagctctgtgaaatcatgctcaatctgagtcgttgttacgatatcaacaagaatctgtcctgtctttactgactttcttacaagaagatgacgcagatacccctcgtggcttaacttgtgctggaaaggaagctccttctctattgcataatcctgaacgcatgtgagaatctttctgtaatcctcatcaataatcttacattctgtaactggaacaatatcatacatgctgtttcgtttgtgaagtccgagtgcaagaggtccgtccttgtactcatcgccaaatgaaaattccatcttattacggtattcttctgtaaccggacttccgattatcccctcaaatggaagctcacccgaaacaacttcgctaagaagcttttccacctgtgcgctcttaatctttaactgttcctcgtaagctactgtctggtaagtgcagccaccgcatttgccaaaatgtggacatgccgggctggtttcaagcggactcttctcaacaacttccataagtctgccttcgcagtgtccttttcttttcttattcacgcagaatctgacagtctgtccaggaattgcgttcttgacgattgccttttccttctgtccgtcctcatctgtcacccacactgtcgccttgttagggaaatcaaccttttcaactttaccttcgtatacgcttccttttttcaatctatactccattccgcacatgaattgtgcctgttattaacatattaatagtttctggcagcacttattcacataacggcataccttgtataattttatcagaaaaatgtgctaaagtatagtagtcacatttactcaaccacgctggcattctttgcctgcactgcagaatgtattctttcaagtaccttgtcacacagccatgtataagcagccccggcagcattcagtcctatacgtaatgcaaccgcataaggcattccaaaaagtcccgccgcaattgataatgcgccaaatgtattaaaagctgtctgccatgcataaccagcggaatatccgactccgataccacctatcatgcctatatacggatacattgattctggcagtactatatacatcactgcaaaaatcgcacatccaacaacattaaacaatgccctgtttccaattctcttatcaacatctttagaaaacggcagacacactgacatgcacgcaattccaatccacattgccctaggcagtcccatcagtgaaacaatcagcatagcgcttgatacgataaatgtaagcttaatgtaccatcttgtccttgctgaattaatattaaattccttaaacaaatcccagaatgttcttctatatggtctgttcctctgattcttatagaaaataatcatgcatactaacatcccggcaagcagtcccacaactctcatcatatattcatgccctgtgacatcatatccctgtagcaaaagatacccaagaacgaatgttgaatgattatacataattacattgtgacatcccattatcataagaagcataatacacacaacatttattacaaatgcagcaactggcggtaccatattggaaaccctcggtcctgctatcaatattgcatatattcccattattgaaatcaacccatgtgatgtcttaattccaaaatccgcctgtcttaataccagcaccgcaagaagcactgtaactccgacaacactgttattattccccagcagcttactgaatactgtaactactgcaacgcagaatatcataaccagatacaccttgaaattatatataaaaatatgtcttcttttctctttagaatcctgtgtgttcttaataagctgttttgaaccagccgagcttaactgtaactcctgataaaatgtcataaattcctgctttcctttcctccccttaaattttgcttaatgacagggttgagtaatataacactgattacacccctatgtcaattaagaaataattaaatattatgcaataaaaaaagccacaaccactgacatatcctaatggacatatcaagccggctatggctttcaatcatatcgcacttattacattacttctcgatgtcttcatcctcgaaatcatcgtcaaaatcttcgtcttcgaaatcttcatcatcgaaatcatctaaataatctggtgtaaaatatctgtatacagcataagcgataccagcaactgctgcaactgcaccaacgatagcaagaacagctatgataattgtgctgcacttcttgcagcatttcttatcttcatcttccttcttgctaataagttctcctaatttagtagctgcgataagctcatctaatttttctttactcataacaatatctcctttcataccacggatttaataaatgtattatagcatagcgttaaacatttgtcattatagttttttaagtctggcaaatcctgccagcattttcttctgtccgtactctgcaaattcaactgttaccatatagtctcttgctgagtcctctatagcaagtacctttccttcaccgaatttcacatggctcaccatatcaccgacactgtagccaagtccacctgaagattttgcacttatatctgcacctcttgcagcacctattacatttcttgaagataagccgcttcgtgtaggcactcctgcataagcacttcttacagaatctgccggagtctttctcttttctggtttcttaagatcaaataattccatagggtcttttccaaatcccggattagaaccaccatttatcttaacctttcttgagctatatgttcctgctgcccttccgcctggtgtgccgcttccgtagctgctaagaattgatctggctgttgcacgcatgttaatgcctgttgtatctggctcatctgatgtcccgccatatgcaatcctgcctttagcatacccactggaattgttttctatgtgcatatattctttaggaatttcattaatgaatcttgaaaccttattcatctgtgtttcaccacgcaccatacgcgacttggcacttgtaagattaagtattttctctgctcttgttattccaacatagcacagtcttctctcttcctcaatctcagttgaatcatctgacacaattgtcatatagcttgggaaaagtccgtcctccattcctgtcatatacacgattggaaattccagacctttcgcactgtgcagcgtcataagcattacatgaggctctgactcatccagattatcaatatccgctattaaggcaacttcttcaagaagtcctgaaagtgtaggctcttcgcctgcttccttacagctctcctcatagcttacaaccttattaatgaattcatccagattctcgcgtcttgcctcaacctcttccaccgtttcattctgtgaaaggctctcaatatatcctgtatcctcaattacagcctcagcaagctcctttaatgacataaattcttctttggcacgcagtcttccaataaggtcaacaaatggctctaacttggaaagtgccgcattctttattgtgtcaatatcctttgcattgacaagtgcttcccagaaagtaatatcattaaaatctgcatattcctgcaatctgtcaatcgtagtattaccaatccccctcttcggaacatttataattcgcttaaccgcctgaccatcaagaccattatcaatagttttaagataagcaagaatatctttgatttcctttcgctgatagaaattctgtccgccatatatcttatatggaatgttgtgaatcatcagcttttcttcgagcgctcttgactgtgcattagttctgtaaagaatggcaacatcattataattccagccatcccttacatactctgcaatatcactcgcaacgccttctgcttcatcatacccgttctcatacagagtataattgaccttctcgccctctccgttatcagtccagagtgacttgctctttctgccaatattattacttatcaccgcatttgcagcattaagaatagtctgcgtcgaacggtaattctgctcaagctttataaccttagcgcctgtgaacacattttcaaagttaagaatattataaatgtttgctccacggaacttatatatagactggtcatcatcaccaaccacacatatattgccatactttgctgcaagcattgcaacaagcttaaactgtgatgtattagtatcctgatactcgtcgaccattatatatctgaatctgtcctgataatgctcaagtacctctgcatcactctggaacagctcaaccgtcttgaatatcaggtcatcaaaatcaagtgcattgttaagcttaagcgtcttctgatattctctgtatacgcctgcaattcttctaagattatagtcgttacctgcctcaagctcgaactcatcaggagtctttaactcatctttagcagatgaaatcttgctcataattgcacgctctttaagcatcttcgtatctatattcatcttcttacatatatccttgattacagacttctggtcgtccgtatcatatatcgtaaagttattatcgtatccaattctgtctatgtatcttcttaaaattctcacgcatgttgagtggaatgtacttacccatacagcccctgcaccctgtgccacagtagtctcaactcgttctttcatctctcttgcagctttattagtaaatgtaattgccataatattatatgggtctactccgcattcttctattaaatatgcaattctgttcgtaagcacgcgtgtctttccagagcctgctccggcaataataagcagcgcgccatctgtatatttaactgcccttttctggctgtcattcaaatcttctaatctcatatatccaccttcatgcaaatgtgaaatctatatccaccttatttctgccaactaccacattatacaaaaacaacgggatgttgccaagccaatatgacaacatccctgattgttatttattaaattcacatattactaattgtcagattatgcaagctttgttccacagttagaacagaacttagcgccattagttggtgttccacagttaggacagaacttaggtgctgtgccacctgacacatttgcagtattattcattgcagtattcatgttattcatcatatgctgtccaacctgcattcccatctggagctgcatcatatcactggcaatattcgaaccgcctcttgaattgccgatactatcagccatagccatctgtgtatatctgttcatatctccaaccattgcctgagaagctgccttattagtcatcttctgtacttcttccggataagagaagcttgagatagtaaagcttgttattgtgattcctaacttgctcatctccatatcaaggtctgtcttaatacccgctgagatatcataagcattagcctgaagattaaacatatccttgccttctttagaaatccacttcataagaagctggtcaagaactgctgatattctttccttaacatctgcaacagtgtacatctgctttacacctgctaccttgtctataagcgtaatgtaatcagatactgaaaatgagaagttaccgaaagctcttattggcatgccacctggaagtgcctgtgttggaataagaataggattcttagttccccacttctctgtgaattccttagtattaacgaataaaacttcagctcttactccactgttgaagccaaacttaaagcctttaagtgttgataagaatggaataatctgtgattcaatatcaaagcttccctcgtccttaaaaataccttcaatcttaccattgtacataaagattgcatcctggccggcgcggataatcagcttactgcctttcttgatttctctgttggtccatttccagaagattatatcatctctgtactcttcccattcaactacgttggcaaactgccctttgaataatcccatgttccctctccttatctatgtattgcttatctcattataaatgtgcttctgaattataagcccatctgagccttaagtgctgctaattcatcatcaactgctgtgttagctggctctgcatcatacttagctgcaagactgtcaacatctgcctcaagctgtgtctggttaagctctgccattgcattagcctcgtcaagcatcttattagccttagcctccatcttaccgaatgcatccatgcttgttccaacactgttaacacttgaaccaaccttgttgattctctcctgagccttagctgctgcaaccttagccttaactgcatctcttcttgcttcaagagactggatatccttgcagagcttatcatgcatctgacgcatcttagctgcattgtctgctgcaatattatatgtctgctgtaatgtagcctgcttagaaactaactgctgcttcttctcaaggaatgttcttgcatctgcctcgttgccagccttaagagccttttctgcatatgactgatacttggcaacatctgctgtgcattcatcaagctctcttttacatcttgtctcctcagccataactgaagctgtctctgccttaacctttccaaggtcgctctcaagatttctcatgtactgatcaatcatcttctctggatcttcacacttatcgagaagtgcattgatgttagcgctcataatgtccttgaatcttgttaaaatacccataataatcctccattcctgtgccgctttctggcacatatcaccctctggtgcatccgaattctgtctcccagaattcttaaaaaacctttttcattataatatatcaggagtaaaaagtcacgaatatttgctcctatgaaacatattttatattcttgtaataaaaattaaaatatcataatatgcacattacactatgctaaagttcattatattattcctacttgaaatgtggttttaaaaactatataatatagcttaagcattaatataaatgtattctctcatgaatacgcatttttaaagaaatgaggaacatatgaacaacgatattaaagagcttatgagtggtattcttaaagatatgtccgctcttaactatataaaacccggagatgtgcctaacatcaacctgtacatggatcaggttacaacatttatgtatgaacatcttcacgatacaaagcgtaccactgatgataaagtactaaccaaaacaatgattaacaactatgccaaaaacaatctgctgccatcaccagtaaagaaaaagtactctaaggaacacatatatatccttacatttatctattactttaagaacattctctcaataagtgatatacagaaaatgctcaatcctctcactgagaaattctttgatgaaggttccaagccggatctggattatatatataaagagattttttcaatggaatcctctcttgcaaggccattatctaaagatatatttgcaaagtctgaacaggcaagcaatgcatttaccgatgtaaaggatgatgatgacagagaattcttacagttcttcagtcttgtatgccttttaagctttgatgtatacatgaagaagaacatgattgaaagtctgattgatgattactctgccaagcatgcgccaaagcagcctgagaagcctgataaaacagacaaaaagaaataatctataaattaagggaactgccagtactgacagttcccttttacattgcttcatatattacttattatcttctgactctttctcaagcatgccaagtctttcaaatactctgtcatacccgtcattaccataattaagcgaacggtttaccctgctgattgtcgcagtagacgcacctgtcttctccgcaatatcaagatatgtcctgtgttctcttaacatcttggcaacctcaaatctctgtgacagggataaaatctcgttaattgtacatacatcttcaaagaaatcgtatgcttcatctaaatccttaaggcttaatattgcctgaaaaagctgctcaacagcctgtgtctttaacttattgttcataattatccaccccggttttccaaaatagcattggcttattactttcaaattttaacacagtgaagttttcaagtaaagacattattcacttcttaatgccacaacagggtcttttttagctgcaagctttgccgggataagtccggcaataaatgtaaggaacatgcttattattataagtattactcctcctgcaaccggaagctgtgcaacattggaaatgtctgtaaagtgcttaatcaacgcatttgcaggtatgcacagcaataaagttacaacaatgccaagtgcgcctgagacaaaaccttcaataagtgtctctgcattgaatattcttgaaacatctttcttagaagcaccaatacttcttaatacaccaatttccttagttctttcaagtactgaaatgtatgtgataatacctatcattattgaagaaactataagtgatattgcaacaaatgctattaatacataagagattgcattaataattgtacttactgatgacatcattattccaacataatctgtgtagttaataacattttcttccttgccatcgtcctgttgcagcttattgtaatccttgataatattctgaaccttctccttagaatcaaaatcagttgcatatatatctatctgtgaaggtgtatcaaggtctgtaattccaagcttcgacttattgctgtctaatgttgcatctgttgttctagcctttagtgacgctgagaaaagctgtagtatctgatcatcgctcattccacttgtcattgcctgcatctgagcgctttcctctggtgaaagtgttgccatatatgcatttacatcatccattgtaatctctgtattcctgtcattgtcaaatggaactcctgtaaatacatcaacgcttgtatcagcaagctgtgccttggcaatctcactattctttacttcttcgataatgtattcagtaagctttgctgtataaccgattccacttgaaattgaagtgctgactgcgtcatcattaggtctgattattccacatactttaatgtctgttccattatttacaacatttgtcatatacttatcatctttgctgtaatcgtcccatgtaccggtcacatcattgtacttatacatgtccgtaggcataacaagcttaaactctgtatcaagtatctcgtcaaatgtatagcttatatctttttttgtttcgtatgattcaccaaccatcattttcttaaagagtgttcttacttcctcagggtctttaagtcctaatgagtaaagtgtataatcatcaacctcgttattcttatcgacaacaagcacaacctcgttgtaattctctggccagtgtcctgcaagtacatcatactgctcatcaagtacctgctggtttcctaaaagctggttccacacactgctgttagaaaacattcccatacccatgcctgatgacattgcagaagatgtgcttgttgcaccctcgccatatatcgaatcaaacattgtacttgggtttaactgctctacaccgttagaagtatccttcatataaatgttaagaggaacatcatatgaatactggatatcacttacatatgacttaatgtcagagccgccgttttcaatgtatctcttaaactctgaaaggttattgctcttaacttcctttaccatggtattaatcatgtcacccatgatatcgttagaatatattttagacttatcctcatgctcttctgaatccgaattgcctgtcatgcttgtaaccatgctgcttatatcaatcgactctgcctgaagcgttataggatagcttgaaagcgtatctctctgaaccctgtcaatatataactgaataccatttgagatagacagaatcattgcaataccgataattcctatgcttcctgcaaatgcagtaagaatcgttcttgttttcttagtcatcaggttattaaaggaaagtgaaagtgctgtaaagaatgacatagatgttttctgcttcttccctgactttttaatcttcttttctgatgtcttaaccttagcagcctctttagccctgatatcagcttccatatcttctaacgtatatggatcagagtcatctgttatcacaccatccaataatttgactattcttgtagaataatttttggcaagctccggattatgagttaccataattataagtctgtcctttgatatctcctttaaaagctccataatctggatacttgtctctgtatcaagtgctcctgtgggctcgtcggcaagcaggatatcaggattatttacaagagctcttgcaatagcaaccctctgcatctgtccacctgacatctgattaggcttcttgtgaatctgctctccaagtccaactttctcaagtgcctctatcgctcttttctttctctctgccttagatacacctgaaagcgtaagtgcaagctctacattagataaaacagtctggtgcggaatcagattgtaactctgaaacacaaaaccaatagaattatttctgtaaaaatcccagtctctgtccttataattcttagttgacactccatttatcttaaggtcgccgctcgtatacttatcaagtccgcctataatattaagcatagtagtcttaccacatccggactgtccaagaatcgacacgaactcgcagtccctgaacctaagattaatgcccttaagtgcactcacagtagtcgaaccggacacataatccttttttatatcatttaattcaagcatttaagtctccttttgttttattgtggattgcggattgggaattggtctgcatccttcaacttgcgtacatgacgttgtggcatctgactatagcatacgctttcaggaatcctgcgcttagtgtaactaaatgccgctatctacagagtttattacggtgtgtcaaatcaaacgcgcttcgcttgaacgagatttgacgcaccgccctcatgtatatagcgacattaagttacacacagctcggattattcaagcgtatgctatagtcagacaccgcaactgatatacacaacatttaagatgcaggccaattccaaatccgtaaccctcaattaatatacaccatggaaagcttggcttgcaatttattccagtacattttatactaatattgttttttgtttatagaaatataatactttataggagtctatgtgaaacattttatcagattaagattaaagaatttaacggccatttgtctttcgctttgcatggcagctacatctgctgttccattttttgcttatcctgaccagttgatggctgatacacaggatgacctcgatgctgttaataaacagcttgaagaattaaggaataaacagagcgaactcaatgcgtcttacggagagcttaacgagaagctgtctgcttccggagagaagctttcttctattgaggatgcagttaatgctaagcagtcagagattgatgctaccaatatccaggttgctgatatgcaggcagagattgaccagcagtatgccgccatgaagctccgaatccagtttatgtatgagaataataatgctactattctgtcaacgcttctgtcagctgaaagcctttctgaccttttatccaagtcagaatatatccagcagatttctaattatgaccaccagaagatgcaggaattaagtgacctcctggcttctcttaaagaaactcaggcaaagcttgaacaagaaatggctgaacttgtcactcttaaagatgatgcctcccgcgaagctgataattttgctgcgcttctctcacagtgtcagacagagcttgacactacaagtgacagcattactgatgcagaagcacttgcactcgaatacgaaaaacagattgaacaggaaatgttagagcgtcagcgccgtgaaatggaagctcttgaagctgcaagaaaagcacaggaagaggctgacaaagccaataactctggcaattccagtaacacaggcggtaattcatcttccggttctgctatggttgaccagaacgctcttaacaatgttcttaagaatcacactgccgaagatgttgcaatgctcgcagcaattattgaatgtgaagccggcaaccagtcatatgagggcaaatgtgctgtaggaagtgttgttatcaacagagttgctgacccacgctttgccaacagcataagtggcgtaatatatgcaccttaccagttttcacctgttgccagcggacgatttgcaatagtacttgcaagaggtgcaaatgcagcctgcacccaggcagccattgatgtgcttaatggttatatcaatattaacgcactatattttcatgtatatgacagttctgtcgatgtgggcggaaccgttatcggagatcatgtattttactaactcattaaatataccaaggggagaattattaactatgaagaaagcaactaaagcatctgataacagatattatcaggcaagattttctgctgcacagaaaaatactgactttgaaagccgtgaagcagcttcagatgtcgtaggtatagacagaacaagacttgcaagaattgaacttggcaatgtaacaccttatgcggacgaggttgtatctatgtcaaaatgctacaacgctcctgaactctgctacaattactgctcaagcgaatgtccgattggaaggcttacaatgaaggaagtcgagattaattcttttgacagattatcattaaaaatgcttggttctttgaatgatatcgaaaacctgcgagcttctattatcaatatctctgctgatggtcaggttgatattggagagcaggaggaattcaagcagatacttgaatccctcgaccttatttccaataatgcgaaagcccttgaattgtgggctaagaaaaacattaagaatatttaacggctgtatcttacataatctaccgtaacaaagcctttgtttgcactattggcagaattatcatgtgatacatatacaccgctctttacaccaacccatcttccggctttggcaataacggaaacagggttggtgtattcttttccgtctgtgcttatctctatcgttactgtttcaacaggtgcttccttaacaggaagtccaccctcgacataatctttagttcctgtctttttaactgtgtatctgaaatatatttccttaagattatcgtatgaagcaagcaattctttagtctctttagtataagcctggtcacagtcaaactgctgcacaccctttactgcatacacttccatcttaccgcctttaacagtcacatctgctgccagataatccattcccatatgaatgaatccggcattatcaccatcatccattccactgatattcatcttagtaatacagctaaattccgatgccggccacttctgcaggagaagatttctgtaatcgccaattggtctgtttgatgctctgccaaccgcattaagctttatataagaaccgtcatcagacacatttccactttcatcagtgccaaactgcgcccagtcactatcaggattggcgttccactgccactgcaatcccaaagtatcttctgtgaattcgtctgtagtatccggctcacatatctcataaactgcaccgacatcaggtttttcgtactccatcacaggctcgccgtaatcattgccatctttcttaactccaataacaggccagtcattttcccagctcattggctgcagatgtgttattctgccagctgcatacacatcctgaaaatgtataaaccagtcctgtcctgtaactgtgtcaacccatgcaccctgatgaggtccattgacaggcgaatctccctgtctcataaccactttatactcatatggtccaaacacatttttcgaccttaacactgtctgccagcctgtcttaacaccgccagccggtgcaaatatataataccatccgtttcgcttatacatcttaggaccttctattgtaatctggtcatttaagttaccgtcaaatataatcttttcctcaccaataagccccattccatccggctgcatctctaccatatgaagcacactcttgtatccgatacggctcttggcaactcctgcaacaagatatgcctttccatcctcatcccagaatgggcatgggtcaatccagcctgcgcctggtcttatattcactggcttactccactcaccataagggtctgttgctgtagtcatatatattccttcatccggcattgggaagcacacataatatgtaccctcatgatatcttattgcaggtgcccacactccgcatccatgaattggatttctatatctgaattctggaatttcagccaaaatgtagttaacaaccttccagtttacaaggtccttagaatgaagcaacggcatagccggagcattagaaaagcttgatgatatcataaaataatcattaccgacacggattgcgtccggatctgaataatcagcgtaaagtattggattcttgtatcgtccatttcctaaatctgctgtccacatatatgacctctttctgccagtttacggctcaataatttatttctgcttatgcagatatttctctgctatcatattacaacagttaaataagaatttccagtacttttgtaaagttattttataaaagttttttaattgacattttattattaagtattctgtgcttaaaccgatattatatataaccgtgttcattgctgaagatgaaaggcgggtatacttatgataattgcagacagtaacatgagtatgtcttcaagaagacactactcacaaaaggtatcaagcgacatggtcgcagcaggcagctctggtaactcctttagttttggaatgagccaggcaagaagcagcttaagccagaaagaatcatattttagtaattcttctgattctccggacagaaagtatgacgacatgtttctgatgatgccactctacaatcgttctggcagacttaatgtcccggacgattcttctaaaacggatttggctggtgaggaatcaccagaaggcacggaggctttaacacctgcttacaacaaagctagcttagtttctatgcggcagaatgtaagcttcagttacacagaaataacaagaaaggtttatatgtccctgttggattttattcagtctctgtctttccgtggaatgtttcatgatactgacagtttatcctgcaattcagtctctgacacatcttcatctgacaaagcctcaaaaaccctttctattactaaccagatttctcctactgtgtggactgtaagaaccagatattcttcaacctatgaagaaaaggaaagcacttcattttcaacaaccggaactgttaaaacagcagacggcagggaacttaattttaatcttgatatgaccatgtcgcgcagatacatggaagaacacagcattgaatttgtttccagctttgacactgtactgacagacccgcttgttattaatcttagatgcaatcctgtttctatttctgataagtccttcagttttgacattgattgtgatggtaaagacgagactattgcacagatgaatcctgaaagtggctttcttgctcttgataagaacagcgacggaattatcaatgacggcagcgagctgttcggaaccaagaccggtaatggcttttccgagcttgcagaatacgattctgacggcaacggctggattgatgagaatgatgaagtctatgaccagttaaaggtctgggttaaagatgagaatggcaaggacacgctcttatcacttaaggaagccaatgtcggtgcaatctgtcttggcagctccaaaacaacatttcatgtaactgatgatgataacaatcttaaagctaaagtacgaagcagcggcatgtatcttcatgaagacggcagcgccggttctgtacagcaggtggatttttaattctgtattggggatatcttcgatatccccaatatttttgtatcccttgctgatgcctgggtgctatttttctctgttcgctgacacaattccatttttgctgttttgccacaggctctgttttttccgtgcaggctgcgtgtcccccgttggctctgtattttccgtgatggctgcatgtcccccgttggctctgtattttccgtgatggctgcttgcgacctatatattcataatatttgctctcttataggcataatttgcgttttttcaatcccaaagcttcttctcaacctataaaattcattatttctattctttaataggtaaaactgctctctacaatctgaaaatccacaaaatcacataaattttcccaaaaatcttcctataagagactttattatgcgactacctataggtatcacgtattgtctgcgtatgaagcttcctttatttattatcatattttgcccagacttgtttttctcagtatatttacatatttttaatatattaagctattgattgttatatatttgtatagtatatttattaaacaatatttcttgcctataattgcaaaagggggatttttatgggagatatacagaattataatatggaacatgttgacacattagcacctgacacgattaaagagtctgttatgtgcaggcattcacaattatctcttttactagctgatatacaaggaagaatttctaatgctcctgaaggttctctgcgaactgccagaaaagctcatggctgccaatattatcataaggttgaagtaaatgataccaaaggaacatatatcaaaaagcataactataatcttgcaattgaacttgcacaaaaagattatgatttaagaattgaacaatgcctgctgaaagaattaaactttcttgaagtcatacttaagaaatataatccatcagaaattcagcatatttatgattcacttaacagcttccgcaaagaaatggttactccagtttttgtatcagatgaagattttactgcaaactggaaagcctcagaatatacttctttaggattcactcctgactgtgctgaatactatactgataatggtgaacgcgtacggtctaagtctgaaattatcatagctaacaaactctatcgctataatatcccttatcgatacgaatatcctctgcagctacaatctggtatcataacacacccggattttacctgtcttaatgttaaaacaaggcaggaatatatatgggaacattttggtattatggataatgtagaatatgcctgtaatgccatcaaaaaaatcagcgattatgctaattcaggatatgtccttggcaggaacttcatagcaacatttgaaaccgctaatactccaatcaatgctaactgcatagattctttgataaaaagtcatctctgttgatacatgtatgccccgccttacttttattctgtaaggtggggcataccttctatagtttatcagattatatgattcttatatgatacctttttatagtcgcatttttgatttcttataggtccttccttaccagattttccaaaaatatttcttattctcacaaaatatttcttaaaaaagacaaattatcctatcaaatagctttaactcactatctgataggaaattattctgaattttattaagattgtactgtaaatggcctattaatcatgtaaaaaagttttcttataggaaaaccaaatcccaccaaaacaatcccgccatgcatagtccttcctgacagcttcctagaaattcaaatcaatatctattcccttaatatcctcattaagcatcttattatctttcattatcctgactatctgcttctgggcttcagttacatggtcgacatcattgcttcttatattggcattcatctctaacttgtcagtctctgcctgtccctcaataatctcttcctgttcttttctttccttgcgcttttcgtcaatcttttcctgctgttcttcctgtttcttctctgcttcgtcagctttctccttgttcccctcggctttgtcgtcaatattatccttgccctcggctacaagcaggttcttaacctcaccctcaacagcacctattatctggtctgctgagtcctgtgcctttagcatttcctgagacttatccctgtcaatttcagcaagtgcaattgaagctgtcgtgcatgcaatcttaagctccttctgaccaatttcatccttaaaatgtatctgtgatgaattcagcttaagtaccttctcctgatactctgtaagcggagtattctgtaattcttttaagcggtcaagttcttcttttgaaaatgtgtcctcagccgaaccataacggttattctgatatttttcaagcagctcaaggtctttctgttcctgtgaatccttatctacaccatagtccacacggtatgcttccttttcattctccaaatcactaaccttattcttaagttctgtgatttcatcaagcttattaagcttatcgagcttcatatcctcaatattcttatctgtcttatcagcagatttccatgcgtcagatataagcttcattgcctgctttcttgctctgagccttttagcatcaatctggttatcattatatggcttaagattaagctctgatgcattgattgtctttctgttcttggtttgctttgaattatcagtattcttatctgtattatctattccctgtgcagccgcctgattattcattgtacttcttatcgtaagtgacatatgccctccttgtcataaccctgtcccaaactccttttcgggaatcacattagtttaaatatatatcggtatatctgacattcattattatagtcagttcttgttcataacctataaatatgatatagtgatactatcaattatttatgaggagagcgattacaatgaactttgcaagaaagacggataaggtattcacaattatttacactattatcagtattctgtcaattattatattaatcatgactcatatttatcctgataaattctttaataatttgtatggatcattttctgcaattaataacaagacatttagtattaacaatttattccatttaattggacatatttatataggaagcacatccatagttctattatatattcttgctgttcttgctgtcataattggattacccgttactgtgattactatttttgcttatataggaatcatattatataaagcaaccaacaacccaaagcatatacgccgcaatctgattgtcaagattatatatacaggaatatggactgttattgcactcataatgacaatcaaggacattggctttgttgttatatttgcaatacctgccataatactttcaattctgattgcagctgtttatggcatgagagagcatgaatatttcccagaatattaattcacatacagcacttattaagaaaaggcaggacatgaaaaaaccgacctcccaatcgttagatttttagtctaactttttttgggggtcggttccatgtcctgccatattatatttaatcttacagatgaagcactctctccttaatctcctgagttcttccctgattccagaactgtgttccgatatatccgcaagttcttcttgcgacattcatcttatcctgattacggtttccgcagttagggcactcccatataagctttccgtcatcatcagttataatctgaatctgtcctgtgtaaccacattcctgacagtaatcactcttagtattaagctctgcatacataatattatcataaatgtactgcataaccttaagtactgccgggatgttattctgcatatcaggaacttcaacataactgatagctcctcctggagataacttctggaactgtgattcgaattttaacttttcaaatgcatttatctgctcagttacatgaacatgatagctgttagttatatagttcttatctgttacgccagcaatcttaccaaatctcttctgtaaacattttgaaaacttataagttgttgactcaagcggtgttccataaagtgagaaatcaatattagtctctgctgcccatcttttacatgtatcattaagatactgcattactttgagggcaaattctgttccctccggattagtatgagttacacccttcatgtaataagtacattcgcaaagacctgcataaccgagcgaaattgttgaatatccgccataaagaagcttgtcaattgtctcgcccttcttaagtcttgcaagtgctccattctgccagagaattggcgcaacatctgaaggagttcccttaagtctgtaatgtctgcacataagagctctcttacacaggtcaagtctctcattaagaatactccagaacttatccatatccttgcctgatgaacatgcaacatcaacaagattaagagttacaacaccctgattgaatcttccataatactttggttttcctgtttctggatcaatatatggtgtaaggaagcttctgcatcccatacatgggaaacactgaccattgccattcgcatcaacctttaattccttcattttcttttcagatatataatccggaaccattctcttagctgtacactgtgcagctatttctgtaagataccagtacttggaatcttcgtggatattatcttcctcaagaacatatataagcttaggaaatgctggtgtaatatatacaccctgttcattcttaacgccctgcattctctgtcttaatacttcctcagtaacaagtgcaaggtcatctcttgtctgaccttccggaacctcatcaatatacatgaaaacagtaacaaaaggtgcctgtccattagttgtcataagagtgataacctgatactgaatcatctgtacaccacgcttaatctcatcctttactcgaagctctgcaacctctttaatcttctcttctgaagcatctattccggttttttcgaactcatctcttacctgtccgataaacttctcacggcttacctggacaaatggtgcaagatgtgctaaagatatactctgtccgccatactgtgaacttgcaatctgtgcaattgcctgagttgcaatattacatgcagtagaaaagctgtgtggcttctcaatcatagtctcgcttattacagttccattctgtaacatatcctcaagattgacaagacagcagttatgcatatgctgtgcaaaataatctgcatcatggaaatgtataagtccctgctcatgcgcatctacaatatctggaggaagaaggaatctctttgtaatatccttgcttacctcgccagccatataatctctctgaacactgtttacagtaggattcttgttagaattctcctgctttacttcctcattattgcactccagaaggcttaatatctgcttatctgtagaattagatttacgcacaagtgctctcttataacgataagtaatatactttcttgcaactgaaaatgctctgaaattcataatctgattctctacaagatcctgaatctcttcaacgcttaaagacctgttcatctctttacaaatgctctcaacattattagagattgtctcaatctgttcctctgataatctctcactatggacaacttccatattagcttttgatacagcatccataattttactgatatcaaatgttacctctgaaccacttcttttaataattttcatacttcaaaccctcacaaaaagaccatcatatccctgtatatactgctttcagcaatacaggctattttcctttacattaaaaaaatctgctggaaacgcagtgtttatgctgtttcccaagcagatttgattatacaacatatagtttgacaagtcaattgaaaacacaatatcttgtaataaaaaactatatatattaattatcatcacattcagtttcagccagaatattgataagagaagccgttacaacagccatctcaatctcatattcagcccactgtgcagactccttacaacggtcaatagtaaacaatcctttcacattatctggtgatcctattatgcattgtacagtagaaaacactctcttttctctcatggctgttccaaattcaggtgcaaggtctgtctgccttccgacgaatcccacagcagcatgattctttccatccagaagcttcttaaaaccttctgtcttaacataatcagcattcattgaaccgccaagctcaacacccatatagtatgcacggttcagattagctccccagtaaagattaatgctgtccagtttaaatgtatcatacatatgatgtataagctctttaatagctgctttgccatcttctgaaaaattctccataatgcctgtaagaaatctgagttccttcatttccctgccatcattgacattcttatcctttgtattaagagaattctcatatgaatccttatggagatcatccctaaagaatacatatctgtctcttcccttttctttcgctacatacagacaataatctgctttcttgaaaagctcctcatactcatgtccgttgttaggactgtatgctgctccaatcgaacatgttatcattaaatcttcaaaatcatcaacaaattcccacttaatctgggttcttatcgcacgaagcatcccccttaactcatgctcatcattaataccattgaatataataacaaattcatctcctccgatacgtcctacaactccatcttcgcctacaacttccttaagctttcttccaacccttgcaagcaccttatcaccatacatgtgaccatatacatcattaaccttcttaaaatggtcaacatcaagaacggctatcgtaactctgttattctgctcttccttgagacattttacagcatatgcggtaatagttttcttgttatacacatgtgtaagagaatcaaactgtaattcttctatcatatcagtaatctgattataattgccatggctgtctgcctcagggacaacacgacctatcacaatcctgcttccatcgcttttattcattacagttcctttaaatcttaaagtctccttcacccttttatatgtacgcatgcttgttctgaattttatagaaaatgtctgcgtataagagcgtacttctgatataaaattagcaaagatttccttatcattctcgtcaatatatccctccgaaagcatcctcttcttccattcatcaatatcagacttatatatgacatctcttgagtcaacatcatacctgtacatactgaatatgccattatctctgttatatgtaaatgtatattctctatccagtccaagcagcatcttatgtttagaaacatcatctcttaaactcttattagcctcctctatagactcaacatcaacaagttcaatatctctcatatgcccattgcccacagctcttcgttcatacacaaataaatgattatatctttctatgccctgtgcgttaataaatttaaacattccgctcttagctgttccatcatacttctctataaaatccatcagtctttctttatcctgaggtgcaactacttctataagagtctccttaatttctccaaaatattcttcaaatgctttattcgcaacacttataacacaatacttatcaacagatgctattcttctactcatcttatgaacaatctcaaatttctcactggcagcaatataattatcgctcatattaatgtacctcttatattttttattattagttatacgtacttaatctttctacatgttataaaaattatattatatacatgtcgattttacaagtataatagtgcgtttaatttgaattttttggtactttagtaccaataccaaatatagtatttccttttattaaaaagcatgctataatacaacatattgttggtttttacttagtaacactattattaaatgtgaggaggtcttttaatggaacgcgtaaagtacaacagagttgaggtaagtcacggcaatacatccaagaaatttcctgtgtacgaaatctatcttgatggggttataattactaaggtatcatctgagaatgaggctttagaaatggtatcacgctggcagaaaaattacagataatatatactcataagtaagtaaaagcagtgcctgcaatcaatgcagacactgcttttatagcattttcttcttccttaatacccataaaactattatacatatcagaagtattattccacttattatctcaaatccaaaaggtgtctttgcaaacggcatccattctccacctacattcattccatatatgcctgatattattgtcggaatagccatcacaattgtaattgaagtaaggtatttcattacattattcagcttactgtcaattactgatgacatcagttcccttgtaccatcaatgacatccctgtatatcgtggtcatctctatagcctgctggtactcgaccatgacatcctcaagaagctccatatcttcaggatactgctcaagtcttttatatcttctgagtctttctaacacaatactgttagctcgaagagatgttgcaaaataaacaagtgtagattctaactcatgaagctcgataaggtctgtatctgatgtgtcgccatcaactctctcctctatctcaattcttttcttgtcaataaggcgaagattagcctgatacacaaaagctgaacggaaaagcatctggtatataaaacgcatctttttcttcgtactgaactctttcaccttatttcttacaaaataattaataatcggtgtatctaccttacacactgtaattattgcttcacttttaagaataataccaagaggaatagttgtatacatttttttctcatgtcttacctcaggtgtaggaatatccacaagtataacagtatatccgtcttcaaggcttatacgcgaactttcttcttcatcaagtgccgatgagatatcctcaggttctatttcaaagcgttctgctatctgctcaagctccttgcttgtcggatctaccatattaatccagcatccatcctgaatatctgtcaatgtatttaatacctgctggtctgttctatatatctctaccataagtccggcctttcataattattatttcatcatagtcgtccctgatgcgtctcataataaaatctcttaacggttcatcaaaacacctgtatatattgtttacagcctcacaatcaagtggattacgcgtaagaaaatattgcacattaaatccatacatatcatatactatctgtaaagtctttacatctggtcttgacaaaccattctctaatgtacaatagcttctctctgatattccaagcacatttgccatgtcctttttattcatatcatgtatccgtcttatctctgtaagtgtatatcctgtccgcacattatctggaacatccagttccattccattaacaatctcaagtatcattctatggtaatatgccactaccctttctttcttatacccgaattgaagcatgctgtcaaacaaacatagcagatttcttataaaaacttttttcctgaaatcagggcatagtgtgtgcaactctgaaaatggattattattatctattccatgcaggatataatcgctgttccagccttcaagttttgccaccttctctataatcctgtatgtaaccggttgtgtccctgtctccaaacgggcaagatagtcagtactgacatgcagcatttctgacatttcccctctggataagcctttcataatgcggcattcttttaacctgtcccccatattacgcattaaagcctcacttcttgtcagttttacagcttcttaatccacatgagccgcaattaccatcacagcccttcccaagaccgcttttttcgtgcttatatgaaactgcaatatatatggcaacaaccacaactaacaatattcctgctgatataacctgtcccattctttatctccttattaattgctcttataagcttttccaatctcacctgtaagtgaagcaaatatcttaagtatcattgcacgttctgatttgtcaagttccctgaaagacttaagaacggcattaatattcttaaacctggctgtacttatctctgaaaggttctttgcaccacttgcagttaccagtgagaataatgtatctacgaattctgccctctgttctcttgtaagcccgtctatccatgcgctcagtgctgcatttaaccttttactcttaggacttaactcctgctcagtctcaaaatctggtcctataacctgccatgacatagaatcatgctgcataagacctgactggctgctctttacaacctcataatccccatcatgattaagaagcattccaacaactgaacaataaggaacaatactcttaatcttaggcagaattgccagataatccggatgctttacaaaatcactgtcaaatcccggaccatcattattataaacagtaataattcttttcttcactgatggtcttgcaaatactgatgcatatactgccagattaccacctttggaatgtccgccaagaatcagctttccttctgaacgctgcacggttgtgtcaatatatcttaccgcatccttctgcgatggaacaggggataagaaactcatgttaaaatcctctttccagcccacaagtgtatcatcagttcccctgaaagcaatatacgtaagtctgttatcgattcttacatgaaatgctgcaaactgttcttctttgccgccatcgacataatcaacataattagtaagtataagtgaaccaaatcttttggttgctgctgcctcccttaaaagatacggagcttttcctatgaaagatttgcatttcttaatctccttctcatcatgggtatcaaaaaatgtgtctgccgcttccgcaattgtaatagtctcgatacttcccggtgccggtacaatatcagtaaaatcaacatatgcaatctgcgcaagtattaaattgtccacgtcattaaatggtgcctggctaaaatcaaggtcacctctccatttcaaataatcagatacattactcatacttaaccccttcttattctacgcattttcctttcagaaaccttcttggttacaagatccttccatattgaaggtgtgaacagaattatcagtggaaataactccagtcgtccggcaagcatatcaaacatcagtacatatttgctgaaatcagaataacttccaaaattctgtgtcggtccgacagccgaaagccccggacctatattattaatagtcgctgctactgcagtgaaattcgtcacaatatcctttccttcaatagatatcagcagtaaggacgctgtgaatatcatgataaatgttatgaaatatatactcaccgacctgcatgtttcactatcaacaggctttccttctgtcttaatcaccttaacactcttaggatgaatatatgactgaatctctctgaatattgtctttatccctattataaacctggaaaccttaattccgccacctgtacttccggcacatgctcccacaaacatcagtacaacaagcaccgactttgacagtgacggccacatatcgaaatctactgatgaaaatccggttgtcgttataatagatgcaacctgaaacattgactgtctcagtgtaagttcaacagcacctacacttctgtatatattaacaaatataattgctgttgctgcaaggataattccgaaataacatcttacctcttctactttaacagccttcttaaactgtcttagaacaataagataatacgcgttgaaattaacgccaaacaatatcataaatatggttacaacccactggatataaggtgaaaagcttgtaaagctgtcatttctgataccaaatccacctgttcctgctgttcccatggctgtattaagtgcatcaaggaatgtcattcctccaaaaagaagaagaattgtctgaagtacagtcatcccaaaatatataatatacagtattcttgctgtatatctgatcttaggaacaagtttacccactgatggtcccggactctctgctttcataagattgatattagagccacctgtaagaggtattactgcaagcagaaataccagaactcccataccaccaatccagtgagtaaagcatctccagaacataatgctctgtgacagtccttcaacttcacttaatatacttgctcctgttgttgtaaatcctgatattgtctcaaaaagtgcatctgtaaatgaaggaatttccctgcttataaaaaaaggcaggcagccaaatatactcataagaatccagctgagtgcagttgtaacacacccctccttcagataaaaaactgtattggcaggttttttaattgtcataagaatcccacatacagcacataatgccattgttatcaggaatgcagatattgccttctccctgtatataacgccaacaatcacaggaatgaccataagagccgcttctatctttaaaacatgtccaagaatatatcttactatagaactgttcatatcaatgttcccagcctttcctatctaagaatatcagttatagcatcaaaccctgtatgagttgttacaataaccacagtatctccaaccataaggctgtcagtaccacttggaataataatcttaccattacggttaataagtgctataagcagattatccttcagcttaagttccataaactgcttgcccgtaactcctgattccttatcaacgttaaactctatagcttccgccttctggtcaaacaaatgatacaaggtctgtatgttattgcttcccatagactccttcttagctcttacataagcaatgatagcttctgatgttatatatcttggataaatcacactgccaagatcaaggctgttaataacactgctgaatcccattcttgttattttcgtaatacatttggcttcagatacttttcttgcatatagagtaagcattacattctcttcatcaatccctgtaagagggacaaagctctccacatactcaatcccctcttctcttaaaaggctctcgtcagtaccatcaccattaataataacagctcccgaaagctcttcgcttaactttaacgcgcgttccttgtcattctcaataatctttacatcaattcccatgttaagaagctgttttgcaagataatatgcaactcttccacctccgacaatcatggtactcttgacctgatgtgtctgaaaacctacacttgcaagaaatgtccttgcattctttcttgatgcaatgaaagataacttatcatctgcccttataataaaatgtcctgatggaatgaacacctctccatccctctcaactgcgcatataagaactttagatgatgaagccttggatatctccgccagagtatgaccacacatctggttaccctcagggacttttatcttaatcatctctgcctgtccatgtgcgaatgttccaatctcaagtgctgtcggcatgtaaagcacacgtgctatctcacttgcagcctcaaattccggattaataatcattgccagacctaatctgtctcttaaaaatgcagcctcctgactgtattcaggtgttcttactcttgctattgcctcacatctgccagccctctttgcaagtgtacagcataaaagattcagttcatcagaatcagttaccgatataagaaggtcagctgagtcaataccggcttctttctgaacagcaaagcttgcaccattgccctcaactcccataacatcatatgcacctgttattgcatcaagcttaaccctgttcttatcaataagagtaacatcatggttctccctgctgagtctctccacaagagtggcaccaaccttaccgcctcctacaactataatattaagtccgttctttctggacttgtcattcccaaacattccaatcctccttgttatttcgcgttgttttgcgaagcaaactatctacccatttcttttaattcttcaagcagttccaaatcagactgctgtacctttatattagatgttataggcacctctccaggattagtaactgtaatctcaattatagttccttccttaagacctcctgcaaaacatctgttaagaaatgccacgaacttcggatgattcttctgaaacttgttcttggcactcataagcttcataattgatgctggattcataataatctccattctttctaattctgctactcagcatgcaaagtataccatattatcaaaaaaatagaaatccctgacgtcctttcccatatattaatttttcagaaattcaaatttaaaaaagttttccgaatttttttcgaaaaaagtgttgacaaaatgtcattttgccattattatcttaaatgtgtttgcgcgagtggctcagtggtggagcacctccttgccaaggagggggtcgcgggttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgcgagtggctcagtggtggagcacctccttgccaaggagggggtcgcgggttcgatccccgtctcgcgctctattattttaaagaggaagccagtagatactgacttcctctttttttgtgctcaatttgtttcaagacattatgcgtgccgcaaagcacacataaataacctactatctcatcaattttcataatccagtaggtcttttcttattgttagctggtatgtaatgcttcttcccaacttaaatacctactattttgtcataattcacacttttagtatgtcttttttctcatatctgtaatatcaaacagatttggtttgaaaaaaaacctactattctcgcataaatcatcaatttagtaggcaattttctttattctcgttaattctcctcagaatttcctcttgataaacctaccatttcatcatatttagcagtcttagtaggtttccccctcatctatagcattatagattcaacttttttaattttacacttgacagattaaagttttatgtgtattatcttgtttgtgttcacaagagaatttaattaaagaacattaattatgcgcgagtggctcagtggtggagcacctccttgccaaggagggggtcgcgggttcgatccccgtctcgcgctctttttaattttaaaaggaagccagcatttaagcggcttccttttttgtttgtgttcaatttgtttgaagacaacttaaatatacacgattcttcgtcttgcgctcttctatcaactgtcatttcacataaacagccactttatctgatacttttcctgaattgtcgccaccaccgacttctttgaaccccacatcaacaatctctgttgttccgtctccatatgtcacagttacacttaatgtaagcccttcatacatatttttaaccatctcattgtatacctgatggtcttgatacaaagattctttttctaactgctttgaaaactttacaacctgtatgccctcgctctgactgttaccactctcctcatactcttctccgatatcttcaacaatgtaataagcatagccattctccgtctgttttctgaatttatcagaagatgtctgatactcaggactgtccttgtcaacctctttcattctcgccagattatatatcacattcgaatcatcgcccattatagaatacttaatctttgagatatcttcgcctgttacatttataccagccataacctgccccatcacagatgaatctccaacctggcttgaaattccagccacaactcctgatacaccagcatttttctcatcattagaaaaaatacattccgatgtgtcatcaagcccggctgcatacacattcatcacatgagcaattttaaatccagtctgctctgatgccagctgattactgctctggtttccgcttcctgtcacagaagtcttcagtcctctgactcccaatacagcagtaacagccgctgctgccacaagacctgctgcaattatcttctttacattattgctctttttatacctgatatccacactggcagttttcttgtaatttcctgcttcttcaatcattttcggactaattccattaagtccttcatataaatccattgcctctgattttttcatagatataaaccctcgctttccatatattttcttaattctttcctcattctgtgaagagtaactttcactgctgattcgctcatctgcatcctttctgaaatatctttaattgaatccgagtaccagtaccgcctgagaaatataattcttttatttttatcaactgtttcaagaaaatgcgataacatctctccaatatcttccttgtccagatgtgtctgcaatccgccatcacctatgcattcttccagttcttttgtcaattcaactactttggcctgtctctttcccgcattgttttttcttatcatatcaatcgcaatatttcttacagatgctgccagaaatgcgaataaatactctggtcttgcaggcggtatgctgttccatgccttcatatacgtatcattaatgcattccagcccatcttctcttgattgcaatatattggctgccagtgcttttaacttagaaccatatttttcatcaaccaccttaattgcatcttcatccctttgaaaaaataaattgattatctgtttatcatccattactgtctgtactccctgttttttaaaagcgttaaccctttcataattaaagacggattattccggcaacggttacatttatcccataaaaaaattctggaagacgcattatctcccagaatcatatttatattcacaacacattaagcattaccactgttttagtaattccccaaacacatccagtgcttcctgcacaacatccggtcttgtcatatctattccgcacagcttaagaagctcaatagggtgcattgaagagccgcctgacaagaactttctgtaacctgctataacctgctcatcgcctgcaagtatcttagttgatattgcaattgcagcggaatagcctgttgcatactggtatacatagaatggtgtgtaaaaatgcggtattcttgcccactcaagtgctatctcatcatcaataaccatatccgggccgaaatacttctcattcagtttcttgtacatagcacaaaggctctctgctgataaaacctcaccatgttcagcctttgcatgcgcttccatctcaaactctgcaaacatagtctgtctgtaaagagttcccttaaactgctcaaagaaatgattgagcagatatcttttcttcttctcatcatcagtattctttaacatatactgcataagaatcgcttcattacaggttgacgcaacctccgcaacaaagatcttatatcctgcataaatataaggctggtttgcattagaataataagtgtgcattgcatgtcccatctcatgaatcaccgtaaatacatcattgagtgtatctgagtaattaagaaatacatatgggtgtgtgccataagcgccccatgaaaatgctcctgaacgctttccggtattctcatacacatctacccagccattattgaagccttctttaatgtgtgaaacatactcctcacccattggtgcaagtgccttcacaacaatgtccttagcctcatcatagcttatcttccagtcaatatcctctaccatcggtgcatatatatcgtaaaaatgcagctcgtcaacaccaagtgccttctttcttatatcaacatagcagtacattttgtcaagattgtcattgacagtcttaataagattcttatatacattttccggaataaatgaaccatcaagatacatgttcagtgttgacttgtaaccccttgcgtctgcatagaacattgcctgcttgacattgccataaaacgctgccgcaatcgtgttgatatacgccccatactgcttatacaacgcctcaaatgccgcctttcttactgttctgtcatgactttccataaatgtggcaaaattgccgttagtcagctcatcttcctgtccgttctctcttttcacattgccaaacttaacatcagcattgttaaacttagagaatacctcattaggcacagttgatatctgtgatgcctttgcaagcagtgcttcctccttttcagaaagcgtatgctctttccctgcgaggcagtcatcaataaaacgcttatacattcccagcctttcatcctcgctgatatatttatcaagcacatcggtatctattgatataagctcaggctctaaaaatgcatacttctctgacaccttcatcgcagccatctgggctttcccagatatttcctgatactttgaattgcctgtatcctcataatatttcataaatgcatacacatacactctttcagtaatgtattctacctgttcatactccttaagcgccttgtaaagcatgccggcagactcgcccatcctgcccttaagctcacttggctggtcagtcagttcaagtatactgttataatccttctcccatgcttcatcagagctgtataaatcactcacagcccatttaaacttatcatcaatctcacttcttgctggcataacaatcctccattcatattaaattacgggaatatccgtatctataacaaaagcctgcaacaactcatgcgctgtcacaggcttatcattcgtattaatcaagttctggcagataaacagatgtcgctatcgcaagtgcaccatgtcctatgtggcaggcaactgaaagtgaaagcggatccatgtggaaatcaaactgtggaaaagtctctttaactaacgcagcccattcctccgcctcctcaggattacctgaataggcaacctccatatgcatctttccatcctttgcaaactctgcaaatcttgtatctaaatcatcctgcattgccttaagcataatcttcttcgcagaagccttacctcttgccttggcaaatgcatctaacttctcaccctgaatctgaagcacaggattaagctttaacatagttccaatagcagctgccgcaggagttattcttccgcccttctttaagtacttaagagtatcaagtgtaatatatatgcttgattccatcttatgtttctcaagaatctccttaatctctgccgcagacttacctctcttagcaagctccttcgcatcaagaacagactgtctcatggttacagaaattctctggttattgacaacctgaacctttccatcataatcatcagcaaccatagtagctgtctgacatgttccgctgagcccgcttgacataggaatatatacaagttcatcatattcttttagaagctcatcaaatgcgtcctgcatctcaccaatagaaggctgtgaagtagatatatcagcatcctgctttaacttctcgtaaaactcttcctgtgtaagattaatatcttcaaaatactgttctccatctataaagaacggcattggtataactttaactccaagctccttagactgagcctgtgtaattccactgttactgtctgtaagtatggcaactttacccatgtaaatcctcccaataacctattgctgataaatcaattattttgttatactgatgtatatacctttatatagtaaggcattttgacacttttgtaaacaaatgtttcttatttcaaagtaatatttttataaacttttattggagaaccactatgaaatatattgagattgactatctggacagcattttaatgaatgctcttgaagaacttattaacaaatgtgacggctacgagccttattactgtgattcccataacgacagctttatccagtgtgcgcttgttgatgaagatgcagattcacctgtaatgtatggctttattggactgcttatcaataatgaatgcgggtatgttgaagtttcaggtcttatagctcctgattttcgccatagaggacattttcgcaatatgttatcaatctgttacagaaagcttaaaagcagctctgctggcaatttagagcttattgtacctataagcggagaactgcttaacagctctttatgtggtgatatatgtttctacgaatatctgtaccagcttgataaagcacattttaacttagaatcaatacaggctgctgagcctgacaatgccgaatattatcttgagggtgaggattatcttatgtatctgccggaatatgaagaacctgtggcgcttctttatcttgatacgcagaacacatttgtcaatgtatacggcgtattcgttgatgaaaagcttcgcgggaaaggcataggcacatgccttatgaagcattttcttaaagactacttcaacattgcctcacttccactcgtacttaatgtaacgagcaataacaaggcagctgtagcattatataaaaaatgcggcttcgccgaagcaagccgcattgaatatcattatattaactgttctgacaactagttcttagctgcaataacatctctcatatcgtacattccagccggctttcctgcaaggaacttggcagcctcaactgcaccctttgcaaatacagccttagaatgtgcggtatgcttgaattctataacctcgtcttctccagcaaagattacttcatgctctccaacaatagttccgcctcttacggcactgattccgatttccttaggatcacgcttctgtcttaactggcttctgtcatatctgtagaaataatcatcatcaagcacttccttcattgaatctgcaagtgcaagagctgttccacttggcgcatcaagcttctggttgtggtgcttttcaactatctcaatatcaaagcctgctgacgcaaacactttggcagcatcctgtaaaagcttgaataatgtattgattccaagtgacatattagctgaacgtaatattgcaacactctttgatgcttcattgattgatgcaatctgctcatcgcttaatcctgttgtacatattacagcaggaatcttagttttcttaatatagtcaacaagtgtatcctctgccttagctgatgcgaaatcaataataacatctgcttcaacattacattcttctaatgaagcaaataccggatataagttatgtccgtcatcgcgaaggtcaattcctgctactatctgtgcattagcatcgttagcaactattcctgtaatgacctgtcccatatggccgttacagccatgcataattattcttgtcatgttcattctcctgtcaattaaagtattccgtagttaaccattgctttctttaatctctcaaggttagcctcttccatctcgcataatgggcttctgagtggtcccatatcccatcccataaggttaagtgcatgcttaacaggaattggattaacctcacagaataatgcatctacaagctctaatgccttaaactgtaactgtgcagccttagcaacatctccagctgcaaatgtagcgcagatatcatgtgtctgcttaggagcaacattagataaaactgaaattacaccctttgctccaattgacataagaggaacaataagtccgtcttcacctgagtacatatcaagtcttccctcagctaatgccattgtcttgctctcctgtgcaaggttacctgttgcagctttgatagcaacgatattgtcaacatccttagcaagcttggctgctgtctctggctggatattgcagcctgttcttccaggaacattatacataatgataggaaggtctactgacttcgcaactgctgtatagtgctggataaggcccttctgtgttgctttattataatatggtgtaactacaagacatccatcaactcctgccttctgtgcttcctgtgaaagccatacagctgtttctgtgcagttagaacctgttcctgcaataacaggaactcttttctttacataatcagcagcaaatctgattgtttctacatgctcctcatgtgtaagtgttgatgcctctcctgttgttccacagataataattgcatctgttgagttattaatctggtaatcaaggaattctccaagcttatcataattaacttctccattagctttcattggtgtaataatcgctacaccggctccggtaaatactgacataccatccttctttccgctgttaacagctattattatgtacatgattcctgtctattctcatcgctacctatgtgggtagctcaataacatagaagagccaatctgctcaaacagactggctcttaaagaaatcatagtaatagtcctttaagtagctctccatctattcgatgacagtcgtaaaactattaatcctacgcccagtaagactgctccggaaacaatcctcttcggcactttccccttttactatccttcatatgtcttccgggacatcaggataattactcttgaatcgtgcgacctctacctgctgcaggggaaacccttacagttaatgtgactatatcactctgataatgttatgtcaatatatatccttaaactaaagaacataaatgttgtcttaattattcctcatcttcaacaaggtcaatcttgcttactgatacctcataagcaactcttctctcaacctcttcttctcctattttcttagtgtactctctgctctgtacacgtccgctaacctgaagatgtgcacctacttcaagacctcctgcaaatcttgcatttcttccccatgctatacatggtatgtaatccgacttgccatatggtctgtttacagccactaagatatctgcaatttctcttcctaatggagtttttctataaataggaggcttgcatacatatccgtcaaggaatatctggttggacttagactgctcttcaggcatctcgtcatcttctaagaatcttaattctcttacaaatattgagagaacaagcttattcttagttccttcatgtctgttatatgaacggaactgtcctgcaacctcaatcttcattcctctataatccttagtaacatcaataagcctctcagatatcataagtggtatgacatctaccatatcacttaatctgttcactgatacattagcaatatagaagccctctccaaagacctcatggctgaaagtgaactctgagacaatctctccaatgatacacactctgttgttttcaattactttatcaagcattctgtatttctcccttctttgccaccttattattaatgtgttgtggcatgtgctttgttttctctaatatgtatatgttgtcgttttcgcaaatattacaaaaactttttgaataatctgtgttcaaaaaatgaaaaaatttttatatatttagtattgttttttaagaatattgtgatagaatataaaagttgctaatcatagaagatattttaagtttaattcaggaaggacattattaatgaaaacaaagcgtgaagatattcgtaatattgcaattattgcccacgttgatcatggtaagacaacccttgttgatgagctgttaaagcagagcggaactttcagagccaatcaggaagtcgctgaacgagttatggattccaatgatatcgaaagagaaagaggaatcactattctttctaagaatacagctatcacatataaggatactaagattaacattattgatactcctggccatgctgatttcggtggcgaggttgagcgagtacttaagatggttaacggcgttattcttgttgttgacgcattcgaaggtgttatgcctcagacaaagtttgttttacagaaagctcttgacatgaatctttctgttatagtatgtattaacaagatagaccgtccagaagcaagacctgaggaagttattgacgagatcttagagcttttcattgaccttgatgctaatgaagatcagcttgactgtccattcatctttgcttcagctaagtcaggctatgctatggctgaccttaatgatgaaaagaaagacatgcagccactctttgactgtatcgtcaataacattcctgcaccagagggtgaccctgatgcagatacacagatgcttatctctactattgactacaacgaattcgttggtagaattggcgtaggtaagattgataatggaagccttaaggttaatcaggaggttatgattgttaaccaccatgatccaagcgttaagaagcgtgtaagaattactaagctttatacatttaacggacttaataaggtagaagttaacgaagcaggaatcggtgaaattgttgctgtatcaggtattgctgatattcatataggtgatacaatctgttcacttaacaaccctgttgccattcctttccagaagatttcagaacctactctttctatggacttcatggttaatgacagtcctcttgcaggtaaagaaggtaaattcgttacttcaagacatttaagagacagacttttcaaggaacttaatacagatgttagtttaagagttgaggaaacacctggcgttgagaactcatttaaggtttcaggacgtggtgagcttcatctttcagttcttattgagaatatgagaagagaaggttatgaatttgcagtaagtaaagccgaggtactctaccacacagatgagagaggtaagaagcttgagcctatggaacttgcttatatcgatgttccagatgactgcacaggatctgttatccagaagttaagccagagaaagggcgaactccttggtatgtcaccaattaacggtggatacacaagacttcagttctctattccttcaagaggtcttatcggatacagaggtgaattccttactgatactaagggtaacggtattatcaattcttcttttgaaggatatgaagaatacaaaggagacatttcttacagaaagaatggttctcttattgcttacgaaagcggtgatgctatcacttatggtcttttcaatgcgcaggaaagaggtactctcttcatcggacctggtgagaaggtatatgccggaatgatcgttggcgaaaatcctcgtactgaggatattgaggttaatgtatgcaagacaaagcatcttaccaacactcgttcttcaagtgctgatgaggctctccgtcttgttccacctaaaattcttagcttggagcaggcactggattatattgacacagacgaattacttgaagtaacaccaaagagtcttagaatccgtaagaagattcttgatcacacagctcgttacagagcaaacaaaaagtaattatttttaggaggtttgaattatggatagcgatttaggagctaaagttaagaagttaagaattgcacacggtcttacacaggaagacgttgctaaggcattagaggttacacctggttacataagtaacgttgagaatggccgtaaccttatgacattaagaatgctttcatattatgcagagcttacaggagtttctcttgattatcttgcaggaagcgttgacaagtcataccagaatacagctcttgacaatgaaatcatgcagattgtacagaagttagatgttgattctaaggaaaagcttatctctacactcagaatctggtttgctgagaataagtaattaaaaccgacaggcatataaataaggagacgggttatattcccgcctccttttattttttagctctgtattgatttcatctgatagaattcgcctttaagttccataagctcatcatatgttccatattcaacgcagtgaccatctgctattaccgctattctgtctgcaccctttatagtcgataatctgtgtgcaactataaatgttgtcctgtctttagtaagattattaagtgcctcctgaataagcttctcagatatactgtctaatgctgatgttgcctcatcaagaactattacttcaggatttctcataagtgctcttgcaatcgatacacgctgcctctgtcctcctgaaagctttccaccatgctctcccacaactgtatctaatccatccggaagtgaatctataagatctcttaaattagctgcgtccacaactttattaagggcttcttcatcgaaatcatctattccatatgttatattatctcttatagttcctgagaataatattgatgtctgtggtacaactgccagatgctttctataagttctaagatcaatatctctcatatcatgtccatcaattgtaacaactccgtctgtagcgaaattaaagcctataacaaggttaagaattgttgatttaccagctcctgattctcccacaagtgcaatcgtctcacctttatcgacatgaagattaagctcatgaagtactggtttatctgtattattataggcaaacctgacatttttaaaatcaaactcaccttctacacttttaagtgcttctttcccgtcattgcattcaatatcttcttcaagaagtacttctccaatagaattaacagactcaactcccttggcaataactggtataagcgacataagtgatgatacctgacttactattgttgcaaaataactctggtaaagtgtaatatctccaggaccaacacttccctttaaagcaagaaatcctgtgaatcccagacacacaacctggaaaacctggaatattgcccatccaaccgagccaaataatgcctgtataacatcaagcttatagcctttctccgcaactgcaaaaagctgtccgctcatcttggttacttcttcctcttcaagtgcatgagcccttgtaaccggaataagttcaaccatctccataacccttgcagacgtctcttccatctccttacggaactcagtatttctcttcttcataatatttctgaaaaataccatagttgccgctgcaagaggtgtagtgagaagaaagaataagaatactataagactctttgatactgtaacaaaaagtgcaactccaatattaagtgcaatatttaatatgcttaaaaacatctgtgttgacagcgtctcaaccgcttccacatctcgcattatctttgattgcagcctgcctgactgtgtctctttgtgatacgaaattgaaagctgctgcagtttccttacaagtgcttttctaagtcctgtttctgcatatcttgttgctaatgatttatatcttgtatacagataattcattggcacattaagaacaactaatgcaaccataattattgcctgaataataatattctgtacagtatctggcgaaccacttgtaatatcattaataatattagctgtaacaattggcagcacccacacaggggcatgctttataaagaaaaataatactgcaagaaaaaacttattataattccccttataaagccctataagtatctttaacggatgccccttatgcttcctatagcactcaatgaaccaattctcaacatcaattccctttggtgcatgtaaattcatgattgttcctcattttccatatatttatactaatctctttcaatcttatcaacattatctgccacaattgcttctccatcgcagccctcaatattgacattctttaatataagtttttctacattacttacaataagtccctgtctgcttgcttcatcacagccaagcatcattgctgctacccccggcttcgcatctttagcatagctgaagttaatattctcaaatgtaagcttctcaactttactctctggcagaccgaatatatatgcacctgcaacatggcagtttttcgcattgatatccttaaatgtaaggctcttgattgaaggtgttctgtcatcaataggaagtggctttctagaaccaacatattctgtctttccatctggatcacagaaatagaagctgttaacaacaaatggtgtcataacattatccatatcaatgttctcaaatgaaatatcatcaagtacagataatttaccacggcctcttcttgtcttaactcttaaacctctgtctgtattcatgaacatacagtctctgatatgaacatctttaactcccgcagctatctcgcttcctactgttactgcaccatgtccgtctctcatacagcactggcgtactgtcatatcctctgtaggagtcttttccttctgagccatatatatcttgcctgacttgatagctatacagtcatcaccaactgaaatgtatgttccaagcacaagaacatcctgacagctttccgggtcaagaccatctgtgttgtgtgaattagcaggattaagaatcttaacatcaataaacttaagatgtttactaaaatatgggtggattgtccatgatggtgaattctgaactgtaattccatgcatagtaacattactacagttattgataaagaataatcttggtctccacgcagtatttcttatcttacaattcttccaccagttatcgtgagttgtgcatccatcaatagttccttcacctgtaattgtaacatttgaacagttgataccacatacaattgctgaaaacatatccagaggattgccttcccatgtaccaaggttgtaataatctttctcatcgtatgtctcaatctgtcccggtaatatagggaacttatctctttctgtaaatgctgaaagtaccgctcctttagcaagctcaagattaagattatcttttaagaatatgcttgatatcttataaacaccttctggaactaatactctggaatccttaggagctgccataatcgcacactggattgcattagtatcatcatgctctccatcaccatacgcaccaaattctctgacattaagtgttacatattcataatctgtcttaaattcaacaggtccgtattcttttcctgcatacaccgctgtaatcttatattctgtatctggcttaagaccatatattgttgtaacaaccttttctgtcttgccatattcttctccattaatcaggagtgtgtattcttccttagaataatactttccaccgtcatcaaattctactacagcacttcttcctgtcttgataactaactttaattccataatacacctccattgctgcgtccgtaatcctgataatccctgtttcttatatattcactgtaagctgttatgtatgccgctgatacagccacaccgctcttatccgcaacatgcttatcagtagctttttcaaagatttcctcagccttggatgcatatttttctgtctgtataagcttcatacggcatcctttcaatactgcatatgcatatataagctttacaaactgcgaatctgtattatcaatcgtatcattaagaactgaaactgctgctttatacatttctcttattcttgcaaatatctcatataacgcctggtccataacttcaagtgtatcaactgctcctgctgcaaataatgcaagtgcttttacagccttaacatcaccatcatgtgctgccactcctgcgttctcaaagcattctgcatatattgcattatactgtgcaattatatcattataatgttctttaccaccatctttggtctcataattcatatagaaactcagtgccttaaatgctgtgcataagcatctgttaccttctgctcctgtaaaataacctgattctgtccgtggctgtgtctctgtctgcttagcaatattaactgcaacatcattctttccaacgctgtaacatgcattaccatacatgtaattaacaaggtcattctcacctatgctgatattatcattctctacaagtttctctaattcacctgtaataacgcccttatattcatcactatgctctgctgcttcaagtttacctaaagcattaagaagaagtgccttatcaaatgcatctgctccttcaagcctagtttcttttaatacattattaatgtatcctttaatttcaaaacttttatccaagcctttttcctcctaaccaatatttgttttattttatcatgttaaacagtattattccactatttgactggtaatgacgaataaaaatacagttttattgctttgtttattctcatcgctactcgcgctcgtagctcatactccagaacttcgttctgtcgttgtcgcggtgctcctcgaatatacagtcaaaaacaccagcatatgcaagcatagctggtgcatttgattgtacattctcatcgctactcgcgcaaaaaggcgagtccatatggacccgccttaaataaattcaaaatattaacattactccttaacggcacctacgttaacaccctgtacgaagtacttctgacagaatgggtagatgatcatgaaaggaaggatagctacgatagttgctgcattagaaattgttgttgggttaacagcaccatcattaggaatatcactatcaacaaccatacttcttaactgaatctggaagttgtaaagattattcttattaatatataacttgaagtttgtataatcattccagaagcttactgcgaacatcaaaccaattgatgcaagagctgcctttgaaagaggaagtacaatcttgaagaagatacccattggtgagcatccatcaatctgagctgcttcgaaaagtgattctggaataccttcgaagaagtttctcataagtactaagttatatacattaatagccattggcagaataaccgcccacaaagtattgattaatcctaactgcttgataacaaggaacttaggaatcataccaccatcgaaaatcattgtgaagagaagcatgtaagcgaagaagtttcttcctggcatctcccactggattaatacataaccaccaagtgtaacaactaaaagtccaacgaatgtacctataatagttgttataactgagattaagaatggatgataaaggtttgatcttgttataatagcacggtaaccaccccaagagaacttctgaggaagccacttaaaatcatatgatgaatatgcatctattgaagtaataattactttgtaaataggaatcataattgcacatgcaatgataatgaataaaattgcattaacaattgggaatactttgaattttttctttttctttttataaactagtgtctgattatcactcattatctattccctcctatacaattcctcgtccacgtactttcttacttgcccagttacaaccgagaactaagatcataccaacgaaagacttaaataaacctacagcagttgtataaccataatctgagttaccaccactgaatgtcttagtatatacatatgtctgtaaaacctgtgatttagcatatgtaataggtgactgtaatacgaatacagattcgaaaaggttcataaccttagcaaggttaagaatgaatactgtaataattgtattagcaagagctggtaatgtaatgtatatcagtctcttgaatctgttagcaccatcaatctgggctgcttcataaaggtctgggctgatacctgacaatgtagccaagaagaggattgttccccaacctgtatccttccaaacattcatgatatagaatgttccacgccagtaagctgtactgttcatgaaatcaacagctgtatcaataacacccatatttataagaattgagttgactggagcactatcatatggagccagtaacatcttaaatactgaagcaacaactacccatgacatgaagtgaggaagatagataattgtctgtactgtcttcttgaaaatcatgttagtaatctcattcagaagaagtgagataataactgctgcacctgtatttaagaacaacttaattaatgacaaaattaatgtgtttctgaatgcctgccagaaatagatatcgttagtaaacatagtctggaaatgatacagaccaatgtagtatggattagcgataacatattttgtgaacgaataacgaacaccaagcattggccagtaattgaataacataatcataacgaaaactggcacgaacataaggtagaaacctctgtaataatacatcttatttgtgaggctctggtttaatgagttagaaagatacttagcatcaacatgaagatctttcttgaaaggcttaacaatatctataaagcaacctgcaactgctataacaataccaatcgcaagtacaacaaatccacaaccaatatgatatgaattgccattatatccattgctaagaatatctggaaggttaacattaacgtacttaagtccaccacctgctaccttaccattaacaagtgtaaactgaactgcaaatacagaaacaactgtaagaacagctgctattactgtagtaatgatagaaaagaattcttttctggctacaataagaatgataccaacaacgatacatgcgatgaataaataccataacactggcatactgatattcatgtaactgaaagcatatgctgtaggataaacgccttctttaatcttctctcctgactgaacaagaggtaaaagactggcaatgagcatgataataagtccgatgatggccatcaatttaatatttccttttggctttcctactgctgttccgcacttagggcatattttagctttcttaggaagctctgtgttacaagatggacactgcatttttttaccttctttcctaattattatcgtatgcctattaaataaatttcataagcaaatccttttttgtcagtataaacggcgcggatttctctgcgccgccatactaacataagatgtataaacatctaataattattgtttaaattacttcttaagtgtttcgtttaatgactcaactactgcatcacacttagcaccaacctgcttcttgtaatcagccatagcttcatcatatgtcttctcaccaagaactacctgtgaaacaacttcaagtctcttagtattgatatcagagatattgttgctaagtacttctgtgttccaaagtggagtctcaagcttgctgttagcattgaacattgcatagttctctgtgataattggatcaacactcttgttacctggatctgtgttatcaccaaatgtagcgatagctaagctcttatcaatgtggttcttagacataagctttgtattatcttcaggtgttgtaaggaagtggaatacgccttcttcatatgtcttagtcttcttctcatcaacctcaccctttgagttgtaaactgtaactgtctcagccttatcatcccagtgagttcccttagcaccatactgccatgcaatctggatgtctccaccatcaagcatagtatcgatgaagtacttgaagattccttcagccttaccattctcatatgccttgtatgtaatacaccaagcagtagcaagacgctccttatatgagccaagttccttaataggcttaatagcgataatcttatctgtcttatcagctatagagttctgaagtgtgtaagcccatgtaccagcccagtatgtgaatactgaagaagctgttgaagcatccttagcattccacttattacgagcatctgatgttgtctggttctgagaagccttatcaagaataccatcatcaacagctgtcttaagtcttgtaagtgcatccttcatatcctgctgagcaaatccatccttgtattccttagctgcttcatcatagtagaatgtgaagttagcattctgatagaattctggaagatagttagtatatggagcttctggagtaccagagttaccaccagctatgaaacctgaacaagagataacgaagttctggttagctgaagcagccttcatatccttaagcatcttgtaatactcatcatatgtaagtgtcttagatgcaacttcctctgggttgtatccagctgctgttaaagctgaagacttgatgtatgtacagcatccattaccacgggctggtgagaatccgtaaagagccttctctccgtctggaccagcaaccatgtttcctgattcgatgatttcagcctgatcgataagtcttcctgagttcttagttgctgactgattccaagcatctgtcatatcccagagatatccgttagatgcgaagttagcaaggtaatctgagctaagaagaactacatcagggatatcgcctgaagcgaatgcattcttaactgaatcatagtagctagaatgttctggacgaatccacttaatatcaagacctgtaaggtcaccaagatacttgtagaattcctgagcgccgttagtttccttaactactgtaccatcaaccataactgtgaactgctctggcttctgtacgttagcccaatcaactgttgcttttgttgcgtcctgattgccgctgttagagccacaagctacgaggcccataactgaagtaagtgataaacctactgcagcaaacttctttaatgtctttttcataaaccttaaaaccctccttaatttggttcgcggggattctctccccgtttcgtttttagacattgatatattagcatttttgtactattttaacaaggctaattttaacaattattgtattttttttgctttttctgtgaaatcccagtatttatgccatttcctgcattcataattttttcatttttttgaaatttttatcaaaaatcatttcgtgagaatagttttttttcatataatctttgtgtttttatgtaaaaaatgcactatgtgccttgctttttttagattattttacatcacatttacacattatatactctttaaagcagaatccgaccattgtattgtgattttttaccactgttaataatttattcatatttcaggtatcatctgcacaattttcctgtatcatctctgtacatctgcatgctgcatgtatcccttaagcatatctttcccgatgacatctctgtcatattcttttccagaacatttcttgctgcattctccatcatcagttcaaatgtaacgccatcggcatattctgtattaactattgttatatcattctgtgcacatatgtactgcacttttcccacataattataatcaacatcaaggaatgcatgcacaccctctgtaagctcaccaagtctgcagacggacagtgcttccttggcagcattagtatacgctcttataagcccgcctgttccaagcagaacacctccaaaatatcttgtcacaacacacagacagtttccgcattcatttcccgtaattacttccagtatcggcttacctgctgtgcctgacggctcaccatcatctgaaaatctctgtatctcgctcttgcctcctaaaacatatgcataacagttatgtcgtgcatcccaatatttctttctaagctgttctattattttcactgccatatcttcatcttcaatatgataaatgttagctataaatcttgatttcttatctgtaaattcacctgttccacctgatattatcttcttcattatctgattccttcttatatatgtatatttagttattatacagccttattgattgcctgtcatacctttttatgttataatatcatgactttattaaggaggacaatatatgaattatggtggtaaaggcataaaacaaaagaaaagactgcttaattcagctactaccaagctgggcaccaaattaggtatatttttcataaaactggctttagttgctgctatagctgttgttgtttccggctcatgccttgtattaggttcctttcagggaattatagagaatgcccctgacattgcatctgtcaatgtttcgcctgaaggctttgcaactaagatatatgattcagatgagaatgaaatacagacactttcttctgccggagctaacaggacatatgtaacaattgaccagattcctaaagatttgcagcatgcatttatagctatagaagatgagcgtttctatgagcataatggtatcgatatgagaggtatcttacgagctgcttcaattacactttcatcaggtgagatgtcacagggtgcaagtacaataacacagcagcttctaaagaataatgtttttaatgcttttaacgaatctacaattgaaaagattaagcgaaaggttcaggaacaatatctggctataaagcttgagacagtaatgtctaaagattccattcttgagaattatcttaataccattaaccttggtaacggatattatggtgtacaggctgctgccagaggatattttaacaaggatgtatcagagctttctatcagtgaatgtgctgtaattgcatccatcactaaaagtcctacaggtcttaatccaataaggcatgccgacagaaacaaagaccggcagagtcaggtccttctcaatatgaaagagcaggaatatatatcccaggaagaatatgatgaagcggtttccgatgatgtctatgcaagacttgaagggattgaacttgccggaacatcaactacaacttattcatattttgttgatgaacttatcaatcagcttacttctgaccttatgtcacagaagggatatacagaagcacaggctacaagccttatatatcgtggcggacttcaggtttattcaactcaggacacaatgatgcagcaagttgctgacgatgttatcaatgatcttggcaactacaatgataatacacatttttctatcaattatgctttaacaataaagcagactgatggatcattttcatattattcacacaattcaatggctaactggtacacaaagactcttggagatacccgcttcagtcttacaatgaccgatgaagacgctgcaagaagttatgttgaagcatataaacaggagctccttaaagagggtggtgaaatatatgctgagacacttacatttacaatacagccccagatatcatttactgtaatggatcagaccaacggacatgttaaagttatggttggcggacgcggtgataaaactcttaaccgaagcttaaaccgtgcttctaatgacattgcaagacagccgggttcaagtattaagccacttgctgtatacggtcccgcccttgatacagggacatattctctggcatctgccattgatgatgctccttattattattcaggaactgatgcaaagcttgttactaactttacaaaaggtgaatacagaggtctgatgacattaagagaagctcttactgtttcacagaatgtacctgctgttaagattctttcaaagcttacgccccaggttggttataattaccttgagaaattcggtatttcaacgctggtttctcctaaaaatgcaatcaacggtgcacacgatgttgtacaatcacttgcacttggcggtatgacacgaggtgtttccaatattgacatgtgttccgcttatgcagccattgctaataaaggaacttacacaaagcctatttactacacaaaagtgcttgattcagaaggcaacattattatcgataattctgtacctgaaacgcataaggtacttaatgagaattctgactggcttcttattcagggattacgctctgttgctactgacggtactgcacgtacagccaacttttcaagccagcctgtagcaggtaagacaggtacaacacagttcgacagcgacagatggttctgtggcttcactccatattacacagccgtaatatgggcaggctatgatgataactccaaagagcttggaaatgttgtcaaccacaatgttatatggcgtacaattatgcagacaattcatgaaaatcttaatcttccaactggaagttatgaacagccatctggtattgtagaggcggctgtatgctctaagtcagggcttcttcctgttgagggcttatgtgaccaggaccctgaaggaaactgtgttataacagaatatttcactgaagacacagttcctactgaatactgtacaacacatgttaatgtttcaatatgtaatgaatccggagatattgctacttccggttgtccaagtgttacaactaagattatgagaaagaaatcttctgctgataagcttggcgaggataaagacggttctgaattcaagacatgggatgctgatatctcaattacagatactgagttatctaagttatgcactattcacagtgcaacaaccaagccttccaaggttacacccggaacaggcagcaacaaaaacaattctaaagaaacaactgctgcctcaacagagacatctggtaaaactaattcatctgacaaacggccttaatcattaaaaaaggatagtggttcaatttaagcgaaccactatccttttattttattctttcttcatcctaggttcaaatataagtgatgcaataaatccaaatataagtgctgctgacactccgactgcacatgaagtaaatcctcctgtaaacaatcctaaaaatccctgctcatctattgctttcttcatgcccttccataagacattgccaaatcctgtaagcggaactgttgctcccgctcctgcaaatttaacaaaaggctcatatattccaactgctccaagtacaactcctgttgttacaagaatgaccattatccttcccggcataagctttgtcttttccataagaatctgcgtaagaacacatattaaccccccacatacaaatgctttaacaaaatccatggccttaactctcctttccttcaagaattacaccatgggctatgcccggcacactttttccttcattgtaacttacggtagataacaaagctcctgtaggaacaaaaagaactcttttatattctcctcttataagcctgtccataatacagcttccaagaacaactgcactgcagccacagccgcttcctcctgaacacttagtttccccttcgtatataagcattccacaatcatacagcttatcagcaatatcaatgcctttctcttttagaagctcagacaatatcctgttgccaatctctcctaagtcgcctgtaaatattgcatcgtaatagtccttatcaacatcaagatctttgaaattagcttctataagctctgctgctgctggagccatacatgctcccatattcattgaatccttaacgccgtaatcaacaatctttcccgttgtaataccctttatgagaacacattttttcttatccagaggcttatcgccgacgatatacgcccctgctcctgtaactgtccatgtagatgcaactggtctctgatttccatactcgagcggataacggaactgcttttcagcacttgcaaaatggcttgacgcgatggcaattacattttgcgcatatccggcattaacacacattgcaccaagtgataatgcctcgcccatcgttgaacatgctccgtacagaccaaacatcggtatttcatatctcataagaccgaaagatgtagcaataagctgtccaagaaggtctccggcatagatataatctatgtctgacgcagccatgccgcttttaataagcagcttgtcaaccgccatctcctgaatgtggctctcagcctcctcccagcttttctttccaaacatatcatcttctactgccacatcaaacatttcaccaagcggaccatcagcctctttctttccaaccactgttgcagcacatctcacatatacatctttgtcaaataacagactctgttttccagtcataatcctcgtttccgcacatactcatgtgccattagtctttataagtagtctgtccaaaaatgtattaattatgtattattttcgtattatgtcaagcgtatgtgcagcagcaccaagcagatcagctctttcacaggttgcaagatgatacctgtaaaacatctcgtattcctcctcgtcaagctgattcacaaactgtcttatgtaattagccggtccatccggtgtcacaatcttcacacgttcacatcctgctgcttcattaacattttcaatatcttcaagtcgcacataatcatacagatcctgctctgaagatatcgtgtggaaatcctctgtcagcctgccctgttccatacactccttaatatgtctttccttaaatgcatatgtaattacaccatactcgttcataacataagcgacaagaataaagccacctttccttgtaatacgggccgcctcctttaatgccttaaccttatcctcctgtccgaacagatgatacatcggcccgaacagcagggttatgtcaaacgtttcatcctcgaaacgctttaacttaagtgcattgccctgataagccttaactgatgaattcttagatttcaatattccaagattgtgctttaccagttcaactgcagttacatcaaagccttcctcagccagtgcaacgctgtatctgcctgtcccggcacctatatccataatctttatattctctctgccttctctctttaattcttcaatacactcatgtatataatgaatcgatgtacggaattcaatctgtccgtgtcttgaagtcagtcttttttcttcattaaatttattataataatcttctaaaaaagttcccatattatcctcgtatcctgcgcatttctttaaaacagttcctatgattctaccatacagatgtttcttaatcaagaatcacagtacatgtataagctttaaagccagatatataagtcctgcacaccagctaaaaaatattccatatagaataacaggaccggcaatcgtgaatatcttgcagccaataccgaacacccgtccctccttcttatactcaatcgcaggtgcagcaacgctgtttgcaaatcctgtaatcggaacaagacttcctgctccgccaaatgtggttatagacggataaatattaagtccggtaagaattacacttaaaaataccagtatcagtgttgtgtaagatgctgcatccgtgtcaggcactttcatccacttgcatacatttaaaataatctgtcctgcaacacatatacagccaccaacaatgaatgccttaaagcattttgccacacagcttcctttaggcgtaacattttttacataagcattatagctttcatttcttttttcaatatcagctttggtaccgctttcagaattaatatcgtgcataaatcctccctttttgcaatgcaaaatcaatacatatataagtaatatacaagctgtcctagtgcttttcctgccgctgtcgccgccacaataaaaccaagaccggtgcctgcctttgccctgtgaacgaatataggtaatgctttgactgtctctgcaaggcttattaaaaatgtgcctataaatatcccggatatcaacccgaatataatacagcccgtcattcctattctaaccgtgattccaagaacatatacagcattagctgccgtcgcaccgattattatacattcctcatacagagacacatgtctgctcgtcccgctgacatcagcatatctgttaataacaccaacgctggttataagtgcaaaaagtcctgcagcagtaaacactcccgacatagcccctataaaaataataaccgctatcattttccaccttccctgtcaataacagattctgatatatctttgtcatatttatccatttcaacctcaagcggtgttggtgcttttgacagcttttgtcctgcaaaatgatcataaaatataacaattccaataaacaatcccacagcataggcaatctccattgcatttgttgccttatatgcagaagctccaagaagctcgtacacccggtcaaatatatccgtcgtacttacgtcattgttgtacgcaataattccatatccgcttccaaccattgttataaaacatataacagctaccttaatccaatgcactgtgccttccttctccggtttcttgtactcaacaacaaaatcacattccccaagacattcaatatctgcatccggatactccttctgaataatgcccacaacatcaagtgcatcaagcaccttcctgtcatacttgcccagcgtaaactccacaagcgttatatgtccgattttttcaatcatatccttatcactgcaataaacagtaatcacatcccctatatcaaccttcggtttcttaacatatctctgctggtcaatcttcaaataaatcttctctgacataacaaaccctccgttgctagtattagtattgtacatgcccgcagaattattcatgaagcttttatttctgcaacagcctgccctagcccaccgcactccataccggcacaaaacagtcccatcactgttttcattcagcataaaactacgccgctgtgtccgtctatggcatatgcccgaatatttcgaatcgtgtgggagttaatgccgctgtctgtaaaagggcggtgtggataaactcgttcaagcgaagcgcgtttgtttatccacaccgtaataaactatacagatggcggcatttactcccactagatgaagaaatcctgagggcatatgccatagacggacacagcggtgggatcgttaatatatgaatgaatccttcacgcaaacagccgcttgcgcatgccacttaaaatcttcttctccatccgcgacacctgcacctgcgatattccgaactccttagcaacctgcatctgtgtgtaatcatcataataacgcattctgataagctctttttcacgctgtgaaagtgtttccataagctgtgcaagtgccactttacttgatgcagtttccccaatgtctgccttgtcttctaacttgtccatcagcatgacctcacttccatccccctgatagattgtcttatatattgattcaacctccattgatgcagacattgacaatgttatgtcttcaactgacaactcacaggcagctgctatctgttctaccgtcggttcacagcctaacgtgtcacggagctgtcccgccgctctcatgctttttactgcattttctttgatagaacgactgacctttaccattccgtcatcccgcaggaatcttcttatctcacctgttatcataggaactgcatatgttgaaaatgcaacatccatatccagattgaaattatcaattgcctttataagccctatacagcctatctgaaacagatcctcctgttctgttcccctccccttaaatcttttaattatgttccatataagcccaagattatctgttaccagcttctctctggcctctttgtcattattgtgtgctttagcgatcaattccctggtacaatccttagtctgatccatagcatcacatcctatcaattactcccctattttctttctcataagaactgttgttcctttgcccggtgccgacgcaactcttaaatcatccatgaatgcctccataaacgaaaatcccattcctgaacgttcctgttcaggcttggttgtatacagaggttccattgcttttgcaacattttccatgccaagaccgtcatcgtgtacttctattattacctgattctgtatgccctttaatctcattcttacttttcccggaccattatcatagccatggactattgcgttagttactgcctcggaaactgctgtttttatgtcctgcaattcttcgattgttggatctaaatatgtaacaaaggctgccgcaacaacccttgcaaatgcttcattttccgacctggcttcaaataataattcaacattgttattctctatcatgcttatgcctcctgtcctttaagctcatatatgttaactatcttatgaagtcctgatataagaagtatcctcttaacactttcacggactcccacgattgttatgtcacctttatccataaccttcttgtaacgccccattataagtcctattcctgcactgtccatgaaatccactttagtaaaatcaaatactatatgagttactcctcttttatctattacatcatctataacctgacgcatctcttctgcaagatgatggtcaagttctgcattcattcgtatcataagcttgtcatcattaaccatgtatatataatccatatgctggatttcatcatgctcatccgctgtattaacctgttttgacataataatctcctctttcctctctgcttttacacttcactaattctgcaacaaagcccccggcaaagaattatctttgccgggggcttatcttttagtacctcatcaatgtgaattaacgtaatcgctggcttctttgtaatatccgctagtcgaataatcatccacaatatacttatagtatttctttgcatcatcagtctttgctaatgctacatatgacttagctgcataataagctgaatctgcactgttattacatttgtatgctttgacaagattatctgccgcaacttcatagttggacttgtaatactctgtcattcctgtgttatagaaggtctgtgctgctgccggaagtgtcgccgttgctattgtattatataaagtctttgctgactcacttggaagtgcactgacatctatatcaacaagcttattcgcagcatcatcaggcttatttgcaatataatcacttgctgcctctattactgataccaaaagcttgttgcttccctctgttccattaacaacgccaagctgctgctcaagtgcatccttctgcgccttaacctcttcaagttctttctgcatagaattcagttctacattaccagaagataactgctcactatactcctgaagacttttcttataatcctgtgtaagtcccttattccttgccggaacaataagaaaccatattaatgctgcacctattacaacacctgccaatacatttattattgttattgcaccattacttggttctttatatgacgaccttggaagaataacatcgttgccacttagcggtttcttatcaatatccttttcctttctcttaggaaggaaagaacctgatgtttccgctttctttgctacatttctttctgctatctctttctgataaatatgtgcaagtgtattattcttatctattgcaagaacagcgttaagcagcttttttgctcttgaaagctcgtcctgcttaatgtatataagtgcaagcagaagatgtgccttaataagctgtggattattggcaactaccttcttgagctgtattacagccatatcaagattgccttccttggcatatttcaaagaaagattatatttacggatagtacctgtaatcatctcaaatctgttctggttagtctgtatcttcttaatatagtgtcctgcaatattgccttcaggcgtaaaattcttacttactacccactggcttaaagcctcaactacatcacccatctcacagtaaacaagacctaacagatttcttgcattggtattgtacttgttaatcataaggcttatcttaagagattcaactgcaccggttaaatctcttactcttgctttatatagtcctgcattataatatgcatctgatactctggctgtcttcttatatattcttacattctctccacattgtggacatgtatcaccatctgtaaggaagcttccacatttataacatctcatatgtccacccctcactacttatctgtattctttccgctaagtatctgtgatatcagatctgtgatatccggtacatcattgttatatattgcgtcctcagcatcttctacttcaagacttggctgaaacttctgtatctcttcatcaaaattaatcatgattattttcctttccttccaatgcacggtccacatcaccaactaaataaagcgaccccgttgcaaacatcagtctgttatcccattttttcatagcttcttcaacactctcaaatacatataccggtgtatccttaatatgtgcttcaaatgtttcctttattatatcagctggaagctttctgacaccgcccgttattgtaacatatatctgtctgaaatgcttacagctgcatagtatcttaatcattctgtcataatttttgtcacttactactgaaaaaagtaatgttgccttatcaagccgactgttttcataaagactgtttactgaatctacaaagctttgaattccttgtggattgtgcgctccgtcaacatacagattatctcttaacagttccattcttcctgcccagtgtgtatcgtacattgccatactgactgctttattgtcaagcttaatcatccccctgtcacacagattagcacataccgtaagtgcaatacttgcattttccatctggtacaacgcattcgtacttaaccggaagcaatcattcttataatactcattatgaattaaaaaatcaatatacccgtatgtattttgtatcagttcaaatgtattgtcgtcaaccacatgacagtcgcatccaaagtctgctgcacgctttcttatcacatcagcagcttctttcactatgccactgcacacaaccggtattcccggtttaattatccccgctttttcatttgcaatcttttctattgtatcaccaagaattgcagtatgttcaagcgatattgttgttattactgagacaaccggattatcaactgcattagttgcatccagctttccgccaagacccgtttccataacaacataatccacatcatgcttactgtaataatacattgccatgccaaaaagataatcaaaatacgcaagctcctgtgtcctgtgttcttccacataccagtatgcttcttcaaaatcctcttgtgaaatcattattccattgattcttatacgttctgttatatcatcaagatgaggagatgtaaaaagtcctgtcttataaccattatgctgtaaaattcctgcaatataagcacacaccgatccttttccattagtaccggcaacatgtattatttttaatgacttctctggattattcatatcatgtaataactgtctgcctctttctaatcctgtagatgatgcaaactgacttatactgtcaagactattcacaatctcattatacatgtctcatcttttcctttccggatgtcacatactttgtatagaaataatatgtctgtcctcatatgtaataacagctgtatattttccaccagtatatgcccttatcacattattatcccctactgccagcatagaagctgaatcatgtgcctcttttaaagtttcttcaatatatcgtaattcttccctgctaaatatactaacagcagactcaaatacttcatcatcaaatgaatatttaaagaaaaaggctgtccattttatcttaagttcctttgctctttttttggtctcttcatctgccgttttctgtacagattcaagatatatctttctctcctctgccttctcacatgcaagttttaattctttctctgtctcctgaagtctttttttcttcctgtcactatcaccaagacttctgtccatttccctctttgtatcattaacctgtgcataatatcgttttgattcatcttctgtctttctgttattaatgtaatcatctttgacatcttcaagttttgcaaaatcattttgtgcaatattaagcctgtccacggcagcatcatatttcttctgtgcttcagtcatcctgtctgtctttacagaaacatccttttcacatttttctaattccttgcgtgccttttcaacctgagtacacataacacggtattctctgtccttatcatcagcggctttctttttgtccgcagcaatataagacggcataaggtctgatggtgcataaaacttgatatcatttgcatggcttaccttccatatgtatcccgccgcctgaagttttgatattcttgtcatatttctgacagcctgatacattgtctttacctgcgcctctgtcgaccagaatgcatcttccccaagaagtcttattgcagcttcaagctttgtcgtacttctctgtctgccgagtacatctataattccctcgccattgaatttctctggcataagacttttttgaacctcacgtttagtctccattgaagcaacccctaattttcttccaacctgttcagcatatgactttttctggacaactgtaagattacgtatctggttcataatattatttaaaaatgcattgttatatcttatgcttatttcttctattttatgagcgggtgacatatatttattaattccgtatgcagatgccgcctcatcaataatatatctggacatctgctcttttacttccttatccttcatgtctccttcaatttcaggacacatcacttcaagccgctcatataacattttctcaagtttttccctgtttaacgccttatagcgaagacagtcttcccgtacgagatctgatactttttttacctcataatcaatcgaattctttattcctatactctgtgtaaatgaattggcaacatctgcaagcacattaaccagcctgtatccggtctctttaaccgcattagatatattaacattgtcaataagcgctatctgcattcgcagctcatcttcactgattctgcttatctctgatattatatctgacatatctgcctcctcttctgactgctacataagccagcagtctgaattgtaccataagaacaaaagatatatttcgattgcaataagaaccgccataataatgtatcttacagccttattacatcttgtaagtatgtcatacactcccacaaatgcaacatatgttcctgccgtaaatctgcatgtactcataacatgtgatgtcaatggcacaagaagtgatataattccgaacactgccattgagtaatattttctgtaaaacatatatccataaagtatcagtattgcaatacagaaccaccccatatatgtatatcttggctcaatctgtcctgtacatgccttccacaacacgcctataatcgggaaatactcatcctctctccatgcaatctggacattcttatatgcccatgcatcaccacagaagaaattaagaaatgccatatatgcaaatgcaccgagcgggcacacaagcactgacagtatcttcttgggtgctttaagcatattcattacaaatgtcttaaccctgccaaagcttatcttagttccttccatgtcaatatatagctgtacaaccagtgcaaatacaagtatacagcctacaattcttgttccacttgagcatgctgccataattcctgctgccatgtatttcttctcaaaaaggaaatagaaaaaaagtacaatgaacattataaacatcgcttccgtatatacagaactgcaatagaaggtgtaaggtgccataaataaaagcactggcataatcatagtatattcttctttaatagaagtctgcttcttaagacctttaacagcaaagaatgctgcaataattatgcatatattagatactatcattccaataacataagtgttaataagcccacctgtcactgcctttaatgctgcacacacgataacatataatgggaagaacgcccagttagcctgtggatcaatatccgtagggtgtgtataaccatgattgattatataagcatatttctttgcatcccactcgttcataagaaacagaaatgatctgtgtgtccccataattccattatacacaggaaccatgataagcataatcagtcttgatatcgcaaatataatcaatatctttaacagaagcctgcaattctcattattttttagtctgttcatctaatgcctcatttcaataatatacggattatatgatatatagctgccgggattgtacttattacaggtactacaaacattgcagccacaactattgcaaacaatccaatatatatatactgtgcacagtacttagcccatacaggaacatttatagttctcttataattaatcacaaggcataacacagttattaacaatgtcacaagtgtaataagcagtcctgcatttctgccctttggcacaaatgtaaacactaatgtattctcgccttcgtgaacctgtacacctgtaaacagccctgctatctctttagtcttaactgtctttccatcaagtgtcacggtccagttagcgctcttaataaccggtatcagggcataatccttagttccatcactgtttatcttaactgtaagcgtattattagtatatgaaacatctgtctgcttatctgcgaaatcctcacagagcttatccatcttctccatattaagaagtccgatagtcatcttactctggttcatatatttaggcttatcatattcaatcttaatctgaacatcttcatcttcaaatatgccaagataaagaagattattattataatccgtaaaatatgctgtattattaacatctccaagtgtaggtacaacaactgcctcaccattcacatatacatgtatgctgctctcaagtttagatgcattagcatccgcattaggcttcttcacatctgcaatattcatatatatagcacttctgcttccgacattaatagtcatggacttaatattgccagcagtctctgcctgtggatatattcttgttacaaatgtttctttatctccagtcattgctttatacattctgttatggtatgtaatccagtcaacattagtcatatcaagcttgctgaagctgctgtcaacacagaatccaaatggcaggttataattagtgttgtaaaggctgtaatcgccttccttcttctctaatgtatataaagcactgtcaagttcattgatattaactgcttgtgtaacatgcagcactgcattactgaatactgttccacctgaatctaacagccacaggaaatacttagaatatccccatctcttggcataactttgtgtatcgtcctctaaagctgctgtaaagcttgataatgctcctcttctcaatataagaggataattggcattaagactgatatcaggatttactattctgtctgtagcagactcttctatatcaaggctgtctgccgcatcattggcatactgcacataatcaccaatctgataatcttcatatgtataaaacttaggaggtcctataagagcatatgcaccgataaacaattcaagtgcaataacaaggataactgatttgcagttaaattctttctttcttatgagcataaacatatacactgcaaacattattgcaaatatcattataaaaaatgccattgcaagcatttcattgtttattggtaatatgttataaatcataacatatactgcaccaattaccgctactatcgctgtctgcctgcgataaaacgcaccctttaatggtatatctgcaaacatcttctcagccattcctgcagcaatacagataagtgtgaacgatatcagatatccgtttcttaatgtatatccgttatatgagccaaaatgccacataaggttagtagcctccataagcaccggacctaatgcaacaacaagcatagctacagaatatataagctgttttctgtctgacttatatatttttatccccatgataataactgctataacgaatgcaagtccataaagcatcatccagcgctgcagtgctgccattgcaccatctgtaacgattgaacttgttatccagcctgcatactgtgataaaagccccttagacgcaccacctctctgtgatgaagaaagctgtgcaaatacaggaacaagcacgaatgctgaaagtccgatacctgcaattgtgcctataccgacattccatgcagtttccttccactgctttctctcctgcataactaccattcttattccacagataaggaatatgtatataagtgacattgcacttaagtaataattaattatgaagcacaacgcaatcatgcatatatataacattttctttcctgtctcaagcattctgtcatatgccattataagaatagggaaaaatgcaactatatccatccatggtgtaaagcatgaaccatagagaattacataaccacaaaaggcatacatgcatgaaaacataacctttaatccatacacaagattattgtatttcttattaataagcgcatacattgcaactgacatgaatatcatcttaacaagtgtaattattgatatgctctctaatatgtaacttcttggaacaaaatataataaaagattaaacggtgtaatcattgaaaatgctgatatactcattgacacatttgttccaagacctgtataccagtcaaaccatattgatgccttaccatgcatgaaatcccacagatgtgcataaagcggtgctacctgctgcatgttgtcaaaataatctattctgctgcttccaaaaggccatatacctttaagtataagtattacaatcataaccagacctgttattataccaggtactgcgtatggcctgatcttttttaataatgatttaaatcccgatttcttcatataattctacctttctatacatttacacatattctgtcatctttggatttaagtttccgcctgacctttatcaaggcttatactgtaaagagtatattctgcattgtcagcatgaaacttcactgtaagaagctcatcaccgctgacatatcctatctttagcttcgttgttcccttgctgtctatatttccaatcagcttatcattcacatatacttcaattcctttatcaccaacggctgttgtatcatattccgtaatatcacatacaagatatatattatcagatgattcctccggaatatagtatatatatgaatctttgtctgtattcttcgttccttcatatctctttgttttctgccagccctgacctttacggctgcagacattgctttgttctttaccattacggtctttatgttctgtacatatctctttcgttccaaatgtatatttcagattaccataacccggccagtctgtaagctcatgtgtcagatagtacattcggtattctgttccaaccttaggattctttccccaccataatactaatatataaaaaacaacaagtaccgcacatgctgtgtacagcaatactcttgctatattctttctcatacagacctccatttttatacttctacaatcatataatataaatcatttttcgcaatctgccaagtaaaaaaaggttctacagacatattgtctgcagaaccttacaattaaatcatattataagacaattattacattaaagcctgtaattagcaaactccctgagcaagcatagcgtcaacaaccttctcgaaaccagcgatattagcaccagcaacatagtctgtctttccaccaactgtcatatcatatctcttagcagcatctgaaatgttagcgtagattgtttccatgattcccttaagctttccatcaacttcttcgaatgtccatgaaagtctctctgagttctggctcatctcaagagcagatgtagcaacaccaccagcgttagcagccttaccacctacgaagagaacaccattctcctggagatactttgtagcttctaatgttgtaggcatgttagcaccctctgttacagatacaacaccgttagcaacaagcatcttagcatcctcgatgtctaactcattctgtgtagcacatggaagagcaagatctaccttgtactgccatactccgtgttcaccattctgcttagcaaaatactgagctgatggcttagcagcagcgtattctgtaagacgtgctctcttaacttccttaacttccttaagaagtgcaacatcaattccttctggatcataaatccagcctgttgagtctgagcatgtaacaaccttaacacctaactgctgtgccttctggatagcgtagatagcaacattacctgaaccagatacagctgctgtcttgccctcaagtgacattccattatctttccataaagcattagtaaggtataataaaccataacctgtagcttctgttcttgcaagtgatccaccgtatgtaagtcccttacctgtaagtacgccttcgaacattccacggattctcttatactgaccgaacatgaatccgatttctcttgcgcctgttccgatatcaccagctggaacatcgacatcagcaccgatatatttgcaaagttctgtcataaagctctggcagaatgccatgatttctctgtctgacttgcccttaggatcaaaatcagaaccacccttaccaccaccgattggaagagttgtaagtgagttcttgaatacctgttcgaaacctaagaacttgatgatgcctaagtttactgaaggatgtaatcttaaaccacccttgtatggtccaatagcgttattgaactgtacacggaaacctctgtttacctgtacctgtcccttgtcatctacccaaggaactctgaacatgatctgacgatctggctctgtaattctttcaagaatagcgttctttctgtaaacttcctcgttagcctcaacaactggtcttaaagactcaagaacctctgttactgcctgtaaaaattcaggctgatctgcattcttcttagacacgatgtctaatacttcatcaacataccccataaccttaaaacactcctttaaattattatttaagattgtacattactgcacatcaattctagcgttattatatctgttctggttaatttccgcaagttttttatagcgtttgcctattaactttaagttatttgtaataatattaattaaaataagcctatacctaaggtatgttgtttttcttgcttaagataattaagttttactttttgataaaatcatggtagaatgtattcgttatttttttattatcctattgtaattaaggagtgaattatgtctaatttttttacaagaagtaaagacgatatgaaatatttatttaagaataaagaagagctttctaagaaagaacgaaaaagaaaaaggcgtggctggggtacacttattggtcttatattagttctgatacagcttattgtatcgggattacttttatttaatatatttaagttagatattcttccattgaagtatttaattgcggtcaacgcatttttactgctgatattcctgtacgatttcacatcgcagtttacgaaggctcatattataggtaagattcttgcagtacttatgtcaggagtgattgttttcatataccttgtatcatctaagcttgattctgtccttaataaacttaatcttcctgagattaacactgacatcgttgatgtagttgtactggcagatgacaaggcttcctctttaaatgatcttgccaattacaagtttgcttataattcaactgcaagcaacgctaatgtcaagacagcatttgattctgttaaatcagagcttaacaagagcagcctggaacttgcagaatacaaatcatgggatgaccttgtaactgccttttatgataatacagaggttcaggcaattgttatgaatgattccatgcttaaggttgttgcctcacagtatgaagactttgataccaaggttaagattattaagcaatacgaatataagaagcttgttactgtccagaaatccaacgttaacgtaaagaaagaaccatttataatatatgtttccggtatctcaagtgaagatggtgccgattcagcactctctaataatgcacttagtgatgttaatatagttgccgttattaatcctgaaacaaagcagattctcctagttacaacaccaagagattcttacattaagattaccggacctgatggaagaaaaggttatgataaacttacacatgctggaaattacggtgtagaagcttctattgacactctccagaatctgtatggcattgacattgattattatgtaaagattaatttcacaggctgcgtctctgttgtagatgcacttggtggaatcacaattgactcagaagtagaatttacttgtggcgaagatgcttctcctattccatatcatttcgtcaagggacctaatgaatgtgatggtgagatggccgttgcattctcaagagaaagacatgcatttgctgccggagacttccagcgtggacgtaaccagacagccgccatcaagggtatcttacagaaagctacttcacctgcaatacttaccaagtattcagccgtactcgatgctgttagtgatatgttccttactaatattccaacaagtacaatatctgatcttgttaaacttcagttaagtgacggtacagcatggaatatccagacatacagtattgaaggaacaacccagccacccgctggacagggtcctgcttatctcgaaataactggtcttagaggtgcttctgttgtgtatccttatgcagacagtattaatacagctatccagcttatgagtaagattcagaacggtgatgtattcgatgtagatgaatatgttgacagtctcaataacaattctaattaatcaataaaacatacccccggcagccaataaaaccgccgggggtatattttttataatccattattataatatataattatctataacatatgccacaccacagtcatcgttagatggtgcattgacatctgcatatttcttaacttcaggatatgcattctccataaccgctgcaagacctgcatactttaacattggaatatcattcattccatcgccgcatgcaacgagttcttcacttgttatatcaagcattgtgagcagcttatccaaagatgcatcctttgcaactcctgcaggtactacctctaagaaatagctctctgaaaaaaatgcattgattactccctcatgcttatctaacagggctttctgtaccggaataagcttttcatgctctcctacaaccagaaatttctctacaggataatccacaaatttgcacaaatcatctactttcttgattgtagtgctgttgcatattgcttctttctttacatattcatcagaatcactctcagcagctatctgcgtatcagcatatgtcagagcatacacaccgttggctcttgcaagactgcatatatctgctatacaatcctgtggcattattgtcgcagacatctgcttccctgtcttgcagtcaactatacagccgccattatatgccagtatataaccaccttttttgtcaagctcaagctctctggctattggtgttattccaaaaagcggtcttcctgatgcaagaataaccttaacacctgcatctatcgctttctcaatcgcttctttgttgcccgctggaactttcttctctctattagttaatgttccgtccaaatccagtgccaatgccttatatttcatacttctctatctcctcttttagtcatgtatgaacaatttagcatataacaccagtgatttcaacctaagatattctcatcatgttaaatgttgtatatatattcagttttccataaccagctacagggttaggatataccatatattctgagcgtactgcacctcttataagctgtgctttaatatcgttatgattaatcatctgactattctttacatttacctgatatgaatataaaagtgcaacacatcccccggcataagccgctgcatagcttgttccagtaaccttaacacctccagatggagcaattccatatacccccgcacccggtgcaacaaaatcaggtttaatccttccgtcagcgctatatccacgcccactttcataataagcagcccctgtataatgattatatgctcctacacttataacaccatcagctgccgctggaactgtaagtgttgtatccgggtcggattttaaaaaatatatatcctgtccggaaaactgctttaatggaagccatgcattataacttccttttatattagtgagactatatatatagaatttccatgtaccctcaactggtgtcttaagtcttacgaatataacctccattccagcaacattttcagttatctgataatctaccgtaaccgtacttccctcataaagaaatgtatactccatacttgcacccattcttgcaggtattcttggaacatattcccctgacggtgattcaatcgacacggataatatatcaagactatccgcccatatttccatcgtaaaaccctttcctgttccatcaacattaatttccataacatcaggtaccagggctgacattactgtccctttataatgacatttattattagcttcattgcccatacatgttataactgatatattgggttttttagtaagattctccatcatttctgccagaggagatgcgcctgttcttgaaccattagcacttcccagaccaaatattattatcaatggttttccaagtcgtatagcgtaatcttcaagaaatcttaaagccagcataatatcactttcctcaaaagctggaacgtcatcctttatcagaaaaaaatctctcagatactgtttactttgttttaatttaaccactaaaagttctgctcctggtgcaacgccaacatatccgtctgtatatgaacctgctgatattgaagccagcagcgttccatgtcctgacgtgtctctttgtgcaacataagaatatggattttctccgttattgtcagcctctattgccctgtctatttcatccttttcatatactctgccaaaatgtgcatacgtatttgcaacatcagtacctgttttatctgtctgatcccatatagcctgaattcttgtatttccaagtctgtccttgaaaacatcattaagataatctattccggtatccacataccctataagaacattactcccgtctgcctgcagattatcctgtccaagtacccgtaaagcacctatttcatcaagtgcacttatatccgcatcgccttccatgagtccatataactttggaatagtaaaataccccagagagcttatattaagctggcggttatcaggcagttctccatgagctataatccattgcgaatcagctctctgcgaacatatccctgacaatgccttaatagcttcatcagcccctggagtatcttctattatgtaatcatatatattctctttggttatatcaaaatcacatgccataacatctccttaacataaagcaatcactgtacatgctatatgtattcagaaatgtattgtattattctgctataactattatgctctcatagttattaccggagcacctttcttttcaacaacatcttctgtaattgtaactgaacctatattgctgtctttcggtatctcatacattatatcaagcataaaatcctcaataatagaacggagtgctcttgcacctgtatctttttccattgcctttcttgctatgcttcttaatgcatcatctgtaaactcaagcttcacctcatcaagctctaacagcttctgatactgcttaagaattgcattcttaggctctttcagaatattgacaagcatatcctcatccagtctgtcaagtgaatatatgataggcagtcttcctaaaaattctggaatcattccgtattctctaagatcatcaaccgtcacataagacatgatgttcttctcatcatcatatttatctttaaggtcagcattaaatcccattgaggatgacttattaagccttgtcttgataatatcctcaagatccggaaatgcaccaccacatataaacagaatatccttcgtgttaacagttacctgtggaaccattgcattcttacttgtcgcaccaacaggaacttcaatctcactgccttctaacagctttaacattccctgctgtacagactcaccacttacatctctgcttctggtctctttcttcttggcaatcttgtctatctcatcaataaatataattccatgttcagctttctctacatcattgtctgctgccagtaaaagcttagaaacaactgactctatatcatctccgatatatcctgcctctgtaagtgttgttgcatctgtaatagcaagtggcacctgtaatatccttgcaagcgtcttaacaagatatgtcttaccacttcctgtaggtccaatcataagcatattagacttctcaatctcaacgtcacccagaatcttagcatctgctgaaactcttttataatgattatatacagccaccgacattaccttcttagcatagtcctgacctataacatactcatctaactttctcttaatctcatgtggtgcaggcagcttagaaacgtcaagcgctggtaactccttcttattctctttctttttcttaagcttctgcttttctggaaccgggtctgaatccatagcgccaaaattgccaaacatgcccattccaggcatgtttgacatcttcatcatatcttcataattaattccgctgctgttaattgaatcgaatgttctttgcatacaatcctgacagatgtatatattgttaggcataacaatcatcttaccagctcttgattctggtcttctgcacacaaaacatatcttctcataatcatcggaattcccattgttattcttattaatatccttatcttctgtcatattctcattggtattatccataaatatatacttggaatatatccttaagatgccttcttagaaccaagcgttacctccgtgctcttaagaacatactcgcttccttccatatgataataatctatagttactttttcacctgcctcataataatactgaagcatgttagtaagtcctgacatagtagtaactgtctggtcatcaaatccgacaattatgtcatatgtctctaatcctgccttgtctgctgctgaatcatcagctacagttcttataagaatacctacaggatatccataatatgatgcataattacttgtaatatctactgctgcaattccaaggtatgctgccttatctgatgaaaccttgtttcttgtctgcttagtcattaatgaatcgataatatccttaacattagagacaggaattgaataagccataccttctacaccatcactgcttgtttttgcaaagttaatagcgataacctttccttctgaattaagaagagctccaccactgttaccagagttaatcgctgcatctgtcataagaagtcctgtaaatgttacattgttgactgtaattgaacggtcctttgcactaattataccagttgtaactgactggccttcacctaatgcattaccaatggcaacaacctgctgtccaactttaatatctgatgaatcttcaagttctgcaattgcaatattagacgctgtatcagatgaaatatcacttaatgatactgcggctaccgcaatatcctgatctgacttagaacccttaacagaacagcttgcacttgtgccatcagagaatacacatttaagattatcaatattatcaacaacatgtgcattagttacaataagtaattcagtatcactcttgcctacaataatacccgtaccacttgatgttgcttcatagctctgtccatatccaaaataacttgaatttttaactgttgttgtaccattgagctgaaccattgcaggaagggctgctgtagcaaccgcctctacatccatcttacctgatgctgaaagattagtatcttctgtaagcgaagaatctgtcttagcaacattagaaatattattacttactgttggtatattaacacctgtagcatcagacttattactgccagcaatctttccgcctgcataattaacaccaaacataaccgaaccggctattgcgccaaaaagtactgctgaaagaacaaagcatgctgctttctttgcaaatccgcctttgtgtttcttgtgcttcttagcttcataaggtgcacttgaaaatgctgtgttattattggctgtactgctattattagtattgttatatggtatatcactgccactgtaacggtactgtgaatcattctcattattgtcgttatacataatcattctctccttttaacattgtattatgacaatgaagattccatacataacaaatgaacacatctcactgtcaatacatgtaatataacaacgaaatgtgttcatattgtgttttagttgttaattaaatttgaactgattataaaccaacaatttcagaaactgcatcagtaagttcttctaacttcttatcagcatcctcaagacctgttcccttaacacccatatagaacttaatcttaggctctgttcctgaaggtcttgcacagcaccatgcatggtcattaagttcaaaataaagtacgttagattcaggaagtcctgtaggcttcttctcgcctgtagcaataactgtgcactcatccttcttgtaatccctgaactcaacaacatcccatgccccgaacttcttaggtggattatttcttaaatcatccatcatcttagcaatctggacagcaccttctgcacccttcatagttacagccttctgtccttccttgaagtagccgtacttatcaaagatattaatcatctgatcccataaagtaatgcctttagacttatagtaagctgctgcttcacataatgccataacagctacgatggcatccttgtctcttgcatgagttccaaccaagcagccgtaactctcttcaaaaccgaattcatattcgtatgtattattctgctcaaagaacttaatctgctcaccaatatacttaaatcctgtaagaacttcaataagctttaagttatattccttagcgataagatcagctaagttagtagatacgatagtctttacaaatgcaccattctcatgaagaagtcccttctcctttctctgtgaaagaaggtattctgcaataagcataccagacatattacctgtgaatgacttgtactcacctgatttagtgtccttagaatatacgccaagtctgtccgcatcagggtcagttgcaagaataatatctgcatcaacttccttagcaagtcttaatgcatatgtgaatgccttagggtcttcaggattagggtactcgagtgttgtaaagttaggatctggtttttcctgttctggaacaacatatacattcttgaaacctaactctcttaaaattcttcttacaggaacattacctgtaccattgaatggagagtatacaatcttaatatcatcagcaacctgcttaatgatatctccgttaaggctctgcttctttaatgctgcaataaatgcatcatccatatcatatccaataatgttatacaggcctcttactctagcctcttcttcatcaatagtcttaacatcattaaaatcagtaacagccttaacttcattgataatctgtgtatccttaggtgctgttatctggcatccgtcatcccagtataccttatatccattgtattctggaggattgtggcttgccgtaaccataatacctgctgtacagtgaagttctcttactgcaaatgaaagttctggtgttggtcttaatgaagggaatatgtataccttaatgccattagccgcaagacaaagagctgcttcctgcgcaaattctcttgacattcttctattatcatgagaaatagcaacacccttatcctgtgttccttccttgataataaaattagctaacccttgtgttgcctttcttacaatgtatacattcattctgttagtaccattgcctatgacacctctaagtccgcctgttccaaactcaagatccttatagaatctgtcctcaatctccttctcatctcctgcaattgatttgagttctgcacgtgtgtcttcatcaaaatattcattctcacaccatgctttgtaagtttccatatagcccataccctttacctcttttcttgatttatattagtcctgtaaagcttttctaaagctctcagaaactgctttcaatgcttcttcttcgtccggaccttctgctatgagagttatctcatctccacagccaacgcctgatgcaagaatagatataacactctttgcattaacaaccttattcttaaatgtgaatgtaatgtgtgaatcaaatttaacagctgtatcacacattgctcctgcaggacgaagatgtattcctaatgcactcccaactagtatcttctcacttaccatatgaatcacctctcaatttctagtcgtcactgatgttgtttcctgagtcgactgagtagtttctgtttcctgggtattatccttaaacaacacattaacggatgctgctttctttaatgtaactccatccggaagtttaaccgacaatgtaatgctttgtattcctgacgtagtatatgtagacaaatctgcagtcatcgttatggcagatgcgtctaatgcagcaattgcagtctctgaaccctcgacatctattgaaaatgttctatcctcaaagctgtagctcattccggtttcaagtccactaaccttaatatctgatgtattaagtgttattgtcttattacctgtactctcgattcttactgtaacctcaatccttgcattatcaagaattgtaagcgatttatctatgtaatccgaaagaccaaacttatacactttattttcagtcaaaccatctacattaatattacttgccggaataacaatcttatcaagactgttaagcatattggtatcaccatatacaacaacactatcacgattaagcgtcactcctgaaactctgtatccgtctgccggttttcctgacgtcttaacttctatacttacagtcttagtccttacaacctgtgcagtatagcccacacttgtctgtgtaagttcaacagaagaatcattaatttcattattatcagaatcatacaaatgaatatctgctgttcccgtcacatctgcagtcgctcctgtcacatcaaaagatatccctgcatggtctatattatcgataacagacgaaggtcctgtaaccttaacagatgttggattaagcactcttcttaccactgcatagccatctgccgctgaaccggtaatctctgaaacaacatttacagtcttagtatctctgttttctatgcttaatcttacagcagatgttttaggtgtagcttcaacattattaagaacctgtccatctttaacaactgatacatgaatatcaacataatcagcaaatgcgcttatcttgctaagatccgcagttgcaacaatatcacttgctttgatattagtaacaatactcttcggtccacttacatatactgatatcttgccaccctctacaatttcataactgtaattcttatcagtcagactctctgtattaataagctgtaccgacacattactgaatgtataactcgtggttggatcatatacattaactataaccgtccacaaaacaaccgcaaatatagccgacagaatcttaaggctcaggttcttaaacatcttttccttcatgctttagccttcctctccatatcttgaacgacttcacatcaatagttctcctgcgaagatattccagcttgtttctaagagaatccgcatcaatatcatgaataagttctccaccaacagccaccgaaaccttaccggtttcttcagatactataatagtcatactgtctgtcacttcactgataccaacacctgctctgtgccttgtgccaagagccttattaagattgttattatctgaaagaggcagataacatgttgcagcaacaaccctgtctccccttataataacagctccatcgtgaagcggcgtattatgctcaaatatattgataagcagctggcttgtaaccaggccatcaaccgtaattcctgttttctcatattcttcaagaaccatatcctgttcaataactataagtgctcctgtataagcagcccccatatcaaagcatgcccttactatctcttctgcagtcttactgctaaacctttcacccttttctcttccgtcattaaacctgaaaagtccaaacagaatcttctttcgtccaagctgctctaatgctcttcttaactccggctggaatataataacaagtgcaataataccaacactgattgtctttcctgcaatccacagaatagtcttaagattcagaatatacgcaatcagtgcgaatataacaacaataataattcccttaagcaatacccatgccttggtattcttaatccataccatgacattatatataacaaaagcaataatcacaatctcaataatatcggtccatgttatacgcggaatatataatttaacaagataatcccttatgaaattattcactgtattatcgcctccgttcttcttataatcttctaaataaaactagcaaaatatattctgatgattacttatcatcatcatagaataaaatatcatcatcttcttcgttagatactgcatatccattatctttagctgtatcgccggttctcatctgtctgatatcatctgtcttcttagtctttttagcattaatatgcttaattcttacatcagcatttgcaacattaatctttggtacagcctttacataataataatattcatcatcctcatactgtacatactctgttctcttataatcaagtgcaaagaaaacaatattgcagatatatgcagctgcaacccccagtatagttcctataattataagaacaatattaaaatctgatttcaaagctatctgtcctacaaccagaataaggaactgtgttatacttcccacaataatagctattttccatgaatgatcgattttctgtcttcggataatatatacaacaataatagtaactgcagctgctataataagcaccagcatctgtctgttctttaaaaggctttctataagataagatatctgtttcatactttctgacaaagaatcatcagaaatagcagcctcataatcacttgcagttcttattatgtagtacataataacaccaaaactcactggtataactgccgcaactgacgaacacagaccaatcgctaccggaagcacaaatggtatcttcatccagcagaacatagcagtaataataagtatataagctgttttaggtgcaaatctgaaatacagaagatacatcagaagcattacacacaataccagtaatgcaaattccggagcaattacatacaactgtataagaataaacgctgaaagaactatcagtgtaaaaccacccggaagaaatgcacatataacagaaagtaacagtgcaaacaccggattcttcaacttatccatgtaaccaatacttgtattaatcataataaaacatatcaatgcaataataaactttgatgctggtaccacatatgtattatatctgttgtaaaatttcttaaaactttcctttaattccaataaaaatgccatctatgcctccaaataattatttcttcttctgccctgtatagaatctttccagcttattaagccttgaaaaataccttttaataccttttctggtattctcatatctgaaataatatacaaacccggcaattacacagaatacgataagcataagcacataatacaatgcaaacttcttggcaagtcctatataatccaggttattgatatcccttatcattccttctgcgttacacaagaaatacatcgccagaagaatcactcctgcaaatgtagtggcaatcactgtctttaatactccaaaagcgatgtaatcacccttaaaatacttggcagttttcaacatgctttttccttcattcttctcatatattgccatcttggtcatcattttgattttattctcattaagcaattcattcacctcattaaacaagtttaacctgcatatgtttaaatataacatatttttacttaattgtatattacaatttgagagtgtccgccacctgtagcaactacaatccttaccattcttccatcaactgtaaatgttctgtctgttgaagccgaaagataattattccatatcatctgtgaattaccaggaatgagattctcgattacattattaatcctgccgtcaaattcactgttacgtttcttaatatatataatagtcacattactctgtgttataatctcaccataatatgtcccattctgctgacatacataaacattagaaactgtctgttcaaatccattattaataatcgtatcttcaatttctcctgagccagaacttccagaatcattattatcttctgaagatgagttttctgttgtactactgccaggctgtacacctccagactgcaccccaccagattgtacaccatccccactgtttccggttccttgagaactctctgatttattttctcctgcaggcagattctctagtctggaatctccttcactggcactgcctgaacctgtgttgcttcctgacgaaatactccctgccgtatgagtgtacacactgaatccattatctgaacctgcagctacatttcttattccttcgattacaatcgcatcagaaacacttccaactgtagccgtaagcgtagctgtaccactccctataacagttattactccgtctttatctacagtaaatacatctgtattactgcttgtccatacaattgacttatcgtcatcatcaggtgtgacaattgctgtgaccttcaggcttgtcccaaccggtacagccttattctcaaacaatatctcaacatctgtctgctccttaatattctgttgttgagatgatgcttcattcttaagatctgtccttgttacacttacactggctttactgtccgcttcctgcttctttctgttcttatctgtacttactgaaattataattccagccagtatcaaaacaataaccgctgcaataagaactactgattttttagtactgatattcttcatattcccattaatcctcaatatatattatattccctgcttccgcagattatatctgtttttctctttttatataatataacacaatcactctgttataaaaagaaaaaagagtgaaagacataaaaacttccactcttaatcattctagaattcgatgcgtatctgtgtccccttgtcaacttcactttctaaatatattcttgcatcatgaagttctacaatatgctttacaatagcaaggccaagccctgttccaccagtttcctttgaacggctcttatcaactctgtaaaatctttcaaataccctgtcctgctgatccttaggaattcctattccatcatcagtcacttctaaccttggcttgccatctaccattcctgcaaacacttctacatgtccaccttctttattatatcttattgcattctgtacaagattatcaataagctcccttatcatatccttattgccacgaatcatgcatgttgaacctctatacgaaaaacgtattccctgtttctgtgcattaacctgcagagactctgcacaatccttaacaaactcatacaaatcaaaattctcatactgccttggcatttcgctgtggtctaattctgaaagccttataatatcattaatcaatgataataatctttctgaattacgcttaatctcatgtgcaaaatgtattccctgttcatggcttaccatctcattctcaataagctctgcatatcctgatattgcggtaagaggagtctttagttcatgtgatacatttgcagtaaaatcctgtctgcttcttgcagcagcaagaatattctcatgctgtgtcctgattttctctgcaaaaggggctatttctttatatacaggcttctcctgtacggaatccatattcttagccattctttcaataggctcaataagtgtccttgtaagtaattgtgaaagaacgatacacactactataattactgcaagtattcctgttacagccggaaatacattgccaaacacacttaataaactgcttgcatcacaggatactcttataacagtcccatccttctgttttagagcataataaaaggtattcatatccatcgtgtcagaatttcttacacactgaccatgtccggtatgaaatgcatcctgtatctcaggtctgtctttatgattaggcattacattaatatcattatcattatcaaaaagcaccaccccatctgaatctatccatgtaaccctgagattattaattggaagctttacatcagcatattgcgacgacttttcaaaaactccggtttccatgagtacttcagcattagttctcagtccggcctggacctgtttcttaaacagtccataatatataaaagttattccgatagctgtagcaagaaccgctataactgctattccaataagccttaaattaatcttctgcttcatatatccaccctgttctgtctgtcaattatatcaggctactcaataacatatcctacattacgcacggttcttatacgcgagcctgcatcacctaacttctgtcttaaagtcttaatatgcatatccacagttcttgactcaccttcaaactctgttccccataccttaagtacaatagaatctcttgaaagcactatattcttgttagccataagatatcttaacaattcatattctttaaatgtaagttcaacttgctttcctgagaccgtaacagcatgcctttcatgattaagttcaatctctccaacatccagcacgcctgcctcgtctgtttctgttcttctaagaagtgctttaactcttgtaataagctccattacagagaatggcttcttaatataatcgtcagcaccatcctcaaggccctttatcatatcaagctctgtagactttgctgttaccataataacaggcagtctcttagttgcagaattcagtcttaacttcttaatgatgtcataaccactttcatcaggaagcataacatcaagcaacacaaggtccggaagaatctcatcaagcttcttaaaaaactctttggaacttccaaatgcacctaccatatgtccactgttcttaagtgcaattgtctctatttcccttatgctttcatcatcctcaactatgtatataagagccatattctcatctcctgttctagtcagctttctttaattccggaagctgatactgtttataatactgtctgcattcttttgcaaactgaggattatcctcattagtaagatgctccagatatccatgtgtttcaaacccattatctcttacttcaatcatacatacagcaatattagagcaatggtctgatactctctcaaaattcgtcataatatcttcgagtataagtcctgtctcaattgtacatctgccttttcttaatctgttgatatgacgctgcttaatctctaagttcagtccatcaataacctgttctaacggctcaatatgctttgctgcctcaatatcctgattttcaaaaacctgtactgtgttactaactatatcatgtaccgcttttgcaaatgtttcaagttcttttcttgcattctgtgaaaaagatgactccttgctgttcatctcttttgcagattttgcaatattaatcgcatggtcagatattctttcaaaatcactcatgcagtgaagaagtattgaaaatgtatgattatcatgtcttgataaatcgcagttaccaacctttacaagatatgaacccagcttatcctcgtacttatcgacatcttcttccattgccacaacctcatcatatgcagtatctgaataattattaataatgtcaagcgctttatctagcgctttctgtgacaaatgtgccatcttcacagccgtattcctgcataactccatcgcaactgccggagtctctaagaatctttcatccagtgctgcaagatttgctgccacacctgtctgaataacttcctcatgttttccatccggaatagaaagagttgcaagcttcacaagcagattagaaaatgggaaaagtataattacacatccgatattaaagagactgtgaatcactgctattcctgctgcatttgccggtgttgataaaaattcaaaatgaacaaacatattcaggctgtaaaatataaccataaatataactgtaccaatcatgttgaaataaaggtgtatcattgatgccctcttggcattcttctttgcacctacagaagatataagtgctgttacacatgtacctatattctgtcccataataataggaattgctgttgcatagttaaccgcacctgttacacataatgcctgcagtataccaaccgatgcagatgatgactgtataactgctgtaagcactgtacctgcaagaagtccgaataacggattagaaaacagtgtaagcatacccgtaaacttctcattgtcagccagcggtgcaactgcgccactcatagtttccataccgaacataagaattgcaaatccaagaagaatattacctatatcctttttcttagaattattcttacaggtcatagtcataattataccaataacagcaagcaccggtgagaaggatgatggctttaaaagattaatccatcctgctccgcttatacctgtaagcgataacatccatgaagtcactgtcgtaccaatattggcacccataataatacctacagcctgtgaaagctgcataatacccgaattaacaaagcctacaaccattaccgtagttgcagatgatgactgtataactgctgttacagccataccaagcaatactgccataattcttttagaagtcagcttttcaagtatctgttctaatttacctcctgacagctttgctaaggaatctcccatgacattcattccatataagaacaaagccagtccgcctgccatcgtaagtacaccaaaaatattcattttacataagctcctttttgaacgactttttcacacatcatgtgtattctaaatgagcattgtaaaatgtattatgtaagttatgtaaaatttatgtaaaatttgcaactatgtcttttatacggtctatattaacaggttttgcaagatgagcattcatcccacaatcaaatgcagcttttacatcattagaaaaagcatttgctgtcatagctactattggaatatcctttgcatcagggtgcttcatttgtcttattgctcttgtagcctcatatccatccatgtcaggcatctgtacatccataaatataagatcatactgccccttctttgaatgtctgaacaaatcaacagctgccattccgttttttgcacaatcacaggctgccccctcttcctttagaagttctttaagcatatctaagttaataccattatcttctgctattagaaaattcttacccacaagtacatgatccggttcattctcatgctttggtatgttatatctgttccagaggtctttattcgtattaatatccgcaattctgaattccatagttacctcgtaagttgttcccactccctgtgtgcttagtacctttatagttccacccatgagatcaataagattcttggttattgccattccaagtcctgttccctggactgcatctgtaaggcttgtctcttctcttgtaaacggtttaaatatgtcttttaaatattcttcactcattcctattccattatcagatatgatgaatttgtattttacaatctgtggattggtaacttttatttcttttatttcaaatgttatgttaccgccttcttctgtatatttaacagcattagacaatatattaataagtatctggctgagtcttaatttatctgcggtaatgcagcaatattcaacaccatctgatttcacaacaaatgtctggttcttcttctttgcctgcggtctgattatattgtctgtctcatttatgatgtcagcaagattcacgtcacaaagattaagagtagttttccctgactcaattttactcatatcaaggacatcattaataagactcagcagatgctggcttgaaacaactatcttttctgcatagtttctgactttatccggattcttataatgtcttaacataagctgtgaaaatcctacaattgcattcataggagttcttatatcatgactcatattagacaggaactgactttttgcacgatttgctgcctctgctgtatgaagcgcatcttccatatgatttcttatctgctgctcgtaagttctgtctgacagaattattacaagaacatcatctccgtctttatccatatgataacatccctggttaaaaagtctgtattcacttgaatctgctggctttatccagtattcattaacagcagattctccttttcccagcttcacaatatcattccattcaggaacttctcccctcttttccaattctccaaaatctttaaggataccatcatattcactgctccttattcccagaactctctcgatatttctgcttacatacagttttctccagtctccccacgaaagcataatatacacatcatccagatttttagccataatcgaaaataatatatcccgtcttacaatctcatgatccttctcacttacatatcttttgtaatatgtatatagtactacacatgcaaccataagaagcagtatacctatctgtactgccattataacagttctatgcaaaaccgcaagagagcttgaattggcgacgcttataggaaccattgatataagcccccagttatcaaatccaattggaacataaacaagacaatactggttttcatcaagcctgaataccatttcttctgcatctgaattctttacacttttcataaaaccatccagtgacttaccggaaatatccgcatttttcagatgataaaatatattaccacctatatccatgctgccttcagactttaatacgatatcaccattagcatatattacataactgcttgtgtcctttgaaaacgcttttacacccagttctttattaatagcttctgtattgtatgaaaccgctatggaactgtatttaaaaccgctaatatatgccggctggacaggaatagcaaaaaacattacctcatcacttcccggaagtgaaccatccactacaacatttttcctgtctatcacaagacttttccatgtatttccgagttcaagatacccctttttacctgacgatgacaagtaattacaggcatcatctataaaataaaattctgtgtaatgccattcattcttccattctgtaagaaacttgctgatgctgtctatattttcaccagcctcatctatataatcacctgtcattccaagcaggttccactgctgcccggttatctgcatgaatttttcactgacctgtgtatacacttcattaagattcttcaaacttgtctcatacagttctcttttgaccgtaatggaataattaagcattattacgcctacacacgcaaatacaattattgccacgcctactgctgcaaagaaatattttctatactcattcttcttcaattgccccatttcctttctcaagataatcagttcttctgtatataagcttctggtgcagccagtctgcctccatcagaaaaatactttatccattgttgttctacatttgttgtatgagctatatatccatcatatttttcgccttccctgatgtctgcctcagccttatacatatgaactccgccatgctttgacatatcataattatatgcacgttccaacaaagtatgaccagaaacgtcaacataacagaaagaatatattttttcgtcttctactgactttccatctgtaagaatatcctcaagatgcatattgcccttatcatctcttgatatcttcattgtaaatccgcttgatgccggcagcgtatcccatgatatcgggtcgtcatcccgcccacagccttccacaaggcaccgcacaacatctttaatctcagcacctgttgcatccttcgtataaaacttcactcctccacccattagaagtgcctgtaattgtgctgctgtataacttcccttatagatgtctccggcattcatggcagcaggtgcaatcagcatatccacattacatatttcccgaagcgtattaaccctcactgaaaatgcctcacttcctgtatctgatacccgccactgatactccctgtcaaatgtggtgataaccggggatttttcttttaccgcattgtaattattgttaaacactttcactgcctgctttgcatccacatctcctgccagcattttctgtactgctgcgcagcttgcccggcacacactgtcattccttatatatgtatacatatgattactttcaatataaggaatcaggttagaaaatatgtcctgcacatctacatttacatctttattatacacaacaaccgactgtatcctgtctgccattgcattcattacatcactgccaaacatatatcttactatatccagtgccagctcttcttttttccctgctcctttaagttttccattcatagctattgaatatccgggtgtactgaaataccagttatcattatctgtctccccaaaatatggcaaaagaatgagattattcattccctcatcctgatactctgcaatattagtgctctgtcgtatcattgcaatcttcccggacacaaaatcctggaatatacttgaatatcctctttttgtgtcatctgcctgtgcatcagtatctttcaaaatctgtccaagtctcgagaacaacttcacacccagctcatccggtatgtaatctatatttccatccattgcttcataacgccaggtacgcccttctgtactttgtaacaaaggaatcgaccacgcctgtaacatatatgaagctgtataatcatatttataatctgttgcaaaccctcttatcccatattcactgaatttatcacatgcttcaacaaacgttacataatcatgaggcagttctattccatattcctcaaaaagtgctgtattggcaagtataccctccacgcttgctgcaccaggaagccagtttactgaaccatcttcattggtaaatccatcaagatataccctataaaacatgtttgtaatatctgtccatgaaaaatcatacagataatccttaggattaatatcataatcatcatcaaacaaagacgtctgtgtccacgatgatgcatctattattatatccgcaaggtcatcattaagcgctgcatcattaagatactgtgctcctcccctgcttatgacaaaatcaaattcaacatccggaaaatgttctttcaacatttttcctacacttgcaagccagtaatcctggtcaagctgtacaactattctctgtttttcttttccactgtttcttaatggtatactacatgacaacagcatacttacaatcaatactgttaccagtaaaacacatattatccgtttcattctatcctccaaaaagactttacccttatgttttatatagataatacaacgtatgcatgtcgaattatgtcgaataggaggagaaatcaataaaaagcctgcatggaatgcgctatttgcagccatacaggtctttttatatttacagtatatacatatatttcatattcttttaacacatatcaggcttgttccataggttaagcttcgttccgagtcccattttcacagcattttcataacataccttaccccaggcaacatcttctacaggcattcctccaacagaatatacaattatctgatcatcactgtctcttcctgatgcattgccaagcaatatatctcccatatcagtaatatcacttttacttataattccatcatggcacatatctgtaaactttgcacctattatgttaattgaaccaaatgtcggatatggatattcctctgcccatgcctcgtaaagctttatattatcaactaccatcttacatttttctttgagaaaatctgtctccatatcaaatgcacttggagcaacaataagcgctcccggctttatccattcacctttgacatatgcatattttgacggatctgttcctgctgtggctgcaaatgatataacatcactgtctcttaccagagtttctatatcatctaccactgttacagttgtaagctgtggatatgtagctttgacatattcaaggaaactgtctaatgatttctttcctctaccttttaccttaagtgtatcaagctctgggcatgttgccataaatgcatcaaggcttgtttttcccattacaccaggaccatatattgctcccgtcttagcaccctttggtgcaagatgtcttaaccctacaccaggaattgcaccagtcctgtaagcgctcagaagattaccgctcatcagacacaccggtgcaccggttgtcttgtcattaagcataaccataagtattgaccttggcagacctatttccttattagctgtattagaaccataccatttcataccagccatatcaaatggtcctcctatatatgccggcattgccataaatcttctatcttctcctacattctttggcatattcggaaaaggagattcattcgggaatgttaccatacagccatgagaattatggttttcacctcccattacgaaatcaccctttgtaagacatttaagaacgtcttccattgtatctatgcatttaggcatattctttacgccagcctttatcatttcctgttcattaagatataaaaaatcaacttctggatacataataattcctcctctataatccacaacctataactgcttccatcattatctccacgaactgtgtcggtctgttaagtgcaggtgttccaaccactgtacataatggcctgatatcatgaaatatctctgaatatgcccttgatatatctgcacacattttcatatctacagcaaacacatctactttaataacatctccaacacctgcaccagcctgtccaataagctttacctgcttctcaagtacatatctggtctgctcataggcattttccccatacactgtaccatccggctgtaccgacgttgttccaccaacatatatatggtcaccaacctttaccattctgctatatcctactttttcttctaatggagctcctgatgaataatttactctcttctctgccatttagtttacctctccttctgcacctgcaagtgccttttcttcattttccttctttacaagttcattgaacttgacagaagcatcatttatcacttcaaccggtaccggctggaatgggcttgctttcataactccacatacccagattattgaatagactacaagtccggcaaataaaactccacacaactcaaatatcttaattctggtttctcctgttgatatattccatatcatgtatacatttccaagaatacctattatctgaggtattccgcctaatgtaagccactttttccttggatattcaggatttctctttctgagtataagcactgttacatgtacaaggcagtatgttaataaccagaagcatgaacctgacaataacagaaaacttataccctctgttgccccaagtcctgaagcgattattcctgcaacgaatacaaataacactacaagtccgacccatgctgcgcctctcttgtttgtcttagcaaatactgatggcatcatgccttcctcgcccataccctgtacaattcttgaaacagaagcatatactgtattaattgtcgaagcggctgcaagtatggttataattcccatccatatacgtcctgcatttcctaaaaggttagtagcgtatgtcatatgaggagtacctgcagggtcattggcaagaatatcaagacttacatagttagtcattcctataccaagaatgctctgtacaaaaaatagtaaaaccagacctattgtcatagaaagaagtacatctcttcttggattcttcaaatcctttgctaccggaataataaactcaacacctataaacagccagaatgcaagtgcggcatatgagcaaagtcccttaaatccgcctatctgttcaaatgttggtgcatttgctgcataatcaacaacatttgagcttattcctaatttacatacacctattaatccaataagaaccattgaaccgataagcaggaatactactatgttctgtacctttgaaaatatatctacaccaaaaagattaatcacgagaaacaatgccattattataattgatattatcctgttatctacatgtggcagaaacagaccttttaaaacaagtccgcaaagtgtaatctctgctgtcatgcttaatatttctgtaattacataggctgacagattaccaattaatgatggaagtggtcccataccagccagaagatactgtcctgtaccgccctgaactcttggcataagtccattcagttctgcaaatgatattccaataaaccagttcagcaccattactgcaaatagcggaatgataaaccatcggcctatcgaacccattcctgttcccaaagaaacaagacagcttgtggcaacaataagtcctacacatattgccacgccacttcctaatcctaactttttcttcataaaaccagctcccttccttttttgcatgattaattattaacaaaataaacaataaaggcgccgcacaccagatgtacgacgcctttgtctttgatttattaagtttatgatatggatactacagtgttttcatgaaattgtattgtaaaaaaaagaactgtaatgtattatttcttaataaataatcagaatattactataatacaagacataaaggagggcttatgtgtacagcagctacttataaaactaaagatttctatatgggaagaacactggattatgaattttcttatggtgatgaggtgactgtcacacccagaaattatcctattaatttcagattcatgggtgtcaggaataaccactttgcgatgattggaatggcacatgtcgctgacgattatcctttatattatgaagcatttaacgaaaaaggacttggcatggcgggtcttaacttcgttggcaatgcagcttacaatgaaccggaccagggagcccttaacggggagagtaatattaaaaatgttgctgtatttgaattcattccgtggatattatcacaatgtgcgacagttgacgaagctagagaaaacttgcagtttattaatcttaccaatacacagtttaatgatatgtttccatgtgctaatcttcactggattattgctgacaaggaaagctgcataactgttgaatccatgtcagacggacttcatatatacgataaccctgtaggtgtgcttactaataatcctccatttaacatacagatgtttaatcttaacaattacatgggattgtctgcaaaacagcctgagagcaatttctcggacagactcgaattcaacagatacagccgtggtatgggtgcactcggacttcctggggatctgtcatctctgtcaagattcgtaaaagttgcttttactaagatgaattctgtttcaggtgacgatgagaaatcaagcgtaagccagttctttcatatattaggcagcgtagaccagcagcgtggctgctgccagctggacgataacaaatacgagataacaatatatacctgttgctgcaatacaactaaaggcatatattattacacatcatatgacaaccatcagatatgtgctgttgatatgcataatgagaaccttgacggtgataagctggttcgatatccacttattactgatggcgagataagggctgttaattaatatatatacctgacaaaacgagctggacgtttaattaccattcagctcgtttttaacacatttttctatgtcgtacgcaatctcagtgcatatatcttttcctatccctgctgctgttccaacagcagccagctccttaatccctggatttcttccattgccgtctactgtagtagtatgttctccataatatgtcgtactataagtcaggtcatatgccgggcttagtctccagccatcattattttcatcatatataaatgtaaaattctttgaatggtcatctctgttatgtgcaaacacattaaaacacattcgtcggtacatattttctatatcatgcttattgtcccttgttaatatttttgttaatttcataagttggtgataatccatattgggctgcctgaaatccagttcaagaagcgctgctgctgtaagcatatggattctgtgttctccaaacgaatcattcttacgatcaaatcttttagttccaaaatatccatcacatatatcagatggaaaaagtctggtctcttccatatcaattccacactgctttgcacactgtgaatatcggtattccatcagccccgcattctttccatctacatgagcaggaaacttgataatccaatcctcgtcatctatcttagtcataattttaggtcttgctccaccgcttgttccaccaagcctgtataattcatcaagcttgtccgaatattcagtattaagaattttctgacattgctcagataattcatcaagactgctgagtttttcctgctttggcatatcccattccggtctgtatgttaatgctcccattcctgattctccaacaattgcaagcctgtcaagcatactcacattgtctatattatatcccttttcttttaacatcctgtcaagcagcagctgtccccatgcatcaggcagactgtctgcaaatactccccataagccattaaaataatctttaaccgggacatatactttcttttcaagaggcaatgaaaacggacttattgaaaatccattctcaagccattcatctgcatattcaaatgcagcttttctttcgttcgtcatagcaagagttccaacaagcctgtcatgaaaaaaaacatttataattctatcttgtctcattaattacctcctcaatactgttataaggaatctctgtaaaaatgtttcttaaatcatcagcaatattaagtgctacagctatcttagtcaacgataacagtgaaatctgtcctgttgtttcaaatctttttatcgagccaagactgacattgctaatcttagaaagcttctcctgcgaaatggagcgtctttttcttattagtcttaccctgtcagctatttttttatccagttcttcacatgtctcccagacatattcattcatatattaatctctccttacgtgtaaacatctatataatatattagccattttactgataaatatacatttatagccaatattttatctataattattataacacataacttaatatattcaatcctctccttgccaacttcccagaatatgttattatatgatagattattacaagtgtttaaagcacagaaagaggaatatatgttagtttatgacgctaatgccaattctggcagcactgccggttttgagtgtacttatacaacttttaaatcagacaattctacagcttccccagagaacccaatccttgttctggataattctgagaagcagtgggatgagacatcttatggtttattcactaacccttataaaaaaactgcattcgatttccagattgatggtgagtcttttacaagcaatatcttaaagattgattcaagatttacaagccttatcaaatggcttggcgagaacagagttaaagtaaagcttacaggtgctaacacatctgaaggatacaatgtatacaagattcaggaggttgcatttggcaatggtaacaagttatctgccgaagacggtttccttcagtttatgattgaaagattattagagagcagtgccattgcagaggaaaatagtgaagaacccgatgaatctgctgatgatatgaagcttacaagccttacaagcatatcagattttcttaactgtgcaggaagtacacttcctgagaatatccgtttatgggcaagacgcaatcttgttgttgcccgttcaagtgaggtaactcctgaagagaaaagacatgcacagagagcactttctatcatgcttaatatcaagtggaagagcaattacttcgaatcaattgaccctgtggaagcaagaagaattcttgacgaagaacttttcggtatggagagtgttaagcagagaatcattgagactgttattcagattaacagaacacacactcttcctgcatatggtatccttcttgtaggtcctgccggaacaggtaaatcacagattgcctaccttgttgccaagattcttaaaatgccttggacaacgcttgatatgagttctatcaatgacgcagaacagcttacaggaagttcaagaatatactccaatgcaaagcctggtattatcatggaagcattcaacatggctggtgaatctaaccttgtattcattatcaacgagcttgataaggcaacttcaagcaatggtaatgccaaccctgcggatgtactccttacactccttgataatcttggattcactgataattatatggagtgtcttatcccaacttcaggcgtatatcctatcgcaacagctaacgataaggataagataagcgcacctcttctttctagatttgcagtaattgatattcctgattacacaagagaagagaaaaagacaatattccttaaatattcacttccaaaggttcttaaaagaatcgggcttcacgaagatgagtgcctggtgcttgatgacgggcttgacgctgttcttgattactgcaaggatactacaggtatcagagaccttgaacaggcagcagaacatttagcagcacatgcgctttatatgattgaggttgagcatgccacaagcgtttcatacacagcagacatggtaaacgaactcttttaattaaattatccaagtctgataacaaatacagtatataataaggagctgatatcactacgataacagctccttaaataatctttatatatttaattatcagtcatttcttaacttaaactgtgcaaccatttcactaagagttgtagcctgtgctgtaagctcttcacttgtagccgatgtctcctgtgatgttgctgaattagcctgtacaacttctgcaattcttgcaattgcaacatccgcctgctccatacctgcagcctgacttgtagatacatctctcatcttcttggcactctctgcgatagactgaacgccatcaacaacttccttaagtgaatcagatgccttagtagcaatcttatttccttcaccaacctcgtagatagaagcttctataagatttcttgaatctaccgctgacttagcactctgctctgcaagtgtacgaatctggtcagcaactactgcaaatcctctgcctgcatcacctgctcttgcagcctcaatggaagcattaagtgaaagaaggttagtctggcttgcaatactttcaatctctgaaatgatattgccaatcttctcagaagcctcactgatacgagccattgcccccataagagcttccatgctttctctgctgttttctgctgtatcagcatatctctctgcttctttatatgaattttccagctgttctgctgtcttctgtataccttcattaagatcattaatggttgcctgcatctcttcgactgttgcagcctgatctgttgcaccttctgcaagcgactgtgcagcatctgaaagattagcagaaccttctgccacctgtttagaagcatcttcaacaccctttaatgttgaattcatctgacggttcatgttacgaattccaagtaacaatgcattgaatgcacctgtatactgatcttcatgttcggttgcgatagcgaaattaccatctgccatctctcccataagttttccggcatcactgataatattatgtaatctttctgccatagcatgtgcactatctatgagatcggatatctcatctttagtctcaacttcagggaatggtgaatccagatctccctgtgcaaatgtctcgaatctggccatcattccatctaatggctcttctatactctttgcaatcgcatgtgctgctttagaagcaacaacaactaccgcagctataattccaattgcagcaacaatcgctattataagaaatatttcaagctttaatttttctgcatcacctttagcaacattagtgtccataagttcattaagtgcattatcaagtgcctcatacttaggtgccgtctcattcagcatcatcgactgagccttcagtgactgattagaatctgtcgtagctcccagctttataactttctcatcaatttccttatattcagcccacgccttatcaatcttatccatacattccttgccagccttactagacattataggtcttatctgttcaagcttggcttcaaatgcttcgacatgctcatcatgctgctttttcattgagctgataaggcttactgaatcatatcctacaactccccttgaagctcctcttatctctgctgcctcagacatagctgtagcaatatctccctgagggaatgcgtaacgcttcagcaccctgcggtaatccatagacatataaatcatcattgcacttataacaactgcaactacggagaacgctatgattatcagtctaaatacataattcaaacgcccctttatattcatattattcattttctttaacatcttataactacctgcctttccatatgcatcatttgtacaatgtatttaattgttccctatttcattcaattaacatattattcctaattttaatttttttcaaggtattttcacaaaatactcatatgtaattgtctgagtccgtctatttcatcacacaattccctgcttgagcaagttgaacaatccattgtaagaccgttaaatatgttgtttaaggagtcagttatctgttcacatctgtgtgcttcactttttaaaaatatgtaatcaatatcctgctccgtgacaaaatatatgcttacagcctcaacctctgggcgcttcctgtaggcattgataagtccatgtcctaccgctgcaaagttaatcccatgtgaaaccgcttctttactcactctcactggttctctttccctgacagctgatattctcatcatatatcctttaagaaatgcatggtatcttacataatcagtcgccctcattgaagcatacagtgcattatcatcatgatttttaatatattctctgttcagcctgattacagtaattcttgcatatgaaatatcattcttgatatcacacaggtcatcccccaccagatacactgcatcctccgacacaagccccttatcctgtgtaaatgcaatagcactcactgcctgactgcttccaccgccaagttcataagccgtctcgcttttaagaataagattctccttctcagtcatctcccattctttctgtaatggaagtctctttactccatggctttcaagcattgatgtcagttttcttatctcacaatcatataaatccattggatgtttctgcccttcctgttattctttctgtgtattctgttctttctttttctctcgcctgttctttgaccagttgtaatatgcagtaagcggcttgattaaagctgctgcaaatttcatatccagattaaagaaatatataacaagagtcagaagaaacaatgcaacaagcacgattgctataatagccagcacctttaatactatcatacattacttcccttctgtcttgcatattccgcagcacctaatgctcccataagctgtgggtctgtcggaaggtcaactacattaatcttaagcactttttctattgctttcttcaatccttcattcttggcacatccgcctgtaagtgtaacgctgtcagccgcaccggctttcttagccataacaaaacacctcttggcaaccgataactgtattcctgctgcaatctcttccataggcttaccctcgcccactaatgagataacttcactctctgcaaataccgcgcactgtgctgttattggaatcacgttcttcgctgtaagagacagattagagaattcatctaaagacatctcaaatgctcttgccatagattcaaagaatcttcccgttcctgctgcacatttgtcattcatcgcaaaattaagcacggttccatcagtgtcaatcgcaattcccttaacatcctgaccgccgatatcaataatcgccttaaccgaagggtcagttacatgtacgcccatggcatgacagcttatctctgatatattctcatctgcaaatggtactttgtttcttccgtaacccgtaccaatcagatatgtaagttcctctgcgctgtttaaaccgtcaacctggcttacagcctcatcaagtgcgtccttcgcactaagcactggattaatcctgcttctcttagtaactgcagctaagatttttccattctcatctataataacgcattttgtatatgtacttcctgcgtcacaaccaccgaaatatttcattctgctatcctttcctgccacgtatgcagcatccacacttcttaccagctcttagaatcgtcaaaatcctcaagtgacgggtcaagcggttcttccctgaaaacagttctcatgtatctgttaatctccgttctcatgtctcttcttgttccatcctcaggacacataagattgtgtgttacccatattaaatgaattccatgttttcttgcttcttcttcaaataagccgtgatatcctgacattgatttgcagcccatatgaacatacatgattacaatatcaatattaaacatttcgcagaaacgccagagcgcctctacacctgtctcataaccgccgttagaacggtttctcataatcatgttctcatacagatacgcaaggtctaacattgcctggtgtttatcctctgtattgaccatctctgtagacaccatgcttaacatatccgcaatagttaccacgccccagcagttaagaagccagattggaagcgctgtataatatgcagcctgaacgccccatgtcatggctctgtggcggtactccttcgccgccatctctttattcttatatgcatcaagtgccatctttgtaagctttttatccatatcaaggaatgcctgatttcttccaccggccgcctgatatacaccatatctgtagagtgcaagcgttacgcccataacctgcggataatctgtcttggaaatctccatccactccaagaattcctctgtttctgcattaaaccgcttcatactcttaaagaatgcatcccagtcgaacttctcgccagtctgctcctctatgaaatggattgcattgacaacctcttctgccgcatactcctgtacactttcctgtctgtgtcttataggcacagcaagctgaaatgtaggaatcttaaatgaccttgcttcaatcccgttacccataagacttccgtcacatgtcgtattacactgcaccgcacaacagcctataagcgggaaatcatcagccagtgcaacaccaagctcagccgccggcataggacagacatctgatggcacgccatactggtgtgtaacgtcaacataatagcttactccgtcctgtgacatcatcgagcttgtatacacagcaggaacttccactgacaaccatgtaaggttaggaaaacctcccatcagggtactcatcatattttcatcaaaaagaacaatcttgctgtttagcttcttgtcattgccgatagccgggtctgccttaaatatctgtccaagcatcccgcatatatcagtaacgataagtcccagtgcctgatgtgccattctaagctgagttcctctcataccctcggtatgcctgtccatgaaatcaggcagtgcaagataattaatcatccagcggtatctgaagaagcccttcatgttattaggttttattataaatgtaattaaagtcttccagtatccaagccaccttacatagtcgtaccatgtatccttcaatccgcgccattctcttcttctcttcggctttttgcctgtatagaatctgccgagtggctcgcttcctatattcttagacatatttataatttccttcctgcattgatacgcttaatctcaaggctctcaacaaatgcctgtattcttgttcttaactgtccagaagttccgacagcataaggtctgtcaattgaaagaacaggataaccgtatttttctttcatgacatggaatgccgaagccctctcatagccccagtaatcacagaatttaatctgctgatatataaggccatccgccttatactctttagctattgcgtcaacatactcctgtctctcgataatcttttctgtattcatgaaccttggacactgtccccacttcatatactgtctgcatatctgtgtaagaacatcctctgtatcgttaagaataatctcatctcttcccggaagtgaaccaaaacagaatctgtcagccacaaccagtgcgcctgcttcctccgcaagctttataagctcagggttatcaatctctgaaccaaccattactacccttgccctgtaattacattttttatcaggttcacgcgtcttaagctcctcaagtgtttcttcgagcttttctataagtgcctctttcgggcaacagtaggttgcaagacacagaaccgcaaattcatacccagtaattcttggattatcttcttttctgtaatcaccgatgcttcttataagccggcttatcttattctgcaattctactgactttctaagtgcatcatctgatatgtctattccatatgtattattaagcggttcaagcacatgaagtctcatctgcttaacaaaatgtcttaacgccgtctcatcattcttcatcggaacatctgaatattccacaaagaatttttccttctctataagatgctgtctctcaatattctctacgcacctgttcatctgcgcacatgcatccggcgcaattatacagtcaagaaagttaaatccaccctcaattgctctctctaatatcgcacgacatccctcacatagcatactgctcatgtaatatgtacccatctctatagaacctgtacggggtgcacgcagccttaccgaaaagctgcccggcagattaataagcggctcgggtatctgaaaacagactgcaccgattgcaatattacctttagcctgtgcctgccttacaaggtcgttattcacatcctccaacagattctcaaaataatacagattagctaaatccttcacatttgcctcctcttacaatattcccatattaacaagggctttctttgcgccctcaacaataatcgcatcatcagggagattgaacacattttcaccaagaacatctgcctgcgcaagctttgaatcgctctgtattactgaaagcagctcaaggtcgccgatatccataagcttcgcaacctccatatccggtattctgttagcgataactccgattctgtcatacatcacaagctcatctgcaactttcttgattgtctgcacaacctggcatcccttcttgcttgcgtcagtaacaagcagcagatgtgtaaccttctccataactcttctgttaatctgctctattcctgcttctccatcaattacaacataatcgaacttatctgaaagcattgtaataacttctttaagatatgaattaatcttgcagtaacagcccgctgtctcaggtcttcctattgcgataaatgcatatccgtcctgttcaacaactgcatccattatctcatatttggcttctccaagtaactccacagcagtcttggtatctccgtcttcaacattcttgattacttcttttcttatatcatctatagtcttatcaacctcaacattaagcactgtagaaagtccgaccgcagggtcagcgtcaatcgcaagtatcttcttgtcaggatatgcctcaacaagaagctttacaataactcccgctaaagaagtcttaccaacgcctccttttcctgcaactgctataatctgtgttttcttatccattattgttctccttaaaatatgtagaatttaattcttaattatcagtatccaaaaaatgtgctgacaccattcacaagtccatcagcaagtatctctaatgccgcatcactgtggtctgagctggcatttccaagttccatatcaactgacggaactgtgctgtatgatgtctgtgtcagatctatcgccatgcttccagaaccatgaatctttgcaccttgtccacgaagaccgtcaacaagtgatgccccaagtgaatcatgctgctgccagtggtctgccacaggactcatatccttaattgcatcaggaactgctatataaaaacatcccttatcgtatgaaagtccatcgccatcccagtgcaatgatatatgacaatccgcaacattattgcatatcacagttcttgccacattatcaagccgtacatcagaagaatctcttatcatcagtacatcatatccttctgacagaagcctgtccctaaaaatctctgccatcttaagtgtcacttcactctcaggtgtcccatcataaaaagtcatgcctccagataccgccgcagctgtcacagcgccagccgccgtactgcctcctgtactcttaagagaaccatccggatggcacaatgttctgaccgccgaacctcctgccgttccatgcccggcattaactccgacaacaatgttctttctctgacctgacgctttataaagaacagcatagccatcacttatagcagaatggtccgcatattcccatgttgtattcatataaatgtgttccagattctcatatacagggactccggtatatggttctttctgtcttatatatggattctgcatctcctcctgccctgcatctgtttcaatctgttctgtattctcttcaaaatcgctttctgtctgctctgtgctttctgtttctgctgtctcctcagcagactgactgcctgcatctgaatcctcgattccgcttccagtcatatcctgacttgtttcttcaatgtccgatttattcaattctgatgaaacatcagtattattctttttacagcctgacaccatcgtcacagtaactatcagcgacattataatagctgcatatttagcagcatttgtcaatctattcatctgtatcctccggccacactgaaccttcatcaagtccgttatcagtaagccatttatcttctactgtaatatatttcttagcgccagcttcatcaacaagcataacagaaaccctgggtgtctgcccttctgcaagttcttcacacccataatctccgtcaaatatctgttttatcttccacataacaatctccgtttcaaatacttaatatttttattataaaacatttttacaaaatatgctataatatatccattatgaaagtacggaggacatgatggtgtaagctatggtgttgtatgtaactgggacgagacatgtggtggataagtcctgtcactggcgtaaaaagttacattggcaaatgctccgctgattcattcactgctaagaaattcgctaaagttgatggtgatgataccgacagggtgctggtgataaagtaataataaaacggaccttcccacggatttactgtgcagaaagtccattttacttttatttcagtttatcttacccccagataagcttctcccagaattccttatccctggcatactttaatatatcctcttctttttcgttatcgaggtaatccataaccttgttgtaatctgtcggatttttaaaatcaatctgccacaaaagtgtgcctactccgtccttaaattccttacatgtaattccctgctcggtatatgcagtaactgtccacactttctctcctgattcatcatcacatgatgcactttctgttgcaccttctgtcttgcttacaccttctgttgtgtctcctgtaagcataagctcctgagacttgctaaggctgtcctgtgctttttcattggcaatagctgctttatgaagaattgtctgatcctctgttttcatatcatatgtccaactgttttcttctatccattcttcatcctcagtctttacatcagatgcgaatccattggctgctgcactctgtgctgcgcttgaagccgcatttgccttctgccctgccggtgcattagctgctgccttagaagctgcttcatcctgaacttccttaagctttctgattttatccttgattgcatcaatattctgatcaaaactgtttaaaagcttttcccattctttgtctgacatatcccgccagtccttttcctcaagatcgtctgctgtaagctcatactgctgtttgagcatttcaatgagatccgcagcagaatatttttctcccgttgcctcattttcaagttcaatacctgaaccagtcagtgcatcattccagtttttcttttcagttaaagcttcatccagtgaattgtatgaatatgccatatcatctgtcaaatgttttaaggcattccagcttccccatttgtatgaaccttcactggttgaatcggcatactggcaatatgcaaacatttccacagcacttgcattggatgaatctatctcggaaagattaacatcataatccctgaattcatttccacccagtgcaatgcttactcttacaatcgtgtcctcactgtccggattaataatctgggttgccctcattccgtagccggtatccccaacatttaagaaaccaattcctaatgacttgtactggatattattatcctgcttcatagattcttcaaaaccggtgtctcctttgccagtcttcgttgttctggaactgtactctgaataagtcccatacctcatttgtgtgttaatattcatgtattctcctttctgcagccgctcagtcagtcgcagccgcaccactttccagaaaggtccaagtggcatattatcatcgctactcgcgcaagcagctcatacgccagaactttgttccggcgttgtcgcggtgctcctcgaatatgcacaaaaagccagcagcccgtgcaagcacagccgctatctttttatgcatattctcatcgctactcgcgcaaaaaaggcacattcatccaacagcttcaatccattgaataaatgcgccttccatgcctaatatatatcggcattatttcatatatcattatagtaattcagaatttcattccatattttttcaggtcaaccctgccattaacaacctcaattccatctgccataagaagctctgcctgctttccggctcctccaaatgcgaattccccggcaagctctcccttcgaattaactactctgtagcacggaatatgtaacggatccgggttcttatgaagtgcattgccaactgcacgcgccatctttctgtcgcctgcaagctctgcaatctgtccatatgttgcaacctgtcctctaggaatcttcttaacagcttcatatatcctcttggtcgggctgtaagatacaaggtcatagctttccgcaatcatacgtctgatatcttcatcaggaacagttccatcaagaataatagtattccagtgttccttattctgatgccagcccgcaattacagaagaatatgtactcctccacaaatcccgccattcaggtgaaactttcacattaagattaatatatccgtcacgctcgtatgtccataaaaatgctttcttgcatcctttaactcttaccagctgccagttctgatcatgaaacggtgcttcctgataagtatctggaaaagaaagtccatattcgagtgcttcttcccttgtcgtcatatcatcagtccttagttatatttgtaaaagccttcgccagaagacattccaagcttgccctcatcaatatatttcttaaggattgcttccatcttcttgaaattatatggcatcatcatcttcttaagaagtggtgagaaaattcccggaacgctctggtactggtgaacaatattgtaggcagtattaagtcctactgtgtcaaatatctggaatggtcctttaggtgctcctgttcctcttgtccatgcaatatcaatactttcaggatcagatattcctgctgcgtacaaatcaagcccgcttaaaaggaatggaacaagcatagaattaagcagatatccgctcttttcctttcttacaggaagtccgatcattcgtatgtcgttggcaaactgcataacctcgttaaaatatttttcatcagtctgtgcctgtgtcataacctctgcagtattattcttccatatagagttagcaaaatgtaatgacagatatttgtcaggtctgcctgtatatttagcaaacattgaaggaagaagtgttgatgaattagttacaacaacagtcttgtctggaagaagcggagcaagcttttcatagaaagcaatcttgtccttctcattctcagccattgactcaattacaaggtctgcatctgcaacagccttagccatatcaagttcaagcttgagattagcatatgcattttcaaccttcttaagacactcttccttgtcaaatgtatcttcatccgcaagtcctgcacaccacgcattcttatcctctgccatcttctcaatagcttcaatataagtctgcttaagatggtcaatcttaggctgtgttcttccaatagacccctcgcttcttaaccagatagttacattaaatccacaatatgctgcctgaaaagcaatctggcttccaagcactccgcctccggcaacaacaacatttgaatatttcatacttatcccctttcttataaatactcactacgccataagacttctaaatgtatcaagtacatcatttcgtccaatcattatgtcataatcaggcttttctggctctcttctcaatgccggttccggtggaataaccggttctttaggcattatcggttctttaggcaatgccagccgtgataattcaatccttacattcattatttccttatccttcttggctgcttttgccccagccataaaaccttctataaatcctttatcttcctgaagtctctttaactcatattcaagtttctgcttgttgtcattatattctttcttcttggcattccattcttcaatagctgcgccatttacagccagccactcatcatgttccttctgcttctcttcaacatccttaacccactgctgtctggcttcctcaagattatctctctcatactcccacgaatcatggtctttctggtattctgcttcactgttggaaagattagcatttgccatatcgtccgccttcttaaatgcatcctcaagctttgaaaaatatgctgtctcctgctgtctggctgcctctatctcctgttgttcctgttctgtgacattctttaatatctcgtcaagatgcctgtttacattagcaacaaattcttctattccggctgccacctcatcatcggcattctgctttgccctcttgaaaagctcattatcacttaatatgtaatgctcattattagctgcaatagcactctttgtattctcaacacctgactgatagttaaaatgtacatcaaacagattcgcatactcttcttctgataacagattagcaacaggatacttgtcctttatctcctgacgcctgtctctgatttccagttcatatgtattatctgatgtatttccaattacctgaagatacagattatctgccatttctcttgcattagtgcattcctgctgcacaagaagctgtccccagtatgcctttgaattatcaggttcttcatcaaggacatgaaagaaaagcttattggcttttttccagttcttatctgaaattgcagaaaatccttcatcaagcagcttattgatatccactggttcgatgatttctatttcttcaagttcaatctcttccgctggttcagccttttctggttctggtgctggctggttaactgattcctgcttcaccacatctgcaatctcagccattatattattaaatgtatcatcgtttccaagctggcacaccttcagacctgcaaattctttaggaatatcatattcatcaacatctttataacatggaataagacatttgttcttattcttttctgctatctcaagatatctgttccattcattcttaacccagacattgttataatcatcatatgatgtaccaagtgcaagcataacatttgctgaattaagagctgaatatatgtatggttcacagtctgattgcttttttcctttaagtgcggcttctgataaaaataccctgtatctggctgatgtcagcttgttatataaatgtcctgctatttcactaacagccgtcttatctccattatcatcttttgccctgtagcttatatatatatcgtatggctgttcactttcagcaatctgaatatatttcttacgattttcctctattatcttcgcttcttccctgaatattgctcttgactctgaatctgaattctccataacaagttcaaaatcttcatcatccattacactatcataagaaattctgtgacaaacaggtacctttttcccactcgcattatccgcatattcaataccatatttgcaaaggattaatccccagtatccttctgcttcctctgggtaactgtcagttattgtattatatattcctgctgctttatcaaaatcgcagttaaaacgcagtctcccggcacgctcaaacagcttaagttctttatcgtcctctatatccggaactgtctggctcgttccacatttttcgcatttacagacagtaatcgaatcatctatgtccagattacttccgcacattttgcactttaagccccccatttgcattctccttatcattaacgtatttcacttaatcgcgcatataatacaatactattaaagccgtatagaatattataatatttagttattggggtgtcaatttcggattccgtttcaggcagccatgtgaattcatcaattcctagtacatcgttttctaaataactactccatccttaaattccttacatgtaaatcactgctcggtatgcgttgtgcttcaaccgcctccttttatggtatgaaaaaagcactctaacctgttctggctaaagtgctgtgtaagtttattattaattttctcagtcagacaaaaagtttattaaatctcattatggttcaatcgactttttaacttcaaaatatcatgctttatttgttcaattactatattaaattcctcatcgcttttcccagttggatcttcaagtccccaattatcatcaaatggtctgcctataaatggacaccctacattacatcccattgatattgcaatatccggatctggaatatcactaaccagcttactgaactgtccttctgcttccatatctatattatataattccttcataatacggacagcatcctgattaatctgtggttttgtttctgtccccgccgaataactttgaaacacatctgatgccaaatgtcttccaaaagcctcagcaatctgacttcggcaggaattatggacacaaataaaagctacttttatcttactcataaaatggacacctctcctttatacattgctcattaaaatctgtgaatccgcattgcatttgttcgtattgcaatattactccataatgagcatttacataatcaataccattcttaaatgctatcattgcatctctcttgcagcatcttggcccgtttatggttcctaattctccaattgctttcgaggtaaactgcatatgatttccccatgttccatccgttgaaagcggacctgttccgtcgatgattgctagtgcagcacctatagatgtgattgctccgcatattccccataaaccgcacattgcccccggcatcctaaggccctctgccatcagcctgtccaacgcttgttctaagtctatctctccacctgcgtttttgtaggctacaagcaaacttgcaccatctaatatatggtgttccggtccatgaatactgacatattccttctctgcaatctgcttaaaaatgacaaccggatttgttccccgttctttctttatatcttttacaatcagttctgctttttcttttactgtcatagaaaccctcctttcgtcttatttgcaattcttacaaactaagcattaccggacttagcatttcccctctaacagcagctatctttttgtcacagcatgactcacacgtcaaacagccaatatctcttttctgtccttgcccgtttcttctgcaatctaatctgtcaccatagtgataagaaggtctattgtataattcatttttttctttgtcgataaaactgctaaggaaacaaagtcgcgtctctttcgccactatctatttttcaatacctgtattattttcaacaactgctgccacttcttctgttactacttcattgttatccatttgattataactcctttgcattaatttctcataataatatgtaatgttgattgaaactgcattactattagctagtataccataaacatactgtttttaggaagaaatgtcctatttcatccatgtatgcatattgtcaagtgtatgtgtcatattttatattcaaaataaaaaaggctgctactttctaaaaaataacagcctttcttactatatcagccttttggaatttgaccatcgacatacagaatgtgattaactaaccactctgtgagatattttaaaatccccataatctgttcatcttgatcttctacctcatcattgtgatgttccataaattcatcaagtttatgtataaattcctgatgttgaactttctgtgtaaatatcttcttataattaatagattccatatactgctcttcatcactaaagtgttttactgtataatttcggagattttctaatattatatcaatcctatcatatttatccggtgtaaactcatcatgaagcagttcatatgcctcatctgcatatttaaataactgcttgtgttcttcgtctatcatatctataccgatataatattctggtttcatttcatacataaattaatcctactttcagtttatttgttttatgaacctgttcaatactattcataataggcaaatgcatttctcatgaattttctatactttctcgtttttaatgttagattccaccaaaacattccctaattttcttggaaatatcagaatcaacaaaacctttctgcgccatgtcatcaagcatctcacacgttttttcgtgcgataaacctttcttatatggtctgtcctcggttaatgcctgataaatatcaatacatgccataatacgttccggctcatttaattcagctgcggtttttccaaaaggatacccttttccatttaatttttcatgatggaaagctgcccagtctcgtatttcttcaaaatcattaacctctgataatataaggtatgtatagccagcatgattcttcatttttgaaaattcatcatccgtaagcttatccggtttttccaaaatttcattgcctactgccatcttcccaatatcatgcagtgcaccagccagataaattttttgcacattaatagaatcatatccgatatattgagcaaaaaaagctgctttttcagccactcctatagaatgtctgcttgtaaaagaagatttataatctacaatctttgcaaaaaaatctgcgacatttttacacgttttccaatcaaaaacctgtttttgtcttgggataatctcccataacttcgtttcaaaagaaccatcatttaaacacataaaagattcggaatgtgtgaatgcatgaagaaaagcattcacacattctgaatcaaataatccgtccttattttttaaaagaaattgacatataaaattccaactgttattaccagattccatgttatttcctataatatcaatggtatctgcaagatgaataatccttgcaaacaatggaatttcattccactttttttgaaaaggaccagttccatcggcatgttcatgatgatacaaaatcacatttgacacatctgttttaaatggaattttagtaatatttttttcaccataaatacaatgaagatttgtttttttcttggataaatcttttttacaattaatgacggaatcccttttcagttcttccgaaatatattgtgtcaaagcattatcatgcagtaaagcacacatggctaaatcttgtaattcatcaccttcaattttccaatattcagccatgcatatacttatataagccactctttttccatgtttgtttttgatatttaccaactctgcttctatacagtccaaagcataagaacaggctcctgcaagtccgatgatatctatacttagttcttctttcattgttataatcctatcataatacatttatgcttctgagaactggtcttttccaacagagcataacggacattcaaaatcttctggaatatcctcccactttgtaccaggtgcaataccaccttctggatagcccttctcctcatcgtattcccatccgcaaacatcacatacgtatttcattcgttgttcctccttgtaaatatattaatacacagcctatattactgttatatttgtgttgttctgtaatcttaatatgtataaatgcttttagcatttccataatccatgcaggttacaatatgcatatacttcttctacctgttcaccatcgcaaagacaaaaatctgctaccggctcctgccctggatttaactgttttctgtatattccctggtttgtatttaatgtaatccactcaatgaaatgctcttcaagcattggatgttttgtctctccaaccacgacatgaacatgactgccttccactgtatatacttccatgtgtaaaatttataattcaattgtctccataatctttttcaatgaatctgcagattccttaagctttaacgcttcctcgccacttaaattaataggtatatcagactcaataccatctgcacctacaatagctggcatacttaacgatactccgtcaatatcatatactccatgaatcatgtgtgatacaggaagtattgatttttcatctctcataatcacttcgcagattctttttacagacattgcaattccataatatgtagcgtgctttttgtttataatctcataagcactgttcttgactgctgtagctatttctgccgtgttttccttgtgcttgtaatgtccacgcatttcacacatttcacttaatggaacaccagatacattggctgatgaccatactactacttcgctgtctccatgctcacctactataaatgcatgaacactcctgctgtccacagataaatgctcaccaagcttatatcttaatcttgcactatctaacacagtacccgatccaataaccctgttttctggaagtcctgataactttatagctacctgagtcaggatatctaccggattcgcaactacaagcatgatacccgcaaaatttctctttgctatttcaggaatgattgacttaaatattgctacatttttatttacgagatcaagccttgtctctcccggtttctgtcccgctccggcagatatgacaacaattgcagcatcagccacatcatcataatctccggcatatattttcatcggactcgcaaatggaataccatgactgatatccatcgcttctccttctgccttgttcttatctgcatcgataaggacaatctctgtaaacaagccactctgcatcagagcaaataccgatgcagaaccaacaaagccacagcctatcattactgctttttttgaattaataactttcatcttcgtaataatctcatctccttaatcaatataaacagtccctaactcaacttatacattgctttcctatccatgctgttcctcctttaccttctccctgcatttctggcaaatgcctttaaatgaaatatcataatccacaaattcaattccatgagtgttatgaattctttccagcaaatccggtatttgatccatatccacatcaaaaacttcaccgcactttatacatcttacatggtaatgatttttcaatgtaaaatcaaatcggttcggtccatccggaacttcaacctttcttaatgcaccttgctctaccaatatatcaagatttctatatacagttccttttccaattgttggatatgcttcttttataaattcatacacttcatttgccgtaacgtgtcttctcatttcgtatacggtatttcttacaagatctttttgaatggtatttctcctacttgtcattagtcctccttattaggattaattcttaataaggattatataccactatcatcctgttgtcaataaaaaatagtaataattctcattattataaaagatgccaaactgagcatcttttacctgaataactattttattttacgttcaaatacatattctgaatctgaagataaatcagatctaaacgaatatccgagtctgtcaaatttctgaatctccgcaggattttcaatattattttccgctatgaatctgaccatttcaccacgagccatcttggcataggtaccttttgttaccaatttatctccggataactcacaaaatacaatcgtaatatatctgtcctgtggtgtcagatacttttctatacattttgagtattcttttgatgcaagattaatgataatcctactgtcatcgattactgagcggtataacaattctccccaatactcatacagattttttgcatctccaattccaacctttgcctgcatttcaagacgataaggagtcacaccatccattggttttaaaatgccataaaacgcagacaagattcttaaatgattttgcaaatactcaaactgctggatttcaaacacagatggtgccatatattgaaatgcaatcccttcatatgctaaaacagccggagtaagcctgttataaagattcatattttccaatctgttaaagttctgctctgcaatcttgtcattacatttccagatagctttcagttcttcttttgatttgcttttcatccagtttaatacttctgctgtcttatcaatatagacaggcaattcaagcggtgctaagttatcggtatctacaatcatcttttttgcaggtgataaaataatcttcattatgccaattccttaagcatattttcaggatcatctgccgccttgactttatcatttgcctttataatgattccctgctcatcaataagatatgtagttcttactacacccatagatatttttccataatttttcttttctttccagacatcatatgcttcaataactttacgctccggatctgctaatagtgtaaatgccagtccgtatttttcttcaaatctcttgtgagacgctacagagtccttgcttactccgagaataacagctcccttctcagtaaactgtggataacgctcagaaaagccacatgcctgcttcgtacatcctggcgtattatcctttggataaaaatataaaattatttttttacctaaataatcacttaatttatgcacttctccgttctgatccggcaattcaaaatccggtgcttttattcctaactctaacatttactattcctccgcttttgtattttccacctgttttcttgtacttttattacctgaaatcattttatgaccagaatagactgccataatcatgcatatcagagagccaaatgcaaagtatttgtgtgctgcttttaaccctttatatcctgtataaaaagttccaaccattgtaactattgctccgattgaccaatatttatgtgctttcatgatacacctccatattttattatcaacatcataatacatcaatttattatttttcaacaccagcatttttcatagttttcttttatttaacaaatcacataagattatctctccatctataccattcatccttcgtcatatcatcaccacaaatcgtatggtttcatggtttctaaatttcgatattcatgtttctcataatatcctatcagcttaccctcatctctgagtgccaccatgtaaacatctttattctgtttctcattatgaaaagtataaacgatgaagcatattttggagtaaatcctgctgatcctttttcatcacttactgatgaaggcagggaaaaagctatggattatattaatctgctccacgcatccggaatgtatgaaaagcagactgctaagataattccatttcgaagcattgatatttttgaaaatgctgtatcagccggaaccggtaacttccttgtagacagaccgaaagagactgtatgtatagatgaatctatcttaccggaagatactactttcggtgtccgtattagtggtgacagtatggaacctgaattccacgatggtcagattgcatgggtattacagcaggaatctgttgctaatggagaaatcggcatcttcgctctaaacggagaagcctatattaaaaaattgcaagtcctttttatcggacacatcattttgcataattgacaataagaaaattctatagaactgaaagaagggatttttatggcggttaccaataatatcagagaaatccgggagcagcgtggcatttaccaagatgaccttgccgctgctatcggattcagcaccaaaactgtcggcaggatagaacgtggggacagcaccccatctgccgagtttatgctacggatttctaaatactttaatttattggtagaagatgtcttccatgagattacagcaaatgtagtagtaacgtctatcaaaaagcttttacatattagataaatgcatgtaaaatttcttttacatagcttaattgcggtctatttagcttgtttcttgactactcaggaaaaatatttctaccctcgccccacctgtattttcagaatttgaaagtttaatacctccaccatatttttcagccacagtttttgcaaaaaatagtcccatcccataatgggcttcgccatttctacttgtgtcatccataaaaaactgctctgtgccatgcaataatgcttcttttgtaaatcctgatccgctatcctccacaatgaatgtcagccggccatcctgctcctttgcgtcaatataaatgattccattttcttttgtatgctccactgcattctgaatcacattcattacggctcggaacattggatcataagcaatcgttacctttttatcactttgttccgccttccaatctatcttctggtgatagatttctaccagtccgagtgcctgttcctttatatctgcgaaaaaatcttctaacctcaccgttgtataggtaacatcactgcaattccatgattttgtgacatctatcaactgttttacataactttgtatctgtgttgtgccgttcaaaacataagtgatatttttcttctgttctgtggtcagttcagtctctgaaagtagttctgcatttccccgtacaatcgtaagaggtgttttaatatcatgcgccaaagcagacatctgctgtttcttttgctgctctgttttccactgcttttctaaagattctcgcaatgcatctcgcatatcatcgattgccgataaacagtcatcaaactctttgataccggaacaggatgtctcatattccagattttgatcctttatttgtccgattgcgtctaatacaggctgcatctgctttttgattctttttccaaaacgtatggacggaatgattataatcgctaccgctccaatcacagacataataatcatcacattctgtggtcctataaaatgctctctcaaaaaagctgaatgatattgaggtgtcaggcgatattgcaatacaacatattcatttttccttacaattactttataaaaatatttcccggatgcgtttctgtactttgcaacattccatgctatctgttcgtattgttctgacagatctccacctattttctctccattctctgaaaaaattacataatcacaaagtgcgggaatcatctcagcagtcactttatctgcacgtagaatcgtatcatatgcttcattaatcttttgctctgcataatttgccggataaatacagcccacactaatcaaaaggtacagcagcagataagcaacaatcaccaaaccaactaatgatccaagcatgaccagtacatatctcataaaaatcctgctgagtgcattgcttctctttactcttcccatttatatccaatcccccagactgtttttatcggtgtataatcataatccgcaaattttgctcttatatttttgatatgcgtgattatagtactgtcattactctcattgtcaaagccaaagaccgcttccaatatctgttccttcgagaaaacctgtcctctgtttttagccagaaattcacagatttcgtactccgctttcgtaagaggaagttccttatcatcaaccaatagtttcttttgagatatttgaatacagaccctccccaaaaccatccggacagaatgttccctgtgctctcttctaagatgtgcattgatccttgcccgaagttccatcactccaaatggctttgaaatataatcatctgctcctaaagaaagtccgtttaccagactgttttcctccgtttttgccgtaagaaacaaaatcggacaatccacaagtgccctgattcttttgcataattcgaagccatcaattccaggcatcataatgtccagtaaaatcaggtcataacaatgtaattcttccatattaatttttagtggattacttactttggtaaccagatgtccatccttattcaaaatgctttctatcattttcaaaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactagtttctcccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgccaataggatagagcacagacacaaaaccagtagcatcaacagtttcgataaaaatgctgtaagtttatctggtaaagacaacaggttttgaaaattacctgcattttgttcttgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattaccacaccgctgacggtaataaataggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcagcaaaagtgtataccaccagttccaaacactttctgcataagcatttgtcatcccaagagtaaatataaatgccatgacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatccaaaagttttccatcaaagtaaatctttcctgcagttggtttcatcataccggtcagcattttcaatgtggtagatttaccagcgccattcggtccaagcagtccataaatctgtcccttttcgatattaagtgaaacattatttaccgctttctgttttctaaaatatttacatagattttgtgtctgtaacatcatttccatctttactatccttccttctatatttcatttcttactgaaatataatctatcagagaaaaataaagatttgatgaagatttattcccgtatggaataaaccatcaattgaatatcattatcagaagctgtgactcagtaagtccctttttccatatcattttatatgacataatttcattaatgcaacgaacctctgcattaaaataattttctaaattcgtaatgccataaaatgaaaaatatgcatttacacttttaggataaaatttatttctatattccaaaatataattatataatttctcataattatgcttaatctcactcgttttagtataaagcattatcttttgatttggctgtacagttccaattgctctgtccattcttaaaatatcatttggattatctaatatatatttttcaaaaaaatacaaaaaatttactacttcctcataactataattattcaaatcaaagcactcagataatccaaaattattcttcaaatatggcttccatctctttttttgccattaagtttctcttgaacatattttcttttaataatctcttcctgtccattttctatttttaaattctcatataaaacattatcccttgctttctcatcttcgtattctaataatatcattatttcgcaatatgatttaattataacttctaatttgtccatcattccacctatcataatacgcacattatagcattcatcaccaatattatataggtggaaatgatggaattgtggaattaattctcttctaaagtgtctataattaccctaaccacaccaattataattgctttcaatacagtatccattactatcagctcctttctaaaaaataaaaggtattaattacagaactatatttccgtaactaatacctttttcataataatattatataattgattatcttgaatttaacacattaaaaatcatcctcatcttcatgtgctaaatcccatatcattttagcttctccagcttccctttttaatattcttttcccagagttaaataaatctctcggtgtatcactcatgcttgcctgttttgaacgattacaatgcttgcatatacactgtaaattccattcagaactacttcctccaaacttttgtggaataatatggtctatatccatatcgccttttctgaacttcctgccacacttctgacatgtataccagccattattgttatcatatgcgtcattcttattaaaataagtatctctgtatcccatattaactccttacttataaacctcttcttctagcttcattgcaacaagctctatacctatagtcacatattccatctctttcagctttttcaattgccctcattatttcatcatcactgtatcttcttaatgcattttcaaagcttttctgttgttcattcatcatattattcatctctttttttaatgaatcaaaaaatcccatttctaattttctccttcacattaaatcatattttaaatcattcgaatcacaaggataacagttgaatatttctgtaataaaccagttttatacataactggtcttattacataatataattaatacacccccttgttcactgcgtatctcatgtacacattatataactcacacatcaattatgcaagcattagattttagatataatatctaaaaataaaggagtgtctatatatggttcgtctgcgtgtgcttgatatacttaaagaacaaaatcactcaaaatactggttatataaacagatggaattaagttatcagaatttcaacagaatggtacaaaatgaaacatcatctataaaatttgaaaatcttgaaaaattatgttccattttaaattgctctataggagatttatttgaaataaccaacaatactacaacggacaaaaaataaatccatctttgccgaaacaaagatggatttttattttttgcagtaaatttgcagtaaaatactaaaaacaggggcttccaaatcgctgtaagcccctatttatctagcttttacttatcaatgctcttcattgtcgggagctttttcgctcttgctgtaaaggtctgtaagatgatttgtatttctttaaatcattacagcaatttctgtactaagatgcattaaaatagtcaatttaaaaccattatttagtcacatattagtcatattaaatttttttggtcaattgcctagccctcaaatcagaggactcttttctatattatatcgttgtttctaaaatacatccatgttcttggcaagtttctccaaagcctctctagtaacctctggatttgcctccgcataaatgttcatggttgtgctgacatcagcatgtcccattacttcttgaataacttttacattggtttcgttctcacaaaacctcgaagcaaatgtgtgtctaaaaatgtgacatgaaaacctgggcaacattataggttctctcttctttttctttgcctctacctcttcttcggcattgtgagtatcaacgattctcttgattgcacgatttactgcctgcggattatgtggatttccaaaccgattagtaaatataaagtttgtcattccatcaacctctgcaacacaaaaaccttcttcctgctgacgctgatattcagacttgagcacttcatacaccggtcccatcattggaattgtccttattcctgcttctgttttaggttctgaaacccgaaactcacacttaaatgaattgtcagatcttgtgtaataagtaagactatggttaatattgattgttcgtttcttcatatcaacatcgtcccatctgatgcctattgcctcaccgattctgcatccagttccaagcagaaatacaaaaaacggataccaatggaagaaaaacggattctttgcaacataatcaataaattctctctgttgctctactgtcagtgctcttcgactctttctagcaccaccgtttctttttttcacctcggcataagctccatttacaggatttcttcttataatatcatctcgtactgccagctcaaatgtaggtcgcaatacagtattgatactctccaaagtatttacctgcaatcccttgttcgtaatcaaatccgtatagaaaaataagacatcagaatacttcacatccttaatctttttctttccgaacgtatccctgataaaatgatcccatgtatataagtaatttgcttttgtagtgcttcgcaactccgtcttggtagaaatatatctatcaaacaaaaaatttacatctgcacttccagcaacatatacatttaacccgtccatctggtcacgaacaagttcgtcttctttctgcctaagtgttacaagagatttcgcatatatcgtcctttttttccctaatggatcagtataaatatatgaatacctgccatcagttttacgataatgctctccttttcgtaatactcttcctttaccatcttttctacaagccatcttttctcctttctcaaaaagaaaagagcctgcattacttctggtcagccattagtttctctaacactgccattttaactacttgcgtcatagtcatgttatgatttttggtgtattcaagcagcaattcatgttcttcaccattcagtctgattgtaatcctcttatcagcaggattttcagcttttggtcgtcccatctttgccaatatatcacctccatctgaacatagtatactttatgtcagacataaagtcaagtatattaatgcaaactctttcatattcttttcaatttatttgtagaattcctcgtcttctatatgaaatgtctccagatattcattaagaatatcaaggttcacaagcaccagtctattcatcttataacatgctttcgcatccttacaggaaatagttttcggaaaagttcaataccaagaagcgatgtgagcttatcaaaaacatgaagtacactttgatgagacttatccggcaaaagaaaaatcaacatgaaattggtgtctctaaatagaatagtcagaagtacctttccactatttcgggcaccaattacggtatccatttcaacaatcgggagtttcggattttgttccatgaaggaagtgaaatcagtgtaagtacgtccttttcgatactgataatcgaacttcataagaacctcatgagaatgtcgctgcttataacgaacctttttgggaagatcaatattccttacccggaaagcactctggtcgatgtagttgtagatagtctttttggaaagcctgatttcatcggaatgagtggcaaatatgtggttgatggattgtcctttattaaccagcggcattagtaaatcatttagttccaataaccgttcaggactggtacgaatgcctttccttgatgaacttaattctttgacgtattcagcgtgcgcccgatgagcagtgtagtaggcatggtttcttttgcatgtcttctcatttgggcaacgagtgcaaacataaggcggtttatccagcaaaggacaatgtgcagaaatgtactgtgaacataagcttttacagtcgaattccgtacatgttttgcagcgatgggaacaagtgtaaattgattcctaatcgcatatgtttctgcgtaagcaagaacgataattaatacagtcattcgatgtataccggaaaccgttaacaaagcaacggtggttcttaagctcgcgagagattgtggttgctgagcggttcagtcttttagcaataaaagagaaagacatatcctgggcgagatatttttcaataattgcccggtcagttaaagtgagatgtttactcataggtctgctcctttctggtcagacagcatatgagtattatcctataaaaaacaagatttgtaaaagtaaacgcacgattgtaagagtaaaagtaggcaatttctggcgttaaattttacaattaaagcattgccgataaaattgcaagtcctttttatcggacacattattttgcataatgacaataagaaaatatctatagaactgaaagaagggatttttatggcggttaccaataatatcagagaaatccgggagcagcgtggcatttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatggcggttaccaataatatcagagaaatccgggagcagcgtggcatttaccagaacgaccttgccgctgctatcggatacagcaccaaaactgtcggcaggatagagcgtggggacagtaccccatctgccgaatttatgctgcagatatcaaagtactttaatatgctggtggaagatgtattccatgtggaagattgagtcggagcagcaatttttttgattctcctcgtatgccttgtaattctttttgcgtgtttctgctactctcattctgacacagatagaagatgccatatccaagaagccccgccacagaaaaaacaaatatcaccgctaataaaagttgcagagtcaggcatttccatttccattcccatacacgccttctgctttgattccgtctgtgtcttttctttcgcctcttccgcagcgtacactccctgttgtgttttctttgaagaaaagacggacatacatgcccgccttctccatggttattttctcgttttattttttaactatcgtttctatgaattcaaattttctctgcgtttctttacggtaataatcaatcccgttccggaaagaattgatagtataaacagccatacactcggtgtgttgtctccggttttaggtgcagtcacatccttcttatcagttccactcgatggcttgtcatcagaggaattgctattgttattatcattctggttgttattactgttatcagagatatttgctttggtggtaaatgtggtgcttgcagaaccatccgtccaaaggatttcaactgtatggtttcctgccgaaagtgtattcaggtaggaagctttcagtgtgataatggtagagccttcctttgcagtgtagttgctcttgtctatcaaatttccgtccaccttaactccggtaaacttggagaagtctccgttaccccggatggtgatattaccatcactgtcatgcgtccaactactgtttgctccatcaataatctgataggtgttattcggtgtgtcaggattatcggaaccgcccgcatcctgtacggtcaatgttgcagaattactctctacgtttcctgcgctgtttgaaacaacacacttatacttaaatccgttgcagcttatattgactgtggatgtggtatagctcgttgccgttgcaccgtcaatgtttacccatcctttcccatcatttctgtctatctgccactgataggtaagatctgtaccgcttgctgctatggtaaaggacgcagtctcacctaccttcactgtcgcatttccaggctgtgtggttatgcttggtgcaatcacatccggcacatccggtgtctggctttcctgtttaaaggtaacttctatggtgtgatcagtattcacatcactaaaggtgtagcttgtggttgctgtcacttccgaaccatccacctttacgtccgcaatataatatccttcgttcgccttgattgtatatgtaagctgacctgcggcagataccgttgtcgtgccacagggagagattgttccaccgatacctgccgttgcggtaatcttgtagcttgctgtaccgctcggaggcgttatcggcgctgtatccgccgtaaaactccaacttccacggaataccacggttgtgccgtttaggttgccggcatcccagcccgaaaaagcccatgtgccgtttttaccatccttttgtgcctgaatgcgtgttgtggaggtatatttcttatccacagccgccttcgcctgttgcacactcgaataggagctgctatttagcggcagcgttgcacctgtcgggaatacagagccccaattgtattgcaccgtataattttttgtcaccggcggctcggggcgttcctcagaccttttataaatataacgaatcgtcataccactgttcgggacagcattttccatcccctccgctttaacaaaagtgtagccgtgcagttcctgcggcggctgccaatcaacctttttgcctaccggaacagtaaaggtagtcggcatggtgtttggaacatctgtgccatcctccagctgatattggatggtgacattgacatagcgctgctgctccgtatcatcatcagccaatacctcgcctgtcgcatgatctacaatctcaaagccgatggtatcgccggattgcagaatggcattctccggaatcgtgtaaaccagagagcagttgacaaggccggaattaaagtcgctgccctcgtaatccaacgcaccctttgtccagaatttgcttttctctttccaaacagggatgtcaaactcctgcgtagtgaaaacctgctccccatctgtcgtgaccgctttttcgccgttggaatgttccacccacaggcgcagggtcacagtcttcgcttgggtattcgaaagattttgtataatggtgcgcagctcaacctgctgccccttcatgctgctataatcaaagctgtttttactgccgccgcttaatagacggctattcctgtcattttgatagctcgcatatgcggaggaattcgctgcctcaaaggcagaaggatcttttgtgggatttctgtaaccgccgatatactttttcacctcaggaacagccacataaagcgcagggggatttgtaatgagctgactcatgacctttatgccctgtagcttgcacacatcgcaaaaatcattctgaaaggtctctcgcatcagacaatccctgctggaattataggtataaggatagtagtcaagatgcgggcaggtataggtattacggaagccaagcagctgcttccacttcactttcgtgggatcttttgttgcagtcatattcagtgatgtagtgtaattccactcatctacaggaacagtgctataattatattcatctcccagatggaacagaccgtgtcccagttcatgccgctgggtaaacgcagaatatgcgtttctcgctgacgcaacaatatagtgaataccatattgtttattatcatgagagccaccgaaatactcaccgctattcgccaacacaacgaattggttgatattttcatacacataatcatactgtctataattatgatccatcgtgttttcgtttggatgcgtttcattaggaatatgtgcgtcatgaatcttctcgataaacgcagggcctatgatgcgctccaaaacatggttgcgccagttccctttgttagtagaaattcctcctttggcggtcgcagcaaaaaatgtgctggtaccgccatagccatccaccgatgccgtgcagagtgcatagacattaaagcgatccgccatgctgcgatatggctctatctgcaatacctccccccacagcttttttacatcctcgacaaactgcttttgctggcttttggtgtagccctcggcgcagtacacaatcaccatgttctccttatcgctgcgaggcttctggattgtatacaccggtacggttacatttgcatatgcaggatcctcagtgtagagggtactcatctccagctgtagatactcatccgtgttcacattccagtcaccattcacatcctctcgcacagcgccggatatgccaatgctgtcatccggcgcatccggtgcggaaacaacataggggtcctgtgcgctctgtcctgtgccggatgatacggtgtaattttccgtattcagatagaaggcaggacgaacgccgtaatatcccttatagggtgcgtcacgcaaaatattcccttgaggggtcacaaatcgcatatcatggttacaggttgtaatcggtgtacgcagccaatagttccatgctacaccgcttctgttttttgcgatatggtagccgttcaggttatcattaaccgttttgagctgctgaacatccagcagaaaaactctatcccaaatatattcataatgggcactgtcatacccatccgctaccgtatcaattgtggtgttatagggaagatcaacaccggctgcgtcgatataacctgccgtatactccggatgggaaacgatagaacgctgcttcaccgttcgaatcgctcccagctcatccgaacgaaagctgcgaaggaagccctccttttggtcatatgctgccgttttaggatagacagaatcctctgttggcggatttccgcaaagccatttcacttttcctgcttcagcgttggaattgagccaagaacgtatgttgctgtctctccagtggttagaaccaaaattatctctccagctattgcgccggtgcgagcctgtttcggcatttttgttggtttttgcatcatagggcatgtaatcacacaatactctatccgaaagcatcaatggcccattgctatccttcgctacacaacgccacacaattggcactcccccataagtacccatctgaatgtagtcaccaatttcgatggttggcttgttatctgccgccctaaccggcaaagggcatagcaccaaaatcaccgcaagcagcagagataccgttcgtttgccatatttatgtttgataatattcataaagtcctccttttgtcattctctcctgagcgtcattcacggtcagtaggcttctacccccccccatttttgacatatgtcaatttatacaattgctgcatcatcgatattcacctcatttctacttgagttattgcaaaaaataggtctttctgcgataaccccttgtgccaaatgctgaaacaccttcataaagatgtaatagcttatttattttagaaaagtatccgacaaaaaactctacacttccgacaaaaaatatatatatttctcaaaccatatcatggcgatgtacatttgtcaatgatgtgacacctcaagatcaccacagtcctgatacttcttatacatgtcattgatataaatcgtaggcgaaatattcctgccttcctctcgtaagatgatgccatcaagagtcacattcaccttttccacgggttctgccacaagctccattcctttgaacttctcaggcatataatccataaacttttcttttactacttccttaaaaatctcgtaattcatcatattacggttcctccttaatctaaattgtcatataaaattccctcatcatcgggattattgtgttctctgtaactgttgtcttcttcgattcccatatcaaaagtggtatgagattttcttttctttctgtaataattcttgagaaacatgcactttctacagtcctcacagaataattcttctggcggaataccaagtgcctttgcaatcctgttcaacgttcccgtctttggaactcttgaaccattttcgtattgggcaattcttacatcacctctattttcaaaaccacttttctcgcccagttccctaagtgtcattttttgtcgttttctgtaatatctgattctttctcctaccactgtttgtcctccaaatcaaaaaagcggagaacataagtcactggcttatgttccccgcaaggttaattattactgtttattctttttctttcttccacgaagtccgactccaacacctgtaataagtgcaagtgcaccaattccaagataaagaagcggatttgcattgtcgcctgtctgtggaagcttaggctctgtcggtacattggcaagcttaagagttgctacaacaacatccggtgcattgtcatcatatcgaagtgttacatcgtgagctgtttcatcaaggatatatccgtcagctgctttagtctcaacaactgtataatggatatcttctttgaatgatccatcctcgttgtaagtacagataggaagctccttgctctctgcatgaccattcttgtcagtagtgagtgtatcaagcacctttccatccttatcccttacttcaaatacaacaccctcgatcggctttccggttactttatcagttttctcaatgacaatctttccgactgcctgctcgtccttcatggataccttctggatttctgctgtctcctttacttcaaaggttacatcacttgccatcttatatccatatggtgcagattcctctctgagtgtgtactttccgacaggaagtctctcaatcatatgcgtctttcctgcctctgatgtccagctctcaacaagctttccatctgcatcaataactgaaagctttgctccaggcaattctttcttgcctgtgatatcagtctttgaaatttctaccttgatcggtgcattttcaaatgctgcctcaaactcgataacctttaccttatctccctgatatgaagcatccacatcaaatgtcttatctgacttcacatagccctttggtgcctcaagttctttgacataatactgtccaagtggaaggtcagaagtaaatgttactttgccatcctttccagtaacacctctctcaatctgtgtatctgctttgacaataacctttccatccttatttacgatatcttctttcgcaaacaaaccaaatacagcaccttcaagctctttctttgtctctgaatcagtctttgtaacagtaatctgcactttctgacgctcatttgtcacatccattcctgcaaatacaacctttgtgttctggtcgatataagaaaggtctgcctcaatcggtgtatcatctaatacaaatccatcaattgtctttgtctcaacaagataatacttgccaagtggaaggtcatcaattcttgcgatacccttatcatttgtcacgatggttgccaccttgtctcctgccttatgatatacagtatcaagtccgtcggcacttacgatatcctcttttgcatatacatcaaaagttactcctgcaaggctgtccttgaagaaattgaagataaagtcgtaccagtaacccttcataagagtagtgtctgttacaaattcgccgtccttattgataacgatggaacctgtaggaacttcatctttcatctctacatgctgcactttgcctgtatcctctactgtaaactggatatctgttgctttcaggtatccgtaaggagcaaattcctcacgaagtgtgtaagtttcgcctacgacaagtctcttgatcacatgtgtttccttagcatcagatgtccatgtgtctaccacatttccatccttatcaagtacagtaagtgtcgcacctgtaagctctgcaccgcttgtgatatctgtctttgtaaactcaaaggttgtaggagtgtttttatactcgctgttatatacagcagtcttaacatcctgtccctgatattttgtatcaaagtttactgcttcctcatttgtcacatatccagcaggctttacaagctcccttgcaacatattttgcaaatggataatccttaacaaaagcaatctttccattctcatcagatgttgccttctcaagaagtgtgcctttctcgataattaccttgccatctgcattcttgatatcctcgtctgcataaagaccaaatactgcacctgcaattggtgtattatcttctgcatcaagcttagttaccgacatatcaagcttctgtctgtcatctgagaaagtaaggctctccttgataacaggtgtcttatcatccacatatgtgaatgtcactttctgctcattcggatttaatacatatccgtatggagcttccacttccacaaccctgtactgtccaagaggaagattcttagctgttgcctttccatccttaccagttgtaagagttgtcacaaggtctccctcgctgtaatacttaatgcggtttccgtctgcatccttctggttgtctgctgtgtaaatatcttccgcagcataaactttgaattttgctccggcaagtgagccttccttataaacaaactctttctcatatgagcttgcaaggagtcctcccttaaatccgtcaagtacctctcccttcttttctacagtcagctctccgactgcaggggcatcggaatattccacagtaatgattgcatcatttgtatcaccatctgtctcaaatgctgtatcagtatcaaccgaaatgttgacatacttatcatttacaacatatccgaatggtgcagacacttcctcaatgcggtagttaccgattttcaatgcctccggtaagattaaatctccgtcctcatcagtaaagaatgaagtatgctctacctttgacggataagttgtgtactgctttacatattcgttcttatcaatattgaagattttaaactctgcatttggtacaagcactgtctgctttgtatcggaatccttcttgattacacgaagctttgcagtaaactccctgtcaaggaatactctccatgtctgaggcttgtcaggatgattctcgctgattttcacctcaaatggcttgattgttttcatgttatgcggtgtctttgactcaactaccacataggttccataaggaattgcaatagaaactgcatgtcccttatcatctgatgtgattgttgttgctccgttttccccgattactaccggagttgccttgtcaaagtcataacttccatctgcctttacaggtaaagatgatttcaaataagctgtaaactctgcacctgcaagaagtcctgcttcagtatcatcgccattgtcagataccttgataagctggaatggctgcttgataacctgctctgctgaggttgtgcttcttgatacctctgctacaaggtctccctcatagtcgcatactacatcgtgctcctcttcgtctaagagatacccctctgatggagtgatttcctttacataataattcccaaggtaaaggttattgacctctgcctctccattcttatctgttgtaagtgttgctacaaggtcacctgctttgaatacgactcctgttgctccgtccggatgcacgatatcgtttctcgcataaagaccataaactgcaccttcaaggcttgcatctccctgggcaactgccttgcctgattccttgtctaccttgtagatatgaatctttgctgtagttctgttatttgcaaatgtgtgactgaatgatgcctttgcctgtgtttcaggtaatacattgaaattgaagctgtaaacatctttactgtttctgatatacgcatatggagcctgtgtctctgagataaaatatccattagagattggcagatccacgctatagcttgcctttccgtcctcacctgtagttactgtctcaagagctgtaccctttgtcacaataacctgtccggcatagttcttaatgtcatttccggcataaagtgtgtacttgccgccatcaagagggttctctgtgtcagaatccttctttacgacagatacatccgctttctgccttgtattctcaatcgtagttgattcatactggactgtcacagtctggtccttatactcaactgcaactgtctgaggtgtggtattgattgtatatccgtcaatgctcttaatctcagtaaccacataagttccaagatgaaggtcagataataccacctgtccgtcagttcctgttgtaaggctttctgccacaacatcgccagcactatacacctttgtaccatctgccttatagatatctgctccggcagttaccttaaatgctgctccggaaagcttctttttctcataagtgaaattgcttccattccataagctaagaacctcaccctctttatagattgtgattgctccaagctgctctttatctgttgcagagattcccgttgtctgtcctgcttttacagtaagtgtatgaaccttatctgaaaggacatatccctttggagcggtaatctcttttacataataagtgcctgcaacaagtgcagctgactttgcatatccgtttccatctgttgtcatggtctgtactctgtttgtgcatccgctgtcagaatagattccataaactgctccggaaagcttcactccgcttgactcatctgtctttgtaagctcaccatatccgatgttctctgtcttgatcttgatataggctttgataggatctgctgtcggtctttcagaaataaactcctgatatccgctctttcctgtaagccagaatacacagcttgatgttgtctcaaccttgccagcattggatgtgaatgttcctgttgtagctgtggtattcacgctcgttgaagagattgtaatactgttgccattcttatcaacagaatatccgctgatgccaaaatcaaagtctgataagacaccattgctgtcagataatgttgtttcaaatctctgacttccctcattccacttcaactcataagttggtgcctcactggttctgcgtgatgcaaaacttggaagcgttgcattgtaggaactgctgatattgtctctgagcctctcataatagctgtatgaagaatcaggacttggtgctgtgttacagagctttcttgctgctgaatcaccgcttccggttccaaagatatctgctacaataacccataccattgcctgagttgcgatatactcatcgcactggctgttgcttggtgccgccttttgtgtactgttaaacccataataaaggcagtaacttaaaagctttctctgctgtgctgacattgatgtgctcgcatcatcgtagctgttcataagctgaccgccatctgccttcaatccgaaattcatacaatacgccgaatttccgtcaagaattgaatacagaatcttgccatgattaaatccgggctttagctcacttacttctccggaatttttgactgacgcattccagaacgcaatatttgcctgcggactggctgcaaatgctgttgtaccattcgcaaagagtgttccaaccagtgtgagcatagccataaatcctgccataaaacgctttagtttctgtttcatgtgctctttcctccttaatttacgcataaaaaaagaaagacataagtttatggcttacatctttcttccttctgcttctattcgtttttatttatctgtgacatcgaaactcgtaatagtctgtgccgcctgtcgtgtaaactccatcataactgatgtagaataccggatctgtttccaaaagtaacatacttgcaatatattctgcgattgcatcctcagaggataaccgctgtccatcaatggtacttgctttgttgaggtctgtctctacaaacacactataataagagccttccataccatcgtaaggataatactcattgtactcttcctgcgtgatactgccatcattcaaatgattctgtaaattctgctgtgtggtaatcatccctcctgcctgacactttgctgttgcaagtgacacaacattctgtggactgtatgccacggatgcaggctgtggattgctcacattgtctttcggactgtctgtagtctgaccaccattacctgcattactctgatttccgccagctttctcattatcatttactgaagctttctgttccggctcgtcattctgctttggcttttcttcctgccttgaagcagtttcattatcagcggaccggttatcttccttatcattcttctcttctgaatctttaacctcggcaatatctttctctgtctcttcacttccagcttcggttgtgacctctgtgacagcttccgttgccatttctgcttcttcagttggctttacgctttccgtctgtttctctgtctgattatcagccttttccttaccaccattacaggcagccattgaaaagaccagtactgcggataataagataatacttatcttcttcatagtaatcgcccatcccttctccgcaagagggacgggctttgtgttccgtgccatccacccttgcggtgaactatttatctgtaatgcacgggacacataggactgtcccgtattctgtgcatcttaaactcctttcattataccagctctcttattttaaagaaatactgcataagtcttctgtttttcttataatttaagaataaaccctttacctgcatatgctcacctcctctcagaatgtgcccattcttacgaatgaaagaaatatccttgccaccatagcgaatagaagaagaattattctggcaagtcctaagaccagcttcaacgctccaagaattatccttaatatccacttgagtatctctaaaatcactgttcctacggctcccataactcttctcataataatcagtctcctttcgacatccatcccattgcaagtcctgcaacatctgcatcgtccataacatcttctgtaggttcttgtgcttcactattggctgcctgcattattaccggctgaccaacattcatcccggatatcactccgcctaacagccttatgacctctttcctagcctcattggttgctgcttcaatgacttcttccttaatgtcatcaatatcttctgaccggatatattcagccctctctttttccttcttcttgataacaaaggtttcttttccataattatcaatgtaaaactgaatcgcatctatgatgaactgattcttagatttgaaaatcttcggatcaaggttctgaatcacatcattgattttcacatgctgaggattgctcatgttgaggcggacagaagtttttacttcatattcaagtcttcttcccatcatctgcctccttatgataatcgcctagtgcttttaagtcccatcatggcaagctgctcatatcctcttgcatttgcctttacatcaaggttataggaaatgttcttggcatcgtgactaccaaaattcttcatcacaactgccccgccaccgacaaatacaatcggtgtagtctttaagttatacccaaactcacggattgagttatataccttatcaacaaaatcctctatctctgccttgataatggcaaagtattcatcatcaatatctgacctgccatatcgcatgatgttctgtatctctgactcgtctacctctccattaagctgtcttacacactgctcattgatagaacgcatacaggtaataagaccttttggaatcgtcacacactttgattcatccggtgacttgttgattaccggcataatgtcgattgtccagcttccaatatctactatcagtgttttctttgccatagcaggaatcttgtccactactgctgcatagcactgaggaaatactgccacatcatcaatttcaatatgatatgactcattctcatatttgaagcttacacgcttattctttgtcaggtacttgataaaatcattcttctctgctccaaatcttgtaagtggaagtcctacagcaagaaatacctttgcctctgcaagacctcttcttttaagttccttagcaactgctgcaagagtgagaagataaaagctgtcatcttcgacctttgtatcctttacttcctgcctcacagttccaaccttatagaactttccttcatactcaagtacatcgccgaaaagtgccggagttgttgtaatctccttaacacctgtgacaaatacctgagagattgttttcatcattgaccagccatgatcaatgccgattacttctaacttgttattcatgtgttttgcacatcctttcttcttaaacagccacttgaacatcttaaccacctactttcctatcagctttcgcatacaaggaaaacaataaccattcccccgataatacggacaaccgacacattccgctggaagcttctgttcttttttcttagatggcttacaacatgttccattggcacatctgttgttatgtccccagaagaatctacaatgcatacaatcttttaattctctttcaagcttttcttctggagatacaaacctgcgtttcttatgcttatctcttttttcaactgttcccaccagagctctcctcccttccaaggagtgattgctctcttatactttccaatatcctgtccgactcacctgccgtccttgctaatgaatacaatacgataagaacaataattataaatgctatgctaaatcccatcatcactttatcctccttcaaattagttgccatatagacaaaatttgaatttggaagtgatatagtctacatggctatgcttaatgctaagcatgtaggtacacgatttcttcttatgacctactgccccgtgtacaagaagatgttatcatcttcgggaacaggcacatgacgcatttcaatttttgaaacactatctcctcccttagccagttttgaggataaggacacactctctgtcctctatgggttattatcctacgcaacatatttatctttccacgctctcagaatctccttcaacttctcgtccttcatttctcaatccgtcagactactaatgtgatagctgtaagttggttcatatggtatatgccccgtattttccttatcaaagtcataatttctttgatagcctgttgccatattcacttttttcgaggtttccctcggatgaacatatactatcacagaacttaaaaatcaccgatagacaacactggtgtattttattttttttgcaccgaaatacggtgtttattcttatcattccaaatatgtgcaggcaaaggtcttgatggttctctgaatttttccaaataactctcaaatatctctgtattaatcagagctgaattaccgactttataaactgctcccgcctcctttgcaagagtcataattcttgtttttccaagcccatatatagccgcaccttctactgcatttacatatttcttcatgatatctttcgtatctgaataacacttatatgaataactcattcttctgtctcctttccgttaaataatggatgtttcatcatcaccggcatttctcgaaactgttccatatactcatcgaaaatatccaaactcacaagaacagttccagaagcaccatcacccaatttgtaaactgcacccgcagccctagccatttcaatcatacgatgtcttccaatactatatatgacagacgcttcacctagtcttacatattttttctctattactttccctgatatcgggatcttatataaatgtttcataaaagtctccattctttctctatgtatcagactcgtcctcggaagcctgtataaagcccctgctgcagtcgcataggcaataatctcattagatgacaattcaaattcatctgctgcttcagcttctctcaaataccgcttcgatatatttccggaatgatagcctctaatatcatgttttaattgaaccgccactgacttattcctccaccttaaactgctctaaatacgaatcaaggatttccgtattcactaaaaccatctgatttattttataaatagctcctgcctctttggcaatttcctgaaacttggacattcccattgcatacaatttgcatccttccttatatctcacaaatttctgtgcctttaatctgctatcttcgtaatcatatttttttctttctgccatttcttactctctccttttccgtaacgcaaaaaggacacctttctaaaatttcttttagaaaagtgtcctaaattagtgcattatcaaatttaactttcaagcagtaatatctgaacttattcgcaagtattcatatccgactaaccatttgttgtcattttgttgtccttttgacacagacacctaaattacaactctagaaagccttgataaattgcggttttacggcatttctacttgtcgatgctcttcatcgtcgggaagagcagaacatctctaattgcaggtgaatctgtaagcagcataacaagtctgtcaataccgtaaccgataccgcctgttggtggcatacctactgcaagtgcgttaaggaagtcctcatctgtgtgctgtgcttcctcgtcgccgttttctgcgttcttatcctgctgtgcgaaacgctctctctggtcgattgggtcgttaagctctgagtatgcattacacatttcccatgtgttaatgaaaagctcgaaacgctcaaccttctctggatcagatggcttcttcttagtaagtggagatattgcaagaggatgatccataataaatgtaggctggattaaattctcctcgcagtactcctcaaagaagaggttgatgatgtcgcccttagtgtgacgctcctcgaactcaattcctctctccttagcaagagccttagcttcttcgtcagtcttaattgtatcaaaatcaacaccggcatattccttgattgcgtcattcatagtaagtcttctgaatggctttccaaggtcaatctctgtgccgttgtaagtaatcttagttgtaccgcatacagtctcggcaaggtgtctgaacatgctctccgtaagttccatcataccctcgtaatctgtgtatgcctgataaagctccataagtgtgaactcaggattgtgtcttgtatcaacaccctcgttacggtatactcgtccgatttcgtaaactctctcaagaccaccaacgataagtctcttaagataaagctctaatgaaatacgaagcttaacgtcctcgtcaagtgcgttgtaatgagtctcaaatggtcttgcagcagcaccaccagcattagatacaagtgttggtgtctcaacttccatgaagtctctgccatcaaggaaccttctgatttccttgataatctttgatctctttacaaatgtttccttaacctcaggattcattattaaatcaacatatctctgacggtatctcatatcagtatctgtgattccgtggaacttttctggaagtacctgtaagctcttagaaagaagagtaatctcctcagcgtgaactgaaatctctcctgtcttagttctgaagataaatcccttgataccgaagatatcaccgatatcagacttcttgaagtctgcatatgcttcttcgccaattgcatctcttgaaatatatgcctgcattctgcccttaagatcagcaatgttacagaaagatgcctttcccattactctcttgaacatcatacgtccggcaaagcttacattaattggagaagcgtccataatggctcttctctcattgtaatcagcagtaactgcttctcttgcctgctgctcatctaaaccttcagtattaactgctggtctgtcaccaagaagttccttctcatgtgcttcatagatggctctgatttcatctgtgtgatgtgttacatcatactttgttatctggaatggatccttacctgcgtcctgaaggttctttaacttttccatacgaaccttaatctgctcgttaacgtcaggctgctgtgcagatttattatctcccatgaatgagtatctccttttctatacgttactgaaatatatctttattagtcgttctctcagaaattagtcgttctttacagatacaactgtatattcaatctctccaacaggtgcttctaccttaacagtatcacccttcttctttccaataagagctgcaccaagtggtgactcattagaaatcttgttattaaggctgtctgcctctgatgaaccaacgattgtatactcgatatcctcatcgaattctacatcgtgaagtacaacaacgctctccatcttaactacatctttattcttatcgttatcctgaataacctcacagttagcaagaattgcttcaagttctgcaatttctgtttcgatatctctctgctcgtccttagctgcatcgtactcagcgttctctgataaatcgccctgctctcttgcttcctttaacttctgggcaacttcctttcttctgacaaccttaagctcctcaagtcttgctactctttcgtcatacccctttttagtaagaaactgtttctctgccatgttcttatcacctttctatatatatgctacactaatatgcttctgctctactagagaataaaaccccacaagcgtcacaatattataaactatcagttcctgtctgtcaatgcagcccttccagtatcctgtccacaagcccatcaaactgttccagattagtaacctggttagcttcatttcttaatgccgctgcgtgcttgattcctgctgtataccatgcaaaatgttttctcatctcgcggattcctgtaaactcgccttttatctcacacaatcctttggcatgcctcttaatcatctggcatatttcttcaacagatggaggtgcaattattgtaccattattcatatattcagaaacctgtctgaatatccatggatttcctcttgcagcccttccaatcattattccgtcacagcctgtctgcttcatcatattaacagcgtcttcgccgcttttaatatcgccattaccaataactggaatcgatactgcttctttgacctgtcttattatatcccagtctgcatgtcctgaataatactgctgccttgttcttgcatggactgcaacggcagccccgcctgactcctcaataacatgtgctatctcaggcgcatttatactattctcatcaaatcctgcccttatcttgattgtaagtggcttatcaagtgcatcagccatcttctcgactattcttccgacaagcacagggtccttcataagtgccgaaccttcgccattattgactacctttggaacaggacatcccatattgacatcaattatatcgaactctctttcagaaagtctcttcgctatatctgccatgatatcagggtctgaaccgaaaagctgcaatgcaagcggacgctcccctggcaccgtcttcatcaggtcttctgtattcttattgttatacagcactgctttggcgctgaccatctctgtacacataagcccacagccctgctccttgcataaaagtcgaaatggcaggtctgttactcctgccatcggtgccaatgcaatattgttctttatctcaacatttccaattctcataattactccatgcctaagaagaataccttgaagaacatctcaagtgattcaagaagctctctcttctcatactgatacttcttgacaagcatgccgcatgctatctcgtcatacagtaaatcaccctcgtctgctgatgatttgaacaaaagattgccctcctcatcgaattccatatcaagtattccgcctacttcctctgtgaaaagaacgcacataatctttaactcgttctttacatcatcaggaagcttatcgaaatcagggttaaaatagtatttcttctcataagaattagatacacataaaactacattttcatcaaacatatccatataatcctctcacagaaacctctccggttctgataatcttctcgccctcgtctgtcttaatgataagctcgccctcatcattgattccaagtgcttttccaacaatttccttgtcagcatatattgccttgacgtcgccgcccttattgacaagcattgaattatagtcttctttaagcccagccagattctgtgtcttaacaaatgtatcatagtactttgcaaagctctctgaaaatgcggctactatacggcttcttttcagatggtcgccagtctcaagatacagtgaagaagctgttgccttgattgaatcatcaaattctgtcgtattaacattaattcccatgccgataaccacataatgtatgtaatccatctcagcactcatctctgttaatattccacataccttcttcttattaagaactatatcattaggccactttatacggcactctgcgtcatgtccgtcctctgtaagaaccttgtgtattgcctcctgaacagccatggctgccactattgtaagcattgacgcattgactggtgatatatccggtcttaaaagaagcgacatccatatcccgcttcccgcaggagatacccaattcctgccgcgtctgccgcggccgcctgtctggctctctgttatataaagtgttccatcagctgcattatctctctctgccgctctcttagcttcgttgttggtagaatctgtctcgtcataatacactacttcgcggataatcccggttgtactgcctgtatccacacatgtaagctgactcattatctcgcttgatgtaagaatatcaggatactgtgttatatgatatcccttattctggactgcctctataacatagccttcttcttttaactggtttatcaccttccagacagccgttcttgaaacccccagcatattgcacagtgcctgccctgacacatatccatctgattttctcaaaacatttaaaatcttagtcttcataccattacccgccatgctattactgccataagcagaagtcccaacgtaacaactgtaagaataacacctgacaccgttctgtcactcatgaaattcttagctgctgtaagtccgttaactaatgctccaagcatgaattccacagcgaataatattccgcttccactgcgcaggaaaagtataattatgaataccactcctattgcaaatgtgagtgctatattggcatagtctatgagcatcttgctctttctgtacgcgccactcgttgtataatacataacgcctccataataaatatctggtgaattactatttcatgctgtgtcgtcctgattttggactttcacatgtctttccactgctctaacgtccaattccgcgtgtcaacttcccgattctggacttcctcgtgcctattcactgttttaaagtccaatctgtcattctttctcgtcacttttggactttcacatgtctttccactgctctaacgtccaattccgcgtgtcggcttcccgattttggacttccggcatgacacacgccactctaacgtccaatttacttataagctccaagtgtagctgccattacagccttgattgtatgcattctgttctctgcctcgtcgaatacaactgactgctctgactcaaatacttcatcagtaacttccatctcgtcaagaccgaatttgtcatgaatctctttaccaatcttagtcttaaggtcatggaatgcaggaagacagtgcataaatattgcgtccttagaagcattgtccataactgccttgttaacctgatatggaagaagtgccttgattctttcagcccatacttcatcaggctcgcccattgatacccatacatctgtgtataatacatctgcgtccttagttcctgccttaacatcttctgtaagtgttacagaaccaccgcttatctttgcccattcctcacactgtgcaacaagttccttgtctgggaaatattccttagctgtgcaggctgtataatgaagtcctaacttagcgcagacaatcataagtgaattacccatgttgtatcttgcatcacccatgtatacgaacttaacgccctttaatctgccaagcttttccttgattgtaagcatatctgcgagcatctgtgttggatggtattcgttagtaagtccgttccataccggcacgcttgaatattttgcaagatcttcaactatctcctgaccgaatcctctgtattcgattccttcaaacattgtgcagagaactcttgctgtatcagcaatgctctccttctttccaatctgtgaacctgtagggtcaagatatgtaacacccataccaaggtcatgtgctgccacctcaaatgagcaacgtgttcttgtacttgtcttctcgaatataagtgcaacattctttccgataagtggctgttctacaatgccctttttcttcttatccttaagctctgctgctaagtctatcaaatataaaatctcctcaggtgtgtaatccttgagtgttaaaaagtcgcgtccctttaaatccatgacatcctcctgtctgtatggcaaattcgcctacattgaataattaataactttgttcattctatcgcaattatagttcttcgtcaaatgcgttgtttaatttgtgtagttgcaaaacggtcggttgtgggagatagtggatagcttccgttaaacttctctgcataataataggcactgggcgttccatgcttcgtccccgaccgttaacgctggcaacgcacatccttgtgcgcgccagctcacgcgtccgtccatggacgcgtgtacactcattctttctacatgcccagtacctttattatgcgttcagtttaaagtcagctttccgccatctcccacaacctccctttctccacacttctccaaattcagggcagagtagctttcctctcctacacctctccggactggttcaccttccgtccgccaataaaaaaggtggtgtggcttttctgactgcaaactatgcacataataaaagcattgagcaaagtcactacctaagtgtacgcgcgtccacggacggacgcgcgagctgtctcgcacacggatgtgcgttgacagcgtaacgagaacttaaacagccttccacgctcaatgcttattattatgtagcgtagtttgtacggaagaaaaccacaccaccttttttatcccttaatggaatatatgatctccaattattacaaaatctgaatagttgttaacatctacagtatataatgccctgaatgatgtataaccacctatattattaacacctgataatgcttcaagtgctgcctgcatgcattctgtgtttctcggaccatttgcaagtcttactgcaaatctgtctgatggattaccagcgccatctgatacaccagagaactgtgatctctgataaacaacacccgaaactgtacccggataatgtccgcttcgcactctgttaagaataacatttgcaacagcgagctttcctgcatatggctgatatgcagcctcccagtctatgatacatgccataagccatatatcatcatctgatacgctcatagttgggttatatgttatatctgttcctgatattgtattagcaattatcttctgtcgtcttgcttcctctgctgcagctgccgctctttcagcttctgcctctgcctcaagtcttgcttcttctgcaagtctttcagcctcttcttctgcttcaatagcttcaatctctgctattgtatatcctgcaagaagattatctgttccaatctgttctgctatagcctctgcttcttctccaaaacataagcactgtgtctgtacataaccttcgcagtttcctgaactaactttagtccattcctttccgaccatatcaacatccacaagtgtgttagtatataatcttcccacaacctgcgctgtctcttcgtcagaagtgtcataaacatcaagataaggatcagtaattgctactgccttgttcttgtatgttcctgtttcttcatacccagtcacaagaacctcttctgtattagctgaataagatgcaaccttaattcccgtgtcagtattctgtgttttctcataggtagttgccactgctggaagaaccggtgtcataaataacacaatcgcagctcccacatagcaagcagctttgctacttctaagtttcatattatacttccctttccggcggcttatttagcttcgcctgtaaattgttacagaaatgttacaatttattacggaaatataatagcaaagttacagtaatttgtcaaatatgttaaaacccgctctatgagcgggtttacgggtttgtttattaaattcattttgcaaaatatagtatatgaccatatatatagttggttatctacacacttctctgtctgacagcttcgtatgtaagaattgtacatgctattgccgcgttaagagattcaacctctccctgcatcggaattcttataagtgtatctgcctgcttagtgatatcatctgtaagtccatttccctcattgcctattagaaatgctgttccttccctgtaatcttcaccaagatatgtattctttccgtcaagatgtgcagcatataccttaattccagcattctgacactgtgaaactgcatcgctaaaatcctgcacatatacaaatggcactctgaatatagaacccattgttgaccttattgtcttaggattatatatatccacagtattagaactcataacaactccggtaacacctgcaccttcacccatccttaatatagttcccagattacccggatcctgaagattctcaacaagaatcaacaacggattgtcggtaagcatatctgaaatactgctgtccttcattcttacaaccgccataattccctgtggtgtctgtgtctgtgacattctgtcaaatacattatcggcgacaatctcaatactgtcagaagaaatcccctgcttcttaaccagctcatgcacatactcaggattgttactatgaaatctttcagacatatatatcttcaccagtaaatctgccggcacctcagataccatgcggactccctctacaacatattctttattcttctttctttccctggccttagaaagcaatgatataacatgctttacctgtgaactgctcgtactggttatcattatgaggttacctttctgccatgcattacttagaaagtaatgcacttatattaaattcataatcattaatatccttagtcatggcaagtgcttcatcaatatcataatcaacaaacttaccatccttgtatgctacaagtctgttactctttccttcagcaagaagatcaaccgcataagcacccataatagacgcatacattctgtccttacatgttggtgaaccaccacgctgcatgtatcctaaaatagtagctcttgtctcaatacctgttgcagcttcaattcttcttgccattcctgtagaatgtccgataccttcagcattaataataagatggtgtttcttgcccttctttcttccttctataatatgattaataagagcctgctcatcattgtcatatctttccggaagaaggatatcctctgctccattggcaataccacaccacaatgcaatatatcctgcatttcttcccataacctcaataatactgcatctttcatgtgatgtagatgtatctcttatcttatcaatagcttccattgctgtattaacagcagtatcaaatccaatagtataatctgtacatgcaatatcaagatcaattgttcccggaagtccgatagtattaattccctgtgctgcaagcttctgtgcacctctgaaagaaccatctccaccgattacaactataccgtcaattccatgctttctgcatacttcagcacctctcttctgaccttcttcagtcatgaattccatgcatcgtgctgtatagaggactgttccaccacgctggataatatcagcaacgcttcgcttgtccatatcaattatctcatcattaagaagtccgttatagcccttctgaatacccttgaccttaagtcccttattcaaagcagttcttacaactgcacggatagcagcattcatgcctggagcatctccaccacttgttaatacgccgattgttttaatttcctttgccataacttcccctttcttatctcttaatattattttctgctttatgttaccacattataaaagaaaaatcttctttttttgataattttttaccaatgttaattaaaatttatgttgtagcaacatttttctcaccatatttactcttaagaatataaagcaggtctgatgtcaccttcacgcactgactctgtggaagcgctattctctgtttttctgccacacaatatattgtgactgtgtctttaccgtccgattctttgaaaatatcagtaagctcatccctgtgtgtctcatactcagcaagactgtcaaacctgagccacaatcttcttggaacactgtcaaagctcacaacactgtctgccgtaagtcttgctggtttgtcggcatctgcctgtattcttcccgtaacaaatactttgttggtcgtatcaaaaagtcttttatatttttgataatttcttgcaaacatgattacctcaacgcttccaacaaaatcttctattgtaaggtacgccatctgctggcctgaaccggtagtaataaccttaatgttacttataaggccacctatcgtctgctttgaaccgttcataagctttgcctgtccggtttcctcatcaataagaaaatctgtacttctcgcagaaatatgcttctcccacataccagtatattcatccagcggatgtcctgttacatatacaccgagaacttctttttcccgttcaagcagatcctccttttcaaactcctgaatatcaggcactttcatttcaaggctctgtttatcctcttcacttacgaaatcaaatagtgacatttgtcctgaaatagcatctttattctgcttaacagcactatcaatcattctctcatagacattcatcatgccccgtcttgtattaccaaatgtgtcaaatgcacctgcaagtataagatgttccactgttctcttattaattacccctgccatccttgtaataaaatcctgcatggagtgaaaatcgccattattggttctttcttcaatgatcgcagtaattgtaggtcttcccatactctttaccgcattaaatccaaaccttatgttcttaccttcaacaccgaactcagcaactgatttattgacatcaacaggaagaatactaattcccatctctctagctgcaagaatatattctgcgaccttacttgttttatcagttacacttgatatcagccatgccatatactgtacaggaaaatgtactttcagatatgctgtctgatatgccacaaccgcatagcatgccgcatgtgatttgttaaatgcatattttgcaaagtccttcatctcatcatatatcttattggcagtctgttcacttatgccattcttaatacagcctggtactccgttagcctcattaccgtatacgaaattctgacgttcctgctccattacatcaagctttttcttagccattgctcttcgcacattatcactaccgccccacgaatatccggcaaggtcacggacaatctgcataacctgctcctgataaaccatacagccatatgtcggctctaagattgactctaactgcgggcattcataggttatgtttcccgcgttctcttttcctttaatatactgtggtatgaaatccattggtcccggtctgtaaagcgatataccggcaattaaatcctctaaacaatccggttttaactctttcatgaagtttttcattccgccactctctaactggaatatacctgcacatttgccctgacttatacattcaaatacagccttatcgttatatggtatattatccaccgaaaatgcagggtcaatctgctgttcacatttttcagtctgttggattacagttaagtttctaagacctaaaaagtcgaattttaacagtcccaaatgttccaaagtaggaccttcaaactgcgtaaccttaacattatctgctccaactgcaaccggaacatactctccaacatccttctgactgataagaacacctgaggcatgaactgaagcatgccttggcagtccttcaagtctctttgctttatctataagatctctcactgtctcatcagcttcatacaatgccttaaactcagcatttggcttaatgtccctgtctgcgtcaccattcattgcactgtcaatcgtaacaccaaccttctgtggtatcatcttcgcaatgttatcaaccatcgcatatggaagatccataacccttccgacatctttaataacggctcttgctgccatagttccaaatgtgattatctggcacacacattctttaccatatttttctataacataatcaataaccttctgtctgccttctggtgcaaagtccacgtcaatatcgggcatggacacacgctcaggattcaggaatcgttcaaatacaagattgtatttaacagggtcaagcgttgttattccaagacagtatgacacaagacttcctgccgccgagcctcgtccgggtccaaccggaatatcatgtgtcttggcataattaatgtaatcccacacaatcaggaaataatcgacatatcccattgaatagataactgacaactcgtaagaaagtctctggaatatatcattcgaatcctctgccctttttataacaacatcttttctgtctgcaactattgatgcttttgcctgctctataatatcttcaacgcatacatctgcggtcttgtccggatatctcttctttaatccctcataacataaagcattaagatacacccatgaattctttccatattcttcaggcacatcaaatgctggtagctttgtaactccgaattctatctcaacattacatctttctgctatcttatgagtgttctcaactgcttccggtacgtatttgaacaattccgccatctcttcctctgactttaaatagaactgtccaccctcatatcgcatcctgttttcatcagaaagcttcttgcctgtctgtatacacaataatatatcatgtgcatctacatcatctgcataggtataatgaacatcattcgtacataccagttcaattccggtctcattatgcatacgcataagctgtggattgacatagtgctgttctgctattccgtgatcctgtaattcaagaaagaaatttccctttccaaatatatcctgaagttcaagtgcagcatctcttgcagtctcatacatgcctcttgacagatatctctgcacctcacctgcaaggcacgcactcgtagcaataattccctcgtgatattcccttagcacttccttgtctactctcggcttatagtaaaagccttctgtaaacccctttgagactatcttcataagattctgatatccggtgttattctctgccaataatacaaggtgattatatttatcctcactctgtcctgcgcctttatcaaaccttgaccccggagctacatacacctcacagccaagaacaggcttgattcctgccttcttagccgcctcgtaaaattcaataacaccatacatcacaccatggtctgttattgcaaggctgtccatgccaagttcctttgcccgtttagtaatctcttttatcttactggagccatccagcaatgaatattcagtatgcacatgcaaatgtgtaaaactcatagcatctcctccctatgtaaaaaaatataacatattttcgtttattaatcagcaattttatgatattctatatttaattattaatgtaagggagttgtattatgttaatatctgctattcccgtaggcgggccaatttcaattgaaatatccatagataatgtcagctacgagatgccttcctctgttgttgcatccaagaatggctacattctcatagcgccttttacatcaaaaggtgctgtaatagatttttcttcttataaggatattttatttaatctttataccatagacccagcaacaaagaaccgtgtagtctggaagaatattaacatagaaactatcacttataaatcaaccggtttcgcatctgcttactacaaaatctcgaccaatgtttttgccagcattgcctctgaatgcaacagaagatttaatcagcgcatttcaaccatggctttgggacatatctcatcagataccacagaagctgatattccggtaacgttaattgatgtcagtgataaaggactttcattttcgaccagcaacgaactattatataactataataatacgtatataacattttcagatcaggcaaacggaaagcagtttaactttcattttaaatgttttatcatacgcagccagttgtatggagaacgctacatttatggatgtattatcccaactccgtcccgtgaatatcttacatatgtttttcttaaaaaaattgaattcagaatcagttctgctaaagaacagtctgaacagaccgctcttaaagatgctgctgacgttgcttcacaatctattgaaagcacttcgtcaggatatcattcacacatatctgaaaagaataagcgttgatataaggggcatatcacaatgtgatatgcccctttattattaatcatcttctttttctttagctgtatcatcagattcattatcgtctgaatgactgccaatattcttccatatatcgctttccggctcaccactaactgtcgatgaatagcttccatcttcattaaatgttacgctttctgccactttctctgatgttgagaataatgaagtatcaaccggttcaggtattccctttgcctctctgaatatcttcatgaattccttgcctgtgatagtctcatggtcatacagatatcttgcaagctgatccattacttctctgttctctcttataatctgcttagcctcttcataacatgacgcaataagcttctttacctcgtcatcaacctctgcctcagttgcctgtgcacagttcatagatgctcttccgctaagatattcatcttcaactgttgataatgcaacaagtccgaatctgtctgacataccatatcttgtaatcattgtcttggcaaggttagttgctttcttgatatcatcataagcaccattagtaactgaaccaaatacaacttcttctgcagcacgtccaccaacaagtgatataaggtctgtcataagttcatccttagtctcaagatgcttctcttcctctgggaagttaagcacataaccaagtgaaccattagtatgaggtataatagtaatcttctggaccggatcagaattattcttgatagctcttataagggcatgtccaatctcatggtaagcaacaacctgcttttccttcttgctaagaactctttccttcttctccttacctgctacaactgtatcaaaagcaccaagaaggtccttctgggtaacaacatttcttccattcttaactgccgcaatagcagcttcattaatgatattggcaaggtctgaaccaacaagaccgcttgttgccattgcaatctcatcaaaatcaactgtatcgtccataagcacatccttagaatgtaccttaagagtctcaattcttcccttcttatcaggtctgtcaacggtaattcttctgtcgagacgacctggtctaagtaaagccttatcaagtacttccggtctgttagttgctgccagaatgaatattcccttagatgaatcaaaaccatccatctctgcaagtaactggttcaatgtctgctcacgctcgtcattgccaccgccatacttggaatctctgctcttaccaatagcatcaatctcatcaataaatataatacatggagcctgcttagttgcttccttgaacaaatctcttactcgtgatgcaccaacaccaacgaacatctctacaaaatcagaacctgcaagtgagaagaacggtacatctgcctcaccggctacagccttagcaagaagcgtcttacctgttcccggaggtcctactaaaagtgcacccttaggaagctttgcaccaatcttggcatatttctcagggtaatgtaagaaatcaacaatctctgtaagtgattccttagcttcatcctgacctgcaacatccttgaatgtaacacctgtctttttctggacatatactttggcgttgctctttccaacgcccattccgcccatcattccaccattcttagcaattcttctatatacaaatgcaaagattatatatatgaataaaaatggcagtacatatgcaagcagaaattctacaattgaagaactcgaatccggaatatatccttcaaactcaataccctttctcttaagaagtggtacaagagtatcatcattaacataccctgtataatatgtgtatgaaactcctgctatgccagactgtttctcctcttcaacaggtgtaataagaattctgtcctgctctaatgctactttctttaccttatcttcatcaatcatctgcatgaactggtcgtagcttatctccttgtaagttgcattcctaaacatattgctaagaagcgtaagtccgataaatgttacaactgccgctataataatgaatattataaggttaacattctttggcttcttgttattattgttgttattatgattattgttgcggttatcgttattattataaccattgtcataaccgttgttgttataattatccatactcttctcctgatatgatactgtacttatcttaagcatttccaaataagtctgttttcattataaagaaggaaaaaatataaatcaaccaaaatctaagtgtttaataagatgtttatatttactttatattcttagtttttttctttaaactatggaaatttgtaatacagggctgtataatattgcatatttttttgattacacattcagattggaggaaaagatggctgttaaatatgtatttgtaacaggtggtgttgtttccggtttaggaaaaggtatcactgccgcatctttaggcagactgcttaaagcccgtggtttttctgtaaccatgcagaagtttgacccttatattaatattgatccaggtactatgaaccctatccagcacggagaagttttcgtaactgacgatggtgctgagacagaccttgaccttggtcactatgaaagatttattgatgagagccttaataagaattctaatgtaactaccggtaaagtatactggtctgtattacagaaggaacgccgtggagatttcggtggaggcacagtccaggtaatccctcatattactaatgaaataaagagccgttttttcagagattattcaactgatgaaactaagattgcaattatagaagttggtggtactgttggagatatcgagagtcagcctttccttgaggcaatcagacagttccagcatgaagtcggacatgagaacgcaattcttattcacgtaacacttattccttatcttaaagcatctggtgagatgaagactaagccaactcaggcaagtgttaaggaacttcagggaatgggaatccgtccggatattcttgtgtgccgtaccgaacatccacttgaggctggtatcaaggataagatagcacttttctgtaatgtacctaagtctcatgtacttcagaacttagatgttgagattctttatgatgcacctcttgcgatggaagaagaacatcttgcacaggtagcatgtgaatgtttacaccttgactgtccagaaccagaccttgatgaatggagagcgatgtgcaaggcctggaagaatcctactaagaaggtaactgttgcattagtcggtaaatatatccagcttcatgatgcttatatcagtgttgtagaagcattaaagcatggtggtgtatataattcatgtgatgtaactatcaaatggattgattcagaaactgtaactcctgaaactgctgatgagcttctctctgacgtatctggcatattagttccaggtggattcggtgacagaggtacagaaggaaagattgaagctatccgttatgccagagaacataatattccattcttaggattgtgtctgggaatgcagctttcaattgttgaatttgcaagaaatgttataggatatgacgacgcacacagtgttgaacttaatcctaacacaactcaccctgttatacatcttatgccagaccaggaaggcattgatgatatcggcggtacattaagacttggttcttatccttgtgtacttgataaaacaagcaaggcttatgaactctatggcgaagagcttatacatgaacgtcacagacacagatatgaagttaataatgattacagaaaagttcttactgagaatggtatgatgctttcaggaatatctcctgacggaagaattgttgagatgatagaattaaagaatcacccatggtttattgccacacaggctcatccagagttaaagtcaagacctaatcgtccacatccattattcagaggcttcataacagcagcacttgaatatcagaataaaaaccattaattatattatatatgcataacaaaaaacatcacctgacgaatccgactttcgtatcaggtgatgttttttattgcttttgcttataaaattattatttattaagaccattaagaatcttcttaattctcttaacttcatcgtcttctaacttctgtgattcacaaatagaagcaaccatatcaacagcctttccgttgaaccagaaatcagcttcttcctttaaaagctgtcttctatattcttcttctgaacgaagtggatgaatgaaagctgcctttcctttacggtatgtatcaacaaatctcttgtccttcaacttacctacgaaagtaacaactgttgttcttgcgtaatccttaccataatcgtctcttaactgatcaataagttcctgtacaggaatatcctgtggtgcttcccatataagcttcataattaatgcttcacatggacttaattcattaaaatgatttctgctcataaaccctccttaggctcttccatagatatacatattctatattatactgccattattaatatttttcaactgtataatgaatagtcggatatggatttcacaattgtattaccgataaactgaatccatcaacttccttttctacaatagtgaaattctggggaagtccgcacatatatgctttcattttccctttctctaatctataaactattttgtccaaaatgtcaagcacaccttgacctgtagccttgccataagcctcttttaatgtccatattctgaagaatctttgatcactatcgcactctttaatccattctgcttcagatatgtcaaagaagcgttttgccagattctgtctacctttgcgggctttttcaatatcaattcctaccggtctgtcgcctatcacgcatgctacataattagacgaatgtgagatattgaaaaaaatttcacgatttgacaaaaaataaggttttccttgcgaattatatgctatttcataatcaaagtactgattattcgcttcaatcacagaaataatatccaccttctcatatagattttcatctgttttataatctctttctcctgtttttatagaccattttcctaccgcataattaagaagtaggcctgccgtcacggtttgcagcttattttcatacattttcatcttatcagccttagttttcctgtattccggaataagcgaataggccttttcatataacttttcatcagttaatgcatctgtcgttgtcacaaatatcatcataatcattcaccatctatacacttattgtctgtgcatctgccatataacgctttgagaacacgaatactatatcacctgatttaatcaatgtctcaccatttcttaatactgctgcaagaataagtcctcttggaagactaagctcgcataccttcttttcattccagttgtggtccttagttataataagcttaataaacttaagttccttctccataaggtaatctgtagacttcttaataaggctgtactgctcaacgaaacctgcagataagatacctgttggaatagcgaccattccgacgccaagaaatgtaatgataatactgaacatttttccaagcactgtcacaggatagatatcgccgtaacctactgtaagaagtgttgataccgaccaccatattcctgaaaatgcattcttaaacacttccggctgtgcctcatgctctaaactgtacatgcacagtgatgatgctatgataagcatcacaatgatgaatacagaggataatatctggtccctttttcgccttattacctctgttataacatttaacgcatcataatatgagttgacacggaatatccttaggattcttataaccctgaacatacggaaagcaactgctcctgccggaaaaaatacaggcagataattgggcaggaacgataaaaagtcaacaataccgcttcctgagaagatgtattttattctcgcaatacctgtacatttattaggatacagatattctgccgtccatacacgcagtatgtattcaattgtaaagccgataactgtaatccactctataacatctaacacaggctggtacggaattgactgttcaaatgtatcaaatatcgcaatgaacaggttgattataattgcagcagttatcgcaatatcaaatgtacggcttgcaacatcacccacatatccaatctggataatgtcaaatatacgttttttcttattattcaccgtatcccatcctcctacttaagcatataccacggaagcagcaatgctcttatatattttgcaaatggcacatatgccgttatgttaatgaataccggacataatataagacacgctataagaagcaccggtattattgaaatcattgcattggctctccttacaggtattgccacaagccatgcaaataaagtaaccgctattacatacacaaccatatgaagtatatctgctgcccccttaagttgtcctgccaccgcaagtgttaacattgctgatactgcaaaaagtacacatgatatgaatgcatacaacggctttcctgccacacggtacatacgaggcagtgttataaatgttccggaattcttatcaagataatattccacgattccaaaaagtccgcctatatatacaagaattataagtaatgcccttaacggaaactctcctgtcttatcttcaagctgtgtcccattatcctgtacaccatccagcaccttaaaatcaattctgaatgtgtcatctccggatatgtattcctcgtacccttttcttatctcttcctctgccttttctgaatgctttttaaatatgtctacagaattaacataattaactgcaacctcaggcgaatatgccttaaacatagcagaaaagaatatctcatctgtcattgagctgacaaaatctgacctgcatataataagctctataatgtctctgtagctgccactgtcaagcttatccttaagcccggtaccaactacatagccacactctgtgtatttattcattatatcctgctcaagcttttcctgcgattctgcttcgtagaattgaactgaataatcgccatttacaagataatctcttgtcattatggcaatcttatcgtcatcttcaagcactattccaacccttacaggctctttctccttaaaagacgctgtattcgtaattattaacgctgcaacaggcattgcaataagcaccacgacaatcacaggattctttaactgccttttaacaagcagatacagccagtataacaatctcttcattatctgtctctccttatcttaaccgccaatgctcctgctgcctgaaatataattatccacataacatttgtcataatggtactgatatccacagttcccttgattatctgacatgcaagtgtgaataagccgttagtcggaagatacatgccaataaccctcacacccggcgcaagaaatgctgatgaaacaatacatccggatgcatacatgcacgccattccaaggatacacaccgtaataactgaatacaccgtgtcgtcaactactgagaatatacagtttataaatgaaactgccgcatacacaagcaccacaatccccagtatggaagcaatgaattctccaactgtcgaaactgccagaactcctgatattgcaggcacccccagcctcattacattaattataataaaaagcacttcaaatatcattatatacacaatgccaactccggtagttcttgcaattccggtatcaaatgctgatattcccgcacctttaaggctctttgcaagcgacctgctctcccccttcatattgccggcacatgttattgtgctaagtaaaagcagcatcacaattgctgtgcatacataaaactgtactgtactcaagccttctttaaccgatatatctcttgtcttaaagtatatgcttctgttaagtgcatacgaaagatatatgtcattaagctcattctcatgtgtaccccgcaagcccctgtaattcttaagcacaccattgaacaaatcgtcaaatgtatatatccccgcctctgcagttgcaaggtcagagcctcctgccctcaccatctcacggaatatcatcgaagtattattaacaccctctgactgacacacaacctcaacaggtgtattctcgcccgacataatatcacttatcatattctctggcacaataatagccataacataataattatttcttaatccatctatagcctgctgtctgtcagtatattcaaatgtacagacattcttaattgtgtctatctcgctgacataattgaatgccatcttaatatatcgaaactccttattattatctgccgaatcagagttttctgtgtcatcataatcaggatacacaacagcaaccttcatcctcatgtcgctgtcctgtgccgttgcaatgcctatgcatgtacttattgcaataacaagcactgccgtcactatcgtacccagaattatcttcggtatagataaaaatgcggatttaatctgcaattttaataattccagtttccttctcatctaatcccccaattaaatctatctgtgaataatctctaaaagctcattgccggtaaccggatggtcaagttcattaagcttaccattctttaaaagatacattctgtcagcaagctttaattcaccttcttcgtggcttgttatgatgactgtacctccgcttttcgtgtaagcagacagataattcataatatcctgtttacacacaatatctaatgaagctcccggctcatctaatataagtacgggtggattcttagccagtgcacagcatatgcttaagcgcttcttcatgcctcctgacagcttatcaacacgtttgtcaagatattctgacactcctaacactgcaggaacaccgccctgtaagtctgcgtccatgtttcttcctgtatcacagtaccagaatttaagattatcccttgccgacagcttctccataagtggattctcctgcggcacaaaaccaatatatttctgaaacatcttcacatctgcaaatgcatctgtgccatctatcttaagacttcctccatctgccttaagacttcctgccagtatctccagaagagtagatttgccacagccgttggcaccgactatggcaatatactctccgctggcagcatgaaacgaagcgccgttaagcactatcgttttcctgccatatgattttctaatattttccacctctataaacatacatatatctccacattaattctgggctgctgtatcaaactggctgtaatacagcttgtgatagaatccgttcttagccagtaattcttcatgattaccctgctctataatatgtccgtctttcataacaagaataacatccgcagactggatagttgaaagtctgtgggctacaataaagcttgttcttccctccatcagctttgcaaatgcattctgtatctttatctctgttcttgtatcaatagaagatgtagcctcatcaagaataagcattggcggctttgcaagcataattcttgttatacataaaagctgcttctgtccctgtgaaaggcttccaccatcctcgcctataactgtgtcgaatccgttagacattctcttgatgaatccatatgaatgtgctgccttggctgctgcaataatctcttcctctgtagcatcaggcttacccattacgatattctctcttatagttcctgacttaagccatgtctcctgaagaaccataccaaaaccctgtcttaaagactttctggtcatctgtcttatatcagttcctgatacatcaatgcttccactgttaacatcatagaatctcataagaagattaataactgttgttttaccacagcctgtaggtcctacaatcgcaattctctgtcccttcttgacatgaagattgaagccctcaataagcttcttatctggcacataagagaagcacacatcattaaggtcaactgttccgtcaacctcctcgacaaccttagcgtctggggcgtcaggaatttcaggttcttcttcaataagttcaaatattctggctgcgcaggcaagtgcgttctgaagctcagtgacaacgcctgatatctcgttaaatggcttagtatactggttagcataacttaagaagcttgataactgaccgactgttataccgccattgatagccgaaaatgcaccaacaatcgcaacactcgcatatacaagactgtttacgaatcttgttgaaggattagttatagatgagaagaagattgcctttaaggaatacttctgaagtctttcattaatctcatcaaattttcttaccgcctcatcttcatatccgtaagccttaactaccttctgtccgccaatcatttcatcaataagtgctgtctgctcacctcttgtctcagactggagtttgaacatgctgaaggtcttcttggcaataaagcttgcaactaaaaacgaaagtggcgtgataacaacaacagcaagtgtaatcttagcattgattgtaatcataaatataagtgttccaagtatagtcatgacacctgtaaagaactgtgtgaatcccataagcagaccatctgcaaactggtcaacatcagctattacacggctcacaatctcaccatatgaatgtccgtcaatgtacttgagtggaagcacctgaattttttctatagcctcatttcttatatctcttgttacttcatatgtgattctgttgttacatatgttcataagccactgtgaaagtgctgtaattccaacaaatataccaattcttataagtatattcacaatctttgcaaaatccacattattcacaccgataatgcagtcaattccacggcctacaagaattggtacataaagtgtagttgcaacagttactgctgccataataagcgatagtattataaaaaagctgtgcttcttaattcttttaaggagttttacaaatgttgatttattcttcttcattatgctacacccccttctgaatctgctttcttaaactgtgattcatatatctctttataaacctcacaatttgcaagaagctcgtcatgtgttcccattcctgcaacctgtccgtcatctaatacgataatgagatcagcatacataagtgatgccgctctctgtgaaactatgaacacagtaggagaattgttcattccccttatagcttttcgaagtgctgcatcagttgcaaaatcaagagctgatgcactgtcatcaagaataagcacatccggctttcttacgattgctcttgcaatagtaagtctctgtctctggccacctgaaaggttcttacctccctgctctataacataatccagacgtccctgcttagaatctacgaattccttagactgtgaaatctcaagtgcttcatctatctgctcatcagtagcgcccttctttcccatccacatattctctcttatagtacctttaaaaagtactgctttctgcatgacgataccgaccttatttcttaaagcctcaatatcataatctttaacatttacaccatcaacaagtacttcaccctgtgtagcgtcatacagtctcgggataagattaacaagactggatttacctgaacctgtgccacctataacaccgattgtctgacctttcatagccttgaaattaattccttcaactgaaggtgcacctgaaccactgtatgtaagtgaaacattcttaaattcaacacctggctgttcttccttagctacagcttccttaacgctgccatctgccattccagatgttacatcgaatacagactcaattcttcctgcacatgcaagtgccttagttattgtaatgataagattggcaagcttgataagttcaactaatatctgtgacatataattgtaaagtgcaacgacctgtccctgtgtaagcgcaccggcgttaactcttactccaccaatccatataagtgcaattattgatacatttacaacaacataagtaagcggattcataagtcctgatatcttaccaacatatttctgtaatctgttaaggctttcgttatcgtttttgaaacgcttaatctcatcctgttccttattgaatgctctgataactctcacaccggtaaggttctctcttgttattccaagaatcttatcaagtcctgactgtacatttttgtacataggtcttgttgcaagcatgataccgaatacgataagtgcaagtaccgggattgccgcaacgaatacaagtgctgccttcacatcaatagtaaatgccataatcatcgcaccaaatacaataaatggtgaacgaaggaacagtcgcagtaccatgttgataccattctgtacctgattaatatcacttgtcattcttgttacaagtgtcgatgtaccaagtgtatccatctctgtgaatgagaatgtctggatatgtgcaaataaactgtgtctcattcctgttgctgcaccaactgcagccttggcactgaaatactgtgctgtgatggcacatacaagtcctatgattgcaagaagtataagcataaaacacatctgcataatgtatcccttgtctgcattaacaatacccttatcgataactgatgatactaccaacggcacaaacagctcaaatattgcttcgagcatcttaaaaagcggtgccagaacacattcctttttgtaatccttaaggaatctcataatcattttcataagaaaacttcctccattaattcagtgacactaaagcgtccataagaaacttatatgaataacatctcttcatgccaaagtactctctataaatttcataattgtaatatgaatgttcaaactgtcttgaatacaaatgtgctatatcaacgcgcattgtaaaatctggcatacagccggacgcctgattagctgctgccataatgtccactgcaagtatgcctataaccgcattctttgctttaagcaggatatcgtaatcattcactgcatcaagcatgtatctatacacatagtacattgcaagctgctcatattcatgtgcaaatgcttcacttcccgcatggtaagttttcattaccgctgcaagcccagaatcatccgtcagcccgtctaggaaccgtcttactctcgccacatgaatattccagtcaggattgattacctccattcctttaaagtcatcaaagaaatgtctcaatccctttatcagccttttgccatgcagcttctcatcccggctttttagtctgtcaagcagctcctctctgtaatcagctccacagaaccgctttgcaacaccagctataagctcgtccctttcagcatcaagatgcttctggatacgctttgcataatcaagatagagcatcagtctctcaaatatacttatatccctgtctgatattattccaaaagccactattcttgcctgccgaagatgcatatatgtatatgcatctatatcattaggctccagcgtaagactgttatcctcaaccgtatcaaatgtaagttcatctttataagaaaacatcagctcaccagccgtcttacacgaaggggctatgccaatttctcttatattgccataatcgttaataaatcttggaaactctgcacatgtttcacacagcttatcctctccaagttctatatataaatcgcacagattatcatcattaagaaaaggacatcgtcctccttctttcagtgtaaatgtacattctccgtcctgagatggtaccattacactcttcaggcgctttccaaaagcacctttaactgttttataatatttgtaagaattcttatcaacatcgacatcccacccggcacagcatgtatctgtacaggctcccgcaatgcatctgaaatccttataataatgtggtgtcattaccttcattttattatctcccgcatataaaccggcatgttaagtgcatctgttaactacgcaaaaattgtctgccacaccttattagtgcagcagacacatttacatgtacatattattataattactgttctttttcttgtctacaatatacttatacactgtgacacacgcaagaataatcataagcccctctgctgccatgtatgtatagaacagatatggctgtcttaacgctgacacaagaagcggtgagctgactgcaaaatcatacattcccgtatcacctatatatttagacataacaaccgtactcatgattgttatattaggaaaagacatattaccaagcacaagtgccacaatcagcaccgtattgcgtatcagaaaaaatgtcctgctcaccttagctttactaagacagctcataacaatgcctccaattatacatacaagaaataaaagaaacatcatatacatctcagaggctgcaaatgcagacacttctgttgtcgcagtctcatatcctgtaagcagtgcaaagaacccaaatatagagcggccacccataatacatgccgccacaacaaataataatagtaaaaaattccttctgtttagcttcctgttatccataattcctccatttgcattattatcgcaattatggagacagatttcaataaatattttcgcaaacttcatattttattgtcacccgcctccactcacccctcaggcacgcactggtccgcaggggttggaacgattcgttagaattgcgttaatttatcaggtggtgcttttggcttaatgtttgtgtccattcgcagatgaacatttctggcattatgtccgcctgtggcatacgccctcaaggattgctgcacttagtgggagtaaatgccgctatctacaaagcttattacggtgtgctaaatcaaacgtgctccgcttgaacgtgctttagcacaccgcccttatgtatatagcggcattaactcccacacagttcgcaatatatcgggcgtaggtcacaggcggacataatgacggaagtgtacagatgtcgaatgaacacaaacaatagaaaaagccaaaagcaccacctgctaaattagcaattcttaacgtgttccagacccctgtggaccagtgcatgcctgaggggtgggtggaggcgggtggcttattaatataaagtttgtgtctatataaacttactccgccacttaattgcctcatccctatacgcaattgccgtctccataagttcattatactgtgcctttacactttctattgttgcctcaagctggcttattgtctgtattgcctgtctgttttcctgcatatatgtattaagctggttttcgtactctgatattttctgttcattctgcatcagcatgtctgtatcctgacatttaatgaatttcccatctgatgttatttcgtagaaactgtctacatacaaaaatgcttttccctgcattccaaacacttcatacatatcaacattttcacaatcaacaggaatattaagactgtcaccttcttccagtgggtagacagctcgcagcgacagtctgtccgtaagcgggtttgtcaccatataaaacagcattaacctgtctttatttactacaagctgtggacagtgcatatctgggttctcgctgcttttcacacgaaaaagtgcttcgttgttcatcacatttttaacaagaatatctccgttctggttctgatatgcataatatattgtgtctcccaacactacatctgaaagtccgtccaaaaagtctgacacaagcattatcgggcgttctataccgtctatgtacgccgttctcaaaaatatatatcgtgatatgctatagattataagccgtctgtcactgcctgccgtgtatacatttgccataaaaggacactcccgtttttatattattatatggtcacgcgaatgtagatagaacatataatgtagtaaagaaacgaagaaggaaaagataatggctaaatgtaaatgcagcaaatgtggttctacccgcattgtaagcaatatcgtgcagaacatgcctaatggctgctttgatgtatgcacgaacccgatatgcggttcccccgatgaactcagtattcttgcccctcttatctatgatgagataggtattaatctgtgtaccacattcgctgtcggcacagatatttcaacgacttatccaacagctaccaacgcatcagtcagtgttatagatatagcctacacttatggtgatgaaaatgttgaaatcacccagatagccggaaggcctaactgctactctgtgaaacttgccaaccttactgtaacatttgcaataacgctttatgatgagtcatgcagagcattagcaactcttaccccaacggcagtctaccttcctaactcaactactgctgcaacttatgatgaagataccaatccgacatctgtcacccttgaaatattcgctccttacggagtttcctacaactcgaataacgcaactccacctgtttatacgcctgcacttaacagtataggtttcttgtcatctgccaatgttgtaacccagggactcaacctttatgcaatacctaagcttttaggtcttgatactacagatgacgaggttactgtaggtctcactctcatcttacagagcctttacttctgtggataccgcgtaacaagtgccggcagaatctcaacgcctaagggaagcattgtttccggtgaagaatctgactgcatcaagtttgtttgcggaaacctcttagacagagccatcaagcctctcgatttaagtccaccttcatgcgaaggtaacttaaaaaaagactgcaagaagccttgcatgaatgactgcaccgacactcttaatactaacagcacagcctgccagagcgcatgtaataatggcaataacagccagacttcctctggtgcatgcaccggaccttgcaatggcatatgcagcaagactaactaataacctcaatctgtgggaacagacgcctgcctggcggctgtttccatgtacatattttcttcttttggacttctgcgcgcctttcctccgcttcaacgtccaatccaccgctctttcttgctccttttggacttcctccgtgcattcctctgctttaacgtccaatccgccacgccgcttcttcccttttggacttcctccgtgtattcctctgcttcaacgtccaatccgccactcttttctgttccttttggacttcctccgtgcattcctctgcttcaacgtccaatccaccactcaatttcttcccttttggacttttgcttgcctttccactacttcaacgtccaatcccaatctatacgctcacattttcttccatcgcaaatattttaattgctaatttccctactatgtgtgtataattaatgaaatatattatattaaactgttgtatacacagtcgtaaagtgaatatatttagctgtggatgctcttcggagtagccggcacttggtaaaccgcaagcggcttttgaagaaagcctaattgcggtgaacttagtgtccgttactagcgacaagaagcgaaagcgtgctccacagctaaatatattcactttgcagcgtccgtatacaccacagttcgcatggaaaggagttactaatgaattttaaaaagtacaggtcgagattccttttggtttttgcgaccctcactctcttgttctcttctgttcttcttacttcatgtcagggcaagaagattaagaacactgtattttctgtagatgatcttgcaggcaagactattggtgttcagttaggaacaactggtgatactctcgtaagtgattacgaaactgacggttctggcacaacagtatcaagatacaacaaaggttctgatgctatacaggctttaaagcagggtaaagctgatgctgttgttattgatgaacagcctgctttagcatttgttaaagctaatccagaccttacaattcttgaagaagaatttgcaaatgaggattatgccatctgtgttgctaagggcaattcccttactgcaaagctcaatgaggctattgaagtacttatggcagatggaactatccagaagcttattgacgattatgttggcgataatgctacattttctggttacaaatcaccagacggtataagccgtactaatggaactcttgttatggctacaaatgcttatttcaagccatacgagtactatgaagggggttctattattggtattgacgctgatattgcacaggctattgctgattacctcggaatgaatttaaaaattgaggatatggaatttgattcaattatcactgccgtatcttctggtaaagctgatttcggtatggctggtatgacagttactgatgagcgtaagaaaaatatcgatttcacaactacttatacaacttctaagcaggttattattgtccgtgacgacaatgcttctgcatcaggcatgagttttgctgagaagttcaagacagacttcatcaaagaagcaagatacacttatcttctaaagggtctgttaaacacagtaattattgcattctttgcagcacttatgggtgttgttattggtttccttattgcagttgtccgttctaaccatgataagacaggacacatgaagattcttaacttcatttgcaacatttatcttactgtaatcagaggaacaccaactatggtacagctgcttattatctactatgtaatattcagttctgtacatattgacaagcttattgttgcgatacttgcatttggtatcaactcaggtgcttatgttgccgaaatattccgttcaggtattatgtctattgataacggacagtttgaagcagcacgaagccttggtctttcttataaaacaactatgataagtgttattcttcctcaggcattcaagaatgttctcccagcacttgctaatgagttcattgttctgttaaaggaaacatctatcagcggttatatcggtcttaacgaccttacaagaggcggcgatattatccgaagcataacttatgatccaatgcttccacttattggtgttgccatcatctaccttgtaatggttatgggactttcacagcttgttaagaaacttgagaggaggttaagaaacaatgagcgataatactaacgaaatcatacttgaagttaaggatttgaagaaatcttttggcgaccatgttgtattagaatcaatcaatacaacagtccgcaaaggagaggttattgcaattatcggaccatctggctgcggtaaatcaacatttttgcgttcacttaaccttcttgaaactcctacagaaggtcatgtattattccatgagcaggatcttacagataagagtgtaaatgtggatgaattaagagagaagattggaatggtgttccagcattttaaccttttccctaatatgactataagaagaaacataactcttgctcctactaagctgggacttatgagtaaggaagaagctgataagaaagctgatgagcttcttgcaagagtgggactttctgacaaagccgatgcttatcctaaccagttaagtggtggtcagaagcagcgagttgctattgcaagagcactcgcaatgaatcctgagataatgcttttcgacgagccgacatccgcacttgatcctgaaatggttggtgaggttctcgcaataatgaaggaacttgctgcatcaggaatgacaatgattgtcgtaactcatgagatgggatttgcaaaagaagttgccaacagatgcatgttcttctatgatggagtcatcaatgaagagggggctccggaagaattctttggcaatcctaagagtgagcgattgaaggatttcttgtcgaaggtgctttaattagtacaaaggtgggcattgagatagggagatgttatacaagccctcatggatgcctgcacctagtgtaagtaaatgccgtcatatacaatgtcttttagctgtgtaaaaatcaaacgcgcttcgcttgaacgagatttttacacagcactttttgtatataacggcattaacttacacacggttcggcataaatcggtcttgcataacatctcccaatctcaaagccaccaccccgctactaggcagccaagccttccacggctggtgcaaacgtatcttatcaacagaggacatcacgcacttcaccagcccccactcagaatgcaatgccgcaggcgagcattcgtccggaggctgactacttggtgaagaagaagtcagccgtacagtatgctgtgggataggtgtgtggtgtccttaggtgtatgcccgaatattcttatgtcgtgtgaaagttaatgccgcaatctgctaaaggttgggacttgtaatctcgttcaagcgaagcgcgtttgattacaagtcccattataaacttagcagaatgcggcatttagtttcactagacataagaatcctgagggcagatgcctaaggacaccacacacccttccacagttactgtacgacgtccggaccatcaaacctccttcgagtagtcaaccttcagaagacacagtcccttcgccggcgcagttgcacctgcaaggcttctgtttctctcctctaaaagttcatacatactctctggtgttctctttccctgtccaacttcaagaagtgtaccacttaagattcttaccatgtactgcaggaatccgcttccatgatatgtaagattaaggaatgaaccctttaaagaaacatctatcgaataaatctcacggactgtcgatttcttcatcttgggattaccacaaaatgatgcaaaatcatgttctccagtaagtatgtctgctgccctcttcatggcatcaacatccagcttaccctcaattatattgacatattttctgttaaatacaggcttcttatccccaacataacatgtatagcaataagttttcccctgtgcattgtaacggctgtggaatctgtcagatgcaacacgaacctcctgcacacagatatcttctggaagatatctgttcatataatcgcatatctcatcttccttcatctttgtttccatatgtgcattagctaccattccctttgcatgcactccggcatctgttcttcctgcacctataacctcaacctcagttcctgtcatggcagaaagcactgattctaactttccctgaattgtcatatctgtagttggctgatgttcccagccataataccttgtaccatcataagtgattatcatcttataattcttcatccatatctcccattcattcttctgtccataaacacttttatatcatcttgccagattctgcttcattccatcaaggaaatcatatatctcatccataaataccttaccataacgctcatatttattttcgccgacaccgcttactgacaacatttcttcttcactgaatggtactttaatacacatgtctataagcgtcctgtctgaaaatattacatatggcggaacgcctactgaaacagctatctgttttcttaactcacgcagtctgttaaacaacataacacctctgtcattaagtgcatcctccggcttctttgacttgggcgttgcatatgctgactttgcagcagcggcagaacgcttcattctgtctgccaccattgcagcattccttgatacaggtgcactgaaacggtttcccggatacatataagcctcatctgcttcccgttctgcctcatcaataacgcagttagaacagttatggcagttgtatcttccaccctctggattgtctggtctttctccaaaatatttaagtatatactctcttaaacagcctgttgtcttgcagtaatcgaccattgcattaagccttcttttatcaagaatcataagacgtgcctgttcttctgcatccatatcaggattaggctctctatgttctatgaaaaacttatttatcataatatcctgcggagaatacagcaatacgcattctgaatcctctccatctcttccggcacgtcctgcctcctgataataattctctatgcactgtggcatattataatgaattacgaatcttacattggacttgtctattcccattccaaatgcgttggttgccacaacaacaggcttgatatcatatataaatgaatcctgattctcttttctctcttctgccgaaagcccagcgtgatacttagttacagatagtccgttggcattaagcatgtcatagactttctcaacatttttccttgtagcacaatatataattccgctgtcctgtctgtgacttacaagataatcaagtatataagaatccttgtccttgatatgctttaccttgaatgtcagattacttctgtcaaatccagtagtgagtataaccggtctttcaagagaaagaatctgcagaatatcgtcccttaccttacttgttgctgtagctgtaaatgcgcttattatcgggcgtcttgccagcttcttcacaaatgacaatatattcaggtagcttggtctgaaatcctgtccccactgtgatatacagtgtgcctcgtccacggtaatcattgatatctctacatgtgtggcaaaatcaagaaagccccaggtttccagcctttcaggtgcaacatatataattttataccgtccctgctttgcaaatgcgagtgccttagttatctgattatctgtcagtgaactgttaatataagctgcatgtacaccagcctgattaagtgccccaacctgatccttcataagcgatataagcggcgacacaacaagagtaatgccggacattaacaatgccggcacctgataacataatgattttcccgcacctgtaggcataattcctaacacatcctgccctgcaagaatagcatcaactaacttttcctgacccggacgaaatgaatcatacccaaaataatgctttaaaattccgtatttatccatatattactctcttttcaatcttctcttactctcatacattctcttatctgctctgcttcttgtatcttcaaagttcttatctgtctttatatcatattcagcataaccacatgcaatctgcacattaaggtctttgattccaagttcttcttcagtatacttttcaagttcccttagctgctttacatgtcttccaatatcaaagcttttttgcttctgattaattacagtacagaattcatccccacctatacgataacatttaccatgtctgccaaatatctctttaataattctggctgatgcctgtatataggcatctcctgctgcatgccccagattatcattacaccacttaaggttattaaggtcaaatgtcactatagaatacccttcataatcagaagtttcctgttcccactcctcaaatgcagagcgattataaacccctgtcatagtatcagttacagccatctctttgtagaaatccaccttctggccttctttaatcttctcaaatgcttctgatatgctctcataaccaagcacaataataaatataagaatacccagttttcctataagatctgtctgctgcattcccttataatatgcaataagatcaacaatcatagaaattccaagtgcagccgcacctacaatattagcctttactttcctgtcaaagcctttaacccatactcttttaataagaactgtccagaaatatacaagtgacatagcaagcatcatatgtataatgtacacgctgttcttaaactcccacacacctgtcatatgacatacaagcagtattacagctgttgcagcatatatggcgcataagatattattcagagcacttttccctatctggaaaaaattcttctctgcctgcataaaaggaataggcatcatcataagcagtatataccctatcagtgaacctatcttcctgttctccacaagaattgttgcaatatcagtctcattaagagcccatgcacctataatcattgcaaatataccaaaataaaacagtgcttgtgtctgtgcaatcttctttctgcagaaaatccataatacaatcatagcaaatccaactattattataaacgaactaagtactgctgatggcagcgatttcgcaataagctcttttataagttttgtctcgtcaccatattcaaatgttgttcctcttatcttatgaccagcatatacattagtaagccttacgattatatctgttgtatatggtggaatgttcacaatcgtataattagttccagtggttgttccatatacagacctatgtgcttttatataatatataagtcttccacctgcatatacttccacttcctgatgcctgcttacaaatgccagtgcattattatttcctgcacttgctctaatcttcacatgatattcaattgtgtcatctccaatatatcttgtatcctctggtttaactacgacactcgttcttttatctgccggtgtcaccttatctacagtgctgaatataaatcctgaagccataaaaagcagaaatcctaataaaaatatacagtaaaaaatcctgttaactaatttaattcttttcataaaaaaagcctttcagccgtactatagtgttatccgtaataaatctaaccctataatacagtagaatggctttattttcaaatgattttttgttgttctgtattttgtacactattcgcaaagttttaaaactgaatagcactacaagttactattatatacttttagcaagttccgttggattctctgaaaacttcaaagctacatcccttgaaataactcttgtcttaacaagattagcaagcgaatagttcattgtgtgcatacctgtctgcatatttgactgaagaacggtctgaatctgattagtcttcttctctttaataagattagatactgctgtattattaagcataatctctgttgcagcaattcgtccttcctgctctgcacgaggtacaagtgtctgtgttacaactccagttaatacagatgcaatctgtattataagtgcagactgcgcctcaatagggcatgcactgattatacgctcaactgtctgtgtagcgcttcttgtatgaagtgttgataatacaagatgtcctgtttcagcagctgtaattgctgcattgatagtctcataatctctcatctctcctacaagaataacatccgggtcttcacgaagtgctgaacgaagtgctgtcgcaaaatcaggtacatctcttcctacctgtctctgatgtatcatagatttcttaaacccatatacatactctataggatcttctactgttataatatgtcttgacatattgttgttaatataatcaatcatagctgcaagtgttgtagacttaccacttcctgtaggacctgttacaagaataagaccagaccttttctcaacaagcttagaaaaaagttttcctgaatgccccaattcttcaaacgacggtataacagaatcaagaagacggatacttgctgcaagatttcttctctgatgatatatattaattcttaatcgtccaccagactcatcagtagatgccacgtcaatatcttttcctgcctgaacattctgtatatcttcatcaccaagaattgagaatatcatctcttctgtttcttctatcgaaggtgttatatcaagaagctcaagttcaccatattttcttaccgcaaccgcttctcctgcagtaatatgcagatctgaacacctgttatctcttgcgtatttaattaattcttttaattccatgttcccctcccatacattttgttcattagtatgaaccacaataaaatactaccataataaaaatgcatattcaatcacacttttatcccatttttcttacatatatcattaaggcagcatctttcacagtgtggcgtagtacgcgccgtacatacctctcttccgtggtctacaaacctgtggcacaatccgcttccttcttctggcgggactatcttccacaatgccatctcaaccttcttaggctctttctcgtcttttacaagacctattctgttacaaagccttatacagtgtgtatctgtaacaattgccggctttccgaacacatcacccataataagattggcactcttccttccaactccaggaagctttaataattcttccatgctgtcaggaactttatcattatactgttcatgaagcatgcgcatacatgcacatatatcccttgccttgctttttccaagaccgcaaggtcttataatcttttcaatctcttctggagatgctgcagcaagtgatgctatatcaggatatttttcatacagccccttaaccacaacatttactcttgcatcagtgcattgtgccgcaagtcttacgcttacaagcagtttccaggcatcatcgtaatcaagactgcactccgaatccggatattctgcctttaatcttcttataacctctaaagcaagttctttcttagtcatagattacgcatctttcttcttataattagcaattccgaatattgcaagaagcaatacacacgcaaatatcatccagccaacaagataacctgttccccttggtttaaatgtatcataataacccttaaggtatacaaccactataatagccggaagtatataactcatatagaatcttaaccattcaggaagcttaggaccttttccttcattagcttcttttctgaagccttcccagccccagccgttcttcttggtacagaataatacaaatatcatgcttccaagaggaagcagattatatgaaacaaggaaatcctccagatccataattgaacttcccggaccaataggctggaaagctgcaagcttgttaaagcctaatacagcaggaagcgaaagcagtatcatgaatataacattacctgcaacaacctttttccttgaaaatcccttaaggtcaatataaaaagcaataatgttctcaaatacagcaattacagttgataatgctgcaaatgacatgaatacaaagaatgctgttccccatattcttcctcccgccatatgattaaatatgttaggcagtgttataaataaaagtgatggaccggcacccggagcaacaccatatgcaaagcatgcaggaataattatgaatcctgccataagagcaacaaatgtatcaatcagaatgatattaacagcctctccacctattgttctgtctttctttaagtagcttccgaatatctccattgcgccaatgcctacactaagtgtaaagaatgcatgtgtcatggcatcaaatataaccggtcctaaacctcttgatttaatagaatcaagattaggcaccatatagaatttaacaccttctgatgcattaggaagtacaagtgaatgaactgccagtaccacaataaggataagaagaagtaacatcataaccttagtaatcttctcaacgcccttctgtaatcctaatacacatacaccaaacgaaagtaaaactgcaacaatcatccagattgtcattgtaccaggctgtgaaagcatagttccaaatgctcctgaaacctcatctggctctaaacctgctaacgaacctcttgcctcacgccatgcataataaagcatccatcctgcaaccatagtatagaaagccattaatacgtagcttcctactaccgatacccatttgaaatgatgccatttacttcccttagtctccagttcttcaaatgcccttgcagcacctttaccgcttcctcgtcctactgtgaactccgcacacataataggaaatccaagaattgcaagaaatacaagatagataagcacgaatgccgcaccaccattttccccgcatatgtatggaaatttccacacattaccaagtcccaccgcacagccagcagacactaagataaagccgagtcgcgagccgaatttttctctctctttcaaaataaaacctccatagttaatatatttacattaattaagattgtatcatatattactatattttcacagccaattatttcatactctcactgacttctgatgtaatagtctgaccgccctgttcattccattcttttacaaatgtatcaaagtaagatatatcttcttctccacttataatctttaaatatgcctctttttctttagccttaagtctccaccaatggctcttcattgtgtctgtggtcttaaaataaagcgaatcaactacctttatattatcctgtgcaatcagactgcatgccttaattcttgacatatacgctgcccattgcgtacttgttttgttagcattcttgatatactcactacacgcatcataaaatgaacgttcaagaagttccagactgtcaggattctttcttcctgaaattgcagcatctatattcctgtaacatattgaaagtgcattattgtaatcaacatttattgataaaggtcttgccgtaggttcaacattaatctgatagtaattcttgaattcttctgagtctgtacagtcaaatcttaccttatcaaacatgacacttatcatcttggctgcaatctcaggatgttcatagccctttcttacaacaacatatttgtaacacgggttctggctgtgataactcgttgtcccatccgaatccgttgctattaaatatggctgccagtctgcatccggattcctgcttactgcattagcaagcggattattcggtgcccaccatggtccaaaaaacgagccacacagaccattctctataagctcacatatattggttgatgttctcagaagaaaatcattatctataaccccctgattatacagactgtttatatacgaaagtgcttcttttgcctcatctgtaaccgaaccatatacaatctcaccatcatcgttcattatccactgctttggatacgctccaaagcaggcaaatattatatccagcagaaattcactgctgtaaccacattcacctgtcacatctgtatccactgcaagccccactgtattaggttttccggacgcatccacgccattatttccagggtcttctgatataaaatgcttcactatattaacaacatcatcaatagtgtgtggctctgacaatccaagcttatccatccagtcttttcttaaccacacaagattaggtccatctgttatattagtctccggcagtgccattatctttccatcatatgtaaccatatccttaagtgaatcgccatagctttcatacattttcctgattctgtcacttatacagttattgtagctttctgtaaggtcctctataagtcctgcttccactaactgttcaacctcatcctgacttgatacaaccataatatccggaaggcttcccattgagattaccattgaaacattagtgtcatactgactgtcgtttgcttcaaatacatcaacattctgcacatttatcacagacttaatatagcgtgtgtacgcattgtccgtataagtgtcattctccggcatattggaattattaacacttgtcatctttccaagtgtatattctatagtctccgggtaagccccgaatggagttgttctcgcttcttccattctcgcattgtattcttcattatcattagacgcaaaaccagccgggcttttacacccggctaatataagcattattcctgtgacaccaaatgccacacatttttttaatgtttgctttaatctattcatatatctaacccttcactgcacctgtcatgctttcattataacatctttgcattatcataaacaaggctgcaattggaattgatataagaactgctcctgctgcaaatcttgtgtaccatacatcaacatactccttttcaagcatctgccataagccgattgccacggtataatacttcgcatttgccctgcagattactcttgcaaatatgaaatctacccaaggtgctatgaatgatgtaagtattgtatacactataattggtttactgagaggtattgttatcttagtaaatacctgccacttcgttgctccatctatcatagcagcctcatctattgtcttagggatagtatcaaagaatccctttgcaatgtaaaactgtattcctgatgacgctgaatatacaagcacaagtgcaactcttatcattgctccttctgaaagtcctactgctttaagtatataatatacggcaaccatcgccataaatgcagggaaaagtccaagtatcattgcgatattcatcattgcttttctcatcttaaacttaagtcttgacatacagtaggctactgacagtacaaaaaaagttgatataatacatgagaatactgctactatcagagtattggtaaacattcgtggaaaattaagtattcctgtatctgtaaaaagctttacataattatcaagtgaatactgctttgggaagaaggagcttgtataagcacccttctgagccctgaagcttgtgaggagtatccagaaaagaggacttacccacactatcgctaatattgtaagcactgtatgtgccagtatatttttaatagtctttttctttttcactggaatccctcctcatctttatacgctttcgttcttctgtatacaagcagtgaaccaattgctaagaatatgaatgtcataataccgataacagcaccaagattataatactgataatctattgtcatcttgtacagccatgttaccagaaggtctgtctttcctgccgttgcacctgccataaccggatctcccttagtcagcagataaacaatgttaaagttgttaatattagcagtaaatgtagtgataagatatggtgccgttacaaataacatatatggcattgttatcttaataaacttgacaaatccattagctccatctacatctgctgcctcatacaactccataggtatattctgtaatatacctgtaacctgcagaatagtatatggaatacctatccacagatttaccacgattactgtgattcttgcccaagtcgcatttgtaaagaatggcagtgattttgttatccatcctgcattctttaaaacaacatttataattccatcctgtgccagcatgcttctgacaataagaagtgaaacaaactgtggaattgcaattgaaagtataaatataaatctccagaaagctttgaatttcgtaccttttctgttgataagcagtgcaacaagtattccgaatatgtaattaagaaatgttgcaaatactgcccacactatagtccagccaaatactgaccagaaagactgtcctatcatgcttcctgaatcgaatatctgcttgaaattctcaagtcctacccagtcgaaaagcaccagatggctgtcaaccttactataattagtgaatgccatgcttatcatgaaaataagcggaagtattgtgaatataagcacacctgataccgggagtgtaagcagcagcttatgaagattctcattaaacagcgacttcacgtcttctgcaaatgtgtttatatgctttcctttttcctttaacagctccagcttatatgagcttttcacagcacccgctgcaactattatgtaagctataataatgaatattgttgctattccatacagaagtataagaagtgaattatcacctgcaacatactcatatattccaagcttctcattccagacttcctgctgcggtctgcttccaagacctggaagcatcgcaaggcagttaattcccttcataatcataaagcatacaaaggctgcttctatagctatatacataattccctttataatctgctttcctacaagattaccaagtcccggaatcagaatgcttaacttcgtaaatatatttccttttctaaatgattcagtgaacttaactgccattatgcgccactcctttcagcatttaatccctatcaattattttgcaattgatgtattaatctgcttatagaaatcctgtgtcttagctgctgcattatctgctgttatttcaccatttacgattgccttagcaaagttctgtgcaggtgcccagtaatcattcatgcctgttactgttggctggattactgatgtcttgttaaatgtatcattctgtgctgttacaagggcatccttctttacttcatcagttgcaagaagctctgtattacaaggaataacacctcttaattcatagtgcttcttctgtgcatccttgcttccaagatactttgcaagtgcaactgctacctgctgatacttgcagttaggattaactgcgattgccttagaacctgcaaatgctaacatctgcttgtcttttccaccaatctttactgtaggaagtgaaactgctccaaaattgtctccaagaatctctttaacactcttataatcccatgatcctgagaagtaagctccaactgaaccatctcttaagccagcgataccaacaccctgaaggtcattgacaaagttaggattatttacaagtgaaaccattgcctgtgttgcctgtgttcccttatctcctgagatatcaacacctgctgaattatcttttccgtcttttccaaaatatttacatccattagcaaggaagaatgatgacatataccagccctctgtaatattgaaagccaccttattcttctcaagcatcttatcaaggctctttacatcactgtctgtgaatttgctcttgtcatagtacataaaccatgtattagttgtaaatggtactccgtatacagccccatctactgatactgaatccacaattgcatctgagttagttttcttaacataatctgctgtctctccaccaagctttgcaatagcgttagcatcaacaagtgtctgaagctggtcgttagcaaagaagtatacatctcctgaattctctggatcctgtggaactatctttcctgcgtcctgctctgagcatacaccgtattcaaatgttaaatcccagtcaggatgctctgaattaaactggtcacacattgtctgaagccatttgccgttctcatctgcctgatcttctgcacagccccataccttgattgtagctgtgattttttcctcgcctgctgctgtgtcatcctttttagcattgccacaacccacaaaaagtgacccacacattgttgctgccatcactgcagccgctaatctcttaaacttcataaaaaaaccctccttaataattatccgagacagctttgattactgtcctcttttgataatctaattatattaaggaggggttaatattaaaatataagatattttagaaacatatcagttttttgtgttgtatggttttgccgggaattttattgttattgttgttccctcatcaggtatgctctgcacttccagatgatagctttcgccgtaataaagtcttattctgtcattaacatttcttgcaccatacccttttgactggactgttaagaagttttgtgcagtttctctgtccattcctacaccgttatcagacactgttacacatacaagctttttaccttcttcatccgtctgcatcctggcctctactgttattacacctttcctgtctgtcagcagatctataccgtggtctattgcattttctaccaatggctggagtataaggtttaaagattcgcatggcataacttcctctgatacatttatcaccacatcaaatgagttgtcatgcattatctgctgaatcttaagatacgactgcatgttgcttaattcctgctcaaagcttagtatattctttcccttattaagcgatgtacggtagtagttagacaatgcaagtgttatctcacttatatcctcctgctcatattctattgctttccaattgataagcgataatgaattgtagaggaaatgcggattaatctgtgcccttaatgcccgcatctctgattctttctggcttatacgtccttcatatacctgcgtgataagattcttaatctgggttgtcatgctgttaaagctatgaataaggtcacctatttcatctttgtcctgtgtattaattaccgcatcaaagtctccattttcaacctttgccatactgttttttaatttattaattcttcttgtaatgaagcctgttgtaaatatactcgccgcagcggcacctgcaactgctaccacaaatgcaactacaatcattgtaatcattgaattagctgacctgagcacaagttttcttggttcatagacatatactgtccatccggtaacagggctttccttctttactacagaataaccctctgtatttccacatgtattattatcccattctgccccgtcgattagtgaaagcagtttcttactgtttaatctgtatctggtgttattgttttcaaatgtgtcactgctgcatataacttttccatcagcgtcaagcaccaccattccgcagttctgctcaagaccacctgtaaatgaactcatcatgctgtcataatcaacatctatgtacatgattccaagaatccctagctggtcaagcgttgacatttttcgtgctgaaacaagtgtcctgctgtcttcatcaacaaaccactgtatcttagtgctttcagcagcagaattataaaaaggtctgtcttttatctcttctattgaagctatagtcgtatcatgtttaatagctttatccacatatattgttaccctgttaatatcattgtgaaaatactttaatgatgaaagcatagggtcaaatgtagtgacaatctggttatacatctcatatgtgcttttgtaatcgtatgaaagcactcccgacagcgtatcattaaatgttatataattagacagattgtcatacacctctatctgcccatccaccgttgtaacagactgttcaattgcccccttgatgctctttaagtccctgtccataagaatgtttctcatctgacagtatgcaaaaacaaaaagcacaatcaggggaataagtccggtcactacatatatgatgacaagcttgttctgcaatcttatatcattgattttctgcttaatctttttcaattcaattctccctgatccctgaatttctgaggacttataccaaagtactccctgaagctctgtacaaaatatgaaacatttggataacccacctgctcacttatattcacaatcttcatgttcgtaccggtaagcagttccttagccttctccattctgtactgtttaatatatttgctcagattctgtcctgtttccttcttaaaaagtgaacttaaatagcttggtgcaagataaaccatatccgcaagctgctgtgcgccaatctcctcaccataatggttatgtatataattctttacggtctcaatctcccggtgtgacgtggccggctcttttccgaaactcttttccaacaaatcaatatagttattcactatatccataatgcatgagaaatcctccgacttatacagtctgtcaatctccctgccaaattccgcctcatcagcacccggaatattgtcatagaaatcttttaacagattggaaaatacaaacttgatgtatatatgtgagaagttcgactgccccctgtatttcttacacaatgcatcaaaatgtatccgtaaaaatgtgatatccttcatcttgatatcctgcttcatctgcttcataagtgcatcatcatcaatctgtacaagcacaggtgtatcttcactgatattatcagaaaaaatatatcttcctgtctcataaaacttattattcatcagtgtatcaactgcatccattacctgtggaagctcatgataatcgttgaataaaccggacacagcaatatacataaactgtcccgtctttctgtatatatagtcatgaatatttgtaaacatttcttcaatgttcttatcaatattaccatctgctgtgagtgatttatcagaaaatatgataactgactgtaacgggttaagattaaggtactgataatccagttccccggttatctctttaaatatgtcttcacctgtatcatatttcccaaagaaatcagtattgaattctataagtgcaagtctgttataccctgccagaaaatccccattatcaagtattcctgatgcatcaccggagttgagcagcgtatacatgtagtactgttttataaagttagcctgcctgttatagtcctcatccttcttgtgttcctcgtcaagctctgttataactcctgtaattgttgaactgaattctgacggatcaaccggctttaatatataatctttaacacctaatttaactgccagcttggcatactcaaactcgttatagcctgagaatataattgtctttaaactgatgtcgttgcgcatcacattcttaataagctctatcccgtccataaacggcatcttaacatctgtaagcagtatatctatatgtccaattcctgtattcttgtcagatgtcagatattccagtgcctgctttccgttgcacgcctcaaatactccaagctcaattcccattctcttaagaagcattcttattccgcttctttcaatcttttcatcatccactataagtatattatacataaatctaccccgaaaccttcctcattcacgaacttttgctcttataatgattatagcttccggggcaattattatcaacttatttagttatattaaagatgccatatatcttcattgtactgtcggattgttctgtctgatgagaaaaatccggcatttgcaatattaacaagcattttttctgcccacgcatatctgtcatcataatctgcaagagccttttctttggtttctatatagcttcgtaagtcaagcaatgccataaaccagtcttttcctacaatctcattatacagtctgttaagactatgtgaatcacctgcctgaagcatagcatccgatattataaaatccacacattgttttataagagcatctgtctcataaagcttctttgcgttatagtcacatttttcataatgtgcaataacttcatcacttgttgcgccaaatgtatatatattatctttacctacaagctctgcaatctcaacattagcaccatccattgttcctaatgtcacagcaccgttaagcatgaatttcatgttgcctgttcctgatgcttctttagatgcaagtgatatctgctctgatatatcacatgcaggaatcagcttctctgccagtgttacattgtagttctggacaagcacaaccttaaggtaaggacttacatctttatcggcctcaataaccttactcaatgtaagtatcagatgaattatatccttcgcaattgtgtatgcaggtgcagcctttgcgccaaatatcactgtaacaggagtctttggaatgttgcctgccttgatgtcaaaatatttatatattatatacagtgcgttcatctgctgtcttttatactcatgcagtcgctttatctgtatatcgtatattgactgtggattaatctctattccctgtgtctgcttaaggtattctgcaagatttctcttgttgtctgtcttaatctcaagaagattatcgtaaacatttttatcaccggcaaactttaaaaggtcttttaacttttctgcgtcatgtctgtattcacttccgataagtgtctcaatgtatttcgcaagtccgttattacagtggataagccaccttctgaatgtgattccgttagttttgttattgaacttctctggatatatcctatagaaattattaagctctgtattctctaatatctctgtatgaagctttgctactccgttgacgctcattccataatgaatatcgatgtgtgccatgtgaacgagattattatcgtcaattatatacactgatttgtctgtgtacttcccacgcactcttctgtcaagttcttttataatcggcataagctgtggcacaaccctgttaagataatccacaggccatttttcaagggcttcggcaaggattgtgtgattagtatacgcacagctttttgatacaatatcaattgcttcatccattgttatcggacttccatctatatctccattttctgtaagaagtcttataagctccgggattaccattgtcggatgcgtatcgttaatctggattactgcaaggtctggcagattcttaaatgtttttccggtgttaatacatttgtccctgcactcgtctaatataagccttgctccattgcttaccatgaaatactgctgatagattctaagaagccttccctgttcgtcactgtcatcaggataaagaaacagtgtaaggttcttggcaatatctgacttatcaaagtctatgctgtcaccttttacgatgctctcatcaactgtctccacatcaaacaaatgaagcttattcgttctcttttctccgtacacattgatatcatacattcttgaaaccacactgatttctccgaaattgatagtgtatgccacatctgtcggaacaagccagctgtccttaccaatccatggattaggcacttccttctgcttcccattctcaaacacctgcttaaaaagtccaagatgataattaagtccgattccgtcaccattaagaccaaggttagcaattgaatcaaggaagcatgctgcaagtcttccaagtccgccattaccaagtgacggctctacttccagttcttcaatatctgaaagattctttcctgcctgtgtaagttcttccttaacttcatcatagattcctaagttaataagattattggataaaagctttcctataaggaactctgcagaaatgtagtatacctttctgccattgtctttcactattctatcacgtcccttttgtgcaaccatcttcataagtgcatgaaagcactcctcgttgctgcataagtgcaagtcttttccatattcttccaaacatatagtgttaagcatatcgttgccctccattcttgtatttatattttattatagggttgctggaaaaattctcttgctttataatgggataaacttgtactattctatcatatttaaggagaaccttatgaatataacagattacagaccactgaaagaaatcaaatctcattttgattcagattttttatataacacttacccatgctctatcccgcttgattttgcggaagttccgcttcactggcataatgagatggagcttatatacatcaagaagggacgcatgatcgtaagcgttgaccttgagtattctgttgtaaatgctggagatattgttgttgtcatgcccggacatatccattctatcatccagaacgaaagtgattcatgcgaatacgaaaatattctttttaatcttgatatgcttgttagcaggcagtgtgattatgataccgtaagcttttttaacggaattgccggctttaatgggtattgccctcctgttatcagtaaaactgcgccacactattctgatttaattcattatattgatgaagctgataatatatgcaagtatttccctgacgggtacaggctgaaaatccgtgcatgtctttttaatttcttttttgagcttaatgcacatttttacacgcatacggatatgcctgtacacctgtctgatgataagatggataagctgaaactggtacttaattatattgaaaagaacttcgcgcatgcaatatccattgaagagatggcgcagtggtgtcatttcagccagtcgcattttatgaagttttttaagaactgcaccggaacatcttttatcacttacttaaacgactaccggctcattattgcagcgagaatattaaaaaccacaacccagccggttattatagtggcttcggattgtggttttgataatatatcttactttaatagaaaattcaaagaaaaatatggtgtttctccgagggagttcaggaaataagatgttattaatataatctgttttttacatattcttcaaatcttggcagtgccattgctatttttccatactgtcttgtatctataacgccctttcgctttaaacggtcacggtacacagagaataattccggcttcatgtcgagcttttcacgaatatcttttactgactgataaccgctctcagatataacgctaagtatttccttatctttagatgataattctgcccatatcttactgtatacatattcatctaaatactggtcatactccggcataatatcttcaagtgtatgatcttttctattatcccaataaagatatccaagcacctgaaacgcaaatggatatcctcttgtaagaagagtcatcttatcagccatttcatcattaatatcaaatattctcatgtaatggcttttaatagctgtataattaagcggctctaatataatcttaggtgctctgtataaaaatgtaagtgacttttcattctgtaaatcatatatattctcatacaatcccgtcatcaaaagatatataggatattcttctcttaaaaatatctgaaatgaacttgcaaatattttaatattttctgaattaataacttcatcaattgttataagcagccttttccccagacgttttatgtgagaaagcattatctcaataacattttcaatatcagtaacaggaacagcattctcaactgttacacccaatccaaatgctgaaaagtcaagctttgctttaacaaatactgcatgcatttctggaattgcatatatctttgctgccagactctgtaaaagatcacggtttggattaagctcaactactatccattcatctgaccgtttccgtatctctgacgcaatattagtcatcattacagtttttcctgaacctcttactcctgtaatcatatatatctgattaggcgattcttccgctgtaaaatctccaattattctttctgtctgtgcaattctcgaaatatactgcactggttttttcccaaatgataatgtaaacggattattcatgcgcagcctcctatataagtttatataaccttttatttgttttataactttatataagtttttataactttttatttattatataaccttttataacttttatcaattgcgaaataaaaaatcctgctctcaggcagccataaccacctgaaagcaggattaacattttaattattaacacattacattaagccttgtgctctgttgtaagcattacatatcttattagaattcttgataagaatatgcattgcaacaaatggtccaattccacagataaaagcaccaaatatctgccataaaagaacagttgtaccattctcctggattgaaagtccataacgaggtccgttagctgcaagtctgttaccaagattatagtaccagaaccatgcatatataccacatgttatgagtgataacagaacaaatgcaacaagccctgatgtattctctccatctccatcacatgcaatattaacatcatgtgccatcttgtaaatgaaataatagctgtatattccacatgtgataattgaaagaattatgtatgaggcaagacctctgtcatcctttaatctcgtacctgagtatggtggaattgtgccattattataaccattgctgtaattctggttagcattgtaaccctgattataattctggttattgctgtttccattgaaactctgctttacttcatcaaaagcacttcctaactctttctctaccttattgaagacctgacctgcctgaccagcaatatcctgctccggtgaacaatttgctccacaatatgggcagaacttagttgaatctggaatctgttttccacattttgtacaaaacatattatttcctccccttataagtttagtttgcgaatgattcggaatacaatattgttctgtggctcaaaaaccactacattgccatctccaataaacattctatacaagtaaactataacaaatgcccctgctattgtaaacataaaaattttataaaatttaatatttattttagatttaagaagcataactatcacaacaactggtggcaggaaaaaaagtggatgatacatgaacgcttcatgtatattaaaatgcagtaaagctatccatgcccttgacattccacagcccgcacatgatattcctgttatgtattttatagggcatgtaaccccgaagctttcaagtatcacataaagcataacaactgccgcaactgatgttatcacttctattctatgcgattttcttttatatgcattgcctccgctcattattccccctgataatgctttttattacattataatctctccggcaagcaatgcaagacaaggaagcgtaattatgctaatcaatgtagataaagtaactgcaccaactgcgagcttctggtcgtgaccaaacttaatcgcaaaaagtgtagtaatagccgcacacgggcatgcctcaagtataattgtaataacagcaaccattccacgggcatgtatcagatacataacaaaggtacagattacaggtataataaacattctgagaattactgtaaaatacactcttttatcctttaagatactcaataatgggaactgtgaaatagtaattcctgttattatcatagacagcggagtattcatgcctccgacaacattaaatgtatccttcaaaacatccgcaaccggaattcttgcaaggaatatgacaagaccgaccgcaaccgatataattggtgggcatgtaacaatcttttttaacagttccttgatactcatactctctgaaacatacacaattccgacagtccacaacagaatattgaatacagtaacatacacactcgcatacagtacaccttctgaaccgtacattgcctgaataagcggaaatcccatataagccgcattagaaaatgtagttgcaaatcttataatgcctcgcacttcctttttcattaaaaatgttatgccaatcgataaagccattcctatgcatattgtaagtatgctgtaaaaaagcattctgcccatattcttaagaatctcggcattgtatcctgacatgtaagaattaataatcataaatggaacaacaaaatatataagaagattagaaagcattccctttccttcttcgttaaccatcttaatctttcctataacaactccacacagtataagtatgaataactcaaatacctgcttcgcggtaataagtgctaaatccatagctctcttatcctccttttcatacacgcaaaaaacatgttatatatttcatcttctgaaatatataacatgttaataacaaagtcaagcaataaatctaatactttatctctggcataagctctgcacttattacattaagcatacgttccattgtctctaactcttctttagaaaatctgtcctcaatcctgcccattacagtcttaagatatgtattgctgatattataataatctatatacttctgagttacttcaagatgatactctctcttgtcttcctcagactgtactttctttaagtatcccttcttaacaaggttattaatcttatacgccgcgttaggagatgatatatttgccatatcagcaaactgtgccacagtaggtttatcaagtgcatatattatctccatgcagaaagtttctacagttgtaagagatgtctccctctcctgtagcttttcaaacattttctgataaaaatgcatcttaaacttcgtatataccttactaaaagaatcctgcagcaccttactttacctccaaagcttttttaattgtttattattataacaatagctctattctattgcaaatgtaagttcagctgacactgcaagttttccgtcaacataagcttctgcctttcctactcccacaggaccttttcttgctataatctcgcatgacaaggaaagcacatccccaggtgtgacctgagccttaaacttagcatttttaattcctgcaaaaagtgctatatgtcccttattcttttcttccgacaacaaagcgactgctcctgtctgcgccagtgcctcaataataagtactcccggcattaccttcttctgtggaaaatgtcctacaaaatgcatttcattggcagatacacatttaataccacaagccttctttccaggctcacactccgttatcctgtctactaatagaaatggatatctgtgtggcagaatctgctgtatttcatctgaattaagctgcatctttacaccacctttctaagcacgatggacgcattatgtccaccaaagccaagtgaattagacatagcataatcaactcttgactctcttgccttatttggaacgatatcaagatcacagtcatcatccggcacctgataattaatggttggtggaattatatcattctttacagcaagtgccgatataattgcctcaacagcaccacttgcacctaacatatgtcctgtcatcgactttgttgagcttaccgcaagcttgtacgcatgttctccaaatgccatctttatcgcattagtctctcccttatcattaagctttgtacttgtcccatgcgcattaatataatcaatattctctggttttattcctgcatccttaacagcctcagtcattgcctgtgccgccatacttccgtcttcgagaggggctgtaacgtggtttgcatcacatgttgaaccatatcctgcaatttcacagtatatcttagcgcctcttttcagtgcatgttcatactcttcaagaataagcacacctgctccttctcccataacaaatccgcttctttctttatcaaacggaatagaagccctgttgacatcttctgctttgcttaatgcatgcattgatgtaaaaccaccaattccaaaatcagttatacagctttctgcacctccgcacacaatcacatcctgatatccatccctgatctgtcttaatgcatctccaacagcattggttccactggcacatgcagtaacaacacatgtacacattccatgtagtccgaatctgattgcaacatgtcctgccgccatattagttatcgacattggcacaaaatgtggcgaaactctgtcatatcctttactttcgcctcttaagcattctctctgtatagttgtaagtccaccaattccacttgataatataacaccacatcttaatgtgtcttctttgccaaaatctatagctgaatccttcactgcttcatctgcagctgcaagtgcatatatcgtgaaatcatccatcttccttaattctgctttatcgagaatactctccgcgtcaaagccttttacttcaccggcaagcttgaccgcactattttctgtattaaaatgtgttatcttaccaataccacatttaccagcctttacagcttcccacatatcattaacattgtttccgacaggagtaactgctcccatgcctgttattacaactcttctcatattgccattcctccgtctacacaaagtacctgtccggttatgtatcgtgctccgtcacccgcaagaaatgctactgtttcagcaatatcttccggctttcccatctctttaaaaggtatattctctaccactttttccttaacagcgtctgacattgctccggtcatatcagtttcaatcattcccggtgcaaccgcatttacagttatatgtcttgacgcaagctctcttgcaagcgacttcgtcataccaataacacctgctttacttgcagaataattaacctgccctgcattgcccataacaccaactacagaactcatattaataattcttcctgctctctgtcttaacataagccttgaaactccacgcatcatgtaaaatgtaccctttagattcacatctataactgcatcgaaatcctcatccttcatacgtccaataagattgtccttagtaattcctgcattattgacaagaatatcaattcttccgccaagtaaatccacagcttccctaattaaacgctcacattcctctgaattactcacatctgccttaattgcatggatttcaattccatactctctgcataaattaactgtttcactggcagcctcatcacctgaacggtaactgaatacaatatctgttccttcacttgcaagcttaacgcatatagcccttcctattcccctgcttgcacctgtaataagtgcttttcttctctcagtcattccctatcctttccaaatcaatgtcagatttgctcagccaaagcttatatgtccgatttattcaatctataatctgtcataatctcattaataagttcctgtacgctcattatccggtcaactctgtctgcattacttcctgcaaaaaacagtccattatcccagtcacccttaactgctgctataagtgccctgcttatgcaatatggtatactgtcatccttcttacatgctgtaagacaaccattacattttcttgccgtgaaggtttctcctgcatcaagcctttcaagcagtgggctgttaattgcacgtgccggcattccaacaggacttttaataatacggatgtcttctctctttgcattaacaacagcctgtttaaatgtatctgaagcatcacattcattggtagcaatgaatcttgtcgcaatctgtacacctgcagcacctttatttacataatgtgccatatctttgccatcaaacacacctccagcgacaaaaaccgggatatccgcaccggactcttctattacagcaagtacatctgacaatatttcatcgttagtctgtgtttttccctgtgtaatatcatctgcaccaaagcctaaatgtcctcctgccatgcttccttcaataatgaacatatccggatacacatcataatgcttcttataagttttcataattatcctggcagccctgccacttgaaacaatgggtgctgccagtgtatctgttcccttagtaaactgtggcagattaagcggaagtcccgcacctgagataataatatctgctcctgctgaaactgcggtcttacagctttcctcataatgagaaactgcagtcataatatttacagctacaagtcccttctttgtactttctgctgcaatctgcttagctctcttaatgtggtaatcaagtgcccttagattcgccttaaaggggctactcttaaaatcctgttcatcataacctgcattaacagaactgataactccacatgccccatttgctgcgactgcacctgcaagggatgaaagagaaactccgacacccataccgccctgaattaccggaacatcaagcactttgtccttaatctgcatacaattcctttcgcacagcctcatattcttcatatatttgttcaaatattttctcaattggctgtatcttatcaatctggcctgcaacctgacctgccatcagtgagccattcattgtgtcaccgtcaaacactgccttacgaagagaacctaatgtatatttctcaagttccatcttatcagcacctgccttctcctgctttacatactcgcgtgacatctcatttttaagaacacgcacaggagtaccagcaattcttcctgtaactatcgtgtcattatcctttgctttaagtattgcctgcttataattatcatgtataggacactctgtacttgccagaagacaagttcccatctgtacacctgcagcaccaagtgcaaatgctgctgcaagctgtctgccatctgcaattcctccggctgcaataaccggaatgttcacactgtcaactacctttgggacaagtgtcatagttgtcatctcaccgacatgaccaccactttctgttccctctgcaactactgcatcagctccgaaacgctccattcttattgcaagcgctgcactcgaaacaaccggtataaccatcattccgttagacttccatttttccatatatttggccggacttcctgctcctgttgttacaatctttacattttcttccacaagcagttctgccattgcatcagcttccggattcataagcataagattcacaccaaatggtttatccgtaagtgttctgcattttcttatgttttcacgaagcatatccgtgttcattccaccagctccaataagccccagtccgcctgcattactaactgcagctgcaaattctcctgttgcaatattggccattccgccctgtataaacggatattttattcctaacatcttatctaatctcattatgctgctccttattatgtctctatcaaagcactgctccagctaagccccgccccaaagcccgcaagaatcagctttctgcctttgtcaaagcatccgctttgtgctaactcatctagtgctattgggatacttgccgctgatgtattaccgtattccgctatatttatatagaacttatcttcatgtcccggatattttttctttacatgattgataattctttcattagcctgatggcacacaatataatctatgtcatcaagtgtcatgtccgattttttcaatatttcatcaattccctgtttaagaacatcaactgcaaaacggaacaccgcatttccattcatctttacatatgcatcctgtgcacctatacctctgcatacaagtacatcagtatcgcctcttgtgtaattaatctgtctatacatattgtcagccgcttttataagaactgcaccagcaccatctccaaaaagcacgcatgttgagcggtctgtataatctaatatcttagacatctgctcgctgccaataagcagtatgtatttataatcattgctgttaaacagtgcctgtccaacatttaatgcatgcagaaaacctgtacatgcactgcttaaatcaaatgcaagtacattctctgccaatccgagttccttctgtacaattgctgcagtagatggaaatgcattatcagccgttgaagttgcaactataactgcacctatttctgcaatatccacacctgatgcttctaccgcttcatatgctgctctgactgcaagtgatgtagtattttcctgtgtacatctgtatcttttcttaatacctgttcttgttgttatccattcatcatttgtatcaacaatccggcttaagtcatcattcgtaattatctcttctgggagtgctttccctgtggacactatctgaatgcctttcactttatctctcccctgtctatattcctgaatttgtcatatcttgaattaacaagctcttttgatttcatcctgccaagaattccgagttctttttctaacattcttgctatatctgaaaaacacctgtctccttctgcaattacaccgtcaacgagtccggcagtaaaaagctcctgtgcagtaagcttcataatctcacttgcctgtggtgctttcttagcatccttatatattattgacgcaaaaccttccggagacagaatcgaatatactgcattttcaagcatatacactctgtcggctgctgccagtgccaatgcaccgccacttccgccttcacctgtgattactgatataacaggtactgtaagcttaagcattgctgctatacttcccgcaatcgcattactctgtccgttgctttctgcttccatgcctggatatgcacctggcgtgtcaacaaatgttatgacaggtctcctgaatttttcagcctgtttcataacacggactgcttttctatacccttcaggtgacgccattccgaagttatatcttatattctcttctatattctttcctttacggtttccaataacagttaccgtttttccattaaatgaagcaattcctgcaacaaggcttttatcatctttatagtatctgtcaccatgcatttctataaaatcatcgaaaagcacttctatgtatttcataatatccggacggtcactttttctggctgcaaggactttctcatatggtgttaaaacattttcactgctcatgcttctcctccggtattcacatgcattttcaatatctttgataaagtctgcttcatatcttttctgtcaactatcatatctatcatgccatgttctaacagaaactctgagtgctggaagccttccggcagcttctgtccgatagtctgttcaataactcttggcccggcaaagcatataagtgctcctggttcagcaattataatgtcaccaagacttgcaaagcttgcactcacaccacctgttgtcggattagtaagatatgatataaataatccaccagcatccttgaacttttcaattgccgctgttgtctttgccatctgcataagcgagaaaagaccttcctgcattctcgctccaccgcttgcagcgaatattataagtggcagttttcttttcattgcatattctgtgagtcttgtaatcttttcacctaccgcaattcccatgcttcccataagaaatcttttatccataactgcaacagctgttttgactccgccaattcggcatgttccagtaactactgcatcctgctggcctgtctttaatctgtttgcttcaacctttttctcatatcccggaaagctgtttggattgcctgtcttaacctgtgcatacaattccctgaaacttttgtcatcacttataagtgcaattcttcttgatggtgtaaggcttccgtctgcctgttcctcactatcccttaatctgttgatagtaccccaccttttcttacgctttaagaaaatgtcattgatattcatttaactgtaattccttccttaagccacttttcaatttcggtatgattcttctcccagaaacctgtattgtaatttcctcttataaaatccttatgatatgtaagaagatgcatgaactctctgttagtcttaactccttcaattatcagttcctcaagagctcttcttaatcgtcttaccgcctcaagtctgctgcttccagtcactataatcttggcaatcattgaatcataaaacggactcacttcataaccttcaaaaagatggctctcaactcttactccataaccatctggaaaatgtaagaatttaataactcccggtgtagccgcatttattctgcactcaattgcatgtccattgacacatgtatcttcctgagttatattaagcttcattccggcagctattcttatctgttctcttataaggtcaatacctgtaacctgctcagttaccggatgttcaacctgtattctcgtattcatctctataaaatagtagtcaccctgttcattcataacgaattcaacagttcctgcactataatatcctgctgctttcgcagctcttactgcagtctctcccatgactgtccgctgatctttacataattttgcactcggagcttcctctaaaagcttctgattattacgctggattgaacagtcacgttctccaagatatattgtattgccatatttatctgcaagaatctgtatctcaatatgccgtggattgattatcagcttctctatgtacatatcatcgttgccaaatgcagctttagcttcactcttagcggtttcaaatgcattttctatatcttctctgctgaatgccttgcgcattccttttccaccgcctccagctgacgctttaataagtaccggataaccaattctttctgcaatgtgtgctgcttcctctgctgttgcaaccagaccatcagagcctggtacaaccggaaccccgcattcaatcataagctgccttgccgactgtttatctcccatgctgcttattatgtctgctgatggtcctataaatataagattgttctcctcacattttcttgcaaatgcagcattctcagacagaaaaccataaccagggtggactgcctcacaccctgtcagtattgctgtttctattatcgcatcctgattaagataactttcagccgcctttgccggtccaatgcaaactgccttgtctgctgccataacagcaagtgaatccttatcggctgttgaatatacaattacggtttctacatccatctcacggcagcatctgattatccttaacgctatttcaccacggtttgctatcagtattctcttaaacacttctgctacctccgttaattaaggattacaagcggctgtccatactcaaccatagtgccattctctgctgccacttccttaaccgtaccgtcacaatctgctgtaacttcgttcatcagcttcattgcttcaattattccaataacatcaccggcatgaacgctctgccctggttttacaaaaggttcctcatcaggacctgctgctgtatagaaagttccaaccaatggtgctttaatttctttaatatgctcatctgactgtggctgtacgtcctgaatagttgtaacggtctgttcctgttctgtattaatgcgaacattatctttctttacaggcacatcacatttggcttcgtgcattgttttcttcagtccaaggcatacgccattcatctccagattcagttcgctgcatccacttgcatcaaacttatctataatcctataaatatcattaatatccataacaaactgtcttccttaaaatctttatgttaagctgcattcttgtcaacatactcaacaattgctttaactgatgtaagattaggaagttcttcttctggaacggtaattccataagcatcttcaactgccatcataagttccatagaatcaagtgaatcaattccaagatcatcctttaaattcgcttctaatgtaatcttatcctctgagcagttaatagtatccataataatttcttttaccttttcaaatgtcattgttttgttctccttaaataattttatctaaatatatttaactaatatatttgagctaattataagatcacaaatcaggtttgtcaatactattttgatattcaaagtatttattttgtttcacaactgagtattattccgcctcgctcagcataataactgcataatcctcctgctttatatacacacacatccgtagcaccatatgcctgctttatcatatctgctatcttatctgcaagagcttcattctcaacatgacatattctcagctttccgccttcatatcctgcatcgtcaagtaatgcctgcagttttacaagaagctttttatcacctctgcatttaccgattgcttccaatgttccatgactgcttgctgttcctattacacttatgccaagaacctccgcagccgatgctacaaccttgcttacacggccattctgtgcaagattatgcaatgattttaatgaacagaacagtcttgttttctgcatatatgcatctatcgctccatctatctcttcaaatttctttccttcttcaatcatttgctgcaattgttccagtataatacgcatctgtggaccagtgcttttagaatctattaccctgaccttagcctgtggatgttcctccagatatactgccctcgctgccattgcagaattatatgttcctgacattcctgcagttattgttacaacaaatatctcatcatcatcaccaaaagcttcaagccatgcatctattccagggcacgcagtatatgaacgtcccttatgtttttcaagaatatcaagcattctgtgaatatcaagctgcccatcatcacaaaactcctcgttatctgtagatattgtaagcggaactgccttaaaaaccattcccctaagttcttttatatcgcatgctgaatctgctactaatctcattattaatcctcctgtttgccggatatactccgtttcgatgtagttttaaatactatgtcatattgtattttataacttatagtgttacaatatacaaaaatagcgtttttgtatatttcaggagtacattatgaatatagttaacaaagattctaaaaatacatttacacgaatgtgcataggtgaagcaataatcaagcttcttaaaaacactgattttgataagattcgaattacgagtgtggcgaaatgtgccggtgtatcacgcataactttttacaaatattatgaatcaatccatgatgcactatgcgactatcttaatattattataattgaatatctggaagaatgtgccaacaaccctgaaaacgggagctttctggattattcccacattctttttgcacttgaattctttaaccggtataaggattattttcttactctttcaagatgtggacttcattctattcttattaacagtattaataattttatgtctgaacattttacgaatcctaagaattactctgagtacagactatactgttactctggcggattgcttaatacatttttaaaatgggaagaaaacggatgtgactgtgatgctggcgagatagccagaactcttgaagaactttatagttaataagccactccttccggaatggcttaaatattttataatcatttattaatctgtgaatgcacttttcgacgtactaccaggaaacatataacctgcataattatcgttgccgtccatgatgccggatatgatatgaacaggtcataaagagttctgtgacttgggaatatgacgaatatccagaatattctcattcctacagtaccaataaccgataatatcataggtactagcgaataccccattccacgaagcgcgcccggaaacagatccattattccacataagaaatatggtactgtagtaattgataatatctcaacaccacatttgataacatcttcactgttagtgtatatcataagcactttatcaccaaatatatatgcaccgcagccaaatacaagtgatgctcctactgaaagtattgcacaatctataagcaccttgtccattctcttgaactttcttacaccataattctgacttgtaaaactcatgcaggcctgtgttactgaattaattgatgcatatagaaagccaagaatattgttggctgctgtatatcctgccattgctgttgaaccgaatgaattaaccgacgactgcagcagggcatttgagaaattaataactgtactctgtattcctgccggaattccaacctgaaatatctgtttaagatagtatccctttatctttagctttgagaatctcaactggtaacttgcatctgtcttattcagacatcttaatacaagcacacacgatataaactgtgaaaatattgttgcgattgccactcctgcaacccctaagttaaacacaataacaagtaccatattaaggcatgcatttataattcccgctgctataagaaacatcagcggtctcttggtatcaccaactgctctaagaacagccgcaccatagttataaagcataaagaatggcataccaagaaaatatattctcatatacagtgttgagaggttaattacatcatccggtgttcccataagctcaagtgccggcttagccatcagcacgcctatcagcgccatcacaactccgcttattgctgcaaatgttatcgcagtatgcactgtctctgacatctctttatgtttgcctgacgcatagaatctggcagccagtacatttgctcccaaagaaactcctatgaaaagattaacaaacatattaataagcgctgtcgttgaacctactgctgctaacgactggcttcctgcaaatcttccaacaacaattatgtctacagcattaaacattagctgtaatattcctgaaagcatcaatggcactgagaacgatattaacttatccattattgtgccattgcacatatctatttcgtatttattcttactcattgtaaatttcctttataaagaattggacagactattcccaatatccaagttcaacaccttttttatagattcctacgcccttagaataatatccatacgcattaaaatgtgtccagtctgaacggagtttcacagatatatatccaaacgctccatataactcatctatcttttcctttttcaaaccacaatcatccagcccgttctgaatcatgtagactcttgtattaaagaaatgttctccaaatgcttctcttagcgctgcttcccatgcagtgtcatcagctcctacatagtcatctccatcctccagatatgactggctgttgtctgcaagagatgtacctggatcatccgtgtccccaactatgatataattctcacaacctgtataatcaatcactgcctgatactgggaaataagctcatcatagtcatcccatccaccgttacttcccatctcaatcacaagaatatcatccttatgatcatatgctgctttagttgtaacagcagtaccttgtggaataaacatataatcaggctgttcaagacctgtatcatcacatattctgatgctgaccatataatcctctatattatagtcatcatcctccatatcttcccagtaatcttcaatatctcgtttcttatcaatctgacataatacgccatctatatatacagtatcaggataatcattatattcaataccatatccgctgaaatcatacatataaacaggattccccttatcatctataaggcatacatcctgatatgtattcttattaagattaagattacggtcagtatgcatcttaaggccaccagctcttctcgctatctcctctgatgtctcccctgatacaccaaaattaaatgtattaagaccagtaagctttcccaaagtatatggtgcagtataataacttatatcaactcttcctgctttagtaagtatataagcatcatctgagccaaagccttccatcatgctgtcgccccagcaggcaattgatacagtatcatttgaataatccttatcatcttcataaggttctgtataatcttctgtaccgatattctgtgagaccttcacaattacatgtgttttatctccccgtggttttatgatcttagccatattaataagattatctttagtttccggtctgccattcaataccacagcccctgcggcaatacctcctgcaagcaaaaccactgcaatcccccatatcgctgctttctttaatttcataaactcaccttttctgccccttatatatctggcacttctgttataacacttatttacccgacctgcaaatataatgaagcaatcaaagcaaagattcagtaagggttcgattcacatcaccctgaaataattcacttagacaaaaaaatagagcgggtgatgggaatcgaacccacgtatctagcttggaaggctagtgttctaccattgaactacacccgcataatcactgatatctcaatgctttgttaagatatcataattatattataaagtcaagtattttatgccaatatgttctttctgacatgatttatcaacatatatacttgactttatctgttcttaggaataaattatgttagttgcattttagtttgtaaaatattatggagtaatttcaatgactaataattctgaccacattttttctaatgtagatataaggaaacttcttattcctatcatgctggaaaatctcttggcttcacttatgggaactgttgatactatgatggtaagtaatgtaggtgcatctgctgtttcagcagtatcgcttgttgattccatcaatattcttgtaatacaggccttgtcagcacttgctgccggaggtgcaatcctgtgttcccagtacataggaagcagcaaccctaacggtgccaaccgcgctgcgagacaggtatttcttgtcatgacagtgctgtcggttttcatatcagcaatatgtctcattcttcgtgtaccaatgcttaggttcatctttggttcggtagaagctgaggttatggctgattcacaggcgtacttcctgtttaccctgttgtcatttccattcattggcctgtatgacgctggtgcgtccattatgagagcccagaaggacagcaaaagccctatgataatatcaataatatccaacttccttaatataggtggtaatgcgattcttatattcggacttggaatgggtgttgcaggggctgcaatatcaacacttgcatcaagagttttctgtgcagttgttgtaattattaaattaagaaacccttctcagactatctgcgtaaacagatattacacaatccgtcccgactgggatttaattaagagagtcttatatattggtattccttcaggtattgaaaacagcatgttccagtttggaaagctggcaatccagtcaacagtttcaacgcttggaactgcggccatcgctgcaaatgctgtgaccaatattcttgaaaaccttaacggagttgctgcacagggtgtaggaatcggacttatgactatagttggccagtgcattggagccggaagaaaagatgaagccatatattatataaagaagctcagtaaaatggctgaagctgccattattataagctgtcttgttgtatttgcattgtgcaggccgattaccatactcggtggaatggaatcagaaagtgcaagaatgtgttttgagatgactcttttcataacaataaccaagccaatatcatgggtattgtcattcattccggcgtacggaatgcgtgccgccggagacgtgaagttttcaatgataacatcgtgtgcaagcatgtggttatgccgtgtaagcttcactatattcttatgccgtgtatatggctttggtcctattgctgtatggattggaatgtttgccgactggactgtgcgcggtatcgtgttcactatacgtttccactcccgcagatggcttaatcatcatataattgactgatcttaacgaattggattaacgataaaaaacgcatgccagattgaaaaaatcggacatgcgttttattattttgttataaattataatattgtattgtaaaccatattattacaatcagccattatcctagaatcccttacagttacccttaagagttgctcctgtaatattaacttttccattaatattagtacaatcctcaataatagccttgccaaatgttactttataaccaagtgcagatggttttcctgtaagtggccagtgataattattacccttattagaatctgaaatacaattcttcattgttacaacaccactctggttgtttctatcgaaaccattagcatagtttcccttagctgtacatccaataagcttatggttaagaggatcaaggtgagctgcctttcctggtgttttattatctactccacccatcttaaatccgttaccatcaccatatattccgtcacagtatccattgtagttagcctggcagtttacaagtgttactgctccatgagctgcataacaatcccagccatcatcactattgtattcagctacacagttttcaaaataattgccttcacctgaatgaagttttactgcaaaaccatcagcattctcacccttagcatctgcattatgatgagacttgcaattataaaacttgttattagctcctccgttgcttacctgaaaacctgcgtcttcattataacagcatgttacatactttaatgtattattagaacctgaaataaagattccattatcagaagcattcttaactgtaatgttagaaagtgtgcttccattacctgataatgtaattcctcttcctgaacttccgcttgtctgtgagaaatctattgtcgcattattctttcctgcaagattaacacctgctggaagtgaaacagctccggacttaactgttccatcaataactactgtctgtcctgacttagccttcttaagtgcatctgctaaagacattccaccagccttaaccacataattacctgatacagatgaacctgttgatgaacctgaagatgagctgcttcctgatgaagagctgcctgaacctgatgaacttcctgatgaagaaccagatgatgagctgccattagaatcaacctgtactttgtaaatgttgattccgctgttctctgaatacagatatatgtatcccttagaacctgaatatgaatatgttcctaaagaagctgtcttattagctgcaatagttccaagcttctttccattagaatcagctacgattaaattacgggtagagcttccactgcttcttaacactacctttattgtatcagaacctgacactggtaccttaactgaacggtatgatgtagtgcctgtaccagaaagagccagacaatatgtatatgctgtgccatctactgttacagattccgccttaaccttcatattcttactgcttgttgccataagaccaagtccgtctactgtagtacttgatttaatagttcctaacttcttaaaattagaattcttgaaattccatgaattctgtgttgccgcattagctgacaacactggtgctgctgtaaaacatactaataatactgcaacaacagctgcaaaaacccttcttgccttcttaatcattattaacctcccatacattatagattaaatagcaaaagaggcgttattttgctggcagtgtccgatatcatgcaaaataaatcgcctctgatgctaaaaataccataataaggataaaaatgaaatggcttaaaattacaaagatttacgcaagtgtttgtgcattttgtatagttagttccgaaatataccgttttcttaatacatttttacttaaaaactgatttattgctattacacaatcactctctattatctttcaggctttcaaccatatcaaccctgtcagcctttcttctcacagtaagaagtgatactgcatagcatgcaatcactattactatagtcagtattatgctctgtgctgttattaccggtgtgtaaagcaccccctccattccagaatatatcctgaatacctcaaccatcataaaataccctgtaagcaatccgactgctataccaaacggtattattatatggtttacatcaataatcattctgttaatttcacggttcttaagtccgagtactttaagcattgatatgttgtggcggttctctgaaataagcatatttacagatacatacaatgccgcaatacatataatcgcaccgattaccgcaagtgaatatataattgcacccatctctgtaagaatagtcttcatctgctccctgatgtcatctgatgtcaccgtcttagatatctcatcgcctaagtcaagcttcttctctgacagcagtccgttgtatgttccgtcatcccatacgagcagttttcttgcattgttctggctgcacacaagcaacttctggctgtcattcattataattccgcttattgtgactttcttttcttccattgtaataggattaacaaatgtaaattcgtccccggcttcgagcttataggcatatgccattacatttgtaacataatatccattggaaaggtctgccctgctaccatcctcagtatcaatattcagatacttcacatctgtatccgcgcctatcagtgaaaatgaagagccgtcatgctcgtattttcctataacaagctcatctgctcctgccacttcatctgtctttaggcagttaagcacatattcatacttaaaacttcccatgctgtcagcacctctatcaattacattattgatagagtctataaacataaacgcaactgttatcatcagtgcccctaaaaatgcacctaaaaatacaacaaagcttcttcccggattggcaagtatgcttcttaatgcgaacttatttcttaccttgcccttcttaccggctaatacatgtcttgttctgctgtcaccatctgcattgccattaagcatttctacagtgtctttctttaagagcttagacactttatgtgctgcctcaagcatatagatagccgtaggaattattattcctataaccgctatcgaaattggaagtgtgaaatggaccggcattggctcataatctgcaaggctcatttcgccatatggctgctgtattatcttggtaataattgtaacaataattccaccggcaagtcccggaatcatggcaagcacactgtaatgccacataagttgtcttttagtgtagccaagtgctgacagtgtaccaatcattttctgttcctgctttatctttctgcctattataatagctataagtgcaactgtaataagcggcagtgtaaacagaaatacaaatgccataataagaaacattattgcctgatcatcaaccattgtaattctctggttattgtctttagcaagatagctgtttatcttgtactgctcgttcatgtcttttctgaactgtgtcacatcactgtcgtcactgtatactaccttgtactgacatgagcttgcctcaagcgcatcgtacgcactatctgtcatgtatgcaaggaaaaatgatgtgatattcttgtatgaatcatcagtattctcaagcatatacaggtaatcaggtcttaagaaatatcctgtaaccttgtattcttttcccttaattgtgagcctgtcgccaatacttacatgctcactttcagcatatccctttgatataacaatctcatcatcgttaaatatgtcatttccatcaatcacctcataaaggtcgattttcttattgcgtttgaaaacccttactttatatccgtcctcattaatatttacataatgctctttctcaaatgtaacattatatttcttctctatattactaatctcgttatccggtatctccacatatgttgtaaatgtggcatcttccagcttattatctataaagaattggtcaccatatgatttaattcctgttcctgctatgtaaaaaagatagaacagcagcagggcaactacggtaagaactgccgcagctatataaaacgacagattctctttaacatttcttaaatatctcttgttaagagtcataaccagcctcctcataatcacattttttataattcagatacttgttcttttacaattcaagttcctctgcgctgtgcttactgttgttatctgtgcaggaagcaacctgaccatctttaattcttatgactgtgtccgccatatcagctatcgcttcattatgtgttatgattataattgtagtcttaaactgttcattgactttctctatgaatttcaggacatttcttgatgacttggaatcaagcgcacctgtaagctcgtcgcacagaagaatcttaggattcttgattaatgctcttgctatcgcaactctctgttgctgtccacctgaaagttccttaggaaaacgattcttgtatttgtcaatatcaagtgctttcattacctcttctatatccattggctgctttgcaatatcagcgacaacctgaatattttcctgcactgtaaggtctggaatcagattgtaaaactggaatacaaatccaacatcttcccttctgtagtctgtcattttcttcttgtcacttctgcttatgttcctgcctgaaatcgtaatctctcctgaatcaagcgaatcaagcccaccaatcatattaagaagtgtactctttcctgaacctgaaggtccaagaattacacatatcctgccttctcccaaagacagacttacaccgtcaagtgcgttgacaagtgtttcgccctcaccataatgttttcttgcatctttaatatctataaacatatattccctcctatcatttttgcagctttaaccagcttttgttataatagcggtcagtctttgctgtagtcacaactcgcttccgttagttctcactaactatactatgataataacactagtaatcgcaattaacaagggaatttaataaaatacggcgcgccagtttcctgacacgccgcatttttaagtaattcatattgtcacctaccttgatgtaaaagtggttatcctatcgatattataaagaggtatgttagtcatccagtcctgctcccgataatctgacatagatgtcctcactgcataatcaggattatatttatcacaaaatgctcttaaactcttggctcttagattttcctctgcctttacttcaattggaataacagatgttctaccctgcacaaggaaatcaatttctcctctggaattctgcgcagaatagtaataaggtacaatccctgcttcactgataagctgctgcaatacatactgctccgtcaacgctcccttaaattctgtaaaaatcctgttgccatcaataataactctcgcatctaagtccgtcatggcaataagaagccctatatcaagcaaaaacattttaaatgagtctaaatccatatatgccttcaatggaagtgccggcttgctaacccttgctactttatgaataagtccgcaatcaagcagccactgtattgcaagttcaaaatctttggctctcgcgccctctctgacctgtccataaatgtatttcttattttctttcgcaagctgcataggaattgaatcccacacaagattaagtcgtggaacaagattaatctctgcatgttttgaaaaatcctgcctgtaataattcaacagattcttctgtatctcacgaaccctgttaaagtccttattctctacatatgatgctacaacttctggcattcctccaacataataatactccctaagtctgtctatatatttagaactaaatgcacttaccattgatgtatcttcacccttaagtacatctacatatcgctcttcccctaatgcacataagaattcctgatagcttaagggatacaaatccataaagtcaaccttgccaactggaaatgaagtgcctgtgtgaagtgcaacccccaacagagaacctgctgcaacaaccgcatactccggtgcattttcacagaaatatttaagtgacgaaagtgctttaggcacttcctgtatctcgtcaaatataataagtgtattatgactgtcaattgtcattcctgtctctatacttattgccataataatcctgggaatgtcaatttcaccatcaaaaacattcttcattcttgcattactatcaaagttcacatatgcaacattttcaaaacatgttcttccaaactccttcataagccatgtttttccaacctgtcttgctcctctgataataagaggttttctgtcttttttatctttccattgctttaactgttcaattgcaaaacgcttcatcagacacctcctgaaaaatactataacctgtgtataatattttattcctttaagagtgtatggtcaacatttttatggacgtaaaaatgtgttttatcacacttttatgtacaaacttttgtgttatgttacatttttctgcacgaacttttctcaatccactcatctggcatctcaaaatgctggtaatcttttgcatattcccagtcgccgccccactcaaatccatgttctgcaaacaccttatagcacaaatcgtcatggtcgattttgtgtggaaattcaatgcttctgtctgtatacttttcagcattggcaggctctacatttcttctgccatcaacatatttcacataaggattataaagcgtgttgatgtcaaccgccagccctaacgcatgctttgacagcttcgttgaataggaaatgtatctgaaattaaacgctgaagaattattatccctcatcgacttctcgtcatcagcatcatattcatcaataagtctgattttttcaatctcataaccagcctcataaagctgcttaaatatatcaagcacatcatcagcaatcagcctgttcacaaccagctcacctatgtgcgttttcccatcaaatccgacatacaaaactttaagataccgcaaatcttctcttggaacggtgcagttgtccttaaatgatttcccctgcatctttgcaaatatgtcgtctggaattggtgatatggtaaatggttgggtgttcatgtgtgtgctcctctgttttttaatctaatactcaaattctactatcctgcaattctcacatatgcatgcttccactttcgttctgtggctcgccttaagcggtgtgatttcaacaaatcctttggctgttttcgcatttgtgaatactccaggcacttcatcggcaaagctgaatgcgccgtctttactgctgaaaaggtatcctttccgcatttccttattacattttggacaaatcatacataacacctcattccttaatatctttactaagaaccgacattgccatgctaagtttctcttcaaactgctccgctttaacaagcgctatgccctcattgtcatcgccaagcacaaccagcctgctgccattcactagtccaaaagtctctctagcctctttaggaataactatctgaccgcggtcattcactgtgacaacgccccacatgtgtttgcccttcggtgctggtgccatcttctgcccttcaagctgcacatcgtcctttattaaggaatccatcgtcaccccataaaactctgcaagcctgccgcatttttcaatatcaggaattgtttcaccacgctcccatttggcatacgcctgcctcgatattccaataacctctgcgatatactcctgcgtcttaccggcaagcgacctcagcataataagattctcctgtagcataatgtcagtcctttctgttgttatatatgtattataatccttgtaaatgcggattccaccaattgtagttgtcagaaaagtgggaattgtgttggagttggttgcgtaatattattattttataatcttacacatatctacatatttctttgatattttgctatacatttcaaattcttcattatctggttttatatatggattattctttgattcataaaatgtatctgtaaacatccataataatttaccataaaaattatctattaaatactttcttgtaccatcaaatgaaacacttatcactgaacctccacatgcgtgtttctgtaattccttcagccattgaatcttatctcctcccaaatttttcatttgctgctcatttgtcctattatttattatagctaccattttaatatcaccaaaatgttgtaatattaatatctcatataatatctcgaatgccataactactatatccactttatccttgcaaattatagagtgtataatattagccttctctattaacttttcttgggttcttatatcaatatttttaaacataatttttaacatatcatcaaatatttgtttatcatttaaatcatcatcttttataaacttatttgtataaaaattatatttatctaggaaagaactattgggcaggccattatctaactttaacgaaaaatcaataaatttccttaaatatttatcaacgttcattttttgacccgctccgaacatttcttccactgagtgatttagttgttctctatcaattgccaatattaaaattatattatctaatccataaaatatatgatgtaatctttctaatacttttatagcataatgtggaatacatctatctaactcatccactactaaaactatcgttctctcctttgcaatttcttttatattctcccttattttttctattgttttgctgtaattaaaataattattaaacctgtatttctctgagtccatattagcttcttctgtttttatatcttcatataaacttattaaatcaagtcctattttgttttttatacattcatttgctgctccaataagattatcttttgctattttccaaccagatttaatttttttatcaattcctttgtcaaaccattttttatcaatctctaacgattctaacattgaagaaataatagcaactgaaggctccttataataatcatatttccaacaattataattaaacacaaaatattgattatcaaatgtttcctcagattgctgcagttttaatctatcagatacctcctctataacaaaagtcttacctattccccaaccgccttcaatggaaaaacaacatcctttttttatttctgaaagttgatttactattttaattacattttcaataaactcatttctatctaataaatcaattttgttattcatacacaatcctcatacttcagaattttcctataaatttctttaatcaaatatttttatagctcttgatattaatattgcatccataaatctgcatataataaaattaattatattatctatagctattatgctaaattcctccatttgaggaagattatataagcaaatatattcattataaaaaccaatcaaacattggttattaataaaattatagcttaatattgttattattgttaaaaaaaacatatacaaaaaaagcatgagaataaagtttttaaaaccatttccttttatttttatattccataaaatataaatagtaatcaatataatcaatactttaattattaaaactggtattaatatataattttcactaaaaatcaaaatataatataatacacataagaaaaaagcaattgccactattgtataccacttaaagaatttttctttctcttttagcgcttttatatattcaaatatggtaaatcctattgttccaattaaaataattaatgcttctagaaaattcatctcgtttttcaacctagtttgaatatatattacaaaatagtattcataaaataaaaaaatcaaaaacttcaatttttttattccttcctcaactagtaaggcttgacacattttgcatgctacaaatattgcgtaaataaatgttaaaatgtactccatatttcctcctttttatatcattatcccccttttctcccctcccttcaacatcttttttacgacaaaattcgacaaaccacattatctctactccccaaacctttccattgttatttttcccagcctatattataatttttattaactacaccaatgaaggagatttattaaatgaagaaaaatagtatttttcgcagcctgccgtttaaattgctggtgggcgttattgctggcgtcctggtgggactgctgttaagttcaactgatggcaattcattttcacgcgccattttgaatattgttgtaactctgaagtatattctcaatcagataattaatttctgcataccgctgataatcattgcatttattgcaccttcgattactcagatgggtaaaaatgcatcaaagcttcttctgattgcagttacaatcgcatatacatcatcagttggtgctgcacttttctctacagcatccggatatcttttgataccacatttgtcaatatcctctactgctgatggattgaaagagcttccggctgcggttttcgaattatcaatcccgcagataatgcctgttatgagtgcacttgtgttctctatcatgatcggactcgcagcggcatggacaaaggctgagttaatctctgacctgcttgaagaatttcagaagattgtgcttgcaattgtatcaagaatcatgataccgattcttccatttttcatcggactcactttctgcggactctcatacgaaggttcaataacaaagcaggttcctgtgttcctgaaaattataattattgtattaatcggacattacatttggatgactctgctttacacaatcgccggattgtattctaagaagaacccgattgaagtaatcagacattacggtcctgcatacctgacatcaattggaacaatgtcatctgctgccacactcgcagttgcactccagtgtgccggcaaatcaaaggttttgagaaaggacatggtctcttttggaattcctttgtttgcaaatatacatttgtgcggctctgtgctgacagaggtatttttctgcatgactgtatctaagattttgtatggctctattccatcagccggaactatgattctgttctgcgtgcttctcggaatatttgcaatcggcgcacctggcgtacctggcggaacagttatggcttcgctcggacttattaccggcgtgcttggatttaacgacactggaactgcccttatgcttacaatatttgcacttcaggacagcttcggaacagcctgcaatgtaacaggcgacggtgcgctcacacttatcctgactggatatgcagagcgccacggcatcaaagaaggtactgacaattaatatatttctttgacatatgtaaagtgctataatcatcacatgaatacacgcgcctgcggcgcagaaatgaggtaacatatgccatttattaattcaaagataagcacttctcttacagaagcacaggaaactgaaatcaaaacccgtttaggtcaggctatccagacaattcccggcaagtcagaaagctggctcatggtcggctttgaacctgactacaagctctacttcagaggaagcaatgccgagcctatagctatggtcgaggtcagcgtttacggaagtgagaacccatctgccttttctaaactgactggccagatatgtgacatttttaaagctgttcttggaattgcacctgaccatgtgtatgttaagtatcaggccgtctctaactggggatggaatggggataatttctaatatgcgttaataagcggggcactcatttatttatgaatgtcccgcttaaatattttttctaaaattctttcttttccataatccggacactaattgcataagagagcagtatgagaagtactatcactaccactgcaattcctgcaagtatccagccattcatttggtttaaaaatgaaaaggcacttaatacatttgtctttaccagctccgcaaatgcaatgacagacgctcccattacaccacatgcccccgaaatgactactctgctcttttctactccggatactagctgcagcggaatcagcaatgcaatcaacaatgccgtaaccggcagaaacaccaataccacaggaatctgggaagccatgtctaccggcatctgctgtttcatttccaggatcatgtaaagtcccgctgccacaagccatgaaaccgttcctcctgtaagacagaaaaaatatttttccctcacatacgtttctgcatcaatcggcaaagtcatcaaaaatccatatcctttatcaagctcgtcataggtaattgtatttatcagaagaatactgattgcaaacggcaaccaccccaggataaccgcttcattctgtaatcctattaccactccaatgataagtaagaaaattaatgcctgtttattacaccaaattaaccggaaatctttttctactaatcctgccattatctgtaccctcccgtcatcataagaattaattcatcaattccgccctgctccaccgcaatctgcggataattttcctgataaaatcttctgtcattagtaaagcaggcataaccataagtttctttctgtacttttatgactgctgtcttgtctaatgtcctgtattgttcctcattcaccttcaaaataccatactgctctaaaataacatctgtgtcctcatgcaaaatgatttttccgtcatgaatgagataaatgtcgtcacaaagtgactccaaatctgtggaaatgtgcgatgtaatcaatattgtgcgcttctcgtcctgcgctatatattcccgtagcaaatcaaggatttcattccttgcctccacatcaagccctgcggtcggctcatctaaaatcaacaaatcagctttatggctgattgctgtcagcaccctcagttttgctttcatacctgtggaaaattcttttaatttcttcttccgtggaagctttaaagcctcacatttttggtcaaaaaaatccttctggaaatcaggatacattttagcaaggatatgccagacatcttccaccgtaaattgtgaactaaagcctgcctccgtcaaagatactccgattttctgctttaccgcagccggaagctctccaccttcgttaccaaacacacaaatctttccagcatccggctttaccagtccaagtatcagtttaattgccgtactttttcctgcgccgtttctccatagatacatactgagttttctctactactatcccctcgctcaatatcggcactataactataaccttatctgggaatatctgcacctgctctaagtgctctaagaggtattctacttttaatttctcattaccatctacatatctggatacctcctcatctatgttagccagtaccttatctatctctgcaatatctccagagttagccttattcttttctgtttctgctttgagctggatgatcctctcatctaactcctctgcttttttctggtattcctgtttatttaggatcccatctaagtaggcatccagtagcttactttttctggagagctcacgctgtagatctgcctctgtatgccctccatttgcctctaggagctgttttctgagtttagtaagccaatttatcatatcctgctttattgtgtctgtattcgcttgtaatcgctctgatactacccccattatctccatgagggagttataagagatattttcattatcacagcctaaaggatttatctctccagctttccccatcgtgctatctctttttctggttctcctgcctttagtctgcttggtactgcatacccagtactcatccttagatactctctgtttcctccagtaaggagccccacagataccacataccagcttaccactaaaagagtatccgctggttttcttgcctctcctgtcggatcctgtggctattactctctcctcatggatcttacagattagatcccactcctcctgtgtgactatcggagggagagcgttttctacatatacccactcctccttagggagttttatagtttgcttactctcaaaatcgtgtctttctttgtttataatcatggtacctacatttttacaatcatatacaaatttaggtatatccataggtttccacggtttccctaccgtgttacggtatccagcatcattaagctccttagctatgagggtagagccttttcttgccataattccctcacacatgagcctccttaccttagcctgttctggattgatataatatttaccatcttttttatcccatccatacacgttaccgctaccctgtaaggctatctcctgcccctgtctggctttctctattctgtgatcgtggtagttatggagtttcttactaaggtttctactaaactcctccgctatgatcgctcttacacctgttataagagcatcatctggggaataaaatttcccatccatgtacataaacaggagctttcctgtctgtactaccctgttaataaagaggtaccaatccagagtatttctctggagcctctcttgatccttgattactacaatatcaaatagatcctcatacagatcctcatagagcctctggtaatcatctctgccctttaccatcgtaccgctcttactacgatcaatatactctcctaccagtttccagccatgatccttaatacatcctctattttcttcaatctggagttctatagcgtttagctgttcctcctccgctgtagatactctggcataaaataccgctctcataccaatagtatctcttatatccgttatcttcctgtatgccatcctgtttaccctcctgtaatagtcctgtgagctcctgtgtgcctcatacagccacttttatatattaggtgtagacttctttatcctcgataaaatagagggctttatgaggctgtttttcagtttctatctattatacaccccttatatactagatacaactaaaaaatgagggctaccagcattttacagccagtagccctctatatgaaaaaaaaatattaaggagtgcctaaaggattaaggtaacttgattacctgtccgatgttaataagatttttatttttgataccattgagcttaaccagagtatctacagtagttccatactttttagcgatcttgctaagagtatctcccttaactactgtataggtcttagcggatcctccgcctgtcttaccagaaatatctccagcatttacccagccatatacagtagagcccttaccagagatagcctgtaagtgatacggatgtaccgcaccctcagccttgttagttaccttagcctgtcctgccttacagccatatgcaacgccactagctgtagagctggtatagtggaggcatcctgtaaagtttacaatatctccaatattgtaagagcctcctccgttaccagatggcttaggagcctcctctttagtagccttagagctgtacttaggagtaacaaagcctctgatatacttaccgtttacagcaagttctctatagcctacagcgttactcttgttaccctcgataaccttaataacgcctccagatacagatactacaataccgatatgatccgcactacctgtattatctcctactccgttatcatcccaatcatagaggatcatatctccagcggatggagtataagcatcattctctacccagatacccatattcttagcaagctggataaactgattacagctacactctctagggataatatctgtaagccctgccttgatacctacagcggatgcaaaagtagcacaccacgcatctgtatattttacagcataacttctagggagtggcttacaagcgttataagtatcaataatctttttatgggatccgttactctctttacagcctaaccaacccttagcgatctcaacaacctttgatctgatttctttctctgtcataataatacctccgatctaaacacttaaaaaggagagccctgtaaaggctctccctgtctgtatgataaatatatttactgtggagctgtatagctctttgctctggcactatcgcctaatccctttgtagtcggatcgtttagagtgttccaaaccgataccaccactaaagagagtacataaggattagagatagctcctacaatgagctcccctaccttactccatgtggtaagatcctgtgctgtaagtcctgcatacgcaagcacaggagttaaaatactaagtacaatctgtacccagaatacaggattttttactctaacttttaaattcatactgtacctccttgtgagtttgttaatagttgctacgatacctcaaaatgaggtaaagagataaattggatcccctccttactttagtcctacagaaaccgctaagtatcctaagataagtgttacaagccctgttacaataagccacttgaatttatcccacttatccccatccttaccctccagcttgttaagcctctcaacggtttcattcagatccccacgcatatacttaacctcagtagccagctcctttatagctccgatcatctcactgttacttttgagaatttcatcgtgctcatcaagtcttttagtgttacttcgggctctagcatctacctcagtaagtctatgctcaatgttaatatctgcatctgtagccatatccataagatcctcctttccgccataataaaagggagagcatttagctctccctctgtggcttactctgcaagctctggtaaatcaagatcaatgaggatctgcttaacctgctctctgattactggcggtacatcattgatcgtctttttgccctttacaataagggtagcgtaaattactgccatagcttttacctcctttctgagtattgtttttaagataatattgagtaacatactactcattatctccgtctaagattttttgtacggcttttctgagatcctttggtatattatcaatagtccttaatcctttgcggatcaaagtagcgtaaacctgtgccataatctttctcctcctcttagttagctgataaccctaacatctgctcatacacatctgctaaggctaactgtaaatctgtagcctgctcctctaaggagctgtttttctctgccatgagctggatgtactcatctttctcatagatctcctgtgtttcaatttcaaacccatcaaacccagagctaagatctccctccttagcctcctcatggatctctttgatacctgtatttacatatacatggtaatcatcaatctcaagaggctttacgctctccgctgtagttcttacgtttacaaatttctgcattaccttttacctcctttaagtaataattgtgcatatattctacattaggctctacatatttctggtatagcctaaagctatcacaatgctgtagccagcccacatagctattaaatgagcaccactcactataagtagggctcacattgttttctcttttactggagatgctaagcatcctacgcttaaatgttttgcaagtcgattttctgagtaaggtatactctccgaaaaatctatagcctacaaaatctacacctcttaccttagtaggaaatacctgccagttatgcttaagcacctgcttaagatttaccgccataaactcatctaactctcttttgagtttgtgtaattcctctttactgctaccgaaaataaccatatcatccatgtatctaaagtagtacttaacgcccttaacctctttgagccagtgatctactacagatagattaaaattaccgtcatactggctaacatagtttccaataggaatacctacgccatccacaaactctctaccgctatcgtctatgataatatttaccgccacacctagcctctggaggatctctacattttcctctgtggctggacaagtactaatactatctatgatctcatccattaaccagataagctcctcatccttaaagagctctctatacttagcctttagtacatcatgtacaatgctgggataatactttcttacatccagctttaagcaatactttgtagcctctggatctgatactaaaatactgggtatccacttctccgctactacttttccatctttcttaatctttttcttataccctcgtaactgattgataataggctggatccctctgttagggattgcactataggtatcctttgtcatggaattaagtaagtagggctctataacctgtaagatagcccattgacatatacggtctggatagtacggtaacttataaatctccctctccttattactctctttctttgtaaagatttcatattctgaggtatgatacctgtgttctattagattttcctgtagcctctttaggtaatgatccagatctttttctatacactttacctctgcataccaccctttacctctctttgcgttcttgtgggcttttctaagattatccatatcacaaatcttagaaaataaatctccagtatctttcatgtgttttggcacccaccttatcataattttgtatgtgcataagagggagctaactacctgttgtagtacccctgtgctatcgttcacataacaatcagttcttagcttgctaggctaacatggtttacggatctctccgcacataagcaccctcttagctattttttaccgctcctcatagaggagttttatgttttggcaagagccacggtagctaaatctcacttatataaataagtgtcatggtgtaacacacttttactatttttctttttatatgcacatatagtaagtgactgctgatattccgattgcgattagaggaggtattattcagattaagataccatgcaccacatttagtaccattattccatttaccacctaatttagtaacacgaaacgccttttagctaccgacaaagagggtaataaaaaagagctttacagccctctctattaccctctttgatttctttattttgttgagtttatgatgctattgttatgcactaatctttgtctgaggcacatacagcaagcgaccgccgacactccgatagcgattagaggaggcagcattcagactaagacaccacgcaccacacgcagcaccataagcccacctaccacccaatatagcaacacgaaaaccatcattgttattccaataataatctcctactgggaggttagatgcaccgttatgctccgcacaaaggaaaagatctggatgatcctcatcgtatccaaaaccactaatatagccctctcctgtggcaatattaaaatctaaggctttgtatccatcggctgtagtatcatccttacactctccataaggcttaacaaaagcattgtatactctgcttgccttatcgttataaatattgatagcatccagccaagtccagatattaccccagaggttttcctctcctctgtaagatactgagcacttaccatctactccagcgttaggatcaataccagatccattacctaaaccagaggtagcacctgttactacagccatgttagtagatccatcgtctgtaaaagtacttacaccctgtccgataacgctttgagcgttcatagaggcatactctactaagataagccactgagtagctgtaagggcgaaaatgttatgagatttccagcccttacctctgttagtacagagttttcttatgtttgctctagtgaggttctgtgtaagtccactggctggcttagcacctgcgatagatgagagcatatctgtagcaaaatccgctacctgctcatccgccttaagatatgctccagcggaggtatcaaagatagatccctcaaaggctgagaggtaaattttatcctgtaagataccgttatcatctaagaaaccatccacaggcttaaatcctgccttaggtgtagggctgatataaaatctagccttatcatatttcttacctctaccagaggaggaaacgctggattttacaggcacaaccttagtatagaataaaggctgttctaccatagtctgtaccttagtaccgctaggatattctgtagtaccctttgtaatggtagctgaggtagctcctgcctctgagtaacctgtttcccctctgtaggctaccataacgccctcattagtaaggttacatctctttctaccaccccacggagcgagcttatcaaaatctgcaccagaggtaagattttctgctcctgctaatcttgtaaatttcttatttacaaaatctacctctactccgtatacatcggagctctcatagcctacaaagctcttaacatcgtcaatctgctcctgtaaattaacgatctgagctactgtggctccagcggtaggatctacatttacctttacgctagaggcattagataccgctgttacaagatccaccataagggagcttacaccgataccattaaatggaggcatataatccgctgtagcggtactctcatctgctactgagatactgtagaggatctctccagcctgtggatcatttgcataaagtcctaaatttcttacataataaccctgccctaaggtctgattagagaaactagcggatactgtaacattagatccattctttctcactacagaggctactttttcctcctgtttgatagtaccgatacctgtcatacttgccagatccccagatagcttagcatcggataccttgatcttagtaaactccagcttagtagtacctgctaccacttttgctaagagttcctgtcctttttttgtgattactgcactcttaaaagcacccattttatcacactccttttctttaatttattgtaataactgtagctgtgtttacagggcttgctacagtagtattaccgctgttagttgctttgctgttaatatcgtgggtaataatttttgtaaacgccattccaacgcctactccctcataatgagggcttgctacctcatcctttacagctatatccattgtgatagctccagaggagcctcctgtagataacgcctgtgctacattgagatctgagctcttatttacagtactctttatatcgtgagtgataatgtgagtaccagctctgcctaagcctacaccgtagtacatagggctctctgtagctaccttagggttaatatcgtttgtgatctgatacctcatagccacacaggatactaccgccacactaaaaggagttgtatttccctcctccagagtgtttttaagatccagcaccagattacaggggatcatatcctgcaaaatagaggagatcgtatcaaacgccccctctatccctaaatgagttataatctctaaaaaataatttttataatctggattaacgctaaagttatcatctccacagatactaataagcctgttataaagctctttctccgtataaggtactttatcattccacttaaccagcacattaaaacgccttgtttctaggctggctcctgcctctgggtaaatacccatcatatcctcaaaacgcttaataccgtactcatccgctgtttcaataaacatattgttaagagtacgctcaatctgttctaggatgtacttaagctctggcgtttccgcctttgctatctccttaaactctttaagctgtcggagtacaggcatccaatagcctaatagatcaatctctctagccaatataaacacctcctaacagaggtatctcctcctgtgttaaggctaagttactggctacatcgtttagctgtgtatccgccacatctaagatcccatccagattaaggagcctgttttctatctgagagatacgcactactaagttacctttctcccagttcttacgcatttctaagaaatacgcctccagagtttcctccgccttaggttttacctgtgaccactggtagccatcatttagagttattctggattttatgcttactgtcttacccacagcggatactactgttacggtatgacctataggagctatgccactacctgtaccctgtggatctggatctatagcctcctgcaccgcttttaccagtgtactagatgctactccaaaatcactattgataatgattaacttaacagtgcctcccccattccatacagggataaccactgtaccgcctacaccatccagagcatcagttttctctacataatcctgcttattaccgccaaaagggttactatcaaaggagttaaggtatcgtgtccttagagcctctgtatcctcctcatcctctgctgggataaggagctctgtaagctctccagtaagatccttatcaatgtactcaatagagctaagctctccaaaaaacttattgccattagtaccctctgtttcacactccatctgataataaaaatagccatcggcactctctataaatgctgtggctacatagttaagctcattcagattaaatctggagcctatagggatctccatattaaatttaccctttagagtagccttagtagcctcataagggataatacctctttccttacatcggaggattagaaactctcttactgcggtatctgcatacccattatttacgatattacctagctggatatatacatctgcgtgctctgcggatacaggggctatagcgttcataataacggagccctcacgcttatctacatcacttgccacccttgctagggatctatctaatatattttcgtatgtctgatcctcatacatccatttccacctccttactacctacatctgttaccagagtaaattttatatggagtacatctttaatctgggatacctccagatcttgtactcctgttatgtgctcattctcaaataagcactcctccatataccgccttacctcactgttaaggtattcctcgctatagctatatccgataagatcataaacctcatccccataaccccagctataaataatccagcggtatctcttagccttaagagctaagtaagcccacacacaaagagcatctacaccagttacaatcctccctgtgagtgtgcctttttcaaagtcgatctcatactcacggatagaggaggctgttacctcttgatccgctagagtaagatcctccgttgttgcaaaaggaaataaactcatttacgcctccaccacccttgctatgattacatacttattattatcattaagtttctgtaccagcaccatatccccagccttaagcccatcggtataggttatctggctctgtttccataccctagtatctggatctgggttatccttactggcaaaaccgttactctgtgtagtatccacagatactccagatacataaggtacttttatctgtctggtataccctgctactaagtaatccgctatatacagatcctcagcattgagtaccagatcatctatctttacactgttagagctttgcattactcctagctgggctaaggtaggattatctttagctccctgtgatcgcatcatctctagcacttccgcatattgatgatcgtttttcatgttatcgccattaccagccatgctatccctccttagtatccatcatttgttttagagttactgttaagctcatggtagctactccattctgccatgtgtgagtatctgcatctatccacactacaccgctgagccctgtagagctatctcttactactgcccctgctcctgttactgcctcattgaggtttacacattccagagtaaaggttttctcaaccgtcttaaacatactcttagctgtggtagtagcatccttgccctcctctttagtgtaggtctgttggaatataccatactttttcacatctgcatcattttgtactactccttgtggtttaccctctccgtcataaatacgaaccttattaaccatgttagtaatgctctctttatagttagagctggtaatattgctatcctccgtgatctcaatactgcataccaccttacccatttcctctacattgaggtagccttttttagctaccactctgtagcttactccgttctgttggtacgcctgtgtataggctctcataataatctcatagatagatacattctgtactatgagtttctgtgttagccctgtctgagctaaggagcctacagggatctccatatcatcacataccatctgagttatcgcctccgctgttttagagctaaaattataagtggcgttactcttgatggtatagaaaagaagatcataacaggtataagtaaccgtacctgtggtactgcttgcctccctctctactacaaagcctctaaagagctctgtttttccatcatcctcaaatagataaacaggatccgctaagttgatggtaagaggagtaatatttttatctaggggagcgttgactatatggagctccagctttctagctacctccgatctgctacctccccagctcatagaggatacatactctgtaatgtctgtatccttatgtactactatcactcttaccacctcctaagggatcgttaatacttgattaggatagataagattaggattttttatcttatccctgttagcattgtagatcttagtgtactgagctccgttaccgtaaaactgtttagctatcttccagaggcaatccccactttttaccgtgtatgttctggctgtactagcctgtggctttgtagcccttactgtaggctttacagtagctatagtaacggtagctttttttgtctttatctttttgtactcctttagattacaggtataataaatatctcctgtagcatcctgctctccccacacaaagctctctactgtagcctccatgttaagagtgcctgtaatgataaccctaataggagtaccagactttctccagctctcgatcttctctacataagttagaggctgtttacgccctgcattattactaaagttataatcttttgctggaaaaaaagacttaagagaaatttctcttaagcctgtgttaccgataaggtttacatctcccacctgtattacatttacaaccgtatttttatgggatacggttactgtgtaatcggagggcttaactgggagttgaaacttatcgttattctgttgtaaccaaaattccattaagtatcctcctccctattaagtcatattaggtaacaactttttgaattttgctaccatatcagataccaccttatcggtatctgcctctttctcaatgattaccgtatccgctaacttttcaatggttacggatccgataccaccgctcttaggcgtatctccatcctgtggatttcctttacctcctgtaccgcctttatcatcctgtggatctggatctctatctataggcttaacatcactgagctgtacgccccttgtgctcatcgccctatcatattgatccgcttgatttcttgttaagactttctctccttgatggaggatagctgggtagttatcgtatggtactcggtctttaccataggcaaaacctaaagcactcttaaccttgcctccgatacctcctacaaagtctttagcctttgagattgcaccaccgatcttatctacaaaaccgctgatagcatctatcgctccgcttatcacactcgttacggttccgatcgctgttgataccgcatcagagataccaccgaaaatagtggataccgcatcgaataagccttgaaatacgctcttaatggtttctacgatagttgtaatcgtggagcttgcactgtcgaaaaatccacagatgctctcccagatctgctgtatatatggggctaaaaagttgaacacagtttcaataccagtaaggagcccatcgaccactgttaaaatcaaatcgaccacagccgaaattacaggggctagagcctgccagactgtagaaaccactgtaaccaccgttgatacaatagtctggaataatcccatgtgatttccgatcacagtaagtacctgctggatcacaccgcctacaaaagtgaaaatagagctcagtgtaggcatgatcgctacaatcgcatttaccaccacagttattacctgctggataatcggcatcgctgttacaatgatgttagtgatagtctgaattactgggataagatacggtatgatctgagctacaccgctcataatcgtactaattacctgccctactacaggggctatctgctgtaccgctgagataatcggagggatgataggtaagatcgtattgatcgcctgtacaattccatccttaagcccagagaacatactagcaatacctccaccgtctacctttacactaaaaagctgatcgaaaatagcttgtagtgctccagtatcaataccgatattactcagccctgtaaagattgcatccttgatagatgtaaggagtggtaaaatattctccttaatctgaggagctaccttttctaccgctgttcctattgctgtaggcaagttgctaaaaatcgtctggagcatcggtataaagttaccaaagaaaaaggtacttgcactctctaccagctctcccatacttctagctactgcctctccatcccctacagataagttacctaagaggttagtaacagaggctttcatcatcgcaaaagatccgctaaaggtctgctctgcctctcttgctgtggttcctgtgatatttaatttatcctgtattactccgatagctgtatatacatccgctaagttgtttatatcgtacttagtaccagtgatagcctgtgcgtccttaaggagcctctccatctcctccttagtaccaccgtaacccaacttaaggttatccagcatcgtgtaattctgctttgcaaagccttgataagcgttttggatggatcccatatcagtacccatcttgttagcgttatccgccatatctatcatagctttgttagcaatctcagcggatttatttgtatcccctgcacacgcactcaaaagagaggcactaaatgaggtaacattttccatatactcattagcggataagcctgtagttttatacgcttgattagcgtactgtaacatcttatctaccgctgaggtatcggtactaccatcgctattagttttcgtgtacagtgtttccacaccgcctatactttgctgtagtttagctccctctcctaaggatttacccataagagctgtagctcctgctcctgcaatgcctacagcgattgttacgccttttgcaaggctcttaagtgtactaccgatcttacccagtactgcactagctccatcctttacagctaccatagcctttacagacatattaccgatggattttaagctactgcctataccgtggaggatcttactggcaccgtcttttactgctatcagaggcttagctactaccttacatacggatttcagtacaccgcccaccttacctaaaggggcacttgctttatccctcagagtaacaaaaggcttagctactgttttccctacggattttaaggagtttctaacctttgtgatccctctagtggctccatccctaacagagataaagggcttagccaccagctttcctactgttcgtacacctacccttattttatttaatccagatgtagctctatcatggatacctaccgctactgaggttactttatctcgtagcccccctaaggtatttttgatcttagctaagccctgtgaggctagatctctgatctttacaataggagtaaaagtagtagctatttctttaagcctctgcttaatttttcctactgtactagctgtaagatctctcaacttaatcactggagaaaaaacctttttagtaagatccttaatcctctgtgtgatcctgtttaccttttctgtagcttgatcgtctacctccgctctggttaatgctctcacattccctagcctatgcactctactctctacctcgctgatagtaagagaggcattatcctctacctctacctctggagtggctgtggtattattgacggtatctaaggtatcctgtatagcaccaataaccccagaggcgttatcctgtaaggatacctctggggatactgttgtattgcctacattctctacagtttgtctaacgctctctactactccagaggcgttatccgttgcgttgatggtagtattaacctttgtacgccccatctgttgcatggaggcgtttgttttatctacctgctccgaaaattcacgctgtaaacctagatttttcttaagggtagcatacatattatcttttaaataaagttttgcaccaaactctaccgccatatatgccacctcctctatgtgagtagattgatattgtacataacactcttactcttatctgccctctccagctctttgttattatcctctatctcctgctcataaaaagcctgtaatactaagagctctcctctaggcatcttataaaatacagatgggagtactctaccgtgtttccagtagtagtacatcatctgggtaagcccatctgtacttatgagttttttacttctttaaccgcattatctccaaaacctgccagctcagagatctctccataaatcttagcaatctctccagaaagtaagatcgctcttaccagatccttaggagtagataccttaaacttactcataagctccttatttttgaacatcggagcacctgtaggatctacaactccctcaattactgtaaagagctggagctgtgtaatatcaatatctgcatccttaccctttacatcaatgctcatatcctgtatctcctcaaacttagctggagtaatcgccttaattgtgagaatgaatggagcaccgtatacctgtgataatctggtaatctctacctccttagtagggagcttaatctctcctacatcggagcctaagaggagatctaagatattaaccgcctctttcttttctgtttcctctgcctgtactgcctctgtatttacattctttgtagccattgttatagccctccttaatttttcatataataaaaataaggggaggttttaccctccccaacctgcactcttataactcttactgaggagtaatctgatctaagtactcataccctgtaaaggtaaatggagcctctgtttcaagaggtttctgagcctcccaatcaaagagagtaagatcatccatctgtactcctgtgatagatacacgctctgcaccgtaagcatctggatccgctaacttactgataagcgtaaagcgtacatcctgcttatttctaaccatgttagctaccttaatagccattctggaatttaccttgtgcatcgtaagagatcctgtacccttacatccgacaaccttgttatcagtgaagaaagtaccgcactgtttaatctcctcttttgtaaactctacctttgcctgtgccttatagcactctcctacataatctccgtctaaccagagctctccaaaggtaccgttacaaattcgctttgtttctactgccatctgtaattacctccttaatccttattgatgaaaatatctacatcctcgatagcatctaagatagagatagtacccttaaggaatacatgagagcctgtattagcctccttaatagcctgctcatccatctcagaggtatctactccgatactctctaagtactgtttctgcttagctacattgatctccatagtagagctatcagccttaagccagcccttacctccctctgtagcctccagccctctaaggtagcccttgatagctgtaatcagtaagcacttgttatcataagagttactgtagttaccgatgtagctcttgttaatagtgctgtaaatatctccctcaatctgatcctgtatagcgttgatcttgattttctggagatccgctgtttctacctctgtaactgtagtgagagagtttacacctcttgcaattacaacacgctctccatcgttatagagagtgagcttaccagcatcaatagcggtatctacttcctcatcactatctaccagagggatagctgttacctcagtaagaggcttgtaggtagcggatactctgagatctaatccagctaacaagccagcaattctactacagtactccgcctctgtgtactgcttttctcctacctcgatcttatttgtagcggagctgtttactacctcaaagttaataacgcccctgctatctccagcggtcttagggagtactgctacaggtctgcgtacagagttctttctgatacccttaacccatgtagccagcttagtagcctcctctgtggtaagatctggagctcctacaatgtaatttactttctgtgtagcaaaatactttgtagcctcatcgtaactctctgctgttgtatccatcgtgtagataattaccttagatggagagccgataaacgctctctcaatataagcggtattctctgcactaaaagcactatctccagtagggatctcatccacactacggagcaccatagcccccttgtttttggcatccttaagcataatacctacaatgcctgtagatccgttctggatggctgttactgcctttttggaaaactcaataataatatctggtaatcccattctgtttaacctcctatccgtttgttactgtctttgtttcaatatccacatctccaataagctcatagttatcctctacaggtacatcctctgtaaagttgagagtgatctttacatataaagctccctcactaaccctcacatcatcggagtagttttctatctttgcatatctaggcttttcctttattccagctaaagggatcacaggtacaaccctcttaaggaggaaaagccttttaagctcctcctttacctcatagagtttttccgctaccacttgattagcctcgtttcttttcgcaaagtaaacaatctgaaatatcggatcatcctcatacacattgatattttttagctcgctactgcctgtagccagcgttacataaaagctgttacgctcaaaattattaggaacctcctctatatgcactggcaccccagaataagcggaggctataaccctacacacgctgttaagcaatctcataagctacctccctctatctctctgcctatttgctgtaaaaagctctctaccagcctgttaagtctgggcttagcatcctgcatacctttttccataaaaaaagagccatttacatagctctcttttaacatgatccctttttggttcctgttcttaaggtatttagcttttccgcctacactcagcttatccgctggtaaaaatctcttatgctgtacatgaccgtcatttacatacagagcatactctacattagttcccacctctacaaaatcgtgaggtatcccctctccaaaaatggtaatactatctactaaccgtgaggtatctactggcacatgaggtataacctcgccatgatagatattagccatcctctggaggaggatctttttcttatccgcccatttatccacaaacttactaaagttctctacaaaatcatcccagccctcgatagtaaagccctccactatacctcctcctcactgaggagcgatacaatgagctgagtacgctttttataaggcttatctgcaatagccttaaactccgtactcataataggcttatcgtactcatccagctcatagatatataaaatatctccccttttgataggagcctctggatctgtgtagagtgtaagatctgtggtattctttttctgtggctggagctgtgctgtggtagtactactctctgcggtatggcactcataagtaccaacctctataagagttttattagggcggttaaactctcctaaagttgaggagtatctttttactaccacttgcttatcatagagaaactgcataccttagccctccttatatccgcctactggatcatccagcgtataggatctagggaatagctggcggtatggatacagctttttttctactgatacaggtaatggatcatcaaaggttacactctcatccgctaaggtgtaagagctttctccctcagcccccagctttctaaatctctggatagctaaatcctcctgcacattcttaagctgtttagggaatacatccgcataccctgtaataatgccctcatcgttagtaagagcctctataaaggtatctctacaaaatgcctctatatcctctcttgctttctctaagagcactgttaatagccccagcttttttgtgttatcctctgatattccacagaggatcctacaacgctctaagctatccataggagatccctccttattcctctacaagctctacgccctctaatccagccagatacttagctactgctaaattgtctgtactagccttaccatcactgaaatacacgcctacagcggatacagttaagtaaggattttcagaggtaaagtgatacacctttttaggcttatcctctttcttttcctcctgctctggagttacctctggggatacagcaccctctgtaggagcctctgtaccattttcctgctcctgtttttcatcggctggagcatttaccgcctctttcttttcctcctgctctggagtactctgtgcttttctaggcatatccttttacctccttacctaaaattaaagacttgcctctgtgatagagatcttagatcctgcaaagctgttaaggagcttaattgtactctcgttaagtacatgacctttgtaataatctccagccttaggaagatcctcatagaaagtacctctaagctctgcgatctgtacctctcctaagtctactgtaaggatagtcttagtatcagcataacgatccaatactaaagagatttctccaaagtctgttacgatcttctgtactccgataccaagtacattctgcatagatccgttatcacctaagaaacgtacattgttacctgccttagcaagattgttaatcatacgcttaacatttgcatttacaaaagagaaatactctccctgtgctccgtgatcccacatcttctgtagtgcatctaagaagtgatcctccgtaagtgctccctttgtttctacaacattgttagcatttaccaaatttacaagtccgttcatctgtctaggagtagctccgctctccagagccttagtaccgttaaggaagtaccactccatatctctcttagtttctactaagcgatcctgcacctcagagttaaatacatcgttgatacccttaggattgagggatctagctgtaccagatacctgtgttaccttttcgatgatctgacacacattagagagtgtttttctgctagaagtgataacctctcctgcctcagagccctctaacttaagagtgcctctctcagagttgagctctttctctctccatgtcactgtaatatcctttgctggtactacctgccctctcttcataagcaaagtagtaagcggagtatctgtaggggatgtctgcttaatctcctctgtaaggtctactacctcattttcttgaaaatcttttcttttaatcatgtctgccatttcttattacctcctgttgagttatttgttttgaggagctggcttactcctcatctctgtttctgtaggcattgagtttttcactaatcatgccctttacatttccagcctttttgtactcatcgtacttagtttcatctttcttagatgtagatcctgtagctggagtggatcctttgagaaactcagctttagcctttgcaacttccttagctacctcagcatcaaagagctttttcataccctttactctctcagtgagcttagctttacgatcatcctcatctgtgatagttgctaagtcctctacagcgataagatttctaaagccagcatccagccccatctcctgtactgcatctactacatccagctttaagcccttaatagtaagatccagatctctcttagcctgtgcctgtaagcgttcctgctcctctgcctgtctacgctcatcctctgtcattttttccttagcctgcttatccgcccactctttttcctttttcttaatggcatccgttactctcttatctgccatcttttcatactctttctggagttctgctctgatctcctcctctgtctttaccttaggagtgttatctgcacctgccccagtagtgttagcgttagctgtggtattagtctgggtaccgttaccctgttcctgtgtttgtgtagctgtgtttgtgtttacatctgccatagttgttatcctccttaaaatgagttatatagtgctgatccctcgtaagttatctgcaaaatatccctactgtttctacataagttagggtaaatatctggagaaaatatgtatttactatgtaatcttttttcagtttctttagatttttatttcagagcaaaaaaaaagaggctaacaagtttttacgcctgttagcctctcctgtgagttaatcccacatatcatcctctggtaaatcctccagcactttataaaagttagggatttctgctatcgtcttaccctctttaatctgggtaagtacctctatcttttcatctaaaagctcatcactatccagattaaaatatttcatctctggaataccgatagcataagataaaagatccatgatctgtattttcttctcctccattacttaggcacctcctttaacatagcctccacgcatcctctcaatgctgttacaatctctggataatcctcagctaaaatatctataagctctggatgtcctacgcaaagagaggcatagttagctaaactctctgagcaattaggattagtcctacgcctatctgtataataagcggatccgtgaccgtatgtaacctgtcctgtatccctaaaagttcccttacttactgcatcgtaaatatcctgtaatccagatactccgcctccaaagagagctctacgctcattatccgcctcctcattaacctctttttgtaactttttaaaaaggctgttgtattttttccagtcaatctctccagatctatactgctccttaagtttctcgtgctttgtatcaaaggtttcttgttgctttttatatattatatcacactctttagcaaaatcctcaaatagctttttagccctctctccgataactggagtagccttatcaaacgcctctataagaggtttataagactgtgaaaacatattactgggtaacttatccttattatccttaacagttatcagcatatctaaaaagtgcatctcctcgtggaggttagtatcataggtgccgatataattagggtttattttagggatacccacatcaaaaacatattcaaaatttctattccatgatctcttaaccctgtgctctccgtgtgttacctttaatactacctcatcggatagcccgtcacacaatttatccatcttagtatatagtgctaccacattaggatctacggatgttttagagttcatataatctaatagagcttgtgtacttttagcctctggcttagttgcataaaaaacttgtgggtaatctgtgagcttaatctgctctggtacaggagtaggattttctttaagctctttctctactgtttttgtactaactttttctacaggttttacctcctcctgctttttagcctctgcctctctccacttctcatagttctcagcacctctaacggatcctgtaagctcgttaagctcattatcctcaaaggtatcacttaccacagggatatacacacatctacaattaggatggcgtgggagagtaggctcctctccccttttgaatactttaccattatccgctctacaatactggcaagtcctactatctccaccattagcacagcggtatctaagctcctccaccccagtatctttatatacatcatcgtgagcacagtaggtaactctctttgtttctgtcctcgctaccctctcagcgttatatctggctgtatctatgcccttattgatcctatccgtgatctgaggtattccctctcccagtatcatactctgagtaagtcctacacggagatttctacccagcctctccttatcctgccagagcctatctgagaacatagcaccgctccacggataatctaaggttttctgtatcagagctggattaagcctgttaaagttagcctttaccgttatgctctgccccagatcgtatacctgccttaaaaactgatccgtatagatattactaagcccctgtctaaaagtaatctgctccttctgtcctaaggcttttaactgctctccgatctgctcaaataatcctctactccgtgtgagtgctgattgattagcataactccactctcccccagccttttgtacctttgctatagtttctgttacgctggcaaggatctctttctggcaactagcgtaaatagaggctaagactttctccatcttagcctcatcctcaaacgctttgagattatttttaagtactgcctcctcacgctccttaatgagcttagctctcctcacactgtcctcatggaggatctttttctgttctggagtaagctctgagtagggaataccgtacattttcgctacttctttgtttacatagcctacattagccactctttacacctccttacagcctcatatagcccttttactgttctggttgaggaattgtagccccctgtgcatttagagcctcctgtgggctattctgtgcattaaggttaggaaataagttattactatcatttgtaatattctgcacagagtaaggatctgtactctgtctatctctttccttgtctgcctccagcttttccagcacttccttagggttatcaatgaatgggagtaagctgaggagtgtttccttatccacttttccatccagcttacttactgtatctacaatttctgtaagattgttaggtacattcctactaaactccactttgaggttaagtacatccacctcacgccctgtatttacatgaataggcacactaagcactcttaccagctcctttatagccttttccatttttctctctttgataatacacttagtttccagcccaaagagcttaaatctgatagctacaccgctaagatttcctgcaaagttctcatctgagagatctggtacagcggaaaacttgtggatattcttctccagcctgttaagatggttctctaatgcctccgtctggatctcctttgtaacaaatttcatatctccattttccattacctcaataatgccctcatctttgagtttctggatgctatcattacctgctaccatgtttttaagcattaaataggcgtttctaaatgcctcaaactcattagacacatcggagagcaccttatcatagtcatttaccagcgtttctatcttttcaagatcgctcatctgctcctcattgttgtataccgtgataatagggatcctaccgtaaatatgaggcttttcctccacaaactcatagcttgcaaactgtctagccttgcccttacctgtagccacacaggagccatcatctacacatttaaaaatctctatcttagtagggctgtatacctctgcatagtgggtagttttctttgtatcctctgtatcaatatcatacaaacggatcttataggctggctcctttgtggagctgttcttatacactatgataagatcctctggggatactctcatcatcttagtatggctctcctcatcttgatatactaagatatgggataagcccttaatcatagcctccttaccccactctataaaaagatcgtctttatcattatcgctacagattttatctaactcatcctgtatcgctgtatcctccagctctgtaaggtctactcctacatccgctggatctgcctctacaggtgccttatcctttttaggctctgtatagttaagtacaataggattacccagaaaataacctactgtgttatcaatcgtttgtccgaaaaagtcatttaccagcttgttattaggcttgtttttatcttttctcggtctgttctggatcttatgcttaccctcgtacagcttttgaaactttacatatctgggagcgatcttatttacatgagtatctaccaaatcatttaaaaactctgtactaaatctgcctccctcaacttctacattaaactctttatctatcggtctgctaagctctgccatattgcttatatcctccttttctgcataaaaataagccctcacttattagggcttttacactaaattctaaaatcttctcttttaagtactctgatctcattaccgccatctgccatagtcatagcaaaatctaaggcatcaaataaatcatcgtgatccacctctgggaataacagtaagcactcctccagatcatccataccctctctaaaatataccttgtggttttcaaagttagccgatctcctcatagctcttgttactttgtccttagaggtattgatattgataatagggagtaaagataatctcctaagctcctgtgctaaggatttctgataagctactgtttctactccgatccgctctaccatagggaatttatttctaccataatcaataatggtattaagctgggtattaaaggttagtctctctttcacataatccaatacatacacattatgatctgcatctacccctattaccatgagtacaaaataatctcctttatcctgctctttctccgatattgctaagtcacagccaaaacaaagccttaccttgatccactgatctataccatcctctgtcttaactcgtaccttagcggtctgaaagtcataatcaatcttgtactcctcgtaatatctgaaatactgagccttaaagattttaccctttgccagctctgtatcattttgatactgcatattgaaaatgatcttaccagattgcttaagaatagcctccagcctctctaagctaaacttttcctcccagagagatacttttttaccgtttaccactcttatagctctctgtgtatttaccacataatccttactctttatcagatcctcatacagatccaatgggttatatcgtgtacccagtatatggatctctccatctggctctagggtagggaaaagagagctataaaaccactccttaaggttactcctctgcttttctgttctggcattttctagccctactaagtcatcgcctataattacatcaaagtgcttagaaataaccgctccagaggctcctagtgctgttagagtagcctctttcttaataatgctcctcttatttacagtaaactctctatcattccatacattatccttacttgttttccaatctccaaaaatcctaataagatcctcattctgctcaaagtgagtacgaacctctttaagaaacgcctccgcctgtgtttgtgttttggatcctatcataatacggatattaggatctctgaggatccttgtaatacaataatccacatcgcctacagtacttttaccgaaacctctaggggctagatccagcgtgctcttactattcgatatgttagagataatgctcttatggagatccattacatttctcttagtaatgtaggtgcataccagataatatgctatctcaaaatctgcctcttgtatgaggtactttatcatagcatctctttctctctgatcctgtacctcccctagcttatcctctactagggatactactttataatctaacacatccgcctaacctcctttctacgcataataaaagggagcctgttagctccctacatcgttaccagttttataataagtactatagctacgatccacagcgtaaccacattaaacgcctgtacattcttataacggttactctctggcatagcattaaaccagagtgtatctactaccgataatcctactaccgctatggtacagagaataaataccagctttaataatcctgctaccatgttctactcctcctctcacgctccttatactctgcctcctctctgaggtctttataagtcctaccacaatatctacacctccagccccagccttttgtatattctggcttatgcttaaggatatagagtgtgtgtttacatcttcctaaatcactcatcacagtacgcctccttatatgctctctggatcttagggatctgtatagccatccaatctatcatctcctcatttttagcccagcacttactaccgtaggcattttgccataaaccactctcatagagaaaagcgtgtactatctcatggcggagtacctttttctgatatgctaccagatcctttacactctccgcactctgcttatagttaaaaatgaggatctcctttacactaggatcacaccatccatccgcctctctatcgtatctataatcatcctcatctatgatacggatactgtatctggttcctaagatatgtacctcactattaaaagctctgtgaggctgtgtactgcctgtactctcaatatcatctaaagatacggttatctccagccctgtatcacatagctttactgtagctgtacccttttcagtactataccctgttacctctcctaccatctgcttatatgccttaagatatacaatctctccagtaatatctctggttatatctccgcttactatctgcattactctttatcctccttttgtctattctccagctccactctactgttagagcttgctacacataagcccatagttattactcctacaatgcctcctaatataaagcatccaatccctactaagataatcatataatcctcctaactaaaaaggagagccttttacagctctccctccctaacctctgcctttatttaactgtttcccactccataggctccagatcatcaaataccacaggtactctctctctaagctcctttaagagcggtactgctacctctaacatctgcggatgaggctttcctgtagatccgcaagctctgaggcttaagaagtgcctccactctctaaggttagctgtcattactacctctgttttgaggctgttaggtaaaatagctcttgcctcctgtggagttctaccgataaggataaaatccttgtataactgctccgctttcatacagctatctgcccagttatccatctccacgctattctcattaaagaaacatgggcggataaaagttacatctcctacattacccttatggtaattacagtatcttgtactctcctgtgcaaagctggctaatctgtgtcttacaatctcatgggagatacctctatctactgtaaactttacactaaaagagtaatgctccagcatagcctcatgccctctcttaatgagtgctcttaccatcttctcagcggatccctctgtgattttatcctcactcttataacatacccttgctactctctcgatcttctttaagatttcctccccattgaggggatctaagatctcatatcctgcatctacaattttcatcttatgccttcctcatatcctcaatgtgctcatgctcagcctttgctacatacagcacagtatctaaagtgattgctacaatattactatgaaaaagcgtacctgcatccacataaataacattatctttaatatctgctattctacctgtaagccctgcatctccgttataacctacacctctcggatcaaaaggttttctgtaatttacatccacaatatcgcctactctaaactgctctttcttaccactattagatacaagctctataactctctctactttagatatttttccatctaacataattacctccttacagcaccatagctaaacgatccttaagctctttctcaatgtactctcttacctcaatcggattagcattacctgtaatatgtacctctgtgtatccgtttccctctttgatctcctccagctctactcctgccataccagagataatatctttaatggttttatctacgatctcagcgatctcctcatcggtcttaccgtttctcttgcctgtgatctcgatatgtcctacagagcctccaaacaaaccccttaacatagcatccataaaatcctcatgcttaggcttatcttttctctccgctctggctccctcgatagcatcaatttcaaactggataaactcctgtgctttcttaagatcctgtacaatatcatccttatgccctgctctggagatgtactttacagcactccctaagttgaaatttaagccccacgctctgattacatccttaggctgtgggttcaatctgttatagtgttctgggttaatagcattactcatattatgcttacctccttatgtttgataatcaacttaatcacataaaccttaaaaagttagatttatttaccttttttcttttcatttgtgcaattcttacaaagggctctgtattttccctagataaaaaccttatacccattgtgcaatctgcactacttcttagcacttttcataagctgagcgatctcatctaagcgatccttagcatcctgtgagagctcctgtgtaccgccactctctacacgctctgtagcctctcccataaggagcatatccagcttaactagcctctcaaaatcgttgatattctttacttttaccttgccctgtgcaatatccttactaaaatcagccataaggttattgataaggatacgatacttagtccgtacatccgttagctccgctgtgatcttagcctcgttactgttctgagcgttctctatatttctctgggttactctagctacccagttaaaagccctgctccaccctgctaccgttctctccgttctccctatggtttctgctaccgctctaagggatctcttatctcctaagccataatacagctcaaaggcttttctctggagctcattctctttactcaatgtattaggcattactccgcctcctttctcctctcttatgaggctattttccttgctctttgtgaatgaggaggaatttctacagttttacttacattcctgttgttatccgttaattccctctattttctttctacctatcttccttactatgttttcttttatagtactgaaattagtttttctttttctttgtgttattacattaactactcttatatgtttatttagtattattgctttatttacgcctcttttccgccctcctccgccttttactcatttcatagggatttcagtacatagaatgaaattaaatagagctacctcttacagtagctctttctctcttatatgagttgttaatactcttatgatagtttctttctccgccagctccgcctttacgcctcttacctctctgtatacttcctctcggatactattacaagtatttccatgatctgtaagcatcttgttatatttctgtgtcattctatctataacattctgatctactcccagatctgccagatttcttatctcctctgctaaggtcatttctcttacaccgctcataaccacttttccgcctctctttctcagcatcttctccagcacatccatgtaagatgtttttgctataagcctctctttagtagccatgtaataaagccctcatctggagtactctctacatactcattgtatcggttactgagcattaccagctcatcctctgtaatccttacactgtttgatccgaaacggagcataggtaaagtagttttctcctctttcttctttttctccttaggtacttctttctctgtaaagatctctttaaggtctatctctgtaaagcccattacctctaaggagtaatctacagcctgtaactcaaataactcctttttgagtagttcatcatcccagttacttaattccgccagcttgttatctgcgatacggtaagcctttacctgctctggagtgagatcatctcttactatgtatggtactctatccagccctgctaagatactagcctctctcctcgtatgccctgcgatgataaccatatctgcatctacgataatcggattagtaaatccatactccttaatactctccataaccttttttactgcataatcgttaattctagggttattctcataagggataagatccagcggatctgtgtactttacttgtaaatctttcatagcctcatgtacctctctttctatttatttcctaagctatgtaattttgtttcattagttagggtacatatctgtaatttttatgcacccttttacagatcaaactctccacgctctgtataagagcctcctacctgcttaaatcgcactctctgatagctatttaggttactaagagggatctctgtttctctcctccgcttttcctgctctggagtttcatagggattactcagtttctttctcttatccctatctgaggatgtatagtaaggatcatgctctcttagccatttatccgcctcatcttcctcacgcctaaacttactcaaatccctacaccgcctctctgcatctcttacacaccatagagccctctggtataatggctccgcacattacacacctgctatctgtggagatctctttactccttactgccttatactcataaatccttatggtatcgtgtactactccgttactgtctataaaacattgaggagtttctcctctcggttttctcaattctatgtaagatccgttttcatcggttccacattttattaaactcatctaatcctcctccagataagccttaagctctctctgtattctctttataccgctgtttatattcttactaatcacactctgatccacgcccattacaaacgctaactcatcctgtgtatatcccagtaccagcacatacgctatactcatatactgataatggcttaactttccttttctgtatgccttattaaactctgctctatcgcttttatggtatttatccagatcaatagctgttactgtcttaagatctgtgagaatacaggtagctactgtatctcctttttcacttaagccctctaagcctccccaatttctcaaaaatctctttatattcttaggatccttatagctcagccttagtaattgatcgtttactacatttcttacaatcgctcccaacgctaccgcctcctctcattgctttttctatgtatcttaggtgtacctccgctgtaataccgctgtataacccagtgccttttactgtagctacactctttctaagagctgtaatctctccataggtataatcattatccagaggacacatccacttaatggcatcgcctaccttaaacatcgtgtacctcccttttaacaagaaaaaaggagtatagtttttcctatactcctgcttgatcctgtattattcctgtgttagttcctgtcttaattcctgtgctcttgctattacctctctgctatatactgagctataaatatctttagcccacagctttttagctccgctctctcccatgttatataccatgagtacacagttttctccgctggatgctaagtacttatcctgtatttctcttaaacagttaagccctactctgatattttgatatggattaaagagatctgttactccctccgcctccatccgttctatatgccatttctcatatatctgcatatatcccttactgtttccgttatctcccagcttatcccagtgataaccgctctccctctctatgagggctactactgtgtaataatctactccgtactctttacactcacaccagaggtaaacctgtactatttctggaaaacatcctccagcatccttatactcctgtgggatctcataatatctaaatccctcctcgtatatctcagctccccagtctgcactcatcgtattatacggatatgtataattaagatcgtgctccagctttgcctcctgctctgttactggctctgtattctcagatcgtggagtttctgtaatatgtatctcctcagtaggaggctccttatctgctccctttaggtttacactcattaccacagtaattactcctgctattactactcctgccagtataagaggctttatgtttactctagctctccgctttcttcttttaactctccttttgctcatcctgtacctcctgtaagatcctgtttaatcctgctattactttctgcatattatctacttgccctactaacctgcttagggtagtggatatatcatctggatctctggagtaccagtaaccataagtagagctacatatagcctctccattctgcctcagatcgcttacaatgtttcttagctgtttctcatgcacattaaacagtacacacagctctctagcctttatcgcttttccctccgatgtatgaaactctttaaggtactcaactatatcacatcctacctccgacatggtttttacctcccttttaagttgatatataacctaatcacttttgaggaggatttttagataaaacagaaaaaagtggtacattttttctttcaaaatgtaccactctctgtattattcctctacgatctctccatcttctgttacttctacaatttctccctcgatacagcggtagtatgtatcctctttgatcttctctccgtctactactaccatcttagctcctgtaagctcccagctctccttatcataaggatccatataatctccattgctatatctggctcctacatatttccaatcagagagaataagatgagctcccttacagcccttagctcttgcctcatgcccccatgcaaccgctacaccagtaggatcactaacagatgaggctcctttataccctgtagcagatgaggctccataatcccctgtagcagatgaggctcctttataccctgtagcagatgaggctccataatcccctgtagcagatgaggctcctttataccctgtagcagatgaggctccataataatcccctgtagcagatgaggctcctttataccctgtagcagatgaggctccacaattccctgtagcagatgaggctccataatcccctgtagcagatgaggctccataatcccctgtagcagatgcaaaaccgtgtcgctcgtctgatcctgcctctttgtttaccttactcatagtaaaatcaatagccatctttacaagtcctgcaatagataatctagctccgatcttaatatcagtagcacataccttagtattatctccgctcttatccatctctccagataactctacctcatggaatacgctatgtgctggatcataatatccgaaacaatctaacggatactcgcaagcgtgaaaacctgtatcacagcactccgctctttctgtgtgaaattccttaccctcctcatactgataacctctacaggtaagatccttgttaaatcctttaaatgctctcatagatttttctccttttctatgtgtgttatttttattgataaataacttaatcctcaatatgaggaaaatttagatagtttttgaaaaaaaaattttatttactgctttccattctttctctagtacgatttaccttaaaggtcttaaccgctaagagctcatcctctgggatctggaggagatactttacctgctccagcattaactctacatctgcaatctcctctactaagttatctctggcaatagcttttttatcctctgctacaggctgtcctaagcctgtttctactctacggtacttatttaccgcctgtatgagctctgcacactcctctactaactggttactctgtgcctcatacccatagtacttagctgtttctaaattcatttcactaattttacacatatctcaatacgcctccttaattaactctctgatcctgtaaatctctgcactctctaatcctaatggatcgtgatctactcctccaatagcatctataaccgctctgagtgcctccctgctcttatacagatcctccattaaagtatcctcaatgaggtaatactccttaggatctccaaaggataccgctatggcataatcctcttttctcatggctaagctctgctccttagccttatctatccagctcttttttacagtgatactctggctagggttcatctttgttttagcctcaataaagagtttatctaccactacatctccttttagaaacggagtagagccagatcctactacctgcctaccgcccatagccttagctatacgcttttcctgtatggagctcttagctcttgtactatctttcatttactcttacctcttttctttttaggttttactccccagtatctaatacactgggatctattaggagagattaaatcaaagtaagtacaatacaaaaaaccgtgttttttattactgtgcttacatcgctcacaatcacacgctactctattaggttttttcattttatgagttactgtagatactcccaactttcctctcattactccgcctctctttcttctaatctcactccgccatactcccagagatcctctttcatctcatccatatctagctcgccattttgccagcgttcatagtattccaataccagctctgtaaactctggtatcttctttgcataggtctttttccagtagtgatccatgagtacctccataggaagtactaagagtaatgtcatagctgtatttatggcatcctccatagcctcctgtttgatcctcttaagatcctcctctgttacctgccttactgcattatggagctgatctctggttagattataggtttttacctgtttacctttttgcttttcaagcctacgcctctcggctctacccacacttaacactcctctctcatataaatcttactggctctcctaccctttttaccattaagaacccacttactgagttatcctctatctgaggtagtgtatttacataaagctctatacctaactcctctcggagttctctgtttatactctctaaaggagcgtttacaagataattcaactcactcatagtagtagctgtaaaaggctttcctataaaatctcccattacacctactccctcatctcttaccctgctccacgcctccttaagcaaaatcattaacctacttacatccatgatataccgcctctactttccaccgcttaagaaactcctccagagagttatactcaaacttataagctcttaccgacaccgccagcttatttcctgtgcatctggttttaatcggatacaccttaccgctctggagctcacactctacccctatgtatctagcttttatcatcctgctcctcctgtacctgcatagcctgtaatctgtttaataatctactggtatccttaatggctaactccagatctataggatccatctttccattaagcctctgctccagatctgttacccagctatcgttatcccaccatctccacggtaaaataccagccttatataagactttcttaacgcttttccacgcctgtagctctttctctacactctggaggctttttaacttattttctgcctcctctaaatcctttgctaactttgtgcctaacctctgccctatagcactctttactaccttatcctccagataatccttacagtactccgccctgtcattgtaaaaggggatcctatcctcctccagccgactaaagataatgtacttatacacacctacaggctcctctatctgcctgtacaatgcctttttaacggttctcaaacctttagtatctggattaaaatagataagccctacatgatctgggagctcctctttctttaccagccccttaggtactacaaaataaaactcattacagtactgtaggtataaatgccatttattatcctgtagaaaatcatttctactcactttgatctcatagccgataatattaggctttgtatagctctttgtgatagccagcccatcaaacttaagtagcccctgcggatctggaaaataagtactacaggttttacactctgttataaaataactgggctttccattatgaaactctttaagagccagctttatatctgtactggttactttctgtgccactctgtttacctcctttgttgtgatacttaacttaatcacaatcggtaagtatttttagacaaaaaaaaaagaggatcctaagatcctctctctggtattaaaactccagcacattctcctctatgaaaatatccttatgcacatctgccttaaatgctaagagtgctctggaggctctcaacattacctcctcatctcccatcattttagcccctgtgtaggtattctccagaaagtctattacctcctgtttctgcttttcattatccatagatacctcctataaatcctcccagccatcatatcccagctcttttaattccatcttactctcccagatagcatccattagattatccgcctctatatcctctggatctgtgctacactctaaggctacctgtaacatttttatataatctatcagctcttttatacgctcatccattaagccctcctatttgagtaaatcttttactcctactgtggttttcttatacacagcattttttacagctctcttagggttctttgccagccctacaccctttttaccatacagaggattaactgctttctttaccgctctcttagccttacctgtagtacttgctttaatagcctttttaaggctaggttttcttactccgattttcatattactttacctcctctgccttatattcctctggtaccttttctgtacacaaatgagagaaactctttaaccacttcttagtagcctcaacgctccttacagatctaaactcagtttcttctccctcctcatacagatctacctcatgtaacacgctccaccatacatcatcaaagctcttttgagcactgtaatcatcatttctaaaactatctaccgctaaactctccagcctctctaaggctatctggatcctctcatcctcgatagaaaagttatatcttttctgcatcttcttaatctgttcctgtttcatctgcgtttcctcctgcatatttgctaaatactgtttatgtatcttatcctgcatttcctttaatttcttttcttctagctctgtttctttttcccactcatcccagaatgatcctaagctctctttatcatgtaaccacctacctttttatatagtggttatattataactcatttatgaggctaactcaataaccatcctagcccacgctctggcatcatcctccccatacatccgatacatacaatccttataagggatcctataatccgccttaggatcattctctaccagtaaatacttatactgtggctcccttgccttattttgtaagtggtgcctaaattgatggagaaaaccctctaaggagggctcccctaagaaaatctcctttgtagagtgtacatagttatcatcccttacccacgctgtaataacagggatctctacactgtatacctccgccagctctgtatctagctctctgattatctctaatctctggagaggagtagcggatttatagccctttgccagagccatactaacaggctccagagctttacactccttaaataataccttataactctctactctttctattagatccatacgctcctcctattctacccactctaaacctcctgtatatctgcctctgtgagttactaacttatctggatacactttcttaagataagctatatccgttctcagtgttctcctagatactcctaaagcctcctgtagctccgctgtagttgtacacttagcctccttaaggatatttattatctggagctgtctagcgtttactccatgtatactcatctcttagccctccttatggaggagtaattaactcctcccctgtttttatagttttactgcatccactttacatctctgtaatatagtctgcttagtgcctttataatcgctgtgctcctttacggttcctctcaatcttacctttgatccctccgctatgttaaaaaatgctgaggtgcttttccagataaaacaattaccagcatcatctctaaatacattgatacctaccgtatctgtaccccatcctgcataactaggaatatcataagtagatcttttcttaaatattactaccagatccagcctatctcctacctgccccacatactggctaggatcctcctctgtgggtatcttactattaagtactgcttgtacctctataaggtctttccagctcattgtaccgtattctggatagatattaaggcactcctcatagctaagctctattgtagagtatttatcctgtttctctaagaaataccagttaatccctcctctatactttgctcctgcctctttaagctcctcacggatctcataggtattacctaacactacatagatcttaccctctggattaaatccgtatttctcagctattgctaagcgattattattaaactcctctacctgtttagccctcttaacctctgccctctttctggctctctcatccagcttagctctgtactctggagtatactctttaatgatctgaggcttactaactctaccagtgcctccacactcgtaacaagtccaccctgtataaatccactgatccgctccgccagctcctccacatctagggcaagtataatcatggtaaatctttgtaccgtttttatcagttctgatataaaccatattgttattactcataacattacctcctgtctgggagcctttaggctcccctgctatatgcacaatccatagtacagatccccttatacatagggcttttctttattacatggctcttaattctgagcttataccagagtgtaggatcatctaccgtataaatcttatctactacccagatagcattaaaatgtctgtatgtatctccctcctgtaatccctctaccattccctctgggatctcatcatctactaactcgatcttatctaataaggttctccagtaaaatactctgccatcctctgttactaaaaactccttatggagcttactgttttcctctgtaagatcataagctctacacttaacacatttaccgtcaatgtactctactgtataatcctcaaactctgcattttcttctaagtaagagataaagctctcaactgtgagggcatccatgagctcctctgtagctctcataaagtttactctgtatctgttatcgttatcctctttatatctcatattgtttacctctctttcagtttgtatctagttccttacctcacttataatatataccccctatataataatgtcaagcactttttatataacccctgtataaaataatagaggaggctttttactgcctcctcctgctcttatttccagaaaaatctatctacagatactccgtagaatttagccagattgtaaagtactgtagccttagggatccgtgtacctgtttcccacctgcttatacttacctccgtatatcctgtaccttttaccacatcttttagagtgtatccctttttctctcttacctctctaaggttatgtgctaaggtttcctctacttctctcataccatccctgcctcatataccttttttctaagatactccaactcctccagatcgttataataaaactcctgcactccgttaaatccctgcattttctgctctttaccacccttaagagtagccttaaaccacgctccagcctgtgagatgatccccagcatgatagccagatctaaggtatccttaatctcatccacgcctgtactataattaagtgtgtaagtctggagcctacgatcatttttagtaaccttatttttctctactttcacgcttaccagattaccgctagggttagcatatccgctacttacctctttatacttctcatccagtaaggatccctttgtaaaccataagatctgtgagcacgcatgagctatagctgtaccacaggggatcttaaaaggcttatacggatttcctatgttttctctgagctggttaatcataagaaaagtacactcagttttcttacagagcggtaccgccttatcacaaaaggctttcataagagcactgttaccgccatagcttttctcatctaaacccttttcctgtactgccttaggtataataaatggagcactatctaatactgctaagcctaccttaccagatcttatataatctaagagcatatctaagagctcctctccatactcactctctggctggatgaggattaccttactccaatctacccccagagtttctccccactccttatctatcgtgttttctgcatccagatatacacagtacttatctttgtatttcttttggaaattagagataatatccagagctgtagtagttttaccgctctgaggtaatcctaccagctctataatcctccctacaggtactcctcctctggttaagtaattcatcataggggaggtataaggaataaactctatccccttaagatccgatgctttacggattatatccgttttgtatttcttatttacctctgctatgaggttatctatctccgccatcgctgttctccttttcattccaatttttaactactcgtatctcatcccagccctcagcaaaagtaggaggctctaaaaatcttttcatcctttccatagcctccttaggcactgtacgctccctttcctcgttacgcttaacacaaacctcaaaaggagtatctacaaacacacaaacctttttacagtttaataacctaagagtatctaaaaactccactctataactcgcttttaagtttgtagcatcatatactacatccttaccatgatatagatccgctctaaccaaactctgtaaaatggtaaacacagcaccattatttttcatatcgtttatatctccacagagcttatctctaagataatcggaggatctaacaattacatctcccagcctatcactctcagagcttttaccgctggctggcaatccaactaacatataaaatactggcttattattctccatcctcagatcctcctaactcctgcataatgcctacctccgtattaaagaggtttacatctgcatccgtgatacctaaattgtaatttaactcaattacatttctaataatggctatgtctactccgcctccatcattagggctaaaaagtacaataccatcatcacacttaaaagctgtttctccagagatctctactccgtttttctccagatatgctaaaaacttatctaacttttcctccatacctaacacctcgccataacatctctcatcatatccagctttttaagctcctctacaatatctctttctggctccagtacaactactggcatcaataaagcctgtatagccttaacatctgtggagtaatactccttattatccacagtagttacactgtatcccattaactcctctgagctcctgctctcctccagctttgctatctggttcacattaagccagatagtaaggtttccgctctgatcctcaactcttataaacatcgccttttatgcctccttaaaatatttctacactgtacatagagatcatcatctatatttctgagctcatggagatccctatgtagctggctcttacttatacaaaactctttagccattttacggatactgtctttagggttatcaattagccactgtgcctcctgcttacatctatcctctatggcttgcctcctaaagtactcataagcccatcgctccataggcttactcctccataggatcctctggctctctggtatatttatccttgctaaatctatccagatctacctctgctatcctctttgagagggatttctttaatccgctgtagatcttctcagccatctctaacttaactttgaggctgttataagctctgcggtaaatagcctctactaaggctttatcctctgtgagctgttctactctggcttttttctcctgcacagtaccagatacttttaccatcgcctcattttgagcacttttcttagcattagaggctagatccacctgcatacccagctcctctactctctgccctgcataatacataagagctgggatcttaacacagtagtactctatctggctatctggtatatcctctatagagttttctcctatgctttccataatcatatccagctctgagatagcactgtcaagatccttactaaaatctgctattaactcatttgagagggttattacaggggagctctcctcttttacctctgctatgattttctttaatttatcactctgtaccatccctcaacgcctcctgcaacaactctacagcctgctcatatacatctatcttagtatcatctcttgtattgttagatctaataacaagctcatttattacctgttcaattctacttacttttatatacttatctgccatagtacctccttaaccagctctccagatcgtagctatatctcactcttttctttttctgctctatctttattccgtgatccctgcaccactctacaggtatgctctttctctcctctgtctgagtaaactggatcacatcctgtacggttatgtaatatgtttcctccagctctctaaagttgattaaaaagcctccatacactccctcatactgagtagctttctccattccctgtatctggttaggtctgatttttgctatcggtatgctctttcccttatgagttttaagctctaccagaaagagataaggagatctaaacaggatataatcacagggattagatactccataaaatccgcttgtatcatcctttaggcggtacaggtaataatctggaggtacacactccttaaactcctgctcaaaggttttaccgatgttattacttgccatcctgtacccccttaaatctgctaggagtaaacttacatttctttctgcgatctacatacatagatccctctctatcaataccacagtagtaagctcctagctctctaccacaatgctcacagttaccacataccgctctcaacgctgtattttgccctgtagaggcttttttctttttgcctgtagacttattagccttttttctgtttgtatctttctgggatgtcttaggcttttctggagggttaggatgtacccacttaccagcatccactaaagcacactcatttttatatctacagtaagtacacttgctatcatctttctctggagggatccctgtcttacaagcattgtttacagttcgtatcttgttaagtactgcctgtttcatctcatcggttattttccagaggtacggtttctttttacagaaatttctatcctcataaaagaaaaggatataatctatccccagccccataccgtaacaagtagcttgccacttatgatccgccttaggctcatatctgttactaaactggtaagtactctctgttttaatctctaagattacatccttaccattaaatctaataactccgtctggctggaaatagatagagagctcatcatttttacacctgccctctgtatgatcctcattccagcctacaaactctgttttaattcctttagcctgtgcctcttttaccatttcctccagatctaagcactctacgccctccatacgctctactatgtgctgtatgtctaagtgccgatctgtaccgctctggcatatctcaataagatttacctcactctgctctccgttctgtgagcctccatgtactctctggaaaaataacatacgctcacagccatacatagaggatgggcggatatactcagagggggctacctgcctctcctccagctccttagcctttacagcctcctcataatttttgagaaacttatcctcaaaggatacgctctctgcattttttccttgtgctactgctattaagctctttaatcccattacttttccgcctcctctctagctttttcaatatttttattaaatctggcaagctcaaaagctaaatacatctgggatctgctttctcttatccttagaggtctggtttctttatctctctttacctcaattaccagatttacgatagtaaccactatgtagccgactaacaaaagccctaaaattacatttcccattagtgacctcctaacataactccgatgatatagagctcaaacaaaaatacaaaaatacttaaagctccaacaaaatctcctaccagctcacagccctctctatgagttctgtaaaatcttctccattttcttttaatccgtcttaccatccttgatcctcctgttttgattgataagtaacctaatcacaaacggtaagtaaatttagataaaaaaagaggaggctttttacgcctcctcagagttaatcttataatcttctaccccacggatcccacggaatatatcctacagggctataaaaagagcgtggataaatataaggatcttttttccaaccccactctttttcctttgtttctgcctcctgttgataaattacctgcttacaggtagatttagcatactcaatctcttttttagttcctactgagttctcagaatgtagcaaaacataaatagcatcacactgatctatcatagccttgttaatcttatagtaatctgctaagccctccggtaaaaatgatggattaagtactatatgccctttactccttacaaactcctcagcctcattaaaatactttttataatcaaatctacctgtcatagctccagctatataaactctcacttatcgcacctcctagtaatttgtaataaatacctctatatccttactctgcttatcctttttatgataactgcaattactgtatgtatgatccagataatgtactgtatatcctttagcccactctttaagtattgtgttttcttttcctttactctcaaacacattagataacccaaacttaactcctgctttatccagtgcatacagcttagctaaaagatctctctccgcctgctctccccagcctccattttcattataagaggctactgtaatcagatacggaggatcacaatatacaaaatcattctctcccagagtatccagatccagctctctaaaatctttactgctaaactgtatctccatgctctggagcctctgcacaaaagtaataaatttttctcttagtgtcggattaaaactactacgatctttaccaaaaggcatattataagcccctttgttattaaatcgtatctgattattaaaggaataacagatcaatgtatacagcattaaaggatctgattttcctttgttataaagctctctcaaagctaaataaccctctttattttccttagatagatcataactgcttatgtacccatcaattttcctaaggctctcctcaactccgattttcttaaattcctgtagcatttctggtacctgccacatgagatcattaaatactactttctccgccttaacatttacggacacattccccccccctgcaaacaggtctacaaaggtatttacctgttttggaaataactctaaaagctgtgggaggagtttgtattttccacctgtatagttaagtgggctctttacatactccatcaaataaacctcctttatgttttgatcgatcctaatcacataaaggagatttccttagatactaattttatgaatttttcaaacctgctaccagagtatatacctgctctgcctcctcataagagagttttgtataatcaaactccttaagccagcctaccatacactttctcttattttcctgtataacctgcctacctctttcctcagtataaggctctaaataaagtgaagttctaccatatccagaggatctatgatactcatatccgttactcttaaatctctcttttttaccattcccatactctatatccaatagccctgtaggagttctttttaccacagtacctacataataggatttactactaaagtagctcgcatacactattaccttatctccaacctgtaaattttctccgttaaaatcaaacactctttaactcctccaatactctaaaatgatgtacctctctggtatttccctttttaacctgcactctcattacagatcctacctctaaaggagttacgcactcctccagagttctctctttcttatcttcctcatcatatactttatatctcactttttacctcctaatagtataattcctgccctacctctatatggttaggatcctgtatattatttaactctactaacctgtaatactctgctccagctccatacagatttttagcaatattccagaggcaatctccctcttttacaatataaatttttccattaaacagatctcttactctatcatgtggggctttcttctttttaggctcctgtttcttttctgctacagtgtagtaccagctctccgccttactgccacaataggtacatctctcccctattgctacctcagctccacagtatttacattttgccatctggtttctcctttaatcccattacataatccattgataatcctaaaaggctacagatcttagcaagcctcatactgctaagatctgtaccgttatataaaaaggcgtatattgtggatctgcttattcctgttttgtcggagatagtctggagaggtatatccagctcccagatcctctccattactctctctccagcactcattatagagtaggtttttctctgtgccttttcgtgctctactctgatatgagagggctttgttaagccctcataatttcttatacctctgctatatctatgctgtacggtatccagccttataccgctctctttagctatctgatttagagttttaccatctacaaagatcctgttaggcttaccctttagctctggtaaaggaaaatatcccataggcttactcctcctctaagtaatcatccgctaagttttctccgtaccaataatcattaacctctgcatcaacactcatagggagatctattaggctgtgtcctactcttttcatagtgtttactaagagatctgctccctccttaatgtgatcttctggtacctccataattaactcatcgtgtacggttattaccatgtggcaatccagagccttgtactgcggatcattgtaaatagcgatcatagctaatttcataatatccgcactagatccctgtattacagcgttaaggctctgcctgtgagcctcttggtagcggtaatcatcgtgatctggtaactgcatctctggcaatcttctctttctgccctgtatagtagttacatatccgtactcctccgccatcttctctaccttaaggcggagctgttggatcttaggaaaactcttataaaaatcatcaataagtttctgagcccactctgcggatctgtcaaactgctctccgatggctttagctcctcgctcatacatgatacctaagagtacacttttcatggttgtacgcctgtgtttaccctcagcatttaccgtaccatctggataaaattctctacaatcctcataaggcactccataaaccttagatcccatgatggcatatagatctttaccctctctgtatgcctcctgcatcgcctcatctccagacacataagagagtactcgtggctcaatctggctaaaatctccacctacaaacttataaccatctctggctctaaagatcttacggatgcttttctcatggctaggaatgttctggaggttgatcttagtaactgtatcactacttgaaaatctacctgtttttgctccgtactggttatatgtggtatgtactgcattagtcttagcacacttaacctctgggatcttgtctatataagttcctaagagctttccacactccttatatctctggtagttatctaaaaactggataaactcctctccctttttagtacctgcctttttagccttgtttctgtgttgctgtacaatcttatctcctgtacctctcggctcttttctggatacgcttttcagtttgaaaatatcataaaataaacaagccacctgctgagggctgttataattgatcttcttagtacccttagttaatctcataagagtaggattttcctctatgtacttatcaaacttagctacatactcatcacagagcttttctttctccgccatctcctcattgaattttacagagagctccttagcgtaatcctcacggatctctacacctctaagctccatatccatgcaaacatcaataagaggcatctcaatatctctaaatacatgatagagctttctgtagtctgctctcggatgatcctctctaagatactttttctggaattgatacagagcccatgttttaaaaccatcgttagcaccataaatagcaaaaatatcaatagggatatagttacatgggataccctcaaaaagatctccaaaatcctcatctgagccctccccattgaggatatacttgttatacatcggttttaatccgtgtttctcattctcattgagtacccagccagctatgttagtatcccaccatacattagctatcctctgcccccactgaaaagtaactactttatcatcaaacttaatattatgattgatgcacttaagggatccgttagccagataagggagcataaccgccttacactcctcctctgtcatttgcccctcaactcttttattctggagatccgtatgattaaacggtacatagaaactagggagatctggattatataaacagatacctactaaaatatcgttatacacatccagccctgtagtttccacatccagtacatactcgcttactccagttaagtaggtttccattacttccttaagcctctctggagtacggataatctcatactctccctctgcgtggagcctaccgctctttaccagctcatttattacctccagccctttaagtaaggtattctggtttcttttcaaatttatattacatacttttttatgagctaatcggctactaagatcctccagatccacgctctctctactcatatctacctgtatctctcttgccatcctgtatcctcctgtttaataaaagagggaggtttttagcctccctccctgccttaaaatactcttgtagctcctgctccgctgtcattgttactatcgttattgttacccttgttaagctgtaatctaccctcgatagccttaatctgatcctcacgatccagatctaagataagtgagcctactaagttctgaggctctgggatctccatctcactaggatccttagggaaatactggtatgtagtcttaaggctaccctttgctccagatctcttgatcttaatatctctcttagtgagatctccgtactctccagctaaaccgataaggttcttaatatctgttaagcctctctcccagagctgtacctgcttatccttatctttctcatccttgttaatcatctgtaagaacattctaagctgaggcttattaccgctcttacaaaactcacagctctctcctttacagagacaagtacgatctctaccgctaccgtctacatctaatttgtgtacctcatagatgggaaaatcataatccgtttctccatcctttactcctacctctcccttatggaggaggcgtactgtagctgtatctccatcatcctttaactgaaaccagcctgtcttagaaaatcctccattgtcatacttgttaataagatcctgtaatcccatttctgtatcctcctgtttttccttgattatttttttttctataactacagcatcaaagcctttacagctcctaccatgctgttgatagcaaaacgcttatccacattctttcctaccagcacatccgccttatgctcactctttttagtaagcactacagcctctccttttaagatggctaacagggttcttaaactactcataccgcttacctccttgcttttcgtgataaataacttaatcacatccaccaaaattatttagacagcatattgataaccagctaaaataaatttctttttgaggttcttgatatgccagcttacggtagcattagtaatattgagagccttagcaatctctcccttagctcctccagccatgagaatatttaccgctacctgctctttatcgttgagctgtaagctatctaagagatccataaactctacagagctaaaatccttacactctacctcaaaggtgctatctgtttctgtaccgccctctttattgatctcagataagcgatctaaactatctagagtggtacctgtaaatcttttctggcgtgtagcctcgttgtataaacggttaaggtgctggcgtacatacaccttaaggagagtggaaaaagctactccctgctctggatcgtaatcctctatagctctgagcatcggtatataactctcacttgtaagatcctctaactcagaattagggatagaggttaaataaggggataccaaaaggttaataagccccttgttagcctctatgagctctttaagatagctctcatctctactctctttgtatgctttaataagttcctcatttgttcctgtaataaatcctttactcatcctgttttcctcctttaatatcctgtgagatggtctttccagccatctccgtactctttgacaagatcgttaatatcctttaggcttgtatgccatttgaggttgataaaccgaaaacccttaggtatcagcaacctcttgatctgggaggctccttttctccctgcatcatcgttatctgtggcaagtacgaaccgcctaaaaggtgtacgctccagctctttacactgatcctctgagatatgtgatcccataatggctaccgctggtactccgtaagagataaggctgagagcatctatctcactctcggtaatccaaacctcctctatctgatccgatgtaccccagctaaaagatccgttaaggatctcccagagcccaaacactacggaggttttatctacctcttttgcgttataaaaatgctttccagctatgctcctgcctttgtaaaagatcactttcccatccatgccccttacagggaaaagtactgttttatcctctggatcaaaccccagctcatacgcctccagcacccagttagctatccgccttttatgtaagtacctacacgcctcctcactctgtaggaggttctgtgtgtactgctttactaagctctcctccagtactgaggatttagctgtggatcctctgtacatatccagatctgggagctctctctcctccgtctggtagttgtactgatttaccaaccacttaaagccctctactgggctactcagccctaagagatccgctacaaactgaggtagatccgctgtgtatccacaggtgtagcaatgcaccgtaccagcctcgtaggtcttatcctttgttaccttttgctgtaggagcactccgcacgatgggttatgctccttaccgtttgcgtgaaaagggcaagtacacataagatccgatcctgtgtttttaatctccctaagtagccctgctccatagagctggagcttaagatccttaagtacctgctctactgtggctactattggagttttccagatcgttatcactttttagcctttgcctttttaggagctgtgagcttaagcattactacctctgttacctgtaaggcatctgctaatacttcctgtggcaactctccagcctctaccgccttaagagttgcatcctcatctacaacctccttagttgtgatacagctagtaaggtttctctcatggagctctgctaagagcttttcctcatccatgctcttacgctcctgcacaattcgctcaaaacggtatccagcctcatccgtgtagtcactttctccagcctctaacatcgcatccttaaggagtgccttgtatttctcctcctctttctttgctgtatcaaaggctaactttttggctttataagcctcctttaactccgctaaattcattagcttgtacctcctttatctctgttttattgtatatcattctctgtttaatagagattgatagcaaaaatatatgaggggagtaccccctctgtgttctctctgtttctcagagaacaattataatataatcctgttttacagagatgtcaatacctaattttctgttttacagagttttatctctgttttactttactttttctctgtaatactgtataattaacttatccctcaaaggagaggaggtgtaaaaacaatgagtacatttgctaaagcacttacctactacctagcggtaaaaggtaaaactcagcaagatctaatcaacgatctccactacagctcctctacagtttctcaatggtgtactggaaagaacactcctagaatggataggattgaggctgtagcaacttatctagggatagatgctacggatctcctaagagatccagagattttctcacaggaaaagttttctactgatcctgctttaatctcaaagatcttagagagtaagccctctctatacgatttatttaagctatctatctcactatcagataaggatctggagctacttaagggattagctcaacgcatcaatgagctacaaaatcttaaagaggagtaatcctctggatggagccagcctgcaaaagctggctctttttctttatcaaaactcaaccgtaatcttctttacgccagcgtcttttacagcctttatggtatctgcaataaactcattcacacaaatttctgcaagcccctcatctgcatccagatcgctcataagctgattatttaacattttacactcattaagctccgcctctaaattttcaatataggctttctgtttaagcgatacatccataagatgcttaacctcgtctaaatcgttaatatgtctatgatctcctaacatctctcctacaggcatttccaaataatcacaaatttccattaacttctcaatgtctggtaaatgggctcctctcatccacccatttactgtagtaggcggtacctccagcaccttagcaagctctacctgcttaatccctctctctgaaactgctttgtgtaaattttttgcaaactgtcctttaatcatctttttttcctcctataaattaaaaagctgggatctgtggctcactctcacgctctctaagaggtgtagagtttccagcctttgaaaaatccatataagccagagggataccgtacagatcactaagctcctgtgctttctccatcttaggagctgtcttacctgtttcccagctaacaatagtcttatcactacagcctaagatctctgctacctctgcctgtgagtatcctgcctgtattctgcaagcggagagcctccatttcatttcaaagtaattcattaactagccctccctgctttatatttttccagagcctcctctgttacaaacttcttaagagtagggatcattacctcacgctctacagcctccagctttccactctggatatttctataaacatttctctcactacagcctaagatctgggctacctcctctactgtgtaggctttctcctgtggctcctcctgcttttcctctaccacctctacaggagcctcctctccaaacactggagcatatttaatcttaaaagcctcactctgagctccgataatacgccctgccataagatcacagccagccttagtaatatggtataatctaccgcccttatctggatcctctgagaaatacttagaagcctcatctcctaactgtgtaatatatttgcggatcgctcttaaaaggttatcgtgcctctttcccagcatctccgctacttccttacttgtaatcgtcatataaaaaagtacctccttttccgatttacttaacctaatcagaaaaagaggtaacatttagagagatttttattattttttcttacttaaatcaaaaatagagattttatcattctctgagttaattctggtattagtatctaccacaatcttattatctaagatacctgctacaagcctctggataatctctaactctcccatctcatgcaaataaatagggtacacatctccctcatctgtaagatatacaggaatgatcctccccttaggtactccgcctttagaaaccatagtctttctctcctcctttatcgtgctctccatctggtttatcatcctttttatcctctgtgctctcctctggattttcactaaggagaggcttaaggtatcctgtgtttacttcccagatcataagtacctctttgttattgataccatacctatttttcttaatgctgatcttaagagtgccatctatcacggatagagataatactctcgtggcgttctgtcctacaccgtcactctccgccagatcgtggagctctgggctctctccttttttacggttctttaccgcctcacggttagcctgtgccataaggagtacaggctttttaagctccttactcatcaaaaagagatcctctgaaatattgttataagctattctaggtatatccgccctacgcttatcactcataagagagagctgatctattactatcatatccgccccatgcttaatagctaagctcttgatctcatctacattaggcttacgcccctcaaaatcatctggagtaactacgataaatccgctcttttgctggagctgtgttatgtacttctcataatcctcctgtaagtactttgctccgtctgtatctggtttctttcccagagtgccagatccattaaggagccccatattactaaagtgcttattgagagtatcgaaacgaaaaccaaccatagcggtactcatctctccagagtacataaggatcttataacccatattccacgccgtagtagcaaaatactctccgatccatgttttacccacattagtacgccctgtaagtactaccagatcctctccccagagccagccattagtaatctcatccagcttagggatacctgtaggaatacctataagcccctttacctcacaacgctttttatactctgtaaggcgatctccagcgttagagataatatcatagccatctttattcctgctaactggtacggatttctccagcttttctatctcctctttgaggtactggatcgccttaatactatcctcttttactacctttgctgtatcctcaatcagaggcaccagcttagtatatgtataagcctctttgagcttgtatactaagtaatccgtactctcagtaacctccaacatttgaaaatctttaaacctgcctaaaaaggttagtttatctggcatctgcttatagctgttgtaatgctctatgataaaatggatctcatctttacaggtaagaaacatctcctctattactccgttagagtggaggatctccagatctggagcatctaataccttacagagtaagctctgctcaatcatattagccatttataatcccctcctatctccgcttgtaatttctactacctgtgaggatcctaatactctactggctatccgatcccctaactcactcctaagctcctctggagagaggttactggtataaatcgtagtgagattattagatactctggtatttatgatgcttaccatcctctcccttacccaatctgttaccctctctgctcctatatcgtctatgataaggagcctacaggtttttatcattctgagtatctcatcaaactctggatctttgttatcatagttatctctgagatcttctaagaaagtggggagaaaaatatatagcccctcattttccagccctgtattaaaagctatctttctgaaaaagtaactcataatcttacaagcccatgaggttttaccattccctgtactctttccccagatatataaacctctgccctcatctaccatactgagcacatcatttttataattatccaatgctgtaaacgcctccagatcctctccattctctggcttaagagcgatagtataacggtatctctctgggatcctgcttaaattatataaagctctaagtactctgtagcctccacatacatcactacaggagcttttatctttctggcaataatcacttgcataacatctcattttttgcctaatacctcctataaatttgatctaaggtaccttataccttttgattaacctaatcacggaggagaaaattttttagacaaaaaaaaaaaaagaggagagcgtaacagctctcccccagattgctaaaatacaatatctttaccctcagcatctttaagggtattaccactaaattttttactgatcgctgtaggctttccctgtctaccatagttcttaagtggatagagatctttccatcccttatctatactctgatccacaatagctagagccactacaggatcctctccagcattatctctaagagtactagcaaacttttctaccgtagttactttaggagtatagtttttacccctacaatactggataaatttactaagagcctctttcacaaacttattaacaggatcctctaagatagtactataagatttctttttaggggctttgccctccatctctttagagatggatttttctatattatctttactatctttattgagtaaaaaatttttactcgtatcgggtaaagtttttttactcgttggatcctcatcggataaaatttttttactcggtcttaaagctgtatagctgttgtaaatgagagcccctttagtggtactgctcttagtgaggagcccctgcttaactaggttatctaaagtgttaattactgtaggtcttgatacaccacccagccactcacagagatagtctacactccctgtaaaagctgtgttagtagtctgagaaaatccgtagatgatcgcatagagcataagagcattaccctttaattttagctctgttaccatccagccctgtacagcaaagtaattatcctctcttacttttatctgttttgccataattacctccagttaaggagagaggagagatactctcccccccccctgtaagtattactccatctctgagatggttttctcaatgttatcacaaacctcatcaaaagcctgtttaataatagcctctctctgctgagggttcgtacctccatcaatcttaagatccatctttactgtaggcttacaccagataccactcttattctgtacactcatacccagctctacgctgatacctgctacccttgctgtaaaatcatttgacatctttgttatcctccatctcttttaaatttttttctctgcgtgccattctacggttatactcctccacggatttacagcccatctttctagctactacctttttgtggaggagggtaccgttattcttttggatctgcctctgcattttccttttgaaactgctcactcttttctgcctccatttctgctacgctgtgccatacttcatcctctgtttcaatctcacatatactattatgtggattgataataaccgtaacatcacagctattagaattaaagctaggtaatccagatccataaccaccattacccttaagtttagttcctaaggcggtagaaataatatcctctaaggatttaccatttacctctaaaccgtatccgtgatccgatacctcagcatttgtaaaactgattttaagcatcctgcttacctccttttcttttgatacttaacctaatcacacaaacggtaattttttagatagccctcaaaattaaggacaaaaaaagaggagagcttttacactctcctcacacttagggttactttttaagttttgcttttctcggtaatgaggcataagcctttatagcctccagatcctcctcataccagtatctatagcctccctcatctcttacgcttgctggaatagctccagcatcttcccagaggcggatagattgagtagaggctcctaccagatccgctacctcttttcttgtatatactctttttcctgtatctgcatctattgttatcgctctcattatatacctccattttgagttattataccacacctgtatattaaatgctaagtaatttgttaaggatggttttaatatcctgcttagatcctttaccgtctactactcgatcaatgagatctttattttctaacaggtaatcctctaccgcctcatctatggtacccttagccaccatagagattacatttacagcccctacggtacctattctgtgggctctatcctcagcctgtgcattatctccgctattccatgctttatccataaagaatacataagaggctttatttagagttaatccagtacccatagctccgatagttcctatagctactttacagtgtgggttagtctggaaattgtctactaatctctgcctctgctctggaggtacctctcctgtaattacaatcggatcatattcactaagctctatccccagatccttagctatcgtgctccactgagaaaatatgatagctttgtgaccgttagggataatctcctcctccagcatctccttaatacgatccagcttagggctatcatctgttaagttaggattaccgctggtaagctgtctgaggcggagagtacagttaagcggattaacagaggctaagatattttccatatctgctacaatgccatttttaatatccctgtactgttttttctgggctgtggtaagttctacatactcagtactgtacagcttaggagggagatctagtacctcctctttctttcttctaagcattacagtatttaactcagcattgaggctatctaagtttttatatccgattactttatagcctccgaaacctcccatagtacaataggcatttctaaaactataaaaggatctcctctctactcccagccatgtaaggatattccacagatcctccgctttattcatcggagtaccagataaccctatcttaactggagctttcaaaaatctaagagcttttccctgttgagagcctccgtttttagccttatggatctcatccacaataatagctcctatatatccatccttaatccccagatagagagcatcttgtattttctcatttctgaggctctcaatattgataaccccaaaataagaggagcctctgtaccagtcatttagctgttgtactctaacatccattgtcttaccgtctaccattacacagccctcgttagagtggatctggatctctttttcccagttatattttacagagtttactccgcatacaataagggttttaatgagctctttctttctggctacacaaatatcaatactttcctttgtcttgcctaagccctgctcatctccgataagtaaagagtttttctccattccataattaaaagcctcgatctgatgagggaggggagctgttttaaaatcaaaatctcttacaggcttaataccctttagcctctcctgtgtagcctcccttttatcctcgatctccttagtattgagagcctgtactacagcctcctcacttttaatattgctaagccctactttctctatgagagctggtagctcatgtgctgggatctcccacgctctatcctctggtaaatatctccgctctgccagctcttttaccttagctacagtagtgggatcgtatctaaatgagattttaaaagcatcatcaaaataagtacctttttccagtttttctactgttatcataaaaataaacctcctgtgatttagtctttatataacctaatcacaggaggtaaatatatttagataacccctatataatttatgctactaactgcacataaagccccagctttctagtatagtacatataatcctctaagtagtggatcatactttcagtatgtatcttggaacattttttcctacaaaccctgtaattctcccctctggtatttccaaggatagttccagttcaaagtccttatatttttttcggacattctgcattgttatcataattcgcctttctatttctcatcaagtatgagctttacaacctctaagatttcttctttctccatcccaattgccactgcccggtcaatggctttgtcaaagtcctcttccacagcaattcttctcgcctccgacgcaagctgtttatccgaagcagtcacatatgttccctttccgtgaacagtcgtaacaaagccttcctcttctaacttgtcataagctttctttacagtcagcgcgctgatgcgaagttcccctgcaagcgtcctcacagacggaagtgcctctccctcttttaatacagactggataatctctgactttatctgctccataagctgttcgtaaatcggaaccatggaagaatgatttaatataatatgcatatttttcttttctcctttgtgataaacagtatataacagttgatttgtgttgtcaactgttatatactgtttattaaaaatatacaaaataagagccactctaaggtgactctcatttatttttatatttaacttaactaaaatattttacctatttttctgttaatctacaagaagttccctataataatattttaatcctttttgagcattctctttcttataaatataaaaatcgtaccaaactttcaaagtttagtacgatatctccactataataggattatttcgactatccaactagcttatccaacattcctgcaatcttttctctttcactgctgccattagtcttaaatcttaataatggaatttcatacaaatccattattcaatgtctcgagctggtactccaacagataacgctgccatggaagcaatcaatggttggatcaaagcagagatatttaatgatttccatcttacaagtaatgaaaatataacatatgaggtggagaaatacatcagattcttcaatgaagaacgtccggcatactctctgaattatctgactccaaaacagtatagggagtattatgctcattaaatgatgtataaaaatataaagtggtgtctactttttgttgaatagtgcacatatcatatttgtggatgccctcattattctcacaatatctaattctataaaaagttttcccttcgtgcccttcctttataaattatattccctaaaatacggactttacttaatagaattctcatttcttttttttcgccaattcttatactctccggttgttattctcttatctccaggcttctttgcatccaccggaatcgcccaatctcttccaaatttagttgctccttttatacgccctttggaacatagaaattgaattcttctaggggtaacatcccatttttcagctgcctgtttaattgtcatatatccttccataagcacctctgacctatacaggtgatttgtatctttatattaccgttgaaaaaaatatctaactatcaagttttgattcgatattgcttaatttccaatcaagatcactaaatttagaatctaactcggaactaattgcactttgtacagcactttcaatatctgatttaaatgaatagcagtcataattcattgcgtctgcgcaagctgacctaacatcactctcatccaaagaattcatattctcggatatagcatctctaattgtagaatccatatcactcaatgagaatcttaattctgtctccaactggccaactgaatcttcaagtgatttttccaaatcattaacagactcgactaaattgctttctaaagaaactagatgatcagaataatcctgcactcctactaatttactttcaatgttacatatcgcatctgaaattctttcagccttaacatgcatctcaataattacatccctatccgattttccttctagactttctcgtagcttctgttccttattaaattgatccactctaccattaaattcttcagtccttctgtgcagctcattctctgccgctcttatgcgatcattagcactctgctccatttgatttagcttattttgagtttcaatctcctttctacgaaggttctcatgtgcaatttctatttcagcctccaatgcacgctttttcttcttataaatctttactgaaaaataaatggttaaaatcgaaaccaaaacggcgcccaccgcaatcagatattgtgtgtactcattcattgttatatcctccaaatgcttagcattatatattttttctgatgtattctactgtatttttcatatataaaattgacttttttaatttctgtatttcagttttttctttcttaattttagggttgagatcattcatatattctgataatgctcctatactatcttcgaatctttttaacactaagaaagcggcatccttatcattttgtactttatttaaaatctccaatattactacttcaattttcgcacattcagaaactgcatactcaggagataatagaagcgttattccagcaacacttgcagtgccacccgtcgcgaatccgagcaatgctccgccgccaacaattacagctgtacctccagccataccagccccacctgctgccaaagcaccaccacctagcatggcaagactggcacttgtcaatgcagctccagatagtcctacaaaattactgcctaccaacattactgcaatcggtccagcaaaggcagagcatagtgctgcaaccgcaaccgtcagcgctatagccggaacgatagcaaaagctttcttattatttcctgaaatattcttagcggcaatatcatatttttctttgatttcatcaacaaatgaaacatcaatcagtccttcaacaatgaccatatcctttatgtcatctatctgatccttatacatcaaattcttatattccttgacattcttatcaataggactataagcatgaaacaaggccgcctcaaatataatgagataataccaagtcaaattatctgtttttgacttttcctctgctatctgcttatggatatcatatatcccatacaacgaatcaattttttcatcttctaaattcatatattcaagaatagccttttcccgctttacgagccattctttctttttatccgaatccttttttgacttatcaatatccttactcacaagatatttttctatcgagaacaacaaccttgattggttcactgtcagtccaaagatatccattgcatctgctttttctttagccacagtatcccccttttctctaccttatcttaaatccgttacgcattttttgtttagccttttcgggattttcacgaagttcaattaagaacataaaagccccttcaccattaagataatgtgacatatttgcaacatctgtcactgtatatccttctacggaaacatcattcctatactgcttgttctgaatccaatattcaaattctgctgcaatatcactatgttttttcaacttatcaagtttatcctcaataagaaatggctttacaccagcattttcataataatctttaattatcgaactcatgcaaccatctcctctccactaaataagttggcaaacgctcttgattctgcctccacaagttgatcctggtaatctgtgaacagaatgcaatccccattttccgtaaacaacggtgaaatataatttttgaaattcgttaaatacttataatccatttctgtttccggatttaaagcacgctgttcctgaaatgcatgccgaagttcatgcggaattgtattaattagttcctttggatcacttaactcacatatattaatccctaaaatgtttaaatccgaataataacacccgcagttgcttggatcatcttcaaaatacataacttccggaatttcattaaggccaagaatatccgctattttagatacaagctgttcaacaagatccatccgttcatcctcagataaatctgcccatttactattatcaaatttatccatcagttctttcatgtttgataaatcatagtcaaaagagaattcatcctcactccggttcaaaatatccttcatggatatctctggcacagattcgaattgtttatcccaaaacgccattgcttcttcaggaaaaatatccgagttaaacattggtacttcactaaaagacatttcagtatcttttatttcattttccaaagttccttcaccaaatttaaacatgacaatcccccactacaacacaatgtcctgcggccctatcttcttgagtttctcatcttcaaacacaatagccaatccatgctccatatcaaatttgaaattgcacatgatggctacaacacgtttcttagccttcggtaccgaaatggtcttcggaataacatacttaaagatattatccacactatccatccccatatccttaagcccattcttaataacatacttttccatgtcatctttagcctcatttacaaccttttcacaggttacaaatttttctactgcatccttttgtacatcagtaatttccttacctttaaactgtttaatcattacaggaagatcaaagtctctcccccaaatattcattttaattttattcatcgaatccacctccgtcatttacagaatctcttgccttacactccgaaacgccgcccaaatgtttacaataactatgaatatcatatggcactaagtccatagtctttgtatcgcatcgttcgtgccatgaacactgatgcgctggatcatgcctccattcatagacatcttcatccgtccagtctgctctaccgtctttttgctgttcattccactgcttagccaacttggcatctgcttgagaaaaattaccggattgtaattcaccattctcatcataataatcatcacgatgttcggtcatattatcaatctttactgttccctccgaaacttctgaaaaatcaggttcaagattcttatactcgataccatcctttccatattcagcaagtttttctttacatgcagcccctcgctcagtttcatctgaaggaatgaacttggagtttcctcgttcgccttcgaactttccagtctctccatcagcaggtacgcatcctaaccttttttcataagaattatacttcccaccaaactcagaatcagtattttctgtcggttctgcagtaaattccttattccaaaagtctttcgcttccgagaccgtcataccattttccggttgtatatttctatagttttcgacctctggagcctttgtctcatttacttcacttgacttaatctcttgcattaaaacactcctccctcgtttttataaacctctgtaaacttacaaaatacagatccatatgacgcatctctaacagtttgctcataaagaattaatgcaagtgcaagatctatttgcttgttaggatatgcctttagcgatgggctcaacctatcaaccacggttcttgtccactcaacaatatcgttacactgttttgcttcaataattgcattttcagctgacaaaaaatcataaataagttttcttagtgtctcgattgcattttcaccatcatgttcaagatattccatgaaatctctcttaacacatgtttcgagcttggactttatgatttttgatttcaatgcttttaggtcagttttattacctcttctaagaatttctttctccataatgcaattcaaaagagattcctcgacttcggtcttataataattatccaaatcattatcttcaggatcaaatgtaaaaggcttctctggcgcagcaaacaaatcaactttacataagacaggctgaatccattcattctgatataccgctgccactccacatggcaatttggcaagttcggtaatctgatcttcattaagattagctgctctacctacaagctctctatctgcctgatcaggtaatcggagtatgatttttgtatttgtatttcttattacagacatatccattagacctggagcttggtccgcaataataaatccttcaccataggttctcatctctgctattgcgttagatagcatctccacactctttcctaagagattacttccctcggctgattgttcatttgaagttcttctaagcagattatgagcctcttcaagtaccgtgatatgattaagttcagcattcatactagtagcagaagacatacgatactcttgtaactttaacaccatcattcccattatcaatgatttcgtctcacttgaaccaactcggctcagatccacaatcacgttttcttcaaacaattgctcttccgaaatctcatccgcaacgaaaattattccattaatgccattacataatgattgtaatctggttaataatgagcccttatacgcgcctttattttcagcatcatactcgctactatcaattatttcttttacatttcttgcaacgtcagcaaatgatggatatagttcttcaccatatttattctctgatttaacaatatcccatccgcaatcaacatatgacctttcaactgcattctttaatactgccggcatagcagcatacataggccagcaaacattaaatatttctaccagtcgatccatatgctctaatacatgtatattttcagggaagctaaaaggatttattctaagaagctgactaagcttaggatttgttccaaggacagtcacatcctttcttccaccgaacacattcttatattctcccttagcaggttcaaccacaagaaactttactccttgttttcgtgctctatcaagcatatggtatactgtattactcttacctgaacccgtacttcccgtaataaatgtatgcgacgccaaagattttttagaaagacttactttcgtgttttccatatgattcatataaaaaacattgcctagtccaatttctggcgcatcttgtctcacttcatcatacgttacaacgttccttccaaattcaacgcactctaatactggaagtcctgctatagacttctgtgggaaattcaatgaatacgctaattcttttcctgaaagacttgttgttgcagttacgataggtggataaacaataaattctgtatcctcatctacctcgaccttgacctcaccatcttctactttaccaacaacacctggattcaatccaaacaaaggatgtcttaacatcttaatatattctgtaatctcctttgcttgtccagcttcatcctcaacattgcctcgccatgtattgatggcagactttgacatataagaatcttcaccgagtgttaaagccaaatatgaatgtgcaacattgtttgcaacatttggatcttcactcaagacatatgctgcaaaatcccacattccaagagccgtgctttgctcaaatcgcttcatctgctctttaagcaattcaagggcatgttgcacattgaagtttgtatagttttgagtaatgccttcattctttcctaacatcgctgtcgttgtagatgaacgagcaaaattagcccctacatttccaccaaagcttactgctttagatacacctcttgtagctgccattgaactggtcaccgctctaccaagcgtatttgcaacagcagtacctaccgttcttccagtacttttgccaagagtcttagctgtacctttggtaatagttttcattgcagtttttcccaaggcttttgcagtgcttctattccaaccatgattataatttacagccgcatgtgcaaccccgaaaggcaaaccgcctccggcagatccacctacactatcactactaccttcagtttccgtatttgtttcgctagtcccttttgcatctgactgactctcattttctgtgaatgattcattttccgtttccgtatcactctctgactcagtatctgtgcgagatgtactatctgttgttccctgcgtatcagtaatagaactattgacaccattctgtacaccagcactagcacctacattaacacctacagtcgcagatgaactaatactttcattttctgttctctgaaaacttgtagaccatgatgcatatggtgctaatcccgaatagaactcgccaagcttaagctttcgatcttccacatccagaataggggttgcaagcaaaataacggtatactctttcttattggtatctggaataataccatcgatcaacttttctatcgtctgacttataaacttctccgatttctctgttggaatattagaggcagtcgccaccgaataattcttatcatccttaaaacatggcaacacccctaaaccagaatccttccactctgctcccggaaaattacctctaatagcttcaacaatctgatccttatagttgtcagcatctgtactacttgtcgaattcttgttgtttacaatagcaagatatacattagttttattctgcttacggtcaaaaacaagtgcaatattacagtcctcatttgaaagtaccgcatagacatttacaagcttttcaaggttattctctttcttatccgtaacccacttagtaatatttatataacggatgttatgagcatcatcgaattcttttccatactccgcttcattcttaatcggaagataaagatctttaatctgcggtaaatatgcattaaagatttctacactgcttgcagccatgaggcgttccgtttgctcacgcgcagtgggatcattaggattcggcatttcaagaagatacttttcacgtaataattgcacgttctcaacctgtgccggactcaaagatgataattgtgcaaccttgtctcctgctttgccgcctattttttttacgacattttttatacccatctgctattcctcctccgcttctttccaagacatcaaatccttgattgtatctagtgaagcctgtatcatagtctgattattctctaattcagtaatattttccgtctcaattctaataatctctgccaagctcttcagttctggatttagttccgtaagattagcgtttattttaacaagtagtttttcttcccaaatcttaaactgagaaaaacaatcttcgttcatactttgtgacatatcattaactattctcttgatccggtcattataacttctagccaaacgcttgatgtctaatttttcatcatcattaatacgaatgcctagcaaatttcctttcaagaatctctttcttacaaatactgaatcagcctgttctttgaaattattaacatcataattctgtatcatatcagctatctcttcacgttgagagtctgataatgcatccgtattagtaatctgaagaaccaacgatctcttaaagtctaattctttttctctccagtactcatctaaatgcatggataatttctcctgtgcatcatctatattaactttatacgaattgataacatatttaagaatctgttccgagctcaactgatcaagctctttttcttttgcatccattttatccttagaatgctgaacatccttaaaatcgctggacaaatcatttgcaatagtcttaacggaatcaacaatatttctcttaaataaaccttggctactttcctttaaatgctcccaaagtttatcctttgcttcctgataatcttttgcctttgaagcaaagtcattctcctcaaaattctgctttctacgatcagcgtccatattggcaagttgcgttgcatcaaacgaataattcagcttgcttaaggcatattcaccaacatcactctttgaagttcttccattagcctcttccatactctttgatgaacgatcaatttcttcttgaagcctaacagtctttgcatcaagctcttgagtacttctatcccttgcatcctttaatacctttgtacgctcatcaatacgtgcatttgtcttatcaattacgttgctaaggaaagctaataccatttggcatttattataggaagaatgcttactagcaaagttttctatctctttttcaatacaataaagaccactgtttgcataaataagattctcatttttctgacaataatctaaagcattctgctttacctgcgccggcatgatgttatatttataaagcgacatataatcaatatcttccggatcagaaaatgttgggctttgtgttctaaaagtctttctgtaaaacctatctacaaactctccatcattttttcctcccaatcccataatagatgaaacaaagaaaataccgctagcatacatcttttcaatagctctatattcaagaatctcttttacctgtttctcagaaaagcctccttccggaaggtctgcgtcatccgctttattaaagataatcatcgtaaagcgcttatctaatgagtcaatagctaatactttatcgcaaagttctgcattatcctttgtatcatgcgcatcatactgtgtcacccaaagagggatgccatttgaaaaaccatccattgcctcagccaatactttcgcatgatcctgatttgaattagaatttgatccgggtgtatcaaaaataacaaacttattcgaagaatttcctataacaccacttgtagaaaatggcactactaaagtaatcacactaccaatttctgtgacttccttatctttcttttcgtaattgttcaagatatccatggctatacggaccattgcatataactcatgggaaccctcattatcaatctcttctttgatgctctttacaatatcagtttcggaatctccctctaaaactctaaattctttgccctcaattgagatttctattctttctccatgaaactcaaatgatatcttagcttgatcaaggaactcagaatttcttatctcatatatttttgcagttactggatccccaccacttggaagaagttcaactccaataagtgcattaataaacgtggattttcctgcgctataattaccaaaaacgcaaagaggtatcacatcatctaatgcctgcgacactttattaaggcctctctttacagagaagtcttccttcataatgttttcaataaccggattgactctttcgaaaatttctttaatatcccccttaataaaacgggcgttttcaaggatagtatttgtgcgaataagttctatcttatccttcacatcatccgattcgcatacagcttctacctcggaatactcatcctgtgttccttcaaaatacagctgtaccttttctcttccaacatagtattccttaataataatggttatgatttccttaattttaaaaggcaaaaaagatctttccgaatctgtttcccttaatctacttctttcatctgtctctcttacatcaacccattgtccagtcgcctcatccattgtaagatatgaaatttctctgttatacggattgcttctgatcttaatctttgtcattttaagtaccttccattccttttttacttgttctatacttcctctatcatttcaatatagtcgccctgacttcgtatccacatattaataccggtaccaaacacctcggcagcaactatatactcgcaattttcttcatcaagcacatgtgcggttggcaatctatcaaggatagaatcaatatcaggacctttatatcggaacctaatcttttgaatctttccaccatacataaactgaattctttttctaaactcgccttcctcaaagcggctactatacggaatatgaaatcttttatcaagtacagacatattcttgattctatctattctgtaaatggtcgggaatgaatcgtttataacatcaaagtcttttctaacctcttcgtcttctataaatgcagtcaagtaaaaataatactccgaaaacatgattgccactggctgaagtcttctgtgaacaattgctttgtcttttgttctaagataatcaatttcaatatatctgctttcatttattgcttgacccaaatcccacattaaatctataaactcattgccatgtttaggctcaacataatgaaattcttcattttgaatcaattccttaactcacttttgattcacttttgggacacagcaagtaataagtttgtctaacatacttaccatttcattctttgtgaaagctctgatatcaagcagtatcttacaaagagctaaaacttcactgttttgaagccttatcttattcagagtctccagccgatatcctttagccattctgtcgtaaacaacattgtttacaattccggtcctttctgaatcctcatcaagaaaattccgtatgtcatcaatatccctagtaatactacgctctgtaactccataataagctgcttcctccgccttatttatcacataaccgtccgaaagcttagcatataattgtaaaacgcgtcctatcttatcacccttgttctcttcctgcatatatttcaccactttcaacctattcaaaaagcataaaagggcactccacgaattaaccgcgagcacccttatcacttttgctattcaagttttgttaaggcctcaattacggctgcttctaacgctttttgttttgaagctgcaagctcgtctgaggttcttactacacacgttccaaccacagtatgggaacctgaagcaagtattccaccatcgaaacctgctaaatattcatttctggattcggcatcttctacatttgcgtagacttcaatagcaccgcctccatctgttcctttatctataatattatttcctaatacatttgcttgattaacccaatcgcaagtaaagtaaacggttgccgtataacctccggctttccccaaatgaccattgggatcattatcctccgtaacagcagaaatacctgtaacatgttccacttttgccaaacactttattacatacgcttccgccggattatttaccagttcatactgcttaacactattattaaatgctgtatatgcctcattaagactcttaagcgcatccgaataatccgttgtattcatttcagttgtttgtgtatctatttctttaaccgtctccgccattttcggtgcagttatcttaactgcttttgtttccgaaatctttgtttctaacgaagacctaagcgactcatccaatgctgtattttctccgtttacaagatcatttgcctcagaaattgctttatctaattcagcatttttatcttcgagcgatgatttagcttcatcaaatgcagctattgaatcaataaatgattggcattcagtggctcgatccgatacatctttataatcatcgccaatacctttaaacagctccaatgcacctgcataatccccactattctgtaactcaactgcctttttgtaatcggaactcttacagcctgtaagtgaaaagcataaaaccataatcaatcccaaactcaacaaacgttttctcatagttcttctcctccaataaagatgtccttgttttatgttacagactcattataggaaatcagtgggacagattatgtcattcttgatatttttatcaatttttattgctataagtatcaataaaacttcaatatcaccacactaaatattatatgaattgtagcgaacaatgtcaataaaaaaccagtgcacctcgaattgcttcaaaggtgcactgctgcgctatttattcagtttttaaatacatctgtataccgccatatacaaccgctgtattgatactttcaacttcctccggtgtaacccatacggtaaaggatgtcgccacgccctcatcatctgtaatcttcttcccagcattatcatatacctcactgacatatacattttctgccataagtacaagcatctcacttgccggatccacagcatacacatctacgatatcgccttttcttaaggaatcattcactgagtcatcaaatgattctgctgcaaacgatgtaatctcgtatccacctttgtacttatccatcacctgatccttcgatgccaaattatcttttaaaaccatctgtgccttggtcattgcatcttcaatatagaagccttcctttggaagatctgatgttgaagtgtatgcattctctggaatcgcaattttttcaactgcgacacttgtaaagtacttgtccgcatcttcatacttaacaaaagtatttgcaacaacattctccttcatgacaagcacctgccccttaaggctttctgcctcaagcttgttctgcatggaaagatataatccgcataccacaatacctgcaaagagtgccggaagcactatcactttaagcacagcaataagctttaccttgatatctccacccttcttctttttagccatcatctttttgttatccttttccgttactactgctttcttctgaaacatatataaaaatctcctttctactcattgatttccaaggtacaataaatatccttggtctttgtaataaaactgccgtcaataatgttcttaatatcaaatctcacacgaccatatgccgaggtttccttaaccctctcaccttttggcgaatacacgcttcctagtctgccgtagcttacgctcttcgccccggagggccctgtgtaggaggcatttcctcaaacatcacaccagccatctctgcaggcataccgtcttttccaaacatctctctcatgacttcgttcccttaaagctatttccatctttcaattccatcttccgcatctcgttctgccaagcaagaacgtctcgcggagtgatatctctcatcataagattcttaaaatatggaagaatctttttttcaatcacccagacttttgacttccaagtattttcccttaccttaggctttacatccgcttcataacgtctgtaaaaatctccggaggtcatgtctaaactactgtctttttccaatttgaagtgtcgctcccaatcttgagcttcctttttggtctcaaagccacgcttcatcttcttgaccttttttcctgtccaatcggtgtaatagaactggcagttccacttgcctgtctttttatccctattcgccggcatgttgtacctcctttacttctgtttcgttttctactccatagaaacgctcttcgaaatatttcctgctgactcttcccaagataaccatgtatcctttatcagcaagctccttattcaaaacgcgaactattccataagacttagattcagaaacaccgagtacttcggcgatttcttttactgtgataaatgttctgcattcaaacatatcttccacctccgattacgaattttttctttcgtattacatttggggtggttttttggtcattactaaatctcagcaaaaattttttatttttttgaaatctgtggaaaataaaagataagaaaccgaattggactctttaattggagttatttcgcttctgcttctttcagaaaaaaatagaagcatattagaagcgatgaccaaaaaaagacctgaaaccgtgttatttcacacggcctcaggccttgaaaatactggatttttgaagctaacctctaagccacttacaggtcactcaaactcgatttcggtagctatatattgtgtctatacaaaacgctcattgccatattttgtgtagccattcttgatattctatatattctttatcatcttggggatttttgcaagcaaaacgcaagcactataattaaaactatatttgatttatatttagacatgtatcgttccattctctcttaatactatatctttaattacagttgccactattgtaggatataccctcgacgtttcttctgagacttcccaaatttttccgccctcatcaacgtcagctccatgatcagcagcgtttctaacttgtccaatataatcaatcattcccctatgtttttttgataatacattccctaacgccgaacttttttgaagtattccatttttaccaactaatgacacactatgttcatccgcaatttgttgtagaaaagattcgaaagcattccccgagtataaaataatagtttttccttctgttaattcattttgtaccttgctaaatgcatccgagaggggagtatacactttatcggcatctatgtaattatatgtgctttctcccaataacgttttcaaagcattatcatcatttgctttagattttaacacaacatctaaaatttccagatacgtcacttggtcatcattcaaaacaaattgattagcgccatcacttatcatcgccttagcatacgtagctatattagtaattgtattcttaatatccctatatgttgttgtcataccatataagactttcaattgcttacaagccaaatctatagattgtgtaaatatatatctatccttaaatgatttaaacggtttatattgctctaatataaacctcataattgtggccttttgtaaatcatttcgtgcagaaaccagcaaatgtgatagtaatgaatcacttttatacgattgtgaagtactatcaaaatacaagagttccatattaacagccatttttatcgcattctgtgcctgttgttctgatatatctgcgaattcactaatatattgtatatcacaaatatcttttcctgccaaagcagcgtcaacaacactaacaatatcctcagctgtggtaagaactatttcatattgcataattccacctactctctattcattaattgactttaataattgcttgattttttcactaagttcatctaactgatcaaccgatgcatcgatatttatatttatatttacaacagtaccattttttatcttcttatcatcatatatttttacaatttgctcgttgtctttaatttgattattttgttctatttcttcatttgtatcaataacattttctttttcaacggccaagatttttccatcttcttccctgaccattcctgcatccttaaaaatttctataattgtatttgcaccaacttttgatgcacttgtagtcgaccccgctgaatacaaaatatgattaatgagtgctgtcttatccataccatttctaatcttaatagcagacatcattcttgtgagaaactcattattttcaatcaacattttccatattttttgtacttcttctcttatatctagagaatatgcccttcctaaagaaaagcactcactagtaggtgttttcttagcgccctccatcaacaattgcatttgtaataagaagccattatttcggctaacaattgtcctatcaattcctgatgcttgagcaattgcatctaatggttgagcttgcccttcttttccacttgaatatgccttaattatttttattatttcttcatatgaagaacctggtaacttaaaattatctgccatcttttatcttcctttcataacacaatttaatatttattgctttaacattaatttaactaccgaccttatactttatacttcaattctattatttatctcatatatccatccgacatcacctccttcaaacaattctataaaccttccaaaattgctacctcctgtaattgtatcgattgtctccaattttttcactcgtcgactcatatctttgtaattctccgcagtaacatgttccataactttccgaatctggtctgctcttcctttgtaattctccacccctgtatattcctttatcaaaggagcattcactggttttgcaggagattttaaattttcatctgtccaatgcttagatataatctgcatcgtacaaggattaccaaacataatcacttcattcgctgcactatccacaccatgaaactcattaattttgcgtttaatgtcctcatactgctcgtgaggtttcttttccgtatcacaaaacacaagcacaagttcgtctgctccattttggtatcggtcttgatacctcgccgggatattaccatttccaccggcattgaccaatgaaatatcatattgctcgttccatacttttaaattttttaatcgatttagatactcatattcctcattaccttcacaaataatacaaattttatggttatcaaaaaacttagggagcttatttggcatcggcatcatccccctttacaccgcttttaatgctaagcaaagagttaatcaattctggatcaggtaaagcaccaagtgcacctttcctatatttttccataacatccgtcgtatctctcactccctgctgtgcagtaaaatcagcaagagaatatacatatacaccttcttcatccttgtgaacaaaccaaatctgctccttgcggaacattctcttgcaatccataaggttaatatcatgtactgtaaatatcatctgtgcacttgtatttaattcattattaaacatagcaacaattgccctggtaagcttaaaatgaatactgctatccaactcatccacgactaaaattctgccctgttcaagtgcttcaattacatagctagcaatagctgcaatcttctttgttcctgtggagtcaaacatcatacttggcacatggactcccttataagtggataccaatctaatttgatccataatgttctccggaatatcaagcactttctcatctggcttttcatcaccttcaccagttttcagctgtatcttatccatatccacatattcaaaattatccatgtataagtcagcattttttatgaactcaacaaccttctgctgcaactgattcttattcttcataagttcaatcgtgtgctgcataggtatgttattcatattgatgatatcaattttttctgcaaatccgacaagaatctgcttcatctcattgatatgttcgaatttacttgtatctaccacatagcataacaaattattctttgatacaaccgaaatcatagtctgaacagattcatcaatacactcgtatacttcactaacagtatcctttttcaaccaacaaacttccttttcgttgttgtactgatctttaaatatctccgaaaatgactcatatatatattcttctttttctgcatcgtacttaaaatcataagaaaacttccttccagatgccataaatgtaacacctaactcgcatacatcactatcagtaaatatatttggcatcagtccattcttcttatttaaaagtacatttcttattgccttaatgcacttgattagacatgttttaccggcattgtttggtccatatattcctaccgttttaaggacattaaaattattctctttgtgaacatttgctccaaattttttatttcgcatatctgctttcatcgaaaatgtaatgtcatcctcaaatgcataacagttttttgctcttacctctataatcatggctcattcctccaagtcacttttcctatttacttatcattattatatcatttaatattttttatgcaactttttttcataaaaaatattcgtttttttaaatttaacaatatatcatatagcaaaaaggcagcctttcaactgccccaaatcacgcatacaccaactccctcaccacaatctcctccgcacaagcaataatattattcatctttcccccatagcatctgattttccgccttcaacttctccgtcacaccttgtttctccttcatctgttccacaagcaaatgataaaaaggttccatatttaaaacaacatcaaaggtgtcatctgcaaaacaggacatatctgtagcatccaaaaccgctgtattcatagagtatttttttgttttaagcgtctggttgataatatctatgtgccttggtgtaatgtcagtagcagttacatcatgtcctttatcagcaagccaaaatgcataaacaccagttcccgctgcacagtctaatattttactttcagcatcaataacttcgtctagaactctagtagtagttataaattcaatctttcttgcattattcgtagtcaaacgatcttcctctttataattttcataactctcaacaacataattcatataaacgcctccaatcttctgattcacatcacttttaagtataaaaaaagctaccctccttaaataaattttaaggacgatagctaatagcttcgtgttaccaccttaattcatctatatttcgcaatatagaccttagcaagtacggaaatttctttcgaaactctgacgctgtaatgggcgttcccagtgtagcctaatgaataattcagtcggtacacggctccaagactggttcaatatttcttcaatggagttttccaccaaacaactcctctctgcaatatccaaaatatttactatctctcttcatcgctttttatcagaatagccacataataattatttgtcaagcatataatttattgatcattaagaatagtatctatcatatcttgcttgccattagtgtatgcaaccctgtcatctgcatacttactttccagttcttcctttaacttctgataacacaaagccacattctcattagcattaagataatctctaaaatgtatataatttttccactcgattccgttccatttcacaatatgaatatggtgtgttcttgtatcactttccatatcacccattacataaagaagttgatgttccacatctgaaccgcgataaaagattccttccttctgtaattgctcattatatgatattattctatcaaaatcagtcactccaacagcaatatcaataatcggctttgctttaattgccggtattgctgtacttccaatatgctgtatatcaatagcatcatctcctaatatagatttaagtattttgattgtttgaatggcagcctcatcccactgtttatcatgtggttcaagctgcactgttcctctttttaatcctaatgacatagcaatctccttaatattacatcacaatttcactgtcgaaatattgttcctgaaaatgaatctgtctcctgatttcttcctttgaaaaagttactccttcaggcacaactacccacttttcttctatatcatcttttctataaacaatggcaataattttacctgtaaacttacctactgactcatttacacctaatatataggcatcctgctcctctccatctggtgccataactccttcaatgtaaccataatttattggataatacatatccttatattcaggatgataacttcctaatggtctatcgactgtgacagttactgttgtaccaattattacattatcaacacttttgtcggcatgcaacacaaaccttagattaggatatccaaattcttcaatcagctcgccctcttcaaatccaaatttcttatataattttctaggtgcaattcctttaacatcattttctctaaatgtagacacagttatatccttatctctgtcaagcttatcaattgcttctcttaaaagaagcgaagcaattcccctttttcgataagctggatcaacagccaaacaacatatcatattatacttccaagaatataaaagtacgccaacaatctcttgttcgttcttcacgcacaaagcacgtttgtcattcatgaatttcagtactattattttgtgttcatctatactctgctctgtctctaatcctggaaaattccaacttacttttctcactaatcgcatccatgaatcaatatctgatgttctgccaaattctaccttcatattttctatcattgactatctcctcaaatctgctttgaaacaaaatgtacaatttctttccccggctcaagaatatatggtatcaactccaaaggatataccttagtacctttctttaaatcctctagcggaacccagcagaaatccaaatcaattctctcattatccagctcatcatatccatgaaacactccatctaatggaatattatcatcgaccagatgcacattataatataagcttatctgatgacacggtcttttaccccatgaaaaatagatttcacctattgctaacagattatctacctcaatcttagcatgaatctcttcttcaaattcccgtttaagagtttccatacttgtctccatagccgcaacatgtccgccaataatggcataatcatcattcttcggacgctgtaacaagattttaccattatgtttcaatataccgccaactctgtatgaaaatacaaaatcatcatttttaaataaaatatccacttaaccacctccaacctgttcataaaacttgtagtaaaaatatatttataatatcataaatctcctggtgcaaatgtatctttctcacatataatgtaaatgtctttattcattttcccctcaaaatattgcttcaaatttatattggaattccacttgtcctgcggataaaagccataccttttctttacgtcattcatcctattttctatatcaagaactccttctgctcctgccaaacaatcgcacaattgaattaaccggtcatattcatcatatatggtctttgctaattcagtttttataattgtcaattcttcatctgtaacatcaaattttccgatgtattcatctatcgtatgattattaaaagaatgggttaaacatatctttgctacttcatcatatcccaatgatttcatatatacgtatccatcataaacatgtccaagatgtcttacaccaaattttcttcctatatcatgtagtaaacctaatatatatgctttctcaacatccatatcaccacatgcacttgctattttttctgcacagtgtgctgctgttaaacaatgttttccccaaggtcccggattaaataataacccatcacgaattaacttcagtgcttcttctcttgttggcaacatagcttgtaccttcttccttttttatttaccttttcaaaactgataactccatttaactccattactccacccacaaatagagccaaactagagtcatctaataaaacaaatgccggaaacccgcataaatacaggctttcggcatttaaatccgttattcaaactcgcaaataaaatcttgtcgctatacacttttgtataggaattatggttctatctggttttatatgtgttccactgtccaaagtccacaggctgaactgaacggtgttatcaatttattatcatgattatgttatcaatcaaaaactctcgtaatatcctgataccggttaatcacacgataaatctctacatactcgtttcccgccttgtaaataaccacataatcttcccatattgcatatttatagtctgtccgaaaactgactcgttttgaaagatctgaacccattcctggaaacatctgaagattttcaaatttaccataaatttcctttacggtctttgcagcatattcttcgttatcttcagcaatataatcccgaatattcttcaaatcctttgcaacaatcggattgatccgcagttttaacatcttattcccccacaagtgcttttaattcgtccagatttaaccaaccttcaccgtctttcactgcttcttcagcttcttgcagcttcatcagaagctttttctctgcacggtcacgctcataatcttcaaaatccataactacaaaacgtcctctgccattcttggtcaaatataccggttctcctttatgacagtttttcaaaacttcattataatttctcaaatcagacactggtaaaatatttgccatattctttcagctccttcctttgatttcgtattatttctactacctatattatacacaaaaagctgtaaaattcaacgtagatttttacagcttttatactttcatatattttagcatttatcatgttctcataaaaacatcataaacaacttttttaataaaagttttattttaatttttttaacggtgcacataatacttcatatgcatatttatatacctcatttgctgattcatctggtgaaatatcaccatgtgcaagacagcaccgcagcatatacaatataataacaatagcttcactaatttttcctacatcattcacaaaattatatacaccgatttgtttcgtgtcttgtccagttgctaaaacacttatatttcgatacggtgtcaattctttataacattcttcacatttttcttgttgtctgactgttaaactagtaaaaccagattgttgccttaaaacgtcgatatcatatccctcttgttcaaaattaaatattatatttcccgtagctctagctgtaattactgttttcgttttaccatgtgccctagaacactcataattgtgttgataataatctttacgtttaagtgtatttgcgttttttacagctacttccgcaaatgaaacagattgtcgaacccctatgtattcttgtgtggtaattgcagcgtttaaaagagagccatgcaattttgcaatattttctctatatgcactcccctctgtattttcagcattaattaaattcatcatatatgttttaaatctattagtctgacttgcaatgtattcaatacatgctttatcatttccagtcggaacttcaccactaaaattataccatgcattaaaggcaatccaagctttcataaatgcagaaaaataatcaacctttatgtcaattgcatctatccaatctttatatcctggcatctcagctcacctcatttcgcataaataacttccttatctagaacctctaatgccttctgttctaatctatatgcctcatatctttttttattggcttcaagagcaagggagttgattttttcttgaatatcatggtttttaagtataggaacaggaatttgccttatatgggcgtcatcaatgtgagaaataaccgatccatacgcatatctctcaataagttttgcaccatattccgacaacaagaaaatataaagataccctgcaatatcttcatttgcaggaacaatacgcaatatatcttcacttgccacccaatttacccaatgttttggaacaactgcagtctttcctatcgtaccacttctagtaataagtattgtattttcctttaattcaagttcttctttcattcgcttatcatgctgcgaaacagaaagatattttgtattagtaggatcgagttcaagtaattgtttacctccaaaaaacactcttccatagcgttcatcgacatacactcttttaaatctccccggaagaataacggatttacttatacgcttgtcaccaacaattgtaacttctgctgcatgcctttttaaatgatcgatgattgcatctacaacaggcacatgatatgaagcatctaaacgatattccatatcgctcaatttaacattaaatgtttgtacggaggcatcttttttaaaataattaacaaccatatcatcaattttcggtaactgaagttcatccatcaacatttttattgctgtattaatcaaatcgtttgattcatcacgaagagtatatgaacgtaaaattagatttcctattttttgttttaagacatctggggcatttggaatcggaacagtcgctaaatgttctggctcaatatgtgtaattactgcaccataactattagtaagtagaatcttatttccaattttactctttaaaaaagcatatacatatcccacatcattcacatttttacaattaattcgtaaaagatcatgactaaaaatcaagccatccaatgtattcgaaaccaaagatacttttccaatcgtgccagaacaagtcatgagaatttgccctttagacactcgtagtgcatcaatattcgtgtcggtaatagcagaaatatatccatcaggagttggtttaatatccattatggttgacggctgataaataggatactctgatttttcaacccaaattcgtttaaatcttgcaccagtataagatgtagttaatcctttttcacctcccagcatagtgattggatatttaccctctacaataattttatgagcttgctttgcctctacatcataaaaacttgcctctaaacgtttaccccttttaaccatttctgacaatgaaatcgtacaccatttaacaggcatttcatcaattgtaaccttcgactcaggagatacaacaaattgatgtgctaaatttccatttaccatgctattccctccttagctttccattcagaaaagatcacaggcacgtccggcgtttggtcatcttcaacttttctcttttgttcatgagctacagtgcgatcaccttctccagtttcacccaatacaagcacactatttttatctggaacaagaatttcatttccttctttatcacgcttaaaagtaggattaccacgtttatcatgtccaactttttctaccatagccataaaaatattataatctgccataatgccactcttttcctcttcatatttctgctccgatgtttttttctggagaaatagaactgatgtttgtgttccatttcttggctgaaatgtgtctacatgaagatctacactagcaataattctatgatttttaattagccactcacgaatataaccaagtcctggtgcaccaagaatattatccggaagaacaatccccatacgtccgccctgaacaaggaattgtgtacatcgttcaacaaataaaatttctggaggtaccgatgcctgtaagcgttctgtcattgtccatgtattagtttttttatcattttcccaaacatgagctaattcaaactgctccaaaatagatttatccttaataggaattttactaccaaacggaggatttgtaacaattacatcaaaaaattcaatagtcttgtaatttcgtatagacgccttatctattcctagtgcttcagctaggtccgaacgaaaatcatctgtccactcatgtggcggtaacaatgaattagtttgcaaaatattaccacttccatcgttattcataaccatattcatttttgttgccttaacaagatctgggttaatatcaaaaccaaaatagtttgactttgccatatcagatatacgatccctaaatgcatttattgcctctgcgctccattggtcttttaatactcctaattcagtttcaaattgtttttcaagtttttcgataacatgtgtcatagcatttacaagaaacccgcctgtcccacaagaactatccaacactttttcatcaacatcaggattaatcatttcgactaccattttcattacatttcttggtgtaaaaaactctcctctatcaccacgcagattggcaccaacaatttcttcatatgctttccctttgatgtcaatatttgtattaagcaaactatatttctgcaattcactcacaatatatgccaaactacgcggtgaaagtttaatctcatcattaatatcaaaaatttgtttatactttttcttgtttttaacttgatcaaaaatctttgaaatacgtttttttactgttaactgtccatcgatattagaacgttcctcagaagtcgcgtaaaactctaatggcttagtaatattacgctcatcttcaatcttgcagaaaattactttcagcaattcaaaaaaagctggttgtttctgtaatccatcattcacataaatatggttatgacatgttttaaatgtaaaaagcagattatcatcataagcatttttaagcgaagttctctttggacgattaatatcatctagattaccatcggcagaaggaatatcattataatccataaaatctatctgccctttgtcattaacatatttccggtaaacttccttttgctttccatttgtccacataccccattcacaatttgggcaagctgacatataagattttagttgttcaactccatcttttgcattccgagcatcaacagcttcttttttacattcaataataagcttaacattttcctgagtctgtacagtacactctttatcaaatataacaatatccgcccgaggttttctagagcctagctgaagagtatactcaattttaatttgtttaggtaaatatttatgctcatttataaggcgcttttcaatggtttgacgcacatattcctctggagtgtcattacggaatttaccgtcaatataatcacaaatttttccttctggaattacaattactttcgtttcagccattcttagttcctccatttttagtcttagattttttcttctcacgcttagacagataatcttcagctgctttattaaaaaaatccgcaaaactacttctatcatatgccagtgctgcttttagttcggcatgcagctcatccggcattctgaactgcacctgttttgttcgattgctcaacaagttgcacctccttgacgcaaatgatatcaaaatatcttaatattaagatatcatttatattaaaacaaatcaacaaaaatagagaaaaaattcgaataatgtctattctaatatttcctcaaaatactagcatatacaaattgtgtaccattgctaacactttttataaagtgtggtatttcaaccaccccgttttacatataaatcacctcctgcaccacaatttcttccgcactaactttgatattattcatcaatctatcaaggaacgtttaggacatgaaaaaatacagacaacactcggcacttatggtcatctgtatccaaatacgaatcttgaagttgctaaaaagctgactggaatattacaagtacaatctgctactgaaatcattgctaattataccagcaatcaacatacagcaatctatcacagaacagttgaagaaaaataatgcaatgaaaatacaatcctataaaggaaaagctgtaaaacccttgtaaacaaaggctttacagctcagcttcaactattcaaactcaatcgttccaggtggtttactagtcagatcatagaatactctgttgaccccacgcacctcatttataattctgctcatgactgtctggagaacctcaaatggaatctctgcgctctctgctgtcatgaaatcaattgtgttgactgcacgaagtgcaaccgcataatcgtaagttctttcgtcacccataacaccaacggaacgcatgttagtgagagctgcgaaatactggtttggcatccatgctggagccttgccgttagctttcttgtactcagctacggccttgtcaacctccgaacggtagataaagtcagcgtcctgaacgattcgaaccttatcagctgttacctcgccgataattctgattccaagtcccggacctgggaatggctgacggaatacaagatgttctggtattccaagctcaagaccagccttacgaacctcatctttgaaaaggttgcgtagtggctcaatgatttccttgaagtcaacgaaatcaggaagtcctcctacattgtggtgagacttgattacggctgattcgccaccaagtccgctttctacaacgtctggatatatagttccctgtgcaaggaagtcaactgcaccaatcttcttggcttcttcctcaaatacacggataaactcttccccaataatctttctcttagcttctggctctgtaacgcctgcaagcttagagtaatatctctcctgtgcattaactcttataaagttaaggtcgaactgtccttttggtccaaatacgctctcaacttcatcgccttcatctttacggagaagaccgtgatctacgaatacgcatgtaagctgctttccaatagctcttgaaagaagtccggctgcaacagatgaatcaacaccacctgaaagagcaagtaaaaccttgccactgccaaccttctcgcggatttccttaattgtattctcaacaaatgcatccatcttccatgttccggcacatccgcatactccacgaacaaagttgtgaagcatcttggttccttcctgagtatgaagaacctctgggtggaactggattgcataaagattcttctctgtacactctgctgctgcaactgggcagtctgctgtgtgggcaacaatcttgaatcctggtgcaatctgtgagatgtaatcaaaatggctcatccacacaatagttttctctgagacatctgagaataaagcgctgctcttatctacaaatgtttctgtctttccatactctcttactggtgccttctcaaccttgccaccaagcacatgctgcataagctgtgcgccatagcaaagaccaagtacaggtacaccaagttcgaaaagttctttagtacatgttggcgcgccatcttcataacagctgttaggaccacccgtaaggataattcctttagggttcatggccttaatctgcgccaggtctgtcttgtaagaatagatctcacaatatacattacattcacggacacggcgcgcaaccagctggttgtactgaccaccgaagtcaatgacaataactttctcctgatccatgatcaatctccaatcttgtgtatttatatatacattatagttaaacttgccacttatgacaagccttaattctccccaattcttatcttgctaattctcctccagacaatccttatctatgcatctttctccccaattctcttcttcacataagaatccatcttctctctgaccatcgccatctttctgttggtctcctcattatcagaatgaaaatgcataagctttgcaagatagccctgctccacagtaatcctcacgctctcatcatacacaagctcataagcaagtgatacatgaccaataacagtatcagctggtgtacgtcttattgccttgagtatgcagtgttcctcgtaaaacgcttttaatacttcatctgtaatatcgctcttcatcagttcttcagtcgtagtgttatatatttcttcaagtggagtatcaatattaaccttaaatatatcaaccttatcagcgtcacgaagcacattgcagaatgcctgctcacggcgattaagtccttgcggaattctgtacatattgtgacaccttattgcaagttcaagcatttccatgtccgatttattcaatctgtcatacagaaatactccatcagaactatatcgatcctctaatgctcctggcttgtagcctgtacatttgaccattccattaagaaaagtactgataagaccatctttgaacaacaggtctgcaccgaattttgcatggtcaacagagtccgcatctgaaaatgtgttataacgctttatctgttcaaatcttccaacatcatgaagcattccggataaccatgccagctcaacatcataggcacacattccagctgcctttgcaattctttcgcacaaagctgcaactctgtaagtgtggtcaatttttaatttaatcttagggtcatctgcattataagctgctgtgtattctgcaaatgctttcttaacatgcactctgtcaacatacacacggtttatcttggcattttcataataaccttcaacatcagcaacctttccctcattccatgtgtctataatatcaggcacatcagataaagaatggcacacaactgaagtcagtcttcggatgtcatcgttaatctcaatagtatcaggtatatgaatcaccttcatgcctgctgcatatcctgctttaatgccattaatactgtcctcaatgactacacattctgatggttcatatccgataaagcctgctgcccttaagaatatgtccggctcaggctttccatgctcaacctcatctccatatacaacaccagaaagataatcccatgctcctattctgtgaagactcttttcagcacttgatttctgtgttgaagttgcaacagcacatttgagtccattatccttaatataatcaagcagcatatgaagccccggcttaaccgtaacttcctctgtctccctgattttgtaaacatggtctgtgcgcattgtccgcatttcccagtaatcctgctctccatgataataatcatcaaaaaagctctgactaagctttgccggtgcacctttaaaactgtcgataagccataatggcatctctacatttttctgggaagctgcccacagccagccaagattagactgattttccgtatcaatcataactccgtccatatcaaagataatcccttttatcataactgcctccattctactccccaaaatatcaaaccgacatcccttgcatacaattcccagatatacgttcacttcttaatcttacttctcttccagatacttcttaacatactgtccggtataagacttcttaaccttaacaatctcctcaggcgttcccttggcaataacagttccgccgcggtcgccaccctctggtcccatatctataatataatctgctgtcttaataacatcaagattatgttcaataacaactacagtgttgccaccctctgcaagcctgtgaaggatattgactagcttgtggacatcggcaaaatgcagtccggttgtaggctcatcaagaatatatatagtctttcctgtgcttcttcttgaaagctctgttgcaagcttgattctctgtgcctcaccacctgaaagctcagttgatggctgtccaagcttgacgtaagacaagccaacctcgttgagagtctcaatctttcttcttatacttggcacattttcaaagaaatcaactgcatcctcaatagtcatgtcaagaacatcatatatgctcttatccttgtattttacttcaagagtttctctgttgtaacgcttaccctcgcagacttcacaaggaacatacacatccggcaggaaatgcatctctatcttgataataccgtcaccggagcatgcctcacatcttccgcctttaacattaaagctgaatctgcccttcgtatatcctcgctccttggcatccttagtcgttgcaaacaggtctcttatcatgtcaaatacacctgtataggttgccggattagaccttggtgttcgtccaattggtgactgatcaatattaatgaccttatcaagctgctctattccgtcaattccatcatggtcgcccgcaatacatctcgccctgttaagcgactttgcaaggtgcttgtaaagaatctcattaacaagtgaactcttgcctgagcctgacacacctgttacgcatgtgacaactccaagcggaatatctacatcaatattcttaagattattctcccttgcgcctctaaccttaatccagccagcaggctttctacgctctgccggtacaggtatcttgattcttcctgacagatatgcacctgtaagtgagtccttgcacgccataatgtccgcagcagttcctgttgcgacaacttctccaccatttcttcctgcgcctggtccgatatccacaatataatcggctgcaaacatagtatcctcatcatgttcaacgacaataactgagttaccaagatcgcgcaaatgtgtcagagttcctagcagcttgtcattatccctctggtgaagtccgatacttggctcatcaagaatataagcaactcctacaagacctgaaccaatctgtgtagcaagcctgattctctgcgcttcaccgcctgacagagttcctgtggcacgcgaaagtgccagataatcaagccctacatctacaaggaacttaattctcgccttgatttccttaagaatctctgcaccaataaacagctgtctctctgaaagcttcatattctcaaggaattcctgaagctttataatagacatgttagtaatctcatatatgttcttatctgcaatagtaacagcaagtgaagacggcttaagtctctgtccgtgacaggccgaacaaggtctgattctcataaactcctcatactgctgcttagtattatcagaatatgtctctctgtatcttctctccatattcttaataagaccttcaaatgcgacatcatatacaccctctccgcgctggcctttatatttaacctttacagaatgtcccttagtaccattgataataatatccttaatatcatcaggataatccttgaatggtgtctttaatgaaaatccatattcctctgcaagtgcatcaagaatcgccctgctaaagctgccctcgtccttagatgactgccatcccattccgacaatagcaccttcatcaatgctgagactctcatccggtataagcagctctgcatcaaacttcattgtataaccaagtccgaaacagtccgggcatgcgccaaatggattgttgaacgaaaagcttcttggctcaacctcatcaatacttataccacagtctgggcaggaaaagctctggctgaaattaagtgtctcaccatcaataacatctactgtcataagaccttcggcaagcttaagagctgtctcaatagaatctgtaagtcgtttctggattccgtctcttacagaaagtctgtctacaacaatctcaatattatgcttcttattcttatcaagcttaatctcgtctgtaagctcatacatacttccatcagcaataacacgcacaaatccgctcttctttgcctgttcaaatagctttacatgttcaccctttcgtccacggacaacaggtgcaagaatctgaatcttagttctttcaggaagtgccataataacatcaaccatctggtcaactgtctgtttgttgatttcgcgtccacattttggacaatgcggaataccaattcttgcatagagaagtcggaaataatcatatatttctgtaacagttcctactgtagaacgcggatttctgttagttgacttctggtctatagatatagccggtgaaagtccttcaatactgtcaacatcaggcttttccatctgtcccaagaactgtcttgcatatgaagacagtgattccatatatcttctctgaccttctgcatatattgtatcaaatgcaagactcgactttcccgaacctgaaagtcctgtaagcacaacaagcttgtctcttggaatatcaacatctattcctttaagattatgctctcttgcaccctttatccttatgcagttcttgtaactgcctctttctatctctttctttaacttactatcagccatgtttttttccttcataaatatatttattaatctcaatcatcttgtcacgaagctgtgcagcctcctcaaagttaagctctgctgctgccttacgcatgttcttctcaacctgcgtcttaaccttctcaagctctttgatgctcatagattcataatcaaccttaagctttccggaagcatcacccggctccgctgccttgcttatacttatcagatctcttactgccttcttgattgtctgtggagtaattccatgctcatcattatactcctgctgaatctttcttcttcgttctgtctctgaaatagccttttccatagattcagtaatcttgtctgcatacatgataacatgtccctctgcatttcttgcagctcgaccaatcgtctgtataagcgatgtctctgttcttaagaagccttccttatcagcatcaagtattgcaacaaggctgatttcaggaatatccagaccttctcgtagcaggttgattccaacaagaacatcaaatccatcaagacgcatatctcttataatcttctgacgctcaagcgtatcaatatctgcatgaagatacttaaccctgattcctgcctctttaagataatcagtaaggtcctccgccattctcttggtaagtgtagtaacaagcaccttgttcttcttggcagtttccttattaatctctgatataaggtcatcaatctgtccttcaatcggcttaacagttatctccgggtcaagaagtccggtaggtcttataacctgctcggttctcataagttcatgctctgcctcgtatgtgcttggtgttgctgatacgaaaagcatctgtgaaatcttgctctcaaactcactgaaattaagcggtctgttgtccttcgcagatggcagtctgaagccataatctacaagcgtagtctttcttgactggtcaccggcatacatgcctcgaatctgcggaattgtgatatgcgactcatccacaataataagaaaatcatctggaaaataatccatcagcgtatacggaggacaccctgccggaagtcctgccaaatgtcttgaataattctctattcctgaacaaaagcctgtctcctgcatcatctctatatcaaaattcgttctctcttcaattctctgtgcctctagaagcttatcctcactcttgaaatacttcactctctcggcaagctctgccttgatattctcaatcgcagcgtccatcttctccttctcaacaacataatgtgagttagggaatatcgcaatatgttcaagaacgcctttaacttcgcctgtaagggaatctatctcacttattctgtccacttcatcaccaaagaattcaactcttatggcatcacctgatgatgatgaaggatacacttcaacaacatcgcctcttaccctgaaggttcctcgcttaaaatcctggtcgttccttacatactggatatcaataagctttcttatgcaatcatccctgtccttctccattcccggacgaagcgaaataaccatgttcttataatcaaccggcgcacctaatccatatatacatgaaaccgaagcaacgataataacatcatttctttcagaaagtgccgctgttgccgaatgtcttaatttatcaatttcatcattaatagatgaatccttcgcaatataagtgtcactctgaggtacataggcctctggctggtaataatcataataggagacaaagtactcaaccgcattctctggaaagaactccttcatctccccatacaactgcgctgccagtgtcttattatggcttataataagtgtaggtttctgaacattctgtataatgttcgccattgtaaatgttttaccagaaccagttacaccaactagagtctcaaactgattgccttcctcaaagccctttgtaagtgcttcaatagcctgcggctggtcgcccatcggcttaaaatccgaatgtaatacaaatctgtccataatccctccttgttttccaacatttttctcattatacaatataacagccaaaaagtacagaacaaacattcgatttgtcctgtactttattccatacctctatattcgttattctgccgcgctgacactcatttttccattgagatactctactgctgccttcaactgcacatcttcagtcgcatcatccggaagctccacaatactgtcaggtgtcactcccttgccgtgaatatcctgtcccttaggagtgaaatatttggcaattgtatacttaaccgcacttccatcagtaagcggacggattgtctgcacaatgcccttaccaaatgtctgtgttccgattatctgtgccttatcataatcctgcattgcaccggcaaatatctcagatgcacttgcactattgccatttaccaaaactgccatcggaatattaagctcatgattatcagaacctgaatattcctgtctcttaccagacttagtctctgtatacacgataagtccgttcggaagaatataatctagcatatcagccacagtcttaagaactccaccaggattatttcttatatcaattacaagtcctgtaattccctgcttctgaaggtcatcaacagccgatttaaactgctctgttgtaacatcatcaaactgtgaaatgtagatatatccaatattattctcaagcacctctgatgaaacagtcttaatatcaatcttgtctcttgtaactgtgaaactcagcttctcgccatttctcataacagtaaggttaacatctgtacccttctcgcccttaataagggcaactgctacagaaaggtccattcctgtaatatcctcaccattaacctctgttaccttatctccatttctgataccagacttatatgccggtgcatcctcatatgcctcagatataagtattgaaccatcatcagccttctggcataccgcaccaattccatagaaagaacctgatgttgactccatcattgacttatattcttcaggcgtataataaacagtatatttatcaccatatgcagcaagatatgccttaaaaatgttgtctgcagccttttcatcatctacatcatcaaagtagaatccatctccaagcaacgaatcaagagcattcagcttaccttcaaccttagttccgattccttcattatcacttgttccaacatcctgaacatatatacgtccgtcaattccaatatgaagattaccacttcttataagtcccatgaatacgcatgacaacgccagtatcacaaccagcagtgttgccgcaacaccaataataacgcctttgcctaaagcatgttttctctttcgttcctgtgcggccccttccgaagaaaaaggtctgttattatcatattccattgagtcctcctattaagttgaattatttatttaaaatatggcataggattaacatatgaaccattgagcattacatcaaaatgcagatgtgcgccaaatgaattacccgtattacccataacaccaagcttctgtcccttagtaacctgttgtcctactgatacatttaaactatcaagatgcaggtatctcgtatacagtccattaccatgataaatcatcacataattacccgctgttgagtaatactcactctgtctgtgtgcaataacaactttaccgtcataagctgcatatacaggatcacctgaaactcctgccctgaccgctccaatatccacacctttatgcggtgaagttctgtcagatgtatctccgtatggagaagttattcttgtacttgttgttggccatttgaaagttccgccatcatatctgttagacggagtaactccgtttgcttcctctgccttaatcttggctgttatagaagcaatctctgcatcgagcttcttctcgtcagcttcgagctgtttcttataagccacctgatcagccgtattcttactcaaagcattaagctgggcagtcttctcattctggacaacctcaagtgcatcaacctgtgcctgaagtgcctcctgactggcagtcagagtctctttatcttcttcaagctttactttagaagatgatataagattaatcgttgactgatattcctcaagcatctgtctgtcatactctgatatcttattaatatactcaaatttattaagcatatccgccatactctgtgatgataaaagcacttcaacatatgtataatcattatgctcatacataaactggattcgaagcttcatagcctcatactggctttccttatcagcctcagcctgctcaagctgtgcctgtgtctcctcaatctcagcctctaatgttgcaatctgggtattaatatcatctaatgacgctgacaattctcccatctgggcatccagtccctgaataagagatgtaaggtctgaactctgtgccttaagctgagcaatcttgtcttctgtttctttctttttattctgtatatcattctgctggttctgggcattcttcagatccgatttattatctccaaatgtaacctgtgcaaaacaatacggtataagcagcattacaatcatgagtgccgctgttattttctttattaaattgttacaaaacagtgctttctccatacagccactcctttaccataattaaaatgttttctaaaaacaaacagggacttctgcatccgtttgcaaaagcccccaaaaactatccgaaactatacatcggcatgctttcttacagcgaagaaacttcctataagaccaataccaattccaagaataactgctaccggaataagtacctcaaatacttctgatgctggcataaatgctaatatattctgtaaaacagagaattttccaagaacaaaattaacaactccaccataaatatacctcaatattgctaccggaataatagcacctataagtcctataacgataccttctacgaagaatggcgcattaacaaatgcatccgtagctcctatatatttcatgattgatatctcatcttttcgtactgtaataccaattacaattgtattagtaataaggaatatagataccgcaagaagaacaacaattactgcaactgcaacataacttacaagtcttgctgcactggcaagtccgcttgctgtaacctctgaacggttaacctgtcttattccatccttattctcaaggtacttaaccagtgtaccctgattacttgcatccttaagatatacttcataagaagaagaattagctaaaggattatcatccttgaagccttctgcaagttcaggatatgcggcgaaatactcacccttgaagctttcccatgcatcatcagctgatacatactgaactcttgatacttcttctcttttgctgatttcatctccaagcttcttaatatccgtctcactgagattttcgtcaaagaaaactgttacacagacctctgtctcagccttcttaatcatatactgaaaattaaccactatagaatagaatactccaaaaaggaatatacatgctgtaattgttgctattgatgccagtgagaacatcttattacgatggatattcttaaatccatctttaatatgatatgctaatgacctaatcttcatagaaataaccacccttttcctgatcgctgataatctttccttcactcatagtaatagttctcttcttcatctgctgaactatctccatattatgggtaactacaagtactgttgttccctgcttattaacctgattaagaatcttcatgatttcattagaattggcaggatcaaggttacctgttggctcgtcgcacaacaatatagccggcttgttaaccagcgctcttgcaattgcgattctctgctgctcaccacctgataactcattaggaaaagccttatatttgtcaagaagtcctaccatggaaagcatcgcaagtactcttgacttaatctttctgttaggagcttctactaccttctgtgcaaatgcgatattctcatatacatttctgtctggtaacagacggaaatcctggaatactacaccaatatctcttctaagatacggaagcttctttcttgttatcttattgagatatttcttattaacatatatcttacctgatgtaggatctaattccttaagtaatagtttgataagagtcgacttacctgaaccactcttacctactataaatacgaattcacctttctggatgtgaagattaattccattaagcgcagcaacgccagtggaatatgtcttcgtaacatcttccatgattatcatgtatcatttcctccaaaaattactaaaatgtatctttactttccatatacttcatgtacttaactaccataagagcaatcttaaatgttattgcatcatcaaacactctgaggtcaagcccggttatcttctgtattttatcaagtctgtaaacaagtgtatttctatgaatgtaaagctgtcttgatgtttctgaaacattaaggctgttctcaaagaacttgttaattgttgacaaagtctcatcatcaaaatcatcaggagcctttccttcaaatatctccttaatgaacatctgacataatggtataggaagctgatatataagacgacctattcctaatctgttgtaagcaacaacattcttattgctgtagaaaatctttcccacatcaagtgccatcttagcttccttgtaagatcttgaaacctctcttatgtcattaacaattgtaccataagcaacatgtgccgcactcatcgcctcagtgcttaacatatcaattataacatcagctgtcttgtcaagttcatcatatgactcattgcctttaacttccttaacaagaattatactcttttcgtcaactgctgtaatgaaatctcttgttttattagcaaaaagagttcttactgtctctaaagcattagtatccttttcgtgcttagtctcaataatatatacaactctcttaacatcagtttcaatatgaagtttctctgctcttgtatacatatcaactcgaagaagattatcaagaagaagattcttgataaagttatccttatcaaatctttccttatatgccacaagtaaattctgtatctgaaatgcagtaagctttccaaccatatatacatcatcacttgttcctcttgccatgattatatattcaagattgccatcatcttcaaccttaaaaaactgaaaaccattaactgcctgactttctgctggcgaatcaataaaactaatcgcatccgcaaggcattctgaaacattatcaaaagtcttggctgcaacattcttatctgcatccacaatgcacaaatccactcgtgaaatagccttaagtccatctacagttgtctgtaaaattctattagatatcattgttatccctttctgtctaccacttaccttttattcgtacatattctatcttattgtaaagcaaaacggcaaaaaaaaaaaggggaaatgcaaatttattgcatttccccttcataattaagattcatttaataattagtgtgtgataacgatttctgtttccttatcgaatacatgaagtctttcaacatccatagcaaatgttacttcatcaccaggtcttgctgttgtacgaggatttaccttagctgtacatgttacatcaccgatttcatagtgaaggttaacttctgcaccaagtaattcgtataccttaactgtagctgtaaacttagaatctgcattcttagcgatgaattctgcatcatccttaacatcctctggacggataccaactacaactgtctttcctacatagttgccatcgataagcttcttgctcttctcaactggaagagtaattgtaactgtatcagaaagtacaaggtcaacctgtgaaccgttagccttaacttctgcatcgataaggttcatctgaggtgatccgatgaatccagcaacgaagatgttgttaggtgtattgtaaaggttctgaggtgtatctacctgctgaatgataccatccttaagaactacgattcttgtaccaagtgtcatagcctctgtctggtcatgtgttacgtagatgatagttgtctgtaatctctggtgaagcttagaaatctcaacacgcatctgtactcttaacttagcatcaaggtttgaaagaggctcatccataaggaataccttagggctacgaacgatagcacgtcccatagcaactctctgtctctgaccacctgaaagagcctttggcttacgatcaagaaggtgctcgatatcaagaatcttagcagcttcatgtacagccttgtcgatctctgccttaggaacttttcttaacttaagaccgaaagccatgttatcatatactgacatatgtggataaagagcgtagttctggaataccatagcgatatctctgtccttaggctctacatcgttaaccatcttatcaccgatccataactcacctgagctgatttcctcaagacctgcgatcatacgaagtgtagtagacttaccacatcctgaaggtcctacgaagatgatgaactcctgatcagcaatttcaagattaaaatccttaacagctacgaaaccgttaggatatactttacaaacattcttaagcgataaacttgccattattaaatatcctcctaatataaatgcgcctttgcgcttttgatgtgattataatacactaaacaggacttttttaccacattacatttttacaaatcttttcctcgttttttttgcaaatttaccatagccagtcctcttatgtataaattgtacaaatttaccgcctgtttatctgcaaacatcactaatgctgtttatgtttttaattgtttgttgaaataaaaaccttttaaatatataataaaaaagagcgatagggtatttactttattattcatgcgcatctgttatatatgtacacgattggaggaatgattatgactatagctggtttatctactaacataagtacatctggcataactaatgatatccagattgcaatgctaaagaagaatcttgatacagttgaaacagctggtgctgatatcgctaagatgatggaagcatccgttacaccagaacttggtcagaatattgacttaagaatctgattcagttttccctatacatgtctttagaaatacaaagcccatgtacacagttttctatgtacatgggctttatatttttctaaagagttcctgaaaattcaagcattatcatatacattacgcacacaacaatgccaacaataaccggagctgtaaaataattctttatatgtgataacttaacattctgaatcttcattttttcaagatttccatgacgttttgccattgttcttatacataatacagcaagcatcatgaatactgctgctataacagcaatcatcgcaatctgcacaaccgtaattgatgtgctctgacctgccacactctctgcattttcaaatgtttcagatacactgccatcctgcgcatacattcccgccatcttaagaatctgtacaattcctattgaatatgtatttaccgcaaaatgtgcaataactgacgaccacaaagaacctgtagcctcaaccatatatgcaaacacaattcccataacaaatgcatacaacgcctgattaatattaagatgaaagcaaccaaataataatccgctcattagtgcagcacctgtcattccggctttcctgtaagagccaaagaatatcccacggaatataagctcttctacaagcggcggaataactgccagcaatataacctgcatcgcaaatggatatgtaagcagtgttgttgttccctcctcaagataattagttgaaaacaacatgctaagattacttattaatagtactgccggaataaggcagtatcctgcaacaagtgaaagaattacatcaactatgcctattcttttgtatggaatctccctgataggatcaatcttctgaacaatcatatatataattgcaataagcagaattatcccttctgacataacatactgaatccagtcaggcacagctatacctgaattctgtgcataagccataatcgatgcacacacaacagataatccgatataacctattacaaatataataaaaaagccattaacttttcttacttccatgcaattgcttccacttcaagaagaacatccttaggaagtcttgcaacttctacgcatgaacgtgctggaaatggctccttaaaatatttcttgtagatttcattaatcttaccgaaatcattcatttctttaataaatactgttgtcttaacaatgttctctaccttagagcctgaagcctcaacaagattgcagagattctgaaatgcctgctcagcctgagcctcaactccgccttctgctatctcgcctgtagctggtattacagggataactcctgatgtatataccatattgttaatctcgatagcctgtgaatatggtccaattgcacttggtgccttgtctgtactgattactttctgcataataatctccttatttcaacatattttacgttacaaacgcattaaatatattgtaccgcaatcatcatattcattcaagaagctatttcttaagaactattgaattctgtgttatctcaattttgccttctttaagcagtcttcctacagctctcttgaaagcatttttactcatattaaaatgtttcttgataatctctgggtctgctttatcagtaaatcccagacttccgcccttctttactatagcgtcatatatctgtactgaatcctcgtccatctggatataagccttctgcttaaggcttataacaagtttcccatcttctcttactcttgaaacacgtccgtgaataacctcaccgacactaagtggttcaaacacttctgacataggaataaatgcatcatacttatcttcaacagcaacatacgctctgtaatctggagttattcctattatagtacctgtaaccgcactgtcttttacaagtgtctctgacttttcaagatacttgttaattctcatagtagctgcaagtctgccgctcttatctatatagagagcaacaagatactctgaaccttctgatacatgtgttgtctgttccttgtatggcatgagcaggtctttttcaagtccccagtcaagaaatgcgccaatacctgtaacctgtgatactttaagtctcttaagttctccaagctgaatctttggcttattagtagttgcaataagtctgtcacttgaatccctgtaaacaaatactgtgagagcatctcccacttcaacatcatctggaacctgttttttaggaagaagaactttatcttcttctgttccaagatatactccgaaatctgttacctttacaatgttaagacactgtgtttttcctaactctatcataacaacacctatgctggcagcttcaccagccctttcataatatttcagtgcaagtatggctgttgcctttctacgtctattctcatcgctactcgcacaaaaaaacctctcgtataactacgagaggtttctagctgggcttgagggattcgaacccccgaagtgctggaatcagaatccagtgccttaccacttggcgaaagcccaatgtcgtgacgacatgctgtattatacatgaatgttttcaggaatgcaagcacttttttaaaaaaatttcaaaagtgttataatccctgtctactccgtcatcttaagggttactgtaccatctgcatcagtaccaagattaggcatcttctgcatcttttgtgcagttcctataaagaacttgtattggtcaagtacctgatccttctccatatcagatacagctttcttaatgtcaacatcttccatactgcttgttgcagcaacaagattgaatctgtttctgttctcaaaatcaaatgcaaattctttaggatcagaatgtacaggtgctttgttaatttccttgtcagtctgattgtgactgccagcctcctgtgagccagctcctgtctgttctatctgaacatcttctgtattctgcagattattattatgtttactgcctattgtataattatcataaaatgaatgaatattaattcttcctactcccatagctgactcctttctgcatagattacatccttgttttatatttatcggcatgtttatctgataatttaccatctaatccaacaaatttctacataatttcacatatatttataagcactgctataaaatttttataaacacccgctttttacgttgaccttaccgcaagattaacttaatataaagatacatttttataaggagtacattaataatatgaacaaaaagaattcaatattcgtaattataggaatcttccttatctgcacaagattctgggtttcctttggcacagtgaacattgatataagcaatgatatcgtcggatacatccttatattcctcggtatcaataatatgaaagaacttaattcccgctttaagaaaggaatgtttctttctcttgccggacttgccggtgcaatactctcacaatatcttattgcaagagactggcctgtgccagagactatgtattctatagcaataggtatcagtgtcgtatttgctatatattttacctattattatacagaagcccttgtcatggaagcaaggatacaagaaaaaactgctgttacaagaaattatcagataacatggcttcttatgtctgccggaatatttatccactattttgcattcaagtctacaataacaatgtggtctatacttgttgaagcactgattgccgtgattaccatatattattgtttcttagtattttcaaccagcagacagctttacgaagactgattgctttatattttttaacaaatgcaattttgttatttacattattcgtttatacggtaattgagttgacttttgcctgtttcagtgttttaatgatgtcgtcagcacgaaaggatattaattatgaaaaagttagagattattatcagacctgaaagacttgatgatcttaaggccatccttaatagcaatggtgcgcatgggcttatgatttctaatatcatgggatatggaagccagcgtggacataagcaggtttacaatggtgttgatttcggtggtaatcttcttccaaaggttaaggtcgaatcaattgtatcagatgagacttacgaggcaattattgatcagataattgagcagattaataccggagaatatggtgatggcaagatatttgtttatgacgtatatgatgctatcagaatccgtacaggagagcgtgggacagacgctttataacttcatattaattattggttatcaacggggataacagtcagaattactatctgaccgttatctctttttttgtacataactttcgctatctgtatcccataaccgtacagatatataaaatggggtcacaggaaactacccagcctgtgaccccgccccttttttaggatttattcttctttattatctgttgtatcttcaattaaatcttctgatttctcattctcaataacctctggttcatctttcttaaccatgtctttttccagcttcttgaatatacttgagaaaatatatgaatcaacatacaatatcaatggtattgttactataaatgcagtgaaatatatgcatgagaaatatatcagtccaacagttgctataagcataattattgtctgtggaagatgatgcatacatataataagtgaattcttaagtgtacctataagcttattgtcatatcttgaaagcattgcaaatgagtaaagcattattccaacccatattgccatgactcctattacaacaaatataaacaaagttcctatctgtgagccctgaacaagtccccactgtacgcttgctcttaaatcaataaaaagaagaaagccgataactccatgtacaatctctaacaaaagtccctgtacaaaattcatcttgaacgacttccagaaatctttgtatacataactttcctcgtctcgtactaattttattcctgaataaaatgctgctgtaagcgatgctcctattgttacaaccggcagacaaaatacaactgtaataactgccagtattataaagtcacctgccttggtgagtcctctaaaaagttttccatctaatccaaatccattcataattatatacccctttgcttaaacactatgattatacaagacctgccataaaaatcaaagaatttttcgtatatatttcttaaatgtttataaaagctgtttttttgccacagcatttatgataaactgttaaacaataacgattattaaggagtgtttatggctaaaggaaacaacattcacgacgaaattaaagagcagcgtaaaaagcttaaagatttgtctttttcagataaaatcaaatacatatggagctattactggattccaatcgtaggagttgtacttgcagttatatttgcagtttctcttatttcatccatagttaagaacaattatgatactgtatgttttgttgctgtacttgatggcaagatgacaggttatgaaaatgatactgatattctcacaaccggacttacagactatcttggaattgacggcaagaaagaacaggttgatttctcatatacattttcactgaaagaagtggcaatggaccaggaagcatatgtttcagctaataagttatatacttatgcatcaacaggttctcttgacggatacctttctgaacgtgagtatattgattacttctgtactgacaaggatatattcttctgtgatttgcgcgatatattctccgatgaggaattagagcagttagatgattacattgtgtatttcaccaacaccgccggagagacatatcctattgctgtagatatcactgaagcacctgtaatcaaagacagtgacctgaatatgaaagacccttgctatggtgttgtatcatcatcaaagtatcagaccaatgctgctgattttataagatatgtatttaatatgaagacatcctgatataatcacagcttttttctatatatattcatcccgtctatatcgcctgcatacaatgtgaaacccagtttcaatgcaagctgtatggatgggatatttgttttcactgtgcatatatataattcttctaaaccaaacctgtccttagcaatattcactatatggttcataacttcccatgccacatgctttccctgccagcttttttttacaagatacccaagctcctgacaattctgtccgtctatactgcggttttcaatgcctgctcttgccacaagttcacctgttttcttatcaaacacaagccacagaccgtacccgaagaagccatacatattctcaatgtattttattgtaaatgctttttcatccttatattcatataatggttcaacatactggcagtctgaaagtgtctgatataattcgtataaatttggtaaatcccccactgtcatctcccgtataataaacctctccgttctggcaattacaagcggctcattgtattttctggcacatacaagttttaacaggtcgtcatcaatatcttcctcatcatatacaacatatgaagcttttccaaggtatgcttctccaagccctatatcaggaatctccagtgttccatcagggtttaacgtatctttatcactaattattatttttctgccttcgcccatatcaatacattttctcatatatgcctcttcataattgtttctaaagttttaatttgactttttatactgtagtatttagaattaattacatcacattttgctcatgcagacaagcgggcaatttaatgaatttcaggaggaataatatggctaatccaatagttacattcacaatggaaaacggcgatgtgatgaaagctgagctttatccggaaatcgcacctacatcagttaataatttcgttaatcttgttcagaagggattctatgacggacttatatttcacagagtaatcgcaggttttatgattcagggtggtgaccctgaaggaacaggtatgggtggtcctggctactctatcaagggcgaattcgcatctaacggatttaagaacgacttaaagcatacaagaggtgttctttcaatggctcgttctatgagacctgattctgcaggctcacagttctttatcatgcaccagaacgctccacatcttgacggagattacgctgcttttggtaagcttatcgagggtgaagatgttcttgacaagattgcaggcgtagacacagattacagcgacagacctagaaaaccacaggttatgaatactgttactgttgagacatttggagaggaatatccagaaccagagaagttataattaaagtttatccattgacatcaaaaaggcggatacagttaattgctgtacccgcctttatatttttagaaatgtccgccggagccactgtttccaccgcctccgccgctgcttccgctgctattgttgtgctcaatatgtcttgtaacaactgttgtattaatgaacacgtctcttctgtcattaaccttaaagttatggtctttcgtatattctgtgctgcttacagtcattcttgccttggcattatgcatcattgtaagaacagcagcaactgcaacacctgatgcaataagaagcttaatccacattttgtatgtaagtttcttgactatgcttgtagtcatacacatattcatgttcttgatatacttagaaaatgctttgtaataatccttatccgaaagcttttcctcacatgcttctcttatgtcatcaattgtcccctgtgaaatatcagttccagccttgccctgtgtatacattctatcagctcttgactgcatatcaacaccatatattacggcattctgcgaatatccgttatcatcaaggaatttcttaagataactgtccatcgtactgccatcatgtcctatattagttgtgataataactatatcgcactctgaatcctcagatgctttcttacactggctctttagtttaccaacctcatcagaagtaagaattcctgcattgtcatatacatattcctttgatgaatctgcatacacatcagccttaatacttaacagcactcccacacacataaaacatgccataattatgctcatgaaagcctttatcttcttattaatcttcatcatatgaacaaaagccctccaaacatagtaatgataagtgtaacaatgaatattccagctccgaagccaaatgctttctttccgcttattggtctgtcagcaactatctttcctgtctgtccgttaagcatgaactggaaatttttcctgttaaacctgtaattaagtacccataccggaaataatgcatactggcttcctgttggacgcattgttatgtcattgtgaattatattaacagatgaataaccggtaattgttgacattgcaatgtctgttatatatttgtcagctcttcttgtagctctctcctgtatctggtctgccgtataattatatctttctgaaagatatcctgacagatatggcattgaaaatgcagttaattcgttatagttaaatggctccagcttatccatcgcatcatcaggcattttctcagatgcatcagccggaatcttctcaaactttgcagatatatttctgaacacctgaaaatgatctgtgtatatatactctgtatcaccttttcttgttgtcctgaccctttctgcattagcatgcatatctgtctgtgctgaataatcatacagccagtaaggtacatacagtccgcttattttctcaattgttgaatttcttgataaagcagatggtgtgagtggtcctttcttacaccagtttttgtaaatctctactgctttatccttgttaatcttaaatggtataattgttgatggcttgaattcacctttaagtctgtcctccacaagtgtcggattaccacagaacgaacaaaatgttgccgatgtatactcatctgctacaagctctgcaccacatgtattacaatggtacatcttcatctctttgtcatattctccctgtgtactgttctgtgaatatttctcttcatattcccgcacatcaatctgcattccacatgacggacagcctaatttctgtgttgtactgtcaaactccatagcagcaccacacccagggcatttgtaaattgttggcatattcccctccttaatccacagtcgttcataatttattcatatctaattcaataagatttaacactatgcacattgtttcttcacttttgttcaatataattcaatcataagaacaagacattttctactatatgtttttcataaatcgagttgttaataaacagctctcctccctctttcaccgtctgctactccggcagacggtgttttttatcctgcatataattataatacgacgaatgaagctataactaaaaccactcctattataattattatctttcccttcttcttatctttagcaagtttttcattattaagtctggctttttcatcatcaggcataatctgttcctcatatgtcattctgacatctcttgcatcaaagaatatgttaaaattatgttttgccgtaagatatgttgcaagtccgacaataattacaacaattcctgcaagaaaaagcatgaacccaataaatggcagatagcttgtgccagcatgctcttcactattatagaaatccattgcggcactggtatcagcttcaagtgctatcctgttgataaaaaatgttaaataacccatacaggtctcctctctttagatatttccttaggacatacatgattatacatcatatttctttgtattaacacataaatatcatataaatattccttttcatttttaatgatatgagatataatgttgtcatacaaaatcgtgcaatggaggtaaagaaatatgttagtttcagctaaagaaatgttagacaaagctcttgccggcaaatatgctgtcggacagttcaacatcaataaccttgaatggactaagtctattctccttactgcacaggagatgaatgctcctgtaatccttggtgtatctgaaggtgctggtaagtatatgacaggtttcgagactgttgcagccatggttaaggctatggacaagtctcttggaatcactgttcctgttgctcttcatcttgaccacggaacatatgaaggatgctacaaatgtatcaaagcaggcttcacatctattatgtttgacggttctcattatccaattgatgagaatatcaagaagacaaccgagcttgtcaatgtagctcataatcttggtctttctattgaggcagaagttggttcaataggcggcgaagaagatggtgttatcggaatgggtgaatgtgcagaccctgatgaatgtaaagctattgcagatcttggtgtagacatgcttgcagcaggtatcggtaatatacatggaaagtatcctgctaactggccaggattaagctttgagactcttgcagctgttaaggataagattggtgatatgccattagttcttcatggtggtacaggtattcctgcagatatgattcagaaggcaatctctcttggagtttctaagattaatgttaacacagagtgccagctttcatttgctgacgcaacaagaaagtatattgaagccggcaaagaccttgaaggaaagggatttgatcctagaaagcttctggctccaggctgcgaagcaattaaagaaactgttcgcgagaagattaatctttttggttcagcaggaaaagcttgatgatgattggagatttttatgagtaacttaaagacagatgaagatgatgattttataacatctgcttcacctgaaacagaaccagacgaagcggatttcgcttttgacgttaaagaaaaaaagaaaaagcgctcaagcataataagccgtattattttaattatatgtgcctgcgtttttgtttttgcagcagtcaggcttgtatccattcttcttgaatacaagaagggtaatgatatttatgataatattgaaggtaatgtccttgatgatacccctgttaatattacaataggtgaagataatcaggatgtaacaatcccttttgtctataatcatcaggctctgcttgatattaatcctgatggtctgggttttctttatgtaccatcggtagatataaggcttcctattgcccagacaaccgataatgatttttatcttactcatacatttgataaaacttacaaccgcaacggatgccttttcgttgattatcgaattaaagatggtcttaatgccagccatgttattatatatggacataacatgggttctggtgctatgtttggtactcttgccagatataagaattctggtttctaccagacggaaggtaatgatgttttttatatatatacagaggatgtaatccgtgagtacaagatttttacagtatatataactgatccaataagtgatacatttacattcaatttcagcaatctgtccggccttcgcgaatacgcaaagaatgtccaggctgaatcactgtacaataccggagtcgatatttctaacgcaacacaggtagttacattttcaacctgcacagatgattctaaacaacgtgttattgtatcaggtacatatgtcggagaatctaagttagataatggaacatcttctgaagcatctgcatccgcttcagaataagcattttaacactcatatttcatgcaggcttaatttttttaatatttttaaaaaagcacttgcaaattcatacaatatgagttattttatttaaagacagtaggctgtcgctaattaaataaggtagaacaaaggcgttccatttatatatttgtataagtatatacttgggcgccattttttagttttactaataaaaagataagaaaaggaaggatgaggaagttatgagtgaaagattcaatgtagctgacatcttcggcgagaatgtgtttaatgacacaattatgaaagagcgtttaccaaagaacgtttacaaaaaccttaaattaacaatggaaggtgtgcaggaattatctttagcagatgctgatgttatcgctaatgctatgaaagactgggctatcgagaaaggtgcaactcattacacacattggttccagcctttaacaggaactactgctgagaaacatgattcatttatatcagcacctaagtcagacggaaaggtgcttatggaattctcaggcaaggaattgattaagggtgaacctgatgcttcatcattcccttcaggtggtcttcgtgcaacattcgaggccagaggatatacagcatgggattgtacatctcctgcattcgtacgtgaaggtgcccagggtgctactctttgtatccctacagcattctgctcttacacaggtgaggctcttgaccagaagactccattacttcgttcaatggatgccatcaacgagcaggctcttcgtattttaagacttatgggtaacacaacatctaagaaagttactccttctgtaggcgctgaacaggaatacttcatcgtagaccgagagaaatatttacagagaaaggatcttatcttctctggccgtactttattcggagctatgcctcctaagggtcaggaacttgatgatcactactttggttctatccgtgaaagaatcgcagctttcatgaaggatgttaatgaagaattatggaagcttggtgtatctgctaagacacagcataacgaagttgctcctgcacagcatgagttagctcctatctatgcacagtgcaacattgcaactgataacaaccagcttatgatggaagttatgaagaaggttgcttacagacatggtcttgtttgccttctccatgagaagccatttgcaggtgttaacggttctggtaagcataacaactggtctatcacaactgatgatggaattaacatgcttgatcctggtaagacaccacatgaaaacttccagttccttcttgtacttggtgcaattatgaaggctgttgataaacatgctgaccttcttcgtgagtctgcatctgatgttggtaacgatcacagacttggagctaatgaagcacctccagctatcatctctatgttccttggcgagcagcttgaagatgtagttatgcagttaatcgataagggtgatgctacaagctctatccagaaaggtaagttaaagactggtgcttctactcttccagaccttaacaaggatgctacagatagaaacagaacatctccattcgcattcacaggtaacaagtttgagttccgtatggttggttcttcagattctatcgctcctgcaaatgttgttcttaatacaatcgttgcagaaagttttaaggaaattgctgatgaattagagggctctgaggatatgcagatggctgtccatgatatgattaagaagctcttcacagaccatcacagagttgtattcaatggtaacggttactcagatgaatgggtagcagaggctgaaagaagaggacttcctaatatcaaatctatggttgaggctgttggttcacttgttaaacctgaaacagttaagatgtttgaaggatttggtgtattcacagaagctgaattaaagtcaagagctgagattaagtacgaggcttactctaaggcaatcaacatcgaagctaagacaatgatagatatggctggcaaggaaatcattcctgctattatctcatacacaacagaacttgctaactcagtactttcagttaaggaagctggtgcagacgcttcagttcaggcagacatccttacagaagtatctggttacttaaaggaaatgaaagcagcttcagctaagcttgcagagacagttgctacagcagctacatttgaaggaaaagcacaggctgaatacttcagagatacagtaaaggttgcaatggacgaattaagagctccagtagataaagccgagatgatagtagataaggaattctggccattcccaagctacagcgaattattattcgaggtataatacataactaattgttataaatcactctcataaaaagatagccgaaaacagacaagcaaagctgaatctgttttcggctatcttactttatatccagccagacaggcgaagccgaatctggctggttctactcacatcacaaaaaatcccactaatcagacaggcaatccgattctgattagtgcgattttcaccccttgaaacatccactgtgtagattgccagtctgggggtatcgggctgtggcttgatttattacgagctgtgcaggagttaatgccgccatagacaaaagttcagcgtgcaaaagctcgttcaaacgaagtgcgtttgcttttgcacgctgtaaaaaactctgtatatggcggcatttactcctgctaagcgcagtaatccatgaaagccacagcccgatatccccagactggcaccacctacacgctactgtggataactcaacctctcctcaactggattatccagaacctcctccttaaacttcttcatatatatcttcgcaagcttaagattgttatccagataattaccacagtctcttggtgaatatccaggaattggtgtattatcgtcataattaagaacataatcggcagcttctcttaataccccgataatatcctcagactttaaatctcctgcaaatataacataaaaacctgttctgcagcccataggtccgaaatatatagttttctcagcccattctgcatgattccttaaaaatgtagcaacaagatgttcaattgaatgaatccccggagtatccataggtggctcttcattaggtcttgtaaatcttaaatcaaatgttgtaagacatacatctccgatataatcctttcttgatacatatacacctgtcagtaaatcaagatgattcaccgtaaaacttgctatcttgttcattatgacaccttctttcttataaatactattcttttgttatctgttgtttctattagcagttcttttatgcttgatacaaattttgtcagagttgaatatccatattcctttgccttgaatttcggatactgactatgtattctctgtccaagtattgcaagctcaactcctgttgccttgcttgctctgacattatctattgcgtatttaacaacctgttctttaatattgtcatcttctttgagctttaccagtactgcattattaaccttatatgtcttgaacccatccatctcattgataaatgtggataatgagctatacccataattacggacatcaaagtcagaatattttttctgcaaacggcttcctatctctcctaaatccgtctgctttcccttattatcattttcctggataatctcaataatagcattttcgattttggaaattcgtataatattgtgtgatctgttaggcctctgcttattattaacagctgtaatttcttcatcctcctgatcctgtaaaagttccagatcagtaaatactgaacatgctgccctgaatgaccttggtgttttgttctcacccattccaataacttccatgccagattcacgcagcctgcttgccagtcttgtaaaatctccatcacttgatacaatacagaatccatccacatttttcgtatacagaatatccatagcgtcaattataagtgttgaatcagtagcattcttgcctactgtgttgcgaaactgctgtattggtgtaattgaattctccatcaattctttcttccatttgcccgcctgcggacttgtccagtccccatatattcgcttgtacgttataactccatacttagtcatttcatctaatatattagaaatatattttgatgaaatattgtccgaatcaataagaaccgcatacctcttatcgtccatagattcccccttaatataaacattacatctgatgacgtactatcttatattcgtcattgctctgataatatggacactgcttatatgaagaacttaaaagtcttgcgtaatcgtcctcgtccatatcaacatcacatacatatccttcaatctcctcgtcatatacaaggttgttgcagtaatcgcaattatattgtgatgacatatctattccatctccttatcatctgctgtctggctacctgatgcgccattgagtcttcccatttcatcatatctttcaaggaaattatgcttaacgccatactgcttatacgcaataactgtatcaagattaacattttcaacgcttctgaaaatgttcttctcaatgtaagggcttaccttagtcaaatctttaataagctgcttaatctcgcctctcttagaacccttttctgttccaccgcatgaagcacagctctctgtaagcctgcatgcacactgtataaatgcaagattattataatctctccaatgtattatatctgcttctcttataagataaagcggtcttataagctccatgccctcaaaattagtgctgtgaagctttggcatcatagtctgaatctgcgcaccgtataacattcccataagaattgtttcaataacatcatcataatgatgacctaacgcaatcttattgcagcccagttctttagccttactatacagatatcctcttctcattcgggcacacagataacatggagactcctctatatctgcaaccgtatcgaatatctctgatttgaacacggttataggaatatcaagaatctttgcattattaagaataacctgataattaatatcattgtatcccggattcataactaaaaatacaagttcaaaattattcttcccatgtctcttaagctcctgaaaaagcttcgccataagcattgagtccttaccgcctgatatacagactgcaatcttatctccatcctgtataaggtcgtattcattaagtgcctgtgtgaactttctccatataggctttctgaacttcttgactatgctccgctctatttccttaactctttcttcacctgaaagctcattctctgcctgtgcttccttgacataattctcgaacttccacttcatataagcgccccagccgccatacagactgtagacctcataacccatttcttcaagaatatctgccagatcatcactgtgcagacctgtatagcacagaagatatataggaacgctcttatcaaactgctgtgtgaattcctcaggtgtttcttcaagcaccttaatcagttcctcccagtaccagtttcttgctccgggatatgtttccttctcgaattcctgcttgtctcttacatcaagcagaaccttttctctttcatcattctggtaatcaattattgttttcatcatcaacctcttcatcctgcgaatcctcaagaatacgcagtcctgccgtacttgtaacaggaagtgagaacacaatagttcctgccttgctgtctacgccggctttgtccattatagcacgcataatagcatttttctgtgatgactttgcaacaataagaattacttccttctctgaaacaagcgaaactccaaggaactgctctgcccgcttcattccaacaccttttccatgaagcaccgttccacctgttgcaccgccttcttccgctgctctcatcacctgtgtattatatccataattagctattgcaacaataagttcatgtttagtatccttcaatgtgctctcatctcctttcttatattcctgcccgtcaattaagaatcccagctctctcttgccaccaatactgcttagcgacactataaatgcgattccggttcctggcacatctattcttaacttactctgaagccccttcttaacattcttccatgtattctctgtaacaagtgacatatggatacccttctcgtcatcctcaagtcccagtaaatcaagtacatcacttgatgctgttcccctgcctaacgatatattagctgcttcaacattataatccttatagcaatcaacaaaacgcggcatattcttcctgctgcatattgttaccattacatatacttcactcatatccgtcacctctacaattcaataatcgcatcatctgaaagctctgcaaacatatccacaacaggtgcaacagtctgtggcacatttgctctcctgctgtccttgattctgtatataacaccaagtatctgcaaagttataagaggtgtcatggcaaccatggcaacaacaccgaatgcgtcagttacaatattaccgcctactgcgagacatgctccctgtgccagtggcagtaaaaatgtagctgtcatcggacctgacgcaactcctccggagtcaaatgctatggcagtgaatatcttaggaacaaaaagcgtaagtatcagtgctattccataacccggaataagaaaatataatattgagatgcctgtcagcactcttatcattgaaagaccaacagatactgccacaccaacagaaagacttatctgcattgatttgcctgatatgcttcctgatgtcagttcttctacctgacgcataagcacatatacagcaggctctgccttaacaatgaaatatccaattatcatgccagttggtacgataatccatctaaatgataatgaagcaagcactgatccaagataattacctgctggaataaatccaacattagcacctgtaagaaaaagtacaagtccaatatatgtatacacaagtccaacgcatatcttcataagcgacttcttattcatctttggagcaaatatctgaaacactccaaaaaacacaactatcggaagaagtgacagtgctatttctttcagatatttcggtatctcatacaggaacagcttaccaagttcaacagaatcgcttacttcagaaattgctgttgttgtaaaattaccctctgtactataaaccattccaagaataagaacagcaaggattggaccgattgaacataatgatacaagaccaaaactatcattgccggcatgtttatcgtttcggatagaagaaatacccacaccaagagccattataaatggtacagtcatcggaccggttgttactccccctgaatcaaatgcaactgcaagaaagcctttaggaacaaacatcgcaagtgcaaaaacaattgcataaaacactagcagaagcggtgctaacggtattccaaaaagtattcttaaaagtgcagcaacaagaaatacacctactccaactgctacagataatataagcaccatattaggaactgctgccacctgtcctgcaagcacctgcaaatccggctcagaaatcgtaattataactccaagaataaatccaattgctacaatcatccataatttcttagtccttaacatacttccgccaactctttcacccattggcgtcatggacaattctgcccctaaagaaaaaaacaccatgccaataataaccagcacggctccaacaatgaattcaaccagtatactaggtgaaagaggtgctattgtgaagccaagaagcaacactataagcattatcggtactaccgcactaacagactcctttgtcttttccttcatcttctctcttaccactgtattctggtaactaaattgtgtccttaataatccagccttcaataaaatctcccttcgctcttaaatatcagtttcgggttacatagtaatatattaacatctaataattgtactggctacttaaaattttataaaaagtgcccggatcagaacactttttataaattaaaactcaattataaattgtcattttctttctctctgagcagttcctcatactttaactggtatgcaatcagccgtggaatgtattctggtggagttctccttgatgcctcccagtcctctaatgtacgcacaggaatacctgtgtgctgtgaaaattcttttctagtcattccaacgctttctctaagctgttttattgtctctgctatagtcataatatatcacctcttaatgcatttttataattttaataaaatatagctttgataactggtttcatttcttcaatccattcattattaacagcatcataataacaatctttttcatagctggcctcctcaaaacaattgttttgatataaaattattatacatcatatcatataaagatttcaattctataaacagcatttaaccattatatcctattatcatttataaaacccatctataaccacaattttgctgtttcagttcaaacattcgcagttcgtccgcttcttttttctcacggctcctcactttacgctcctgtttattctgttcctgctgtaatttcaatgcctgctgcgattttgtgccgatgcctgtttcctgcatctgttttttcgcttcacgttgcatcctttctctgcctccatgtttgataattacgataatatatctgtacggcttgtatttcggtattcgcttggtgtaactttgtatcgttccttaaatacccgattgaatgttctctgactttcaaatccgctatcatagcatatatttgtaatggcatcactggtattttccaaacgatagcaagcataatttagtcttgcatcattcagatattgattgaaattacgatggaatgttttggagaatgttcgtgataaaacatacttgctcactcccaaatctcttgccatatcatctagcgagaaattctttctaaaattaccagacacgtacgatactgcctgatagacaagatctttacttcccacctctcctttctcgaccagtttcagctttccaatgcatcttgcaatcacaatctgcagatatgcctgtataactgctatatccatgtgatctgtatctaagatggcattaattgcccggtatacttctggctccaccatctctgcctttataatagggtaatccggtgccatcatctgtataatttcagcatattttccaatcgcaaacggtggagaaataatgtaaactgccttattcactcccggcgagaaaatctgataatgatggataatatccggaaatacaaagccgatatctcccttttccatgtgatataactcttgaccaactccaagctccagtgttccatttgtcacacatacaatctccaatgcattatgtaaatgcggagtgacatgcttcgattttctttttaaagttaatatttcttcttttgtatcaataaatgataaatgcattggttacgccccctttgcaagatttgtctaatttttctttcgatttggcaagcaatctcattgtattcattctataatcagcttgtaaataaggaaaggaggacttccaaatgaacaagtttaagaattatatgaacaaccttttagtattctatgctgattactttgaacatgtatatcatgcataaaatactaaaaggactgctttgttaacactgaatacctagtttgcagaccatttcgcaaaaatgaaatggttctttttataaatcatcaataaatctattgaatgctgcaattccatctggtgtccttttataaacgcctgcatcctctaaaacctttgtaaagacaattccgatttccttttgcacgatagaatgaatattctccgatgtaatgtcatacttaggaatccattcctccgcccagtctgcgtgagaagccatagcttcattctgccttagattttctccactcaagattgcccgctccaagtctgacatttcttttttcaatctcgctggtagcaccgcaagtcccataacctcaatcagaccaatattttctttctttatatgatgatactgtgcgtgcggatgataaagtcccatcgggcactcctctgtggtaatattgtttctaagcacaagatcaagctcatacaggtctccacgctttcttgctattggtgtgatggtattatgcggaacgccgtctgtctcgctaaatatatatgcctccggatccgaatagcctctccacttttctaaaatatgattcgccgcatccacaagctcatttatctctcttccttgcaatcgtatcacagacatcggccatttcacgattccggcatgtacattgggatatccgtccaaaacaacttcagattcatatggtgcctttgccattgcaaatacatagcctccaccctgaaaatgatcatggcttaaaattgatcctcctacaatcggcaaatctgcatttgagcctaatgtataatgcggaaactgtcttacgaaatccaacagcttaccaaatgttgccttgttaatcaccattggtatatgattataattaaaaataatacaatgctcattgtaataaacatacggtgaatattgcatgtaataatcttcctcacacaatgtaagtggaataattctatgattctgtcttgcaggatgcataatatgtcctgcatagccctcattttcccgacaaagcaaacatgcaggatatccagacttctttgtcattcccgcctttataatatctctaggatctttctctggctttgacagatttatagttatatccatcgttccaaaatctgtttctgtcgtccacttttcatccttctcaatacgatctacacggatgtaatttgttatctggctgaactgataataaaactgagttgcatgtttaggtgaattttcatatttttcggtaaattttcttcgaacagttgacggagctggtgtcaaaactcccataacttttgtatcaaagagatctctctgcgcaatcgtatcatctttcatgactccatttgcaatagcatatgcaatcatatcctctaagatcaggtgaagttttctcggctctacatcttcttctgatgccacatagtcatttaatccaaacaactccaacaatgaatttgttacatagacctcatctgcaagatcaatcagaccgtttttcaatccataatttaccagttcgttaatcaaatgattaatcatcacacatttctccaatccatcgtaatcctaaattaccttaatgccaccatacttacgaatcttcaacacatcgcaagctccgcttccaaacacttcttccatcccagtcttgtaatgttccacaagctcgtttggaacaaacgcctgaattgttcctgcgaaaccacctccgtgcactcggcatacgcctttatcttccaataggatttcactcaccgccagtgctaccgatacattctgatggctgacatcatgacatgtaaatacgttttgaagatacttaaaggatgaatctcccgatctctttaccaataaaaggaactctgaaaagttgtctttctttaaagcatctacttccttttgtacccgttcattctcacatataaagtgtaaagcacgaagtgccgccctatctcctgcctctgcacgtatcttagataaattactaaggatttctttctttgatacttctcctaatacttctttaccgaaacatgctgccgcctgtttcatctccatcggtattgctgcatagtccggtgtaagatctgcgtgagaacccttggtatctgtaatacataaactgtatccatgtacatcaagatcaaattcaacacgctccacctctggtttttgagaattctcaaaattgatatgcaccagacttccaaccgagcaagccatctgatccatcaatccacatggttttccaaagtacacattctctgcgtactgtccgatcatagcaatctcaatcgctgatatattgccttgattgtacatgtaggataagatagttccaatcagagtttcaaatgctgccgaggaagataaccctgctccaatcagcacatcgctggtaatatatgcctgaaatccaccgattgtatgcccattctcttttgtctttgctaatacgccacgaatcaatgcctgggtgcttccttcttctttatctttcttatctatgtcatccaaatgaatcgcaatcagattattataaccgtccgatacaatacggactacttgatcgtctaatttttttgcaacagcgatagcatcatggttaatagatgcagccaaaacctccccatgctgatgatccgtatgatttcctccaatttcacttctgcccggagcactatatatccaaacatcatcatcgccgaatcgtgtaatatactgttcaatggcttctatatatcgttttctttcatatggaagtttgtctttgtccacataaatatcagtcaatacatcatcacacattctcccgttaatcatctctattattgtgttcgccttcaaaatatacacctccttcttgcacaaaaagcattgcctttctcggatgttcaattagacaatgcttttcattacatataaaccttaatactctgttgcgtctgttacttcatcagacttaattcccttttcagcttttaatttttcatttgcagcttctacgttcattctggaaagaacaatcataattaacacatcaaatatcaatggcaaccataaatacataaactgcatcatatcaagtgctgactgcggctgtgttgcatttgttccgacataaccactaagctctaataaccagccacatactgcagttccaattcctccaccaatctttacaccaagtgatgtacaagaatacatagttccatcaattctctttccctgtgtcagataagtatactctgaacaagatgcaatcactgcgttcatatctccctgccatggtccctgtccaagggctgcaagggatgtaaatgccagcataagaggaacacttcccatatatcctgctacaacaaccaacgctctaccaataacggcaatgatatatcccctaagattcaacttgtacatacccttccatttaccaacgaatgtcggagttaagataagagctataataagtgggatattcacagcccaggcgaactgaccaaagaggtttttattcttcagcacccatgtcatatagtagataccggcaccaatcatagcactgtagagctgctgtaaaatataagttccacatatcatcatataatacttgttctttacaagcagtttaaatgcctgaaccaatccatacttttcttcatcgcccttaacttctccctcgttaagctcctcctctggaagttcttttacggagagtgctgagattgtatttacaatcagaccgataattgcatagataattgctacagttctccatgctgccgcatccccaccacaataatcaacaaattttacggttacagattgaatcaagagacttgtagaaaatgcaaaaataaaacgacaagatcccatctgcacacgctctttgctgttctttgtaatcaaagaagtcaatgcggaatatgcaatattatttgctgtgtagaacactccatttaacaatgtgtatgcaataaagaaccatgcatattttgctgtatttccccagcttgtaggaacagcaaaacaacataccagcgtaattgcacaaccaatgtaaccataaagcatccatggctttgccttgcccagcttactgtgcgtcttatctatcatcgaaccaaagaatatgtctgtaaatccatcaaacagcttagaaagtgctatcagcgtacccactatacctgctgcgagtccaacagaatctgtcagataaatcatcacaaatgatgtcaaaaatgcatatactacatttcctgctatatcgccggatccgtatccgactttgttataccattttaaatactttttttcttccatagaatcactcctcatcttaattaggtttagaatttcatgtgtcgaacagtctgatgctatattattctaaatgttttacttttgttcttttgtatcccaagtatcaccatatgtccggacttatatggcaatatttagggaaatgctgtgtcaacgagttacattattattatcccttcacatacggaaccagtgtaaaccggaaccggaataatctatcatcaaatctgtacgcatctaacacgtctggtccgcaactgttagagcctattccattctgtgcataatcaagacagagtaccgtactgtccgattctataagttcataattatgtgcttttttctccaactcctcctgcgtatagaaagaggcattgaatgaaaatgcatcttcttctgctatagctgttataccatactggctgttgccaagctccacataatcacagtcatagtgacttccgttttcctgtggacgaatataatcttcatgcatatctgaaaccttaagacgatacaatccatggcttgctgctctatgcttgtcccggtagctttcctgcggtcccataccgaagaaccctgcatctgtaagtttcttatctaagaacatcctcacaccaaatcttggaagatcagggaattcatcattctttttcactacgatatcagctccaattcttccggctgcgtcaatcgtccatatgagtgtcacatcaagaatcttctgcacggttggtgctacaaccgaagcctgacttacaacagtcactccgtgctttccttgaatcacctctgacttatatgctcttgtatatgcttcattgtagtgtgctttcttccactccgccttgatatacatatcattatccgtcggcgctctccagatattcagttccatcggattcttcagatattctctgcctgcaaatattaaactgtcaaaaagtgctgtccgtttgttgattatataggaaaactctcgtccctttatgttgatctctgtatcattctcctgcacctgaatacgggtatccggtacttcctttgtaagccagcttaatgcctgctgattctttgcacccttactgcttacatctatctcatcaaaacctaagacatactccttggaaagaagcaggatgtccttcttcagcttatagaacagcttcagatatacctttccattctctgggattgaaagctttaaggttgtgcttccatcacaatgcggtaaaatggatacttcggaaagcttccccttacctattacaagcccatcctgtgacagctcataagtaatctctgcataatccttcagatcatcaaaatccatatagttgtgaagcactaattctccacttgctgcatcatacgatactactcttgccggtcggtatacattcttgtactccaaaagtccggtgtgtatccttctgtccggatataccagaccatccatacagaagttgctgtcatggattacttcgccatgatcgccaccataggcatatatcgtcttgccattttcggctacaccatggacgattgcatgatcgcaccactcccacacgaaaccaccgcacatcttatcctctgcctgtatcatctggaaataatcttcaaaatctccaggaccatttcccatactgtggcaatattccaccagaaggaatggtttgctaccatccttttccaggtattcctctatctcagtaagcgccggatacatacggctgtataagtccagattctcgtaatcataggttacatcgtaattgcggtatctggcactctcatactgcgtgatccgctccggatcaaattcctttgtccatgccagtgccttctcaaaattgcagccataagcactttcatttcccatagaccacatcacgatacagaaccggttcttgtcacgctccaccatcagcttcacacggtcaacaatcgcagcttcccattccggattatctgctatcttctcattccaacgcttaaagcggttgtaatccgtatcctcttttcgatacagcataaatggtccgtgtgcttcaatatctgcctcgtcgatcaccataaatccatagcggtcgcacatttcataaaaaaatggtgcatttggataatggctggaacggatagcattgaagttatgctgcttcatcaaggtaagatctatcttgatttgctccatgctgattgtaaagccagtaactggatcggaatcatggcggttcacaccacgaaacttgatcttctgtccgtttaagtagattacctgatctttgatttctatcttgcggagtgctatatgatctacaatcacctcctgctctgtctcaaaaataatagtgtaaagataaggattctctgtattccagagcttatagtcaacaatctcaaaagtagctttaccgtttttgtcaatcactccctcggaaacaactgcgccattcttatcctcgatctttacccgaacctctaccggttcatgaaagcttactgtaagatctatctttgcaatgtctgcatctaattctgttgtaatatgataatctcgaattgccttttccggacgctttaaaagataaacatcacgaaaaattccactcatacggaacttgtcctgatcctcaaggtacgaaccgtcgcaccacttcatcacaagcacagaaatccggttctctccttcccgcaatacgtctgtcacatcaaactcactggtcatgtggctcacctgactgtaacctacataggtgccgtttaaccatacataaaagcagctatccacaccttcaaagttaagatatgcctttggtgctgcatcatcccttgcatagccaaaggtatgcacataagctccacatggaatatcctgtggcacatatggcggatcaaacggaaatggataacggatatttgtgtattgatgtgtatcataacctgccatctgccatacactcggaactgcaatctcgtcaaagctctcaaccgaataaccatcctcataaaaggcatccttcatatcataaatactgtcaaaatactgaaacttccatgtaccattcaaaagctgcattctgtctgacagctctctgtgctctaccaagtcatccatccgctttgaagccggcatgtaataggctcttgccagcatcgtattgtcatgtaatacgcttaagtcctcatagtaacgtggcacgatcataaatacccctccttcattcatacagtttatacacttttttgttgcttgtaaccctgctaacaattttctccttactgtctgcttttttccttcacgcttttgttaaatttatgttaccttaatccagttcttatgtctataaactagaatagacaaaatatgcacaaaatgatacaataatcccatcaatcagaaaaggagtgctgccctatgtacatgaataccggttatttgaaccattcacatatggattttaaggataaaagccgaccactgattgtcggtagctgcggaatctatcgtttgtccgagctcccaaagatgccaacctatcgcccaagaggacgtgttgattttcagattatatatattgcatccggatgcggacattttcattttgatactgttgataacgaaacaattgttcccgctggtaacattgtcatattccgcccaaaagagcttcagaaatatgaatactatggggaagataagacagaagtctactggattcattttactggaagtgatgtaaaaaacatcttaagaaaatatggtttcccagataacgagagaatattcccagttggtacatccatggaatatgagcgtgtatttaagagaattattatagaattacaacgttgtcaggataactacgaagaaatgctcacattattgctccgtcatcttctgatcatattccaacgtgagcttaccagagagcatgttttaaaaaatgaatatctcaaccacgagatggataccgccgtgacatattttaacgaaaattataaccgtgatatcaatatagaagagtatgctacatccaaggggatgagcgtcagttggttcataagaaacttcaagaagttcacaggttctactcctatgcagtttattgttgcgctccgtgtcaacaacgcacaggttctactagaagcaacaaattattctattaatgaaatatcaaaaattgtgggatatgataaccagctatatttcagccgattatttcataagttgaagggggactctcctagagattatcgaaaaaacagaaagtcggaaatataaaactcgtgtagtgtccacatagtagtcatagtacacgcacaagaagtaattacagtattatgactgtttttacaggtgtaagaaaaaagaattttttttcgaacttatacaattgattcattccaaacatcctctcactcaaaaatcctatgccagttactttgcacttagcataggatatttaagtttatcttgtgttagagaattgtttcagaattgttaattttcttcttttcgctctttccacactgcgaatttggacgttacaacagcgcgtagcacagcagacgtccaaaaaggagcgtaccaacccatctataaaacatttcgggctgacacgttccatatatacttcatatatgctccatataagcttatgaaattattccatccgaaccaaaaggcacacacattcaacatgcaccgtatgcgaaaactggtccacaggctgcaccttaacagtcttgtaacctttagccgcaaggagtcctaagtcgcgggcaagtgtagccgagtcgcagcttacatacacaatccgttctggtgacatcttaacaatagtatcaagaagcgactcatcgcagccctttctaggcgggtcaacgactacaacatcaggagtaatgctcttttttgcttcctcacgctgagcttcggttgcagatgtgtctgctgccagccgcgccatttcttcataaaaatgtggtacgacctcctcagcctttccgacaaagaattcagcattatcaatgccgttaattgccgcattgttcttagcatcttctatggcttgcggaacaatctcaacaccatatacctttcttgcattcttggcaaggaataacgatattgttcctattccacaatacaagtcccatacagtctcattgcctgtaagtcctgcgtattcaagggcttttccgtacagcttctcagtctgtcttggattaacctgaaagaacgaaagcggtgatatctgatacttaatgtcaccgatataatcttcaatatagctttttccccacagagtctcgcactgtctgccaagaataacattagtgttctccgtgttgaaattaagcataattgatctgatgcatttgtctgtacttatatctgagtcaagcgacacttctgtaaggcgccctacaagcgattcctttaacttatcagacatcttagtgccgttaataacaagacagaccattatctcgtctgtgtggaagcctgttcttataaggacatgacgcacaagccctcttccggtctgttcatcatatggtgcaacaccgttgagctccatccagctctttatcacagcaagaatatactggttctcgacagcaccaatcttacagtctgtacatgagataatagaatgagttcttcctgcatagaagcccatcacaatgcttccatctttggcagttccaaccggatactgcgctttatttctgtatctgaaaggctcttccattccgattgccggaaaaaactcatacccttctatcttaccgattcgcttgagattatcgtcaaccagcttttccttaaatctaagctgtgcctgataactcatctgctgaatctgacagccaccgcactgtcttgcgacaggacaggcaggagtcactctgtcagatgaagcctcaataatcttttcaagccttgcatagccgtaatttttcttggctttaataatttttgcctcaatcttgtcgccgattatcgcatccttaacaaagagggtatatccgtcaaccttgccgataccctctcctccggttcctatatcttctattacaaatgttactttatcatctttcttaaaactcattagttgtccttcttatattagaatcaagccatctgttataaccaagccagtcgttggtatccttggcttcaagtgcttcccttaatgtctcaagctttgcatccatattatcagccatagataatgcaacagcctctgctattgatggcttcttaggtgagccgtactcaagctctccgtgatgtgaaagtatgcagtgtccaatctgcattgcaagcatatcagggaatccgtctatctgcttaaccttctccataaccatctcatatccaataacgatatgtcctaagaaattaccctcgtcagtgtaatcattcttaggaaattcagataattccttaaccttgccgacatcatgcagcattgcacatgttataagcagatccctgttaagaaaatcatagttgctgctcatcttgtcacataatcttgtaacacttaagctgtgctctaacaatccgccagcgaaaccgtgatgtactgtcttggctgctgatacacatttgaacttctttgcaaatgtttcatctttaaagaaagaatataacagttgcttcatatatgtactcttaacactgtctacatacttcatcagttctgcaaacatattatcaatattatatcttgaagatggtacataatctgctgcaacatattcattctctgatgcaattcttgctctctctatcttaaactgtaatgctccgttatagcttgttacctgtcctgttaccgcaacataatcattaacatcaaattcagcaattccgcctgaattaaggtcccatatcttagagtcaatctgtcctgtcttatcagcaagcattacattggcatattccttgcctgtcttagtaagtgctattgattttgatttgcacagatatacctctgaaattctctcaccatctttaagagtctctatataacgcataaatccttctgcctccgttaattaagttgttttagctgtacacttactgaaaatgctacatctgaatagccatcttttccctgcctcatagctgtcacatacatagcttctccatcagcgcactgatatagtttctcactaaactgctgaattgtcaaaacactttgtccattaattgcactaattacatctcctgcctgcaatcctgcataataagccggtgaatcaatatccacattagatatgtatacaccactcggaagtccgtatttggctgcaagctcctctgttacattctgtcctgtaataccacagtacatgattccatgctcattaatcatagtctcaatctgtgccttaaggtcagatattccaatgaatttcgaacttgtatctgttgaagccttagatacaccaactacatttccttcagaattaaacaatatggcaaaaccgcccgccgtaatacttacacttgtctcaaaaacctcataaccgctgtctttactatactcaaccttagaacctgcaattgttccgtatgacacgcctttcgaagtctcataaagctttcctgatgcaatcacaagatctccctgttttaccatataagaattatccagctgcgcaactgcgatactgttacgttgttcagctgtaagcttagatgcattaatactcacaattcctattcctgaagctgtatttctgcatacaaatgcagcttctgtctggacttcatcagaaagccttactatataattcattccaggttctaaaaggcttgaacttgtaagcacaagatatgttgaattaacattggcaaccacaagtcctgccacctctgtctgactgctttcaattgtcggaacattagaaaatggctgttcaatgtcaacagaaaccacacatttattaacatcctcaacttttgcgcgaagagctgccatagcagcctcataattatctttcaggtccttctctgtcaatatatctgaatattctgccgtctggttctctgcaagtatgtaattatccttctggatatatatgacattcttgtccttattcttttcttcaatccttttctgtaataccggatataaaaataccataaacaaagttgccgctattacgacagaaacagcaaaaagcagcaacttgcctattcttataagccacttgtatttcttagccggatgaagaactacctgttctgtatacaggtcatacttttccttatcatcttcattagttcccatttcggactccttatgtaattttcgtctcttatgaatacaattatatcatagtttatattacgattatgaacaatttatgacttacatgtaaatatttataagcaaaatatagtttttttaccttaaatgctgtaaacttataaagtatgaaaagattgtttttagtttttggaggtctttcgtgaataagaaatctttatccactttggaattttataaaattaccgaccagcttgtttcatatgcatgctgtgacggagctaagaaaatacttcgtaacttaaagcctatgactgatataacagacatcaacttacgtctcgatgagactaatgatgcactttcaagaatttttcagaaaggtactgttgatttcagccagactaaggatatacgtgcttctgttgcgaggcttaaggttggaagctcccttaatatatcagaacttcttaatataagtgccatcctttcatgtgcaaagcatgttaaggattactatgagcatcgtgaggattctatatcagggatgcttgaaaaccttgcaactgttgatactctcaattcccagattaagaaatgtattatctctgaagatgagataagtgatgacgcaagttccaacttaagaagtatcagaagaagcaaatcaatagccaatgacagaatacattctgaacttaacaaattgcttaattctcctacttacaggacttatcttcaggattatgttattaccacaagacagggacgttactgtctgccagttaaagctgaatataagtcagcatttcctggtatgatacatgaccagtcatctactggttctactctctttattgagcctgcagcagttgtaaagctcaataatgatatccgtgagttagagcttaaggaagcagcagagattgaagttattcttgctgacttaagtgtgaaagccggtgaacatactgaggagcttctgtgtaattatgaaatacttgtcgaacttgactgtatatttgcaaaggcgcagcttgccagacatatgcatgcaagccgtccggtcatgaatacatcaggaattatcaatatcaaaaaaggacgtcacccgcttatcgagccgcatactgttgttcctattgacatctatctaggaacagattttaagcttctaatcatcactggtcctaacacaggtggtaagactgtttctttaaagacagtaggacttcttacacttatggcacaatcaggtttattcattccggctcttgaccattcagacattgccgtatttaagaatatatacgctgatatcggtgatgagcagagtattgaacagagtttaagtacattttcatcacacatgaccaacactgttaagattcttaaagaagctgatgaaaactgccttgtactttttgatgagattggtgccggaactgaccctacagaaggtgctgcccttgctatcgcaattcttaatgaccttaagatgcgcggtgttacaaccatggcaacaactcactacagtgaaatcaagctttatgcgctttctactgaaggtgttgaaaatgcaagctgtgagttcgatgttgaatcgctccgtcctacttacagactgcttataggcattccgggaaaaagtaacgcatttgcaatctctaagaaactcggacttcctgattatattctctctgacgcatcagaaagacttaacgcggaagatgtacattttgaagatatcgtatctgaccttgagcatgcaagaatttctcttgagaaggagcaggctgaggttgaaagctataaggctgagattgcctctcttaaagaaaagcttcaggctaagaatgaaaggcttgatgaaagaactgacaacattatccgtaaggccaatgaacaggctgctgccatcttaaaagatgccaaggatttcgcagatgaaactatcaaagccatgaacaagcacggaatgacagttgctgagcttgaaaagcaccgtactgctgtccgtgagaagatgaataagaatcaggcaaagttaaaggtagagcctgccaaggttaaagcacacaaggcacatgatatatctgaattcaagacaggcatgcatgtaaaagttcttactatgaatgtttccggtactgtttctgcaattcatccagccaagaagcaggttactgttcaagtaggtgcattaagcactaagattgatatcaagaatcttgaaattctttcagactataaagagccaaaggaagctccatctaaggctgctggcggttccggtaagattaagatgagcaagtcagcaggaatatcaactgagattaatcttctcggctgtacagttgacgaggctgttgcccgccttgataaatatcttgatgacgcttacattgccaagattccacaggtccgtatcgttcacggtaaaggaaccggcgcattaagaaacggtgtaaccgcttatcttcgcggtgttccatatataaagagcttccgcctcggcgaaatcggcgagggtgatgctggtgtaactattgttgatttcaaataattattattgggggatattattatggcatctaaacagcgaatacttattgtagatgatgatgaaaatattgcagaacttatatctttgtatcttacaaaagaatgttacgaaacaaagattgtgtatgatggagaaagtgctctgtctgagctttctgtattcaagcccaatctcattcttttagacctcatgcttcccggtattgacggctatcaggtgtgccgtgagataagaaagaataacaatgttcctataattatgctctccgccaagggcgaaacatttgacaaggtactaggacttgagcttggtgcagatgactatattatcaaaccttttgaaactaaagagatggttgcccgtgtaaaggctgtgcttagaagataccatatgcctcagagtatcggtgttgattcttctaatgccaaatgtgtcaattaccccgacctctctatcaacctcgataattattcggttaattatatgggcaaaaatgtcgagatgccgcctaaggaacttgagctcttatatttcttagcctctgctcctaatcaggtgtttacaagagaacagcttcttgacaatatatggggatatgaatatatcggagatacaagaaccgttgatgtacacattaagagaatccgtgagaaaatcaaagatcatgcccactggaatattgaaacagtatggggaattggttacaagttcgtaactaaataaaaagggcagaacaagggaggcagactaacattgaaaggattcagtacactcagcaaacacattttcatatatatagctatatgtgtaatcagttttattcttgtatcaacaatatgttataaagcagattataagcacatatacaattattattctgacagactgtatcttcaggctaatgaaatagcaaacgaatatgctcttgattatcttgcagaatccaagctgagacgaatagaacttgaaatgaaatcattatccacatttaacgacaccagaattatgttcattactccttctggtgatgttattcttgatactaacaacagttccacggacaagagtaatgaggacaggattttattctcaatcaatgattttgactatggtgacctcaaaggaaaacacgatattttatgggatttttacggactgttttccgaacctgaattaagtgttttttcgcctatctcgaactccttcgaaattaagggttatgttgttattaatatacctgaatctgccatcgttgaacgcgtttatgacacatttaacacaaattatcttacacttgcaattgtacttattctgtcatctgcattccttgttctatatttctttcaggttcacagacctattaaagaaatcacaagggcaactaacgaatacagtaaaggtaatctttcctaccacgttaaacctatgcataatgatgagattggacgtcttggaatgtctcttgattacatggcttcacagcttaatgaatcagataaattccagcagaagttcctgtctaatatatctcacgatttcagatctccgcttacttctatcaagggatatctggaagctatccaggatggaactattccacctgaaatgcttgataaatatataggtataatgctttttgagaccgaaagactcactaagctgacaagtaatattcttactcttaatgaactcgatcctaagtcagtaagacttgatatatcaacatttgaccttaattcaataatcagacacactgttgagacattcgagggaacatgcaagaagaagggcattaaattcaatattacatatgctaacagtgtacagaatgttaaggcagacaagggcagaatccagcaggttatatataatcttatagacaacgccattaagttcagtaaagaaaattcttacatatacataacagtcaaggaaaagggcgagaaagcgcagatatccattaaggatacaggctgcggaattgccaaagaagatattgataaaatctgggacagattctataaatcagactcttcacgaggccgtgacaagaaaggctccggtcttggtctttcaataaccaaggaggttattcaggcacatggtgagaatatcgatgttgtaagtactgtaggtgtcggtacagaattcatattcacacttgaacttgcaaaataaaaacacacggacatgcgtaacttgtatgtccgtgtgttttattattattccttccagttaagtctgtgaagatgtccttcgcaattcatgtgtgaaaaattatgctgtcggagtgcttcataaagaacgattgccactgaattagaaagattaagtgatcttatatctcctatcataggaattctgatacatgtatcctcattatcaacaagtatctcttctggtattcctgcactttcctttccaaacattatataacagtcttcttcataattaacttctgtatatgtcttatgtgccttggttgtagccatatacaccttagcacccggattcttagcaagaaaatccttataatcatcatactcagtaacatcaagcttatcccagtaatcaagtccggctctttttaacatcttatcattaatctgaaatcctaatggtcctataagatgcagccttacgcctgttgccacacatgttcttcctatattacctgtattagccggcatctccggctcatgtaaaactatattaatcatatccttatcagtcaccttttactgcaatatcaagttccagaaccatgctaccatcactagacatcggtatacatatattcctggcatatgtctgcgaaatcttcatagctccacggcataatgtaggtggggtaatatcaataccaattcccttagttgaaagaatagtcgctgcattacccattatcatattaccaagttcacttattgcactcattgccatctcatcaagctctggaaccggcatccccatcatcatctttgatgcaatctcacatgccttggtaatcttcatggctatcatgacctgacctctcatctcacctgtaatacctatcataattataactgaatcctctccaaattcagttgttttaacatatggttttcctatactcatctccatctgacaggcatcacgcaatattgtgcctgctgccatcagaaatggattaatatggttgacattaatctctgccatattcattcatctccctacttcagtgtattaataaacttttctattctttcaagaccttgtttaaggttgtcaattgaataagcatatgatattcgtaaaaaaccttcaccacagtcaccaaatgctgttccaggaacaacagccagcttctgctccctgagtagtctgtttgcgaattcttccgaagataagccaaacttcttaattgaaggaaatacataaaatgcaccaaatggctcaaagcagtcaagtcccatctccttaaatgcatgcatgagatatcttcttctctggtcataagcttcaaccatcttattaacttccatatcacagtttttaagagcttctattgcagcaaactggctgttagtaggtgcacacataattgcaaactgatgaagcttagtcatctggcttataatttcctttggaccgcacgcatatccaagtctccaccctgtcattgcaaatgctttagaaaaaccattaataacgatagttctctccttcatccctggaagacttcctattgagcaatgctctccattatatgtaagtgctgaatatatctcatctgatataacatatatatccttctcaattatgacaggtacaagctcttcaagctcctcccttgtcataacagcacctgttggattattaggaaatggcataacaagtaccttagtcttatctgttatactggcaagcagctcttccttagtaagcttgaactcattctcttcctttagttctattatcactggctttgcatcagccataattgcacatggaagataagatacatagcttggctgtggtataagcacttcatcccctgggtcacacatgcatcttaatgcaacatcaattgcctcacttccacctactgttataagtacttccttcataggatcataatgaaggttcatctttcttgcaaggtaattacatatctcttctcgtaattccttaagacctgcattagatgtgtaaaatgttcttcccttctcaagggcatatattccttcttctcttacattccatggagtatcaaaatctggttcgcctactcctaacgaaattgcatcaggcatctcacttacaatatcaaagaattttcttattcctgatggctgtatgcctgttattttctgtgataatgggtttctcatggtgtaatcagcatcctttcgtctttagcctcgtcctctattattgttccatagtccttatacttcttaagcacaaaatgtgtagatgtgctaaggactgaatctaatggtgcgagcttcgccgcgacgaactgagccactgacttcattgatttgccttctataataacagtaaagtcaaagcctcctgacatgagataaactgatgttacttcatcatatttgtacaggcgctctgcaatactgtcaaaacctaatcctctctgtggagtaaccttaacctcaataagtgctgttactttctcttcactagtcttatcccagttaatgaccgcattatatccgcagataatatgttccttctccatatccgctatttcattggcaacctctgcttcagaatagccaagcataatagccatctccttaaggtctatccttccattcttttcaagaacatcaagaatcttctctctcataacgcaatcctcctgctaattatataaatctgtatatttcatcctgttcaggaagccctaaatatctgtcttcctctgtattgtgaataatccggttgttaccatcagttatcttaccaatgacagcggcctcaattccattctgcttcattatatttactatatcacatccattttcacatgtcattaacaaacatcccatagaatccaatatatatggattgatattaaataattcacatatttcaattatctcctgttttacggaaatatgcctcaaatctatatccagacctgtacctgaatattcggccatatcccacagtgctgcaaatatgccgccttccgatgcatcatgcattgccccgtcaatattctgctttataaatatctgtgcctctttagctataatgagttcttcatcagcagcaaatgccttattaataacgtcctctggcaaaacattaagtatctcatcccttttgtgtgatataacagttctaataccactcattcctatatgctttgtcataacaatatcctgccctgcaacagctttctgatgtgttctgagcttatgcccaattgcagtaacagaaacaaccggactgttaacattcggacatactgtagtatgacctcctgcaattcctacaccaacaacctgacactgtctgtcaagttcctttattatctccttaagacgtatttcccttgatttctcatctattataattgtattcataatacaatcagccgcaccacctgcggcacttatgttattaactgccctatatacagccagacttcctgttgcagcagctgcaagcgtatcccatccctgactatgtatatgcgccgcatcctgtccatatgccggttttgaagtatttcctctcctgccaagcagtttgaaaacagacctgtcaaggattgtatcagacacttttcctcttttcatatcacttatctctccaaaaatgttgcataaaattgttaataattctatactcttatatagcttcttcagtgaagcaattcaatattaaggtataaggtatgcaaccataggaacaaccattgctacgatcagtatcaatataagtattccggtaaagcatctttttgttttcttattattgaaattaatcataattacctccacacaattaagcagcggggctacacgaaaaggaatatattcatgcattttatactgccatattttatcatactcataatcatccttcagtttgccataaaaaaaagcaccaagaatcacaaatcaagaaatcagcaattccttgaacgtgaatcaagagccaatcaggtacgccgtaaggacattagcaatcttaattatatatcaattccggataatcttccactgattaattccggtaatgaaacatttaaccagttactttccaataattctggcatgatgcgttcatacaacacaattacaggacttaaagataagaaaatacttaaccttaccggaataagcaacactgaacttaagctgtcatatggagctgctaatcttacagagcttactgaatatgatgacaatttcactacactcataaaagcaatcgcttcattaggtcatgcgcttattgataacaacgacacagctgatgccctttcattccttgagtacggaatcagcattggctcagatatatcctcaaactacattgaccttgcaataatatatgctgcaacagacagatttgacgatatcagaaaactaaaagaaaaagctggaatgcttaaaagtctcagccgtgataatattattgagcagcttaacaatatgctaaaatagcacagtacgaattattttccatactgtgctattattgtatcaatctgtcttgacgccatgcttttcgtcatctcttcaaccggaatctccagattaatattgtgcttttctacaagagctgcaagatatcttctctgaggcggcgttataggtgaatctttctttacaacgtataccagcttcgtagtattgctgaaactattatcttctggctttaatttttctaatttcccataaagtacacttgcactcactgcatcatcataagccctgtgtgaccttcccggatcaatattaaaatactggcacaaaaaagacagattcttatgttccagctccggaagaagccttctggcaatctttaatgtatctattccatcatcagtaatagtatatccattattgactgctgctctcttaagaaaactgaagtcaaatgtaacattatgtccaagtattggccagtcacctataaaacgcgttatgtctcctataatttcttcaattctcggcttacctgccagttcttcattatgtatgcctgtaagctctgttatgcgctcacttacacttattcccggatacacaagcgtagaatacttctgtgttatctgcccatattccactcttgccattccaacttcaataattctgtcaacagccggattaagacctgtagtctcgatatccagtgcaacatatctgttaatcatgttttctctctttcaggaatattcttcctatgtaatcacctataatagcaaggaaattcatgtcgctctctgcccatttcctgtcaagcttatatcttccataagaaataatattgttattcttcttaatatctcccccgataatatattgcacagcctgaacaattccatattcagaatacactttatataccgccggagcctttgtttcaaaaaagttgatgttatctattacaaatatgccatcttccctaaagttgggaatataattatcttccttgaaaaagcttccgtcatcatctgtcatacgctggtcaccatacaggatatgctttgtcagctcagttctgtcatatattgcaatagtattaacattaaatgctactgccacaatatctatcagttcctttcttcttgcgtcatcagcttccttgtattccctgataatggtattaacaacctccatcttatggtacttgtaaaacactttatcattaagatcaacaatccttcccatcccatatacatattccctatgaatatcctcatgataaatgatatatctgtcctttcctttttctttagcaaggtaaagaaccttatcagctatcttaaataattcatcataactcttggcatcattaggataagttgctgaaccaatcgaacatgtaatcttaatattacgtggatcatcatgatacagccattttgtattattacgtactgttcttaaaacattccttatcccctcgttatcattaagtccttccataacgataaacatctcatctccgccaattcttccgcacaatcctctgcttccaactgcatctcttaagatgtctgcaaccttataaagaacttcgtcaccaaacatatgtccatatgtatcattaatagtcttaaaatcatcaacatcaataatagcaattgttacagtatgtcccggctgtgaatctataagctttcttacataatcagtaatagcacgcttgttaagcaggtctgtacccggatctttcatatcagatattatgttgagctcttcaactacatgattatctgaactctcaagtattataatagtacctataacgatactgtttccatattcatcaacaatcgtattacctcttgcaagacatttatccagtcttccaagcttattaagagtattgatagtaatctcccgcttgaataacttctcaccattagcaagtgccttgcagaatccatcaagttcttttacctcattcagcccaagtgcatcagtctttatcttatcttcttcccatgcatttaatgttccacggtaaaaagacaaagtctggtgtccatctgatgtcataaatatattaaagtcatcgttaagtatatcataagaaaacaggacattctcacacatgccaagatagctagaatatctcttaatctgcgaattaaggttatctatctgtgtagtaattaatgcggcatcaataatattaatttcatacatatgacctcttgtctcagatacaccgccatctgtaattcttgtaagcatccagtgatattcgcctgtctgatataacattcttacaacaatatacttaccggattcagcgtaatcctttaatgcttctgtaaatctgctgacatcatcaggatgtatatatcttgtatatacaaaaagtgcattattacctgaaatcgcttcaaaattttcatctgctgttacaattgacattttctcatcaataagaatgtctgaattaacagtctcagctttaaacaaatctaccatagcttaaacctctgctttataattgataatgccctctccctaatttacctgaattcatcaggatgttcctttgtatatgtttcatacagatctggtctgtatttcttagttctctccagtgacttttcatgtcgccacttttcaatattagcatgatgacctgataaaagcacctctggaacagctttcccattataatctgctggtcttgtgtattgcggatactcaagcagaccatctgaaaaactttctgtttcagcagattcttcattattaagaactcctggaacaagtcttgaaaccgtatcaatgacaaccattgccggcagctcgcctcccgtaagaacataatcacctatagatacaaaatctgtaactatattctccaatgctctttcatcaattccttcataatgtccacaaagaataaccagattatcctctttggcaaactcctctgccatgctttgtgtaaatgtatagccctgaggagtcatataaacaactcttggcctttttccaatgttccttacaatatcctcatagcaatcacacacaggagcagctctcataaccattcctgcgccacctccataagggtaatcatccacttttaaatgcttgtcattagaatactctctgatatcataagctttaacggacataactcccgctttaattgcacgtccggttatacttgtattaagtccatccataatcatatcaggaaacaatgtcattacatgaaaatccattacttcactcctgcaattccattaagtaaaaatgcataatatccactcttaagattgtatccactatctgtataagatgatccaaaatatcctgagccatccttgtaaacagatgcaacatcaatataagttatcccaagtgaagccgcattctctgaaaacttgttgttaagtgaatcaatattagcctgtttaaccttgcttgaagattcaaatctctggcttaccggaagcacagaaagaacatatatatcagcagctggtactgcactcttgactgcttcaataaattccttctcatacttatatatatcatctacagatctgcttccataattaaggtcattaataccaaccataatatacactgaatcaggtgactgggatacgatactgtcaagatatcctgtaagcttgtcacttgtcattgaattagatgctataacctgtgcatcaggaagaaaaccaaactgtgaaataccgcttacaacaaaatcaccaataaatactgccttgctgtatgctgatgaagatgtataatccactgtctctggtgtacctgaaacagataaagccctgcctgcagcagctgctttggtctgctcggttacattctccgtagactccttagattcctgtatcactggtgctgtactctcctgctgtacagaaggagttgttgctttagtatcatcctgcctgccgctgttcttattgctacagctctttaacacaattgcaaatataataactgccacgactaccactgccagtccggcaatataatttctgtatctgttccacattcttttcttgcggttaagactaatctttggtttatcattattagaattatatgattccattataatattcctttctgtttcgatgctgtctcattgcattataacattagtcctgcccttgtgcaaatacaacatacagcatcaccacttcatcttatgaagaaccacagctgaagtctttcttaatccaatatcaagccagccattctgaaggtgataaccaagcctgtctgtactgtatccaccttcaaatgtaactaacagctgctcaacatcatcatcaaagccaagaccaacttcccatgcaggaattctggctctcacctcatcatcgttattattaacaataatgattgcagcgtcatcacttgtaaaccttccatatgcaacaacattatatgctgaatacagtgacttatatgaaccttttcttaatacatcattctctttatgcatctttattgcaaccctatggaaatcaatcagttctgtatcctcatgtccccatggataagttcttctgttatcaggatcagtgaatccacacacacctgcttcatcgccataatatacagtaggcgcgcctggtaatgtcatctgcataacaacagcctctttaaacactgccttgttgacattattattggcagcctcaggtcccagtgtattagttcttccaactgtcctgttagttcttgttaaaaaccttgaatgatcatgattagacagttcattcatagatattgcaacactctgtccgcccattcttgccatattatgatgcatggcaccaaaaaaatagtctggattaccatatgaatcaggtcttgcctcatcactgtgcttttccattcctgtaagaaaccatgtaacaggctccataaaagcatcataattcatgatggtatcccattgatcaccctgcagccattcatatgaatcgccataatgttctgcaagaataatagcatcaggattagccttcttaacctcttcccggaatctcttccagaaataatggttatattcaggactatatcctaagtcagccgccacatcaagtctccagccatcaacattgtatggcgcagaaacccattttcttccaatagaaagaatatactcctcaagttccttagatccttcataattaagcttaggaagagtatcatgtccccaccagccatcatatgagttattatcaggccactggttagaataaaatttaaagaaattatgatatgggctttcatacctttcgaaagctcccggagcatattcatcagtactgtctctgtaaatgtgttccttatccagccacttattgaacgaaccacagtggttaaacacaccatctataataaccttcatgcctcttgcatgaatctcctgcacaacctttgcaaaaaattcattgctggcttcaaggtttgattttcttgtaactctgttaatatatcttgtagcatgggtattatccgtgtcaccttctttaagcacttcaccctcatcatcgacaataactccaaaatgtgggtcaatataatcgtaatcctgtatatcatacttatgattagatggtgatacaaataacgggttaaaatatataacttctattcctaatccctcaagataatccagtttgtcaagtacacccttgaggtctcctccgtaaaactcccttattcccatctgggcaggatacttattccagtccttaacctgacagacatgctctccaatataattatattcatcatcaagcacatcattactcttatcgccattatagaatctgtctacaaatatctggtacataactgcaccctttgcccactcaggtgtcttaaatcctggtgtaatctggaaattataatacggattaagatctttaatcgccccaatctgattgtaataacacactgttctgccaagctctaccttaaaataataatatattttgtcggttccgacattaatcttagcctcataataatcaaacatgctctctgatcttactcttgtcataacatgttcaacattatccacaactagatatgctttatctacattatatcttccagtacgcagccttatggtcacctcatcacctggcactggctctgccggacttctgtaatcacttgtaacatccgaaaacaacgctcttgggtgtagcgttggtcttgcactgcacatataaaaaagtcttttttcccaggcagctaagtttcccatttccccggttattctcatagagaatcctccttagcatatactattctgattttatatctaaaagtacattttagcaagtgaaaaggatttttaaacagcaaaaaaggcagccatggggtgactgcctttttcagagaaggtatttcttttcgataagcattgctgctttatctataatgtattgggggtttttacattaattataatatcttatttccctcaataagtgttcacaaacatcactaaattcattcaaaaaatttgtgcatatttactatacaattgttgttcccataataccatcatcatctgtaccgcttccattatcaaaaagtgcttcaaattcttctcttgttaccttttctttctcaagaagaagttctgaactcttctctaatacatccatatgctcagatattatcttcttagcctgtgcataacagtcatcaataatattcttaacctcttcatcaatggctgtagcaatatcctcgccatatggtcttgtatgtgcaaggtctcttccgatgaatacctcatcctcatcactgcttgcataattaataagtccaagtctgtcagagaagccatacttggtaaccatatctcttgctgtcgcagttgcctgcttgatatcctgtgacgcacctgttgtaatatcatcaaatatcagctcctcagcaactcgtccaccaagacttacaatgatattctgtaacatcttgcccttggtattaaacatctcatccttctcaggaagtggcattgtgtatcccgctgctcccattccggttggaataatagatatagtgtgtacaggtccgacatcagggagtacatggaaaagaattgcatgtcctgattcatgatatgcagtaatcttcttttctttctctgatataatcttgcttctcttctcaacaccgataccaacttttacaaatgcatagttgacatccgcattagtaatgaactttctcttgctcttagccgcattaatggcagcttcattaagaatattctcaaggtctgcacctgtaaagcctgctgtagttcttgcaaggctatcaaggtcaacatcatcacctaaaggcttcttggctgcatgaacattaagaatctcaagacgtcctcttacatcaggtcttcctactactacctttctgtcgaaacgacccggtcttaatatagcaggatcaagaatatcaactctgttagtagccgccataacgataattccttcattaactccgaaaccatccatctctacgagcatctggttaagagtctgctctctctcatcatgtccgccacccatgccggttcctcttcgtcttgcaacagcatcaatctcatcaataaatatgatacaaggtgcattcttcttagcttcctcaaacatatcccttactcttgatgcaccgacaccaacgaacatctcaacaaaatcagaacctgatatgctaaagaaaggtactcctgcctcaccggctacagcctttgcaagtaaagtcttacctgttcccggagggcctgtaagaataactcccttaggaattctcgctccaaggttagtgtactttacaggatctttaaggaaatcaacgatttcttccagttcttctttctcttcattaagccctgccacatccttgaatgtaaccttattggcatcaccacttatcattcttgcacggctcttaccaaaattcatcatcttggcattaccgccaccaccagcctgtctagtcatcatcagcataagtgctacaacaacgataagacacataccaaatggcagaatagttgtcatccatacactgtctcttttaacatcccttacagtatatgtaatatttttatcatcaagcttttgctgtacagaaacaacatcagatacattaagagtatccctgcttccatcagtgaatgtaattgtaagtgtacctgttgggacttctgcattctgacttataacaacatctgtaatcctgccgctctttaaatcagattcaaaatccttatacttataattacttgttctctggctcatctgtgcgataacagcccagacaataccaattataataatcatgaagaaaatgcttccaaatcctccagacctttttttcttagtatccatcacttcctccttattaattatgcctcttcgtcaaggtgtaaaactcctacaaaaggaaggtttctatagctctggtcataatcaagtccataaccgacaacgaattcatcaggaatgttaaagccattatacttaacatccacctcaacctctcttctttccggcttatcaagcagagtacatatacatatatctgccggctttctctcctctaacataggcataagtcttgcaagagtattacctgaatcgataatatcctcaataacaattacatgctctccctcaatgctctcatcaagatccttcttaatcttaatctgaccgcttgatgatgtcccgcttccataacttgacacctgcataaaatcaaacttaacaggtacagtaattctcttggcaagctcgcatgtaaatataatacttcccttaagaatacagataagtttaacctccttaccctcatagtctttacttatctgctctccaagctgtgcaatcctttcattcagcttttcctcagatataagcacactgataaatggttctttcatcgtttctctcctttgtcaatcttaatattcactctattgtatagttatatccagcacattccttgtttcatcatcaatcagggcgcactcacttcttcttaccccgacagcccataaaactcccgaatcatcagaaacaacaagcacattatctctcatatcggcaggtactttacggtcaatgaattcttttttcagcttgcgccatgttcccgccctgttcacaacaatcctgtcgccatcagtacggtgtcttatgcagagctttccttgtattttatcataatcaaaggatttcgcatagcaactattagcgtaatttctgtttttttcataattagaatgaagtgaaattacaatatgcacctttcttaattccgtcttgccatcattattataataaatgttttcttctatggtaatattttcacctgaattaagtcttttaagctcctgcggcgtaagtacatgtatgaggtccgaagaaacctgtatccgagatgccacatttttcctgcttattgtgatatcctcatacccttttaccgcacacagtccataacatatatctgcactgctgccaacctgttttcgtataagctcatctacagcattcacatgaaccttatatatatcctttgctgtctgtgtaagtgcatgtactgccttgtagataactctctttcttatgacctcatgaagtcctgcaaactcctccccataaagccttaaaaccaccgtatctcccacatatacatacttatcataagcctttttggcctctgcctcaataaaatcaaaattcttctgcagctcctctgctgcatcagcaatattttcaacagtgtgtgcattaaccttttctgtcatgtacggaataacaacatttcttaaagaattacgcgtataatcattgcacagattcgttgcatcagtaacatatggctggttaaagtctttaagtacttcctcaacctcagctctcgtcactgaaagcagaggtcttataatattatcccttaccggtctgattccacctattcctttaagtgaagttcctcgggaaagattcataagaactgtttctgcctggtcattcatatggtgtgcaaccgcaatccttgcattacgccctttacatgcctcattgaatatacggtaccgttctttccttcctgcttcctcaacactcattccaagctgctttgcaaggccggcggcatctatatgatacgccatgaattcaacacccatgcgttcacacaagattctggcaaactcctcatcatctcctgcctcctgccttatgccatgattgacatgcaccacacataattctgtctgtagatgcttcctctctatataccccttaagcaccataagcagacacacagaatccgcgccgcctgaaagaccgacaaccactctttcgcagtccgtaagcatattattctgttcaatatatctgtaaatcttatctataatttcattcatgcgagaattatattatacgttcacataagtgtcaaacactcccagtaccataactgtacagtcatcaaaagcctccatattattattcttcagggactcctcaagaatctttttcgcaatgcctgccggcttctttacatttatattattaataatctccaccatctgttcctccttattaattccagacagattatcaagcacaccatcacttatcattataatataattaccatcataaagctttttagtcgtacaatcgtagtccacctgttctaacactcccatcggaagcgttgttgacttaataatctcaacccagttatctctttttataaatgtggatacagctccaagtttaatacagttaataactcccgcctgacagtcaataatactcatatccatagttacaggattgttaaatgtagttcccgcaatatacgcagaattaataagatcaatcgctgtcttttcctcgaatcctgcttcaatgcagttttccataagttcaatcaccatacggctctctgcaaatgcccttttaccacttccacagccatctgcaattgctgcaaccatttttccacagttcagcttctttaacaggaagttatccccacttgtattctcttcctctttacattttctcgccatacctgaaagaatcctgaaacgattctcctgatagaacacatactggtccggttcttcatttataatcactctgttgtcctgattagaaaagaattttgccttaaatacactgctcactgtttctcttaatacacgctcagacacacaccccttcataaatgttttcgcagttacaagtatctcacgcctctttccgtcaaccagttttatatccttaacagatatccccattgccatacatttacgctcaaattccctgcgttcctgtttatccggcgctttagcatcaagattcattgcaacacattcctctaatatatctgcagccagaatcaattgtcttttaaaacccgtctgcttctgattagtttctccatatgcatctccaagatttctgaatgttctggctgtttcctgcagacggttaatagtataagtatatccggcatctttatatgtatttttcattcatatccacttcctttccggcactacaccaatgtgaagtatatatgactgcttataaataaaatgtcgaagcatgaaagattcaaaaaatcttccagctccgacataatatttggtatgaattttacttgttattaggcttaaacaccagttcgtcaggatatataagcccgaatttattcttggcaatctcctcaacgaacttctttgtcttgacatacttctcatattcagacaattcatcacttcttttattctcgtcatcaatctgggattgtaactctgtaatctgagcctgataatcagcattcttttcttccagtcctgccttgcctctccacagaacaacgccaagtgccacgacaacaataattgcaataatcattcctgccagcgttgaccttctctgcttcttaagcctttctgcacgctctcttctagattctaatttcatatattcctcacccttgtgcttccttcttacccatatctttcctgcgtttcatatacattttaaggcttcttactggtattgtaataatacgcaccacatttttcaatataaaacatgccggttttagtaaaatttttataattcttactgaccaccttatataaaaactgcttaaaaacttaaaatacagaaatgcccccacagcaattcccataattatgaatccgcggataattccgtctgcaaccttaaagcacatcacaaatacacttaatccggcatatattccatatataatatcttccacactcataaaaacaactgttttatgccgtacaattcgtctgaaagcccttatattatcgtatatccatgcaagcagaacaccattaaagaagcttaccacaagtgcataaagctcccaatatataatctcattaatcatcggagaagcctgctcatgaacgaatcctgcttattcttcatgccagcctccgaataacatacagaatccactctgccgtcaaggtctaattcacccttctcgacagaaagcctgttaacatgcagtccttcccctttgattgtaatatgcccataatcagattcaagtacaaccttaaccggatcaaatgacactacatctgttattcctgtaaaatcaattcttttcctgtcctccatattcagcctgtgtggacgcttcacccttaccttttcctccatataccctccttatagacattccgttatatgagaatatatgcatgaccacaatatatgattacaggtactttgaattaaagatattcaaacatttcctttgcttcttctttcttaacagtatccttgacatctgtaacccttgctcttacattcttgttaccaaactgaatttcaataatgtctccgactttaacatcataagatgccttcacaaccttgtcattaaccattactcttcctgcatcacacgcatcgttggcaacagtccttctctttataagtcttgatacttttaaatatttatctaatctcatgttcttctccttaatccataggtaaatccagcctgctatccctgcagtacaatcagtccgcctcaagccatctacgattccatgtgctttcctaaaaagttagctgccgtctttaccattttcttttcattatctgtaaactttggcttcatgtcaatagacatcataagcacagtacctaaaacatctccctgacatattatcggatacataatttcctgcttaaactgcgcctcatcagtgactttcacaaatccatcctctccttcacctgcagcaatggtacatcttccctccattgcctgattaagctcctttgtgacaggcttattcatcagattcttcttatcgtcacctgatgcagcaataacctgttccctgtcagttatacatactgtcattccggtcgcatccgacagtgattctgcatattttcctgcaaatgtgctaatatctcctatcggtgaatattttttcagaataatctgcccctcagcatccgtaaatatctccatcgggtcagtttcccttatatgaagtgtccttcttatctcctttggaatgacaattctgcctaaatcatctatccttcttacaattcctgtggctttcatattaataattcctcctgattcttacatactttccataatttataatgtatgggtagtatgtggaaaacaggaagaattatgcatctcttgtaatgatcttcatatagcctccagtttcaaaagtttaaattttttcattttttgaaaccgctctgtaatgtttattatactgtctgcaaacaatatatacgaactgctatattctcaccttatttcctgccatatttaactgatttcacaactgtctcaatacagttaattgctaatgcaaaaataataattgccaggaacagcttattaaaatgcataaaaattttcggaattatttctgcattttctccgaataactgctcaactccatcaaaaaatgcagaattcataattcttccgtttaacaaccaaatgaatgttaataaaccatcaataagattggtaataattgtaacaatcattactcttttggtatagcttccatcaataagtttcacactttcttttgcaatacctaagataccaaatgcaagaatcagataccatgtttgtctgatgtattccagattaaagagcggttcatacacactgacaccattctttacaaaagcaatacatataatctgcggacaaacaagaaatacaagagtaaatataactgaaaagataattccaataattgaatctgcttttgaaatctgattcgttttctgtggaacaggcggcagattatctatcccattacttaaaccttccaccttaattcctcttttatagaagaacgcaaacaacaatgtaacaaatgcaaatcctgtcaatacaccgccaaaaattccacctataatcctgaatatggctatataccagatagtatgcgatatcactgctgccataatctgtgcgagtaacatccccccgataacacatgccgttacaattttcagtacatacacatacagattgtaataaggctgaccaattaaacaatcctgtgtttcactcttgtatttcgaagcaagttctgccggagttcccagttctgtcagaacaactctgatatcatgttcagttggcataacatctccgcatcgttcctctagcatatcttgtattattgtctctaattctgccgatacatcttttttcaaatcagccttcatatattttgtaactgcataaacatatctttcaatcaaatcatttttcaccatttattccacctccataagagcattaattgactgggaaaatttttcccagtgtgctttaatttttttataaaccagttttccatcttctgtaatgatgtaatactttctcggcttcgtttcatctgtttcccattcactttttaaaagtccctgactttccagtcttctcagtagcggatataaagtattcccttctattgaaatcccctttccttctaattcttttataagtgaatacccatacatcggcttgtttagctgtgctaacactaccatgataagtgttcctcttcgaaattccagaatcagtcctgaaacaatttcatcgcaattcattcaatctcttcccttcttaattatccaaatcaacaatattcatcagattgtagtgtgtcacacacactatcattttaattcatcatactgtatgtcacacactatgtcaatatttttttcttataaaaatattgtgatttacccgcgatacctttatcatattaatatgaagttatattggaggtctgtagtatgaatggggtaaatgattatgataattttgatggaccaacatcggcatatgttaaaagaaaccggaaaaccagttttgcatataagtttaagaaaatgctttatgaaagaaaaaaagctgaggtagaaaaaagcatttcttttgacgataatcatgcaattgaggaagtatgtcagtatgttcaggaacaatggggatttaaggaagctgacagaaattctgctgaatataaattcatgtataagcagataaagcatgacataaatagcgaaattaacctgtttctgtatgtgcgtgaggataatgacgcacatatggatattgaaatagaaactaccactggttatattgcaggcggcgtgaccggaaagaagtcctcaattaaggaatttaacagaattttgcgtgatgtattcatatattatggtgtcatgcaggacgacataatcgagaaaaccaaaagatacaagaatcttgtgagtattctgatgcaggaagcttaaaaggaatacagtttttctaacaaataaaaacggagttataaatatgtacactatacattcagacattttcccagacggaactcctgttgatggctggtttcacaataccagcattccagaactcaccaaactgggaaagcaatatattattacagattatggtatacatgatgacggcagaatatacactgataatttccagaagctgatagaccttgtatacaatgctggaggcggtgtaatcgttattccgcgtggtacatacatgactggagctttatttttcagacagggagttaatctatatattgaagacgatgcaacacttatgggaagtgacgacatcagcgattatccggtctgtgaaacaagaatagaaggtgaaacctgtcagtattttactgcacttatcaacgcttctggaattgatggctttacattgtgcggtaatggaacgatagacggtaacggcttacgaagctggaaagccttctggcagcgaagaacctggaatcccgattgcaccaacaaagacgaacagcgtgcaaggcttatctatatgtcaggctgtaccaatgttactgttgccggattgcacatttgtaattcgcagttctggactaatcacctatatagatgttctcatgtacgttaccttgactgccgcattacaagcccctctgcgcctgtcaaagcacctagcactgacgcaatagacattgacgcctgcactgatattcttattaaaggctgcacaattaatgtaaatgatgacgcagttgctttaaaaggcggcaaaggaccatttgctgacatcgacccggacaatggtgctaatgaacgcataattattgaggactgcacatttgaattctgccatggatgccttacatgcggctcagaatccatacacaataagaatataataatgcgtcacattaaagtcaactcaggttacaacctgctctggctgaaaatgcgtcctgacacgccacagcattatgaatacatcactatagaatatgttcagggaaagatatttaatttcatcaacatcaatccgtggacacagttttttgacctgaaaggaagaactgacattccgccatcttccacagaacacattataataagaaagaatacctgcacctgtaatgttttccgcaacataaaagaagcacctgaacaatacacactcactgatatccagatagatgacaatataatagaagaaatcggaacaccttccgataagacaaaacataccggagcagaataactgccccggtatattttattatgtatagcttattatatttaccaattaagctactgtcttctcagagttcttctcgctctttgcatagctctttactgagttaactacgatgattacaccaagtacaataaggagtatagcaattataagctgaagtccgttagcgatgaatacgcttccccaagatgtctgtccagcaggaattgtaacagaagctgctaacttgatagccttaaccattgcaattgttctctgtacaagtgctgtaaatgttacacaaagcatgatgataagaggagggaaaagcattttgttgcttcgtcctgtaacctttaagaatacgcagagtgtaagaattacaagagcgcttaataactggttagctgaaccaaataatggccagatatttgcatatccaatcttagtaaggatgaatccacatactaatgttacgattgttgagaagtatgtattgcacaataactttctccatccttctgcatgttccatatcatctacgctgaagagttcctggaaactcatacgaccgatacgggcaactgcatcaagtgatgtaagagcaagagcagatacacacattgtcatgaatactgttgcaaaatgtactggaacaccaaacatttcaaagaatcctgctacaccactactgaagattgcgaatggtgtcttagctggaagcgctccgttagtggcagctgcaccagcaacacaaagggcaagtactgcaagtaaactctcaagtaccattgcgccgtaaccaaccttaagcatatccttctcgttctcaactgtcttagaagatgtaccagaagatacaaggctgtggaaaccagaaacggcaccgcaggcaacagttacgaaaagaattgggaacattgttccaagctttgcattattgaatcctgtatatacaggaagattcattgaaggatgtgcaactacaagaccaactgctgcacctacgatcatgcagatgaacatgaatgttgtcatatagtcacgaggctgcttcattaaccacattggcataactgcagcgaagaagatatatacaaatgtgatataactccatacatctttgttgaactcaagtgggaagaacataccaacagcaaatgctgcgataataaacacaataccaagtactgcttctttccagcctgaaagatttaacttcttctggataagaccgaatactacggcaaataccataaacatgatagataccataccagctgaaccatttgtcttagctgctgctgataaaacagtagcaccatcagcatttactgtgtaagcattaaatgtacctgcaaccatatctgcaaatgctgcaataacgataagtgtgaataaccagcagaaaagtaagaaaatcttacggccaaacttaccgatgtacttctcaatgatcatacccattgacttaccttcattcttaactgaagcataaagtgcaccaaagtctgtaactgctccgaagaatacaccaccgatgaggatccagagtaaaactggtaaccatccaaatgctgctgcctgaatagcacctgttacaggacctgctcctgcgattgatgagaactgatgactgaaaactgtccagccattagttggaacgaaatccttaccgtcgttatatttaacggctggtgtctctgccttagggtcgataccccatttctttgctaaccaacggccataaaccatgtatgcaccaaaaagtacaactgccgcgataagcacgattactaatgtgttcataatgtcactctcctataaaaatatatttcaccagtcaaacgcagtggaagcggtgctatgattctcagtgcttccatagctcgtagctcatatgtcagaactgcgttctgacattgtcgcggtgctcgcacaaaaaaaccttcgtcgatgcactaatccattactggattatgtgcaaagacgaaggtatattatttctacttccgcgttaccactttgcttgccggatactccgaccactctactgccacttggtatattcatctcttatggcatgcccttttaacgatgggtaccggttccaactactagacatctgcctgtctttcaccagaactgctcgcaggtgagggcttaatcattccttgctgccatctctcatcaactgacggctttctgtgagcggtgatatgaagaagtcatttcctgttcttcgcatttgactgttgatttgtacattaaaatattcctttgttgataatttgtcaataagaaaattaaatatttcttaagaattcttaaatttcttaatataattaataattttcactctgtttccgtttatataaccagattgttttaatattattaagcaaatcttctcttttggttatttacctgaatattatgattatatttctctattctatcatgattttataatcagcccacatatattttatcagtccctcctatatattcatagaaatcaatcatcctataggtaaattttgcttcttttactgtcagagactatcctttcgtcccgctcttagaagaaatttcctataagcttgcataatattatgctttgataggttgattttcattctaacattatagtcatatttattttctacctataagatgtttcaaaatgcgactacctataggtatcatattctcctcattttttctccccatatttaagatatttctgttgaaaatagtaaatatttgctataaaataaaactagtttattttcgtgataaaatacttcactaacttaacaattttatattttataggagattattctatgaactacgatgctaatgtttttaaagccaaggctaatattaaagcccgtcggatatggcttgttttctcactccttttgaccgccaattatggtactgatgcagctaatggaatctatccaaaaagcagctacataatatttgttgcactttgctggatacctttctttattggagaattatttttcagaatcaagggaaaagcaactgatgcgtacagattatgtcttgttattggttatggtattttctatacatttgtaatatgcacaactgattctccgatttcattcacatacattctcccggttatgagtcttctcgttctatataagaacaagaaattcatgattaactgcggtattgctaatgtactctctgttattgtcagtgatgtgtacagatatgttgttctcggatgcaggtctgatgcagatatgaagaattaccagttacaggttgcatgtcttcttctatgctacatctgctatgttatgtctatcagacaccttaatgaatccgatggtgctttgaatggaagtattaaagctgatcttgacagagttgtttcaactgttgagaaagttaagacttcctgtaattctattatgagtagaattactgttgtacgcgaactggcttcagagaataagcatggttctgatgttatcatgcttggcatgaacgaactttcaagcaataatgaagatttaagaagccatactgcttcttccactgatatgacaactgacataagctcacaggtagaacatgttgctcagcttattgacgatatggtaagccttacttctgagtcacaggagcatgcatacacaagctcaagcgaccttgaaaaccttattacaacagcaactacaatgtctgagctttcttcagaggttgagcatatcctgcatgattttgaatcagaattcaagaccgttaaagaccagacaagtgctatcgacaatatatccagccagaccaatcttcttgccctcaatgcttctattgaagctgcaagagccggggatgcaggtaaaggctttgctgttgtagctgaacagattcgtgcattaagcacagaaactaagacctcttccagtgaaatacagagtgcattagaccgtcttgctgtaatctccgataaaatgctttcttctattggagagactttatcacttatacaggttactcttgacaagattaaacagacaagtgaaagtatcagtcttatcacatctgattctactcagattgaagaccatatacatattattgatacagccattaaagatgttgaatctgctaacaagcagcttgtaagcaacatgtcccaggtatcagatatagttgataccatgacagagtgcataactaattcaagagatatcagcagccgtattgtaagtaaatatgacgaaagtgctactaatatcaataccatggaaaatacaatacaggctcttatgtgtgaacttggtgttggcggtttcatgggtattgaggatattaagacaggcatgaaggcatccgcaatccttaaaggtactcatggtgaaaatgttgaatatcacggaaccattaagacacataatgacaacagcataactcttgaacttgagaaggcactgcctgcagttaattcagcaattgaatgtgacatgttagtaacagttgaaaatgtaatataccattgggaaaacgctaagattgcagctgacaaaaaagcatctgcaacaacgggcattgttacaatcacaacaagaccgcagattcttaaccgtcgtaaatatcctagaattgatatgaataatcactgtacaattacagtaaagggtacagacgaaacatttgaaggaaaacttgataatctgagtgccaatggttttgcatttctctcaaaagacagatttttctctaataacaaaggcaaaatcattactgtttcaattgataattttgatttgcctgcacattctgtattagagggtcagattataagatgttctgataatgacggcatctacatagtaggctgccagatgccagaggataactactacattatggaatatgtagagcaaatgatacggactcaaaaaaaataataactaaaatcataaaatggagaaaagcatattaatcagcttttctccattttgtatattctagataaccatccagtcttcgaacttatttgcattttcaacaatgttgacaattccatctgcgccgtaagtaaatgccctgtgaataaatacatttacttcctcacccttctttatcggagcttcctctacatttcttgtcccgacaacctctatgccgttgacattgacagttatctcgacttcctttcccatgaaaagcttacctacaaccacgcccttctcaacagaagcggctgaatcaactttctcatcaagccttgtgatgttgacattctcaggtcttaataccgccttaacagaatcgtcaagctggttaaaacctttaatcttattaatccggtcaacatgtaccggatgtcccatgaattccgccataaatgctgtctcaggctctctgtatatctgtcttggcgttccaatctgctctatatgtcccttgttagtgacaataatttcatcagcaacctcaattgcctcatcctgatcatgagtaacgaatatacttgtgattccaacctttgtaatcatatcacgaagccagcttcttaattcctgtcttaccttcgcatcaattgctgcaaatggttcatcaagaagcagaagctccggattaggtgctaatgcccttgcaaatgctactctctgtctctgtccgcctgataactggctagggtatcttttcgccatgcctgaaagtccgacaagctcaataagctcatcaacacgtttcttaatgtccgattttttccatttattgacttttaatccaaatgcaatgttatcatacactgtcatatatctgaaaagtgcgtagttctggaaaacaaaacctattccacgcttacttgccggcacatcattaacaaccttgccatcaataataatatcacctgaatccgcagtctcaagacctgctatcattcttaagattgtagttttgccgcttccgctaggtccaagcagtgcaataagcttgcccttccctattccaagattaatattattcgaagctttaaatgtgccatatgtcttattgatattacgaagctctacatatttctctgtatcctgctgtaaatctgccataatctgttccgcctttctgttgtagtgcgtttctatccttcctgctgccctttctctgccttagctgcctgctgtcccttgtattcaagtacacttcgaagcacaagtataataaccgccatcagcacaagaattgctgacactgcaaatgctcctgtaaaatcatatccctgatacagaagttcaatatacagcggcatcgtgttagttcttccgcgcaaatgtcctgaaagaacggataccgcgccaaactcccccatagctctcgctgtacacagtacaataccgtagagaagcggccatttgatatgcgggaatgtaaccttccagaatatagtccagccattggcgcccataagtgccgcagcttcttcctcatcagttccctgcgaggtaagaaccggtatcagctcccttgatatgaatggaaacgttacaaatatagtcgcaagcacgatacccggaactgcaaatataattcttactcccatagccttaagatatggatatataaaactctgtctaccgaatgtaagcacatatataagacctgctataatcggtgaaactgtgagtggtaaatctattaaagtagatataatcttcttgcccttaaactggaatttcgtaataagccatgaagcaaatattccaaaaaatgtgttgcacacaaccgcgataagcgaaacctctattgtcagcttaatcgaatgaagtgcgtatttgtcggtaactgctgccagaaatacctttatgcccttagaaaatgctgtgtacattacatagctgaggggcagaataagcatcacaaataaaaacaacacacttatacctattagaatccattttaacagacctgaatcttttctaatgttcatacactaacccctttctatgaaattccacttacaatcttcgatgtcctgctctgtaacactgcatttataaagagaataataaatgcgatgaaaagcattacaagtgctattgatgttgcacttgcgtagtcatattcctgaagctttgacataatcataagcggtgctatctctgtctcatacggtgtatttcctgctatgaatacgacactgccatattcgccaagtcctcttgcgaatgacattgtgaatccgccgataagtgctggaagtatctctggaagaattaccctgaatactgtctgtctgttggttgctccaagcatgttggctgcctcctcgtactggatatccaccttttccagcaccggctggacagccctcactacgaatggtattccaacgaatataagtgcgaatataattcccagccttgtatatgcaatccggattccaaatttgccaaaaaatgctccaagccagccattagttgttgtcagatgtgtaagtgctatacccgcaacagctgtcggcagtgcaaatggaagttcaattattccattcataatctgcttacccggaaagttatatcttacaagaacccatgcaagaattgttcccataactgcgtctataagtgccgcgattaacgcagtctcaatacttactctgtagcttgaaagcaccctcggccttgtaactgtcgttataaattccgtaaacgacagctttgccgagaatatcacaagggtacataaagggataacaacaataaatcctaacattgcaattgttattccaaatgaaagaccaaagcccggtattactctttttttctttcttttcttctctttcattctgtcgtttccccttcccttaattacttcttttcatatatcttatcgaatactccaccatccttgaaatgtttgttgatttttaattcctactaattttatatgttactatgttgcagattatatacctactaggtttatatgtcaatagtgtttataggatttctggttgttttcctgatgcctcttttcttcagaacgcttttttctccgtaaacctactaaacatcttgttttcttagcttgcgtaggtctttttcctcctagtttctcttttattccttctcatccctctcgaaagacctactatcctgccaattttccctccctgcgtaggtctttctccttctagtttctcttttattccctctcatccctctcaaaagacctactatcctgccattttcccttccttgtgtaggtctttttccttctagtttctcttttattccctctcatccctctcgaaagacctactatcctgccaattttccctccctgcgtaggtctttctctgtcaatattctcttttaccacttcgcattctcctcaacagacctactaatctacataattaccataattgtgtaggcatttcccaaatattatctcatgcctataattatcctcaccctgttctcttgacttcttgtcttatctgtattactatatataatacaaataaaacataaatcacctctctttacagaaaggagcttcacatggttattgaacttgattttgcgagcgacacacccatatatgtacagttaagaaatcaaattgttaaaggaatcggcaagggagaactcaaggctggtgagaaactgccgaccgtcagacagcttgcttctgacgcaggcgttaatacaatgaccgtcaataaaacctaccagattcttaaagctgaaggttttattaaaaccgacagaaggcttggtgcatttgtcgccgagaatattaatatggatattgaattcagggaaaagcttgaatcagagcttgagctgctatccgcagaagcaagcattacaggaatggataaggcagaattcttaaaaatgtgcgaaaacatttattccaagatgaatccctgcacagtgtaatatgcctgtattttcacatgcattaacacacacagtcccactatacaaggaggtttccttatgaaaatcgcaatgtttatgctattcctcgtatgcaacatgttcacagtcctgatcatgagatttgcatatgaatccaactaccgatacaacaatggaatgcttatcggagtccacattccaggcgaccatgttaacgatgacgatgtcaccaggcttatgacacgctttaagaaaagcatgaaatattttcagaatatcaatgcagtactctcaatagccatatgctttcttaattttgtgaacataatcattttcgttattatgtatacaatctggattctcgtgttcgttttcggaattatgtatatccagctttcagcgcatcggaaaatgtatctgttaaagatacagaatggctggtttgtggaatcccagaaacagaaggtctttattgatacgcgagcttgtgcaaatgcagatgcaactccaatcagcttcagataccacatcatcataattgccgcagaactgctggctctgattccattctattcatggacggacagagcatatttttcaatgattattgtatttgcaatatgtactgtcatagtttctgtattcgggtttgtgttccacatttatatgaacagacgacagaatcaggcatacagccttaattcggacattaacaacattgttaatatgactatgaagaaatacattgcttcagcaatgcttgtaatgtcacttcttaacttcgtggcatggataacatttgtcttaatgtgtattattcagaatactgttggtgatttaagtttctggatgtacattattctgcagttgttaagcggctgcacgctcactgtcattcttattcttgcacgcaacagaaagaatgaaatgcttaaggctgacacacagccagtatttgttgatgatgatgactactggaagaccggattttactacaatcctaatgacccgcaccttttcgtacccgacaggctgtgttcgaccaactactcgcttaactacgcccgcacaggtgctaagatattcaccggaagcataacggctgttactcttggattattaatatggaccactattgtattaattccatacattcatgttactatcgacatcaggactactgatagcactgtaaatgtatcttcatgcggttacacaagcagaattaacattgacgacattaccgaaattactctgatggattcactgcctgatgaccattttttcagatataacggcggcgcaaccgacagttaccttgtcggcaaattcaaaggaaatacttatggcaaatgtaatctctacatttttaatgatgtgtctcctgtacttatgataaaaactgctgaccagactgtgttcttgaattccaagaaagatggcgagattgttaatctgtataatacaattaaggataaataatccgtgacaaaaaggacgataagaattaacttcttaacgtcctttttttgcaattcttctattcgcgtgacttgcgcttcttcacatcatgctcctcatatgccacactcactttcttaccgctgaatgcaaccccgaacatgccaatcccagacacgccatgcttttcaagattggctgtgtaacttttctgatgaatctgtctgactgcactgccggccatcttctcaagctcagcttccttacacgctttgaattctatgatatatccgtgtccgccacggctcttcggttgcagctctatgtcaaatcgtccctcacctgactccctgttagacgagatataataattgtctgacaataccgcaagcattccaaataccaccccatgatagaaatcctcatgtgccgtatcaaacacgcttgcagactgcaaaagatactgctgcaaggtttctgttaataaatgtgcatttcccgtacggattgattccgcaaagtttcttagcagtgcacctgtaaatatgccgttatatctgtcaataatctccttctggaacacgctctttatctcataattaggtatcgacagcgcgcatatcggattgtcgtacagagagccaatatgctctgacacacgcagatatccggcaaccagaaggaagctgtatattgtatcaatgtctccattaatctcaggatatatgatatctgtgtcaacaattgcctgaacagtactgccctgcagcaatcttaataagttgtctgcaaatgtggtatcagcactattaaacagctcgccgattatctcattgccacttgttcttgaccagaaggctttgggaacacatttgttattgaagtaattaataaccgaccacggattatatattccggttctgccaaacatatagccatcataccattccttaatctcacccagccggtcagacacgccgtagtactgcgccatagcagaaacttcctcttccgtaaatccaaaatattgcgaatattcatcatcaagaattgtattaaccacaagattgttaagcccgctgaacaggctttccttagctatgcggagaattcccgtgagaatccccagttccagacttggattgtcctttaagacggccgacaaaagatttctcataaagccaatcacttcatcatagtatccaaatatatgtccttgctggattggcgtatcgtactcgtcaattatcacgattacattcctgccataatgctttgaaagcattgccgacagcttccccagtgcaaactgataatctattatcgttgcctcatcatcaagtattgacttaagatacttcttatcatagtcacttaatctggcgcttgtcgtcagttcaatatgtcgcaaaaattcattccttaatgtaaagcagagacttgcgtacatgtcctgccatgttgactggtgggcatctttaaatgtaagaaaaatcaccgggtactgcccctgcttctccttatatgctgcacccgcgcgccatatatatttatctttaaaatatattgatgtatccgtatcagtcttttcaaaaaatgtgcgaaccatgtccatagtaagtgtctttccgaatcttctcggtcttgtaaataaatacaccttactgtgattatctataatgtccctgataagcaatgttttgtctacataataacattcattcgacacttctttataagatgttattccaaccgggcagggacgcttcctgttgtatacaacgctgtcttccctgacataaagattcctattctcccttaaacaatccggtctgtccacatcgtcaggtatcatccagaacttgcctttcttataagctcccggcagctttccctctgtacacaactggttaattcttctcggtgtcacgccccatcttgcggataattccttcgccttaatatatctaatatccataaagcccctcttttctgtgcattactacacatactgaaatccgtgtcatgtacacagattccacaccgcctcttacttaattcacaacatttatatacatctatattatattctacgcaatttttcggaaatatcaaggcattttcaggaaatattattttaattttcggaaattatatatttttctttaaatattatatatttcctcatttacatttgacaatcctgccccaaagtattataaatatcaaagggaatgaagtactcccttgggaaacctaaactgcttattcaagctgatgacttctacgattttatgtcgcaggaagcatcagctttttttgcgttcataaatgcatttactatatttttaaggaggcttattatgctgacatctttatcacttatctttctggtcggactcgtcatgggcgcaatctgccagaagctgaaacttccgagaatcatcggtatgcttgttactggtattgtcctcgggccatatgtccttgatttccttgacccatcaatcctttcaatatcggctgatctgcgaaaaatggctcttattattattcttatcaaagctggtctgtcgcttgacttaaaagacctgaaaaaagccggacgaagtgcaattctcatgtccttcgttccggcttcctgcgaaatcatcggttatattctgcttgcccctgtaattcttggaattaaccacgccgaagctgctgtgatgggcgcggttctcgccgctgtttctcctgcggttgtcgttccccggatggtaatgctgattgagaaacgctacggaactgacaaggcaattccacagatgatactgtctggtgcttcttgcgatgacatatttgtaatagtgttattcacaacatttttaaatgtggcacagggtggcaaggcaaatgttatggattttgtaaatattcctgtgtctattatactcggcataattcttggcatagtaaccggattgggactgtatctgttctttgaaacatcatacgcccgcaagcataccgtaagaaacagcatgaaggttatcatcgtgcttggcttctctttccttcttattgcaattgagggctggcttgaaggaaaagtgtctgtttcagggctgcttgctgttgtcgctatggcatgtactcttaagtttaaatgtgttcccaccgtatcagcccgtctgtccgaaaaatttggcaagctgtggctcgctgctgaagtaatattgttcgtgcttgtcggcgcggctgtcgatatccgctacacactgaaagccgggcttccagccttactcatgattcttgcagcacttgttttcagggcagccggagttcttctctgcaccgtaaagacaaatcttacatggaaggaacggcttttctgcataattgcctatcttcctaaagcaaccgtccaggcagccatcggctctgttcctttagccgccggactcgcctgcggacagatagtgctttccgtagctgtgctcgcaatcatagttactgctccgcttggcgcgcttggcatcgactgtacttataagaggctgctgaaagaggataaaacccactaaaagccattatacactcaatatagtaggtcatttccatagtttatgcatatactttctggctcataacctactatattgttaaattaacatattttcgtaggtctttttccacattttactaagaactgtaagcaatttgcgagtgaaagacctactaatcatatcttccctgattgattagtaggtcttctcacttaaacaacttataatattctccgcagaaacctactaaaccaacaacttgctctatattagtaggcttcatgtacctgtgcatagtcagattcgctcaatatattcaaccgcgcagtatattcaacaaaacattttaattaatcatatatcttatcaaatattccgccgtcagagaaaaacttctgtgtagccgcttcccagccgccaaaatacccgatatccgccatgtcaatgtccttgacaatccatttgccgtcggaaaggatttccttgatatttcttgaatcactggaagcctcgtattccttctggatatccttatttacaggacggtagaaattctgtgcctcaagcctctgtgcgtcatcggtgtacaggaaagatagataggcatcagcaagctcctccgtgccattcatctgcgtgacctcgtcaaccttcgcaaccgtcggctggcacaatacagatgctgacggaacgacaatttcatactcgcctggatattcctgtaatgcgaaaaatgcttcattttcccatgcaatcagaacatccccctgtccgttctctgcaaatgtggtagaagaacctcttgcacctgaatcaagcactgccacattcctgtaaagtctcgtaacactagcctgaacctgttcctcagtctgtccctgctttttaaaataataccatgccgcaagaaaattccatctggctcctccggaagtcttaggattaggggtaataaccttaaccccgtcattaagaaggtcgtcccagtccttaatattcttaggattaccctttcttacaagaaagacaatcgtagaagtgtaaggcgagctgtcatcagaataatcattgatatacccatcatcaatcagcccttcgtcccttataacattaacatcgccctcaagagcaagcgtgacaacatcagccccaagaccattagcaacctcaagtgcctgctttccagagcctccatgagactggataacctcaaccttttcaccagtcttaccataccagtaatcctcaaaaagcctgttatactccttataaaactctctggtagcatcataagaaacattaacaagttccgtcttcttctgcccacagccagaaagtccaataaaagtcaggctgaaaatcatacctaaacatattaactttttaaaaaatccatattttttcatctatacctgactcccacataaatatattcctaaactaggcaaagcagcgaagcaagctttgccaaacccaaggtaaagcagcgaagcgccctttaccgcacgtctgccaacacttccaaccctgaagtaaccccacgcagcgggaaagaaccccagcagcactaaacttataaagcaacgcaggtgctttggagccgccggcacttagctcgtcaggacagcctcacaaagtgaggcaaatcctgacaagcttagtaccgctgcgagcgacaagcagcgaaagcgtgcctgcgttgctttataagttctagtgcagcgtccgttcttcccccagcctacgcattcttcttaataaactcagccacatccacagtagtgacgtcaaccttagactcccagcctgcaagcacttctgcgccgtcaatcttaatatcagctgccttactaagtgcaagaataacaacaatacctgcatttacaaggtgagtcacaacatttgtataatcctcgccttctgccggaacatacagatatacatgcttgctgtcaagaagaagctccttctcaaccttctttaagaaatcaacattaatcttgtctgaaagaacagcctcaacaacaacaggcttctggttgttaagctccgctctgaaagctgcgtcaacttccttaacatcatcagctgtctcattaacttcacggacaacgccgcaggcactagtcatattagtaacacggtctatgaggataagctcgcccatagtcttgtgaagattgaattcatcaacaacaattacatcagcaagagaaatcttgcatactgcgatttcatttttcttaaggagagctgccggcttctcctcacctgtattaacatcaatagtattgacaatctcggtaacaacgcccggaataagtcttgttccaagctttacaaagaagttcttattattagtaagaacatcatcgtccatccagaggatagtagcagtaatctcagttgcaagctttaagtcagcacctgctgcaagaacagaacctcttgaaacatcaacctcacggtctaactggatagtaatcggctgtccgatagaagcagtctgggcttccttgtcaccgacatggatactcttaacatgaacatgctccttagttggaagagtgataatctcgtcaccaacagatacgcttcctgcctcaatctggccctggaaaccacggaattcatgatttggacggcatactctctgaacaggcatgtagaagcccttttcttcctcagtatcatcaacatcaacctgctcaagataaggaagaagtgcctgacccttataccaaggaatattttcagacttagttgttacattgtcaccctcagttgccgaaacagggataacaactacatctgcaagtgaaagctccttagtaagctctgctatctgcgcattaatctcgttgaaacgctcctcactgtaaccaacaaggtccatcttattaactgcaaatacaaaatgcttaattcccatgagtgcgcagattcttgcgtgtctcttagtctggataagcacgccctgctttgcatcaacaaggattactgcaaggtctgcaaatgaagcaccaaccgccatgtttcttgtgtactcctcatgtcccggagtatcagcaacgataaagcttctgttgtcagttgtaaaatatctgtaagcaacatcaatagtaattccctgctctctctcagccataagaccatcaagaagaagtgaataatcaatcttaccttcacggcttccgaccttggaatcaagctctaacgccttctcctgatctgcatacaataactttgaatcatataaaatgtgtccgataagtgtagattttccatcatcaacactaccgcatgtaataaatttaagtaaacctttcattctagaagtacccctctttctttcttctttccatgcttcctgcttcctcatggtcgataacacggcttgttctctctgattcaaccgcacttaaagtctcttcgataatctcgtcaagagtttctgcgtctgactcaacaccgcctgtaagtggataacagccaagagttctgaatcttaccttcttcatctgtggcttttcgcctggaagaagtctcattctgtcatcatcaaccatgatgatattgccgtcacggtatacaacaggtctttctgctgcaaaataaagaggtacaatatcaatcttttctctctggatatactgccagatatccttctcagtccagttagagatagggaaaactctcatactctcgcccttgtgaatcttagtgttgtaaagcttccacatttccggacgctggttcttaggatcccatgcctgtgctgtatttctgaaagagaaaattctctccttagctcttgatttctcctcgtctcttcgtccgccgccaaatgctgctgtgaagccgtatttgttaagtgcctgcttaagagcctgagtcttcatgatatcagtgtaagctgagccgtggtcaaatggattaattccctgcttaacaccttcttcgttagtgtaagtaaacatctcaattccaagcttcttggccgtctcatctctgaacttaatcatttccttaaacttccatgttgtatcgatgtgaagaaatggaaatggcggtttctcaggatagaaagctttcattgcaagatgaagcataactgagctgtcctttcctatagaatacagcattaccggcttttcgcattctgctgcaacttcccttataatatatatcgcctctgcttcgagtgcgtccaaatgtgataaattacccatgatattcctccctaatatttattagattcttgtctgttgacctcaagcgtcttaactgttccgtctggcgaagtcaccgtccatgtattgatgcttccattctgtctgaacgaaagagtgcttcccttgccaccgacatcagcacccagaaagaaattaattgcctcaaaacaacattctttaagacatgatgtgcagccccagcagtccttgacatgctttataaatgcttttccatcagtatctttcttgataaggttgccgggacaggcttcaacgcacttcccgcagccaacgcattttaacttatttatctgaatgctcatagctgtcgcctcctctcacaaggtctcttatgattatcttaatctcgccattctccttgcgggagttgacatattttaaccagtcatcactcttagccggataatccatattctccgcaaagctgtgccaacgggtttcttttcttgctttcaaatgtgctataacacttctgcacaccgtaagtctttctcttatctcatagattctaagcaagtcatctgcatcctgtgccgcaagattatcaatgctctgctctaagaatttaatcttctcatctgcaagctcaagtcttgcttcattgtactgataatcagtgcttatgccacctgcgtactggtccataatcttctgcattgcttcctcagtctgctcgatatcaaccagtccctgcttattattaagaaatcgctcatactcgctcttctttgcaaatgcgttctcagacaattctgaatctgccacctcattgacaacaaagccctttcctgagcctttaagcctttcagctatcgcctgtgctgcaatctcgccctctgccagagctcctgtcacatatttctgaggacatccgcctgcaacatcacccgctgcaaaaagcccgtgaattgtagtctcgcggttgttatcaacccagtaaccactcgctgtatgacctccgactatgtatggctcagttccctctatctcaacattttcttcagaaggaccgcccgccgcctcaagccacttaagtgtctggctcggtgccatgttaagatatgctttgtaaaggtcttcctcctgctccctgcttattcccttagttccaagatagcaaggacctctgccctctcggttctcagtaactgttccgtaaagtctctgtgaagttgtaagaccatatttgttctcatacacttcgccgttggaattaagctgctttgccggaacgccctgtgcgatagttcctgtcggagcaatcgtatctttacatcttaaagcaatgaatctcatctcaaatgtggtcatctccgcacctgcattgattcccattgcatatccggctcctgtattgaacggtggataccacattttatgtcttgaaaatccaggattgttaggtctgtaaaggcctgccgctccgccagtagccacaagaactgccttcgcatttatctcatagaacactgcatcattgacatcaaatccgtatgcacctttaatcttgttattctctactatgaaatctgttatattcaggtgattgattaccgctacattgtcctgcttcttaactgcatccgccagtatcggcttgatattctcaccatttatcttaatattgcgatttcctctcgcaacataatctccattctcatctttaaggattacaagtcctaagtcctccattactttagtgacatgattgagtctttccgacattgaaagaagcaaatcctctcttactattccatctgcgtccttcttacaataatcaacataatcctgtggaactctgcctttagtgatataagcattaattgcattaacgcctgccgcaagacatccgcttcgtacaatgttcgccttctcaacaatcagtacatcaaggtctttcttctttccaagcgtaatacctgcaaaacaccctgccgttccgccacctataataagtacatctgtgtcaataattctattcttcaaccttcatgtacctcctcgcatatttctgcataatcttcttgcaaaatctatttccatataaacatagtatcttggtatgtaaatcattatattctcaatttcttatttgtcaataggggttttgcagattattgttatttgaattgtgggggagctaggtattggctcggtattagctgagtatggggctggatattggcctagtaaggagctggatattggctgggtgcctactaatctccctcttttctcaactttaataggtctttctcggttgatttcctctctcctgctctttatcttgcttaattttgcctactaatcttccattttcctcaactttagtaggtctttcacaactattttcttcccatccgctcatcttcttgcttgatttcgcctactaatcttccacttacgctctctttagtaggtctttcccagctgttatcctctctcctgttctttatcttgcttgatttcacctactaatctgctgcttacgctctttttagtaggtctttctcggctgttatcctccctactgctctttatcttgcttgattttgcctactaatcttccacttctatcagctttagtaggtcatcccccaaaaaagaacttgattttatacgaaaaatatatacataataaagcggagcaaatataacacttaaacaattgtatacaccatgacaaaatggttattatatatgtagtgactgatatgcggctgtcacctacacagcagcagatgacagccgtatatccccattctcaaggaggctttatgataatagatttccatacacatacatttccagatgaacttgctgacagagcagttggcacattagcccacagcggaggaatacacaattatcttgatggcagagtacattctcttacagattcaatgaaaaaagctggaattgattactccgtactgcttcccgtggcaaccaagcctaatcagtgcgacacaatcaatacacttgctttaaagactaatgaaacaagtgagacaatcggattaatttcatttggggcaatacatccggcttgtgagaatttcagagaaatattgaactggctttccaacaatggtttcaaaggaatcaagcttcacccggttttccagaaaaccaatatagatgatatgcagtcattaaggcttatcgaatatgcatcagcactcgggcttataatacttatacatgcaggcttcgatgtaagctttccgggctgcgacgagtcaagcgtcgacagacttgccacaatgattcaggaagtaaagcctgaaaaactcgtccttgcacatatgggtggctggggacaatggaacgatgtttcttccatattagaggaagattacatgaaaaatgtatatcttgatacctcatcatgcatcaagaagctcaatcacaacgcaagccttccaatagaaaaattcaagaaaatggtcaacattcacggtgcagaccacatattattcggctctgacagcccgtgggacgaccagaaagacgcagtagatttaataaaagagtgtggattttcagaaaaagataccgatgcaatactcggtaaaaatgcggttacactccttaatctataattcaatcagaaagttttgcggttataacctaaaaattttttacagtttattttttcgacaacgcacatattcaccaaacataaatcaagcaggctgtcccacataacagcctgcttacaatttaaccaccaatataatcatccccaccacatgcacaacaagcatagcaggaaccgtatacttaaaataccacttttttgtcttatgcctgaacatctgcattgcaataaaagctccaagcgaaccgccgattagtgctgtaataagaagagtcgcctcccttatgcgccatttgttgtgtatcgctttccacttatcaattccatacaaagcaaatgttactacattaataatcaataaatatattcctataatcttaagcattacttttctttaaatgcataatcccaagtcttagcattgcctaacttattctgcacaatcgacatctgccattttgcatcatctttatccgtgctgtccttaacagtataatatggcgactttccgctatccgacatatagattatgacgctgtctcctttcgcatctggtgtatccattgtaccatagaatacgtaagatgcatacgaatattccgtatcaatgctcttgctgctaatatactgcgtattctcctgcggcttatgctcttcgacatacatttcgcgcttctcaatcacaacttccggatacttagtcttaagaaattcttccgcttcctgtgccgtttcctgagacacctttgctgtgcgattctcctgaaccttagacattactggcttgataagcagtattactgcaattaccacaacaatgaatactgcaaatgcaatagcaagagtcacccttttcttaacaacatttttatcatccataaatctcgccctcctttttcaatgtctcttattaaaaatgtgcttctttatttaccacaattatataacacgaaacttacatccagcttacattcacatataatatacatttgtacttgccaatctcatgataatctgctaaactacacaggctgtgttatgacacagtaacaaatcgtgtgttcgagaccttccacacgcaaaacaaaactaaaggagataattgaatatgaagaaaaaaggaatgagtgtgaaattcatcacacaggccgctgttatcgcagcaatctatgtcgtacttgtagtaatctttatttaactacatcagtttcggaccagtgcagtttcgaattgcggaggcactcacaatactgccttactttacacctgcagcaatccctggattatttgttggctgtataattgctaacatccttggtggcgcaattgtatgggatgtagtatttggaagcattgcaacacttatcggcgcaatcggaacatacctgttaagaaagcataagtggcttgcaccagttccaccaattgttgctaacacaatcattgtaccattcgtacttaagtttgcttacggctcagagggcatgtttgcaatgttcttcgttacagttggtgctggcgagataatcgtatgcggaatcatcggcatgatacttttatatgcacttacaccagtaagacatgtaatcttcggtgatgcggaataattcacacaacacataaaacacaaggcagaagaactacctgagaaattcaggtaaatcttctgcctttttcaatatccttattcaccctttcaccatatactcacatttcccatcacagccgcaatcacaatcaccgcagccataagaagcacagacacaacccttccgcgcacctcagaaaaacggctgcacagtacatatgtaactgcaaatgtaatgagcattgcaatcagccttacaatcagtctgattatcataaatgttccaacagtaatataaaacccgcaatccctcataaatgtgagactcataagcggtgcgtccgtgtacggcatgccataatagcttcgcaaatgtatcatatcaattccatacacaagaacatacaggactatgcacaacactaaagatgccacaatccgcttaaccttaacagtgttctttccgcttgcagcattgacaatatatttagttcctgtgcttgtctcaattccgatattctcagaaacaataagcacaacagacacaagcagagccataagaagaacagtctctcttgcctttccgtacttgccaaatatctcctcatatcccctgtctgacatcatgtaaccatcaataccagtctcttccttaagattctcaagatattcctgcttctgctcaaattccctcaccgcagcataacgcgacgcatatatagacacagtcgaattaatctgcgataactcgtcaattccaatctcaccattctcatactgttcagaagcttccatacttttctggacagcctgcatataatcagctctgcgctcatcaatcagggcggatatctgcgaataatcagcaccgcccttttcaagatatatcctgtcacgctctctggagttgtccgagaaagccatctttccataactgataaaatacataacaaccagcagaagcaccacaataaccgtaaatcccctgcttgtcacaagcagcttgtgaagctccttgaatacaacaggcacatttgcaaaaatatgctgatatccggcatacagcttatcagtaagccgtgtcagcacatttttaccctgactcggacgcataaacacagttcccactaccgcaactgccacggacacaacaagaatcaccataagcgcccagaacataatagccgactcagatatgacaaagcttccccttccgcggttcgcatatgtgctgatgaccgcgttgaccttcataagacgcacaatattaatctgtttaaatgcactgtagatgctgtgaagtcctatcctgtaatacataagcacttccagccccacaactactccagtcagaataagcgcatgatttcgcttcctgttgacaacgaatacagtccataatgccacgctaagaaccactaccgccagcgcactgtatacataattgtatagcacgaacccaatctggctcatcggcatagcaaatctttcaaatgcctgtatagactgaaccggcgcattgagcgcacctgctccgccgtataacagcagcgctgctgcaaatgttgtaaaatacagacccgctgttataaccacgccagagcctgcgataataaacagtctgtgtaacgcaagccgaagccttccgcttcctgccgaatgtacaatcccccacattccattatcacgctcacccgacagaccatatattatgaaaaccatcataatcagcgcgaagtaaaatgtgtaataataattcacaaaactgcctgctgctttattattaacaagataaagcgatacatcagctactttttcaaaatccttgccagtctttacaatattattatatgtaaagctgttcttatctgaaaatatagagaaagtcataagctgctgtgcattagtctgaatctgcttcatgtcttcaggatacttctttatatattccaactggctttctatatcccttaataccgtcagaaacagaagctgctcactctcagacagtgccttatatttccccaaaacttcggtctccgcaccagcctgtacctcggattccgccacagtcccctgcttatcagccttcctgtaacttaatatcctctttatatccgaatccaccgcatttatcgcaacctcaatatcataattgccatagtaatcaacacaccactgccgctgcgcggtttcaaaccttaattccttaatccctgcgccctttgtctgctgatacacatacaacgatacattaataataagtaatgcgataaagccaatgacaactttcctgttaatcagtctcctaaactcgttcatattccgcccctcactgtgtaagcccacttcaaaatcacttaacaggaactatctccacactgctgctaatattgctcttatcaatatacgacagcttattagagtagcctatgaacaggtacttgtcgtcgccgtagtacagattactcattttccttctgtcgagttctatagtattgacaagtgttccgtctggattgagtacaaatattttttcatcaataaaattagtaatctgggttgcacttcctgcaccaccgttacacatatatatgtactttccatcatatgacaaggctgccattactattgaatcatcagccttatacaacagtttgccatcattttcattaagctttcttgaataaagccccttatctatcacgaaatagtacagaattccattgtctgtatcaacataataatcagatatattcttatcagataccagttctgcgctgcctgtggcataatcataacaataaagcttgtaattaacgtctgccgttaatgtttctttatcaattgaattatgatttatcaggaaaaacagcttatcaccgaagcttcttgcctcgttaatagcgttatttgctccctcatatgagaacacttcacttgtctttccatttgcaagttctgcctttacaatcactactttatcagtatctttgctctcaactgcccccatgtgtccaattctgtcatatgcatatacacaatcatcatggaatactaaagacactgttccatcatcactggcaaacagatctgcaacatcctctctgctgcttccatctttcgcaattctttctaacttagccataccgccttccactttaacaacatatagacttcccttatagtaatgaagcggagaattgtcgtaactgctgtctaatactgcattacaatctgatgaattatgcttacattcagctttggcacacactggaataatcttatgtgtactgtcatcaagatacataagcattgtagtcgaatcagtatcactccagtccagataataatatcccgactccgctttagccacacgatgtccgtcagttctccagctgctcatctcgtctgactctgttgcattgccgacattaattgttttgtctgatttccctcttctcatccccagaactactgccaccacgattccaacaactacaactgctgcaataatacctataataacctttttcttacccttcatatgagacaccacccttcttcaattcataactataattatagcacttttagttatctattaaaagacatattgaacgaaataacataaatactgcttaaaatgcatcattttgattaattatcctgtaatctcaccacacagactattaccctaagcggtgggtactcttaccgctttccaaagttacccggtaaacctactatttcatcaattttcacaatctggtaggtcttttttacattgtaagttggattatgatgcttctttccatcttaaatgcctactaaatctgtcacatctcacactttagtaggtctttttctgatatatctgtaatattagtcgcatctcgtcagctaaaaagcctactattctcgcataaatcacaactttagtaggcaattttctttagccactttaattcccatcaaaatttcttttcaaaagacctactatttcatctcatttagcaacattagtaggctttttaccaactactcaagcaatttcctgtcagaacacttaacttatacattatttgcctctccacaaataataaattctttcctttcatcaataaatttagagtatattaattaacttccgcctttttaaactcataatttcccagaatatcctttttatctatatatacaagttctcctcccgtttttgcaaaaaacatatatctgtcatctccaaaatatgctgttcctgaattcttgtcgagtgcaattgtattaacaaccgttccatcagttttcagaacgaatatttttctttctatcttcctgctgtaatcagtcgcacttccagccccaccattagacatgtatagataatttccatcatatgacattgtggcacgtactattgtttcatctactttatacagcaatgttgactctgtatcgttaagttttcttgaatacagaccttttccaattacaaaatagaacaatatcccattatcttcatctacataataatccgatatattcttatctgaaatcatacttgcctctcctgtattataatcataacaatacagcagaaatgattcattaatctcatgtttatctctgtctaacgaataagtgaatatcttaaaaaataatttatccccaaaacttcttgctcctgatatagcagcatttttgccttcatatgaaaatgcttcttctgattgtccagtctttaaatctatctttttaataacttcttttccgacttcatcacttgctgtatgtcccagatgatcataagcatatatgcagtcaccatgaaaaaccattgatattgatgtaacaccatcattagcaaacaattctgccacatcttccctcttgcttccatctttctgtattcttacaaccttcgccatacctgcatcaactcttaccatatatatgtatcctttataataatagacaggtgtcgaaagataatccattgaataaaatgcattacaatcagagctgtcatgtgtacaatcaggctttgcacatacagctatagacttctttgcagtatcatcaaaatatctcaaagtagttccatcaatatcatatgtgagataataataaccatcctctgatttggcaattccgtgaatatccggattccaatagctctgttcatctgtttcttcgctgctcttgcctaagtttattgacttttccttctttcccctcaccattaccaaagcaacggataatgcagccacacagattacagccacaataattatcataaataatttcttttttgacataaaaagcacctcccccaatttatgatcataattatagtacttttaattatatattaaaaaacatattgaacgaaataacataaatactgcttaaaatgcattattttgattaattatcctgtcatctcaccacacagcctattaccctaagcggtgggtactcttaccgctttccaaagttacccgataaacctactatttcaccaatttccacaatctggtaggtctttttctgatacgtctgtactattagtcgcatcttgtcagccaaaaaacctactattctcgcataaatcacaactttagtaggcaattttctttagctgccttaattcccatcaaaatttcttctcaaaagacctactatttcataacattgagcaacattagtaggcttttcaccaaattatgcactggtttcatatgctatttgacactgccccaacaataacatatacgaaaaatgtgcctaaaaagttttaattatccccaacaatctttccatcgcttatagtaattatcctgttcgtcatcttagcaatcccctcatcgtgggttactataatgacagtctttcccgacttgttgatttccttaagaagctctaacacctcatgtcctgtcttctggtcaagcgctcctgtcggttcatcggcaagtatgatatctgcattagtaaccaatgctcttgctatcgcaactctctgctgctgtccgcctgacatctttcccggaagcttgtttctttccgataatattccaagatgttccatctgttttaatataattctctttctttccttgcgcttaacattggctgcaagaagcggaagctctatattctcatatgccgtataataatccatcagtgcaaaatgctggaacacatacccgatcttttccttacgcagcttatgtacctgtgaacggcttgccactgtcacctcggtattatcaaggaaatactttcctgctgtaggtgtatccatgcagccgataatcttaagaagcgtactctttccgcttcctgacgctcccatgactgcaacgaattctccgtcctctatcttaagacttacatcatcaagcgccttagtatcatcaaccttttcattgtatatctttgtaatattctctaatcttatcattccatatcctccaatgtaacagccgggttcatcttcattatcctgtatacaggaacaattattgtacacacaagagccgtaaggttaataaacagtacagacgctataagccttaagttccagcttatcgtatacagctttattccaagaactcccactgcaaacagatgaacctgaacatatatgacaagcgatgccacaccaagtataagaatatcccttgcaattcctccgattaatcttaactgcccgaagccataagtcctctttattgcaaattccttatttctttctataatccagaattcagacataagcatacagttaagaatacagaaaatatacacgactttatttatcttgatattctctttctggagagttttttcaactgtactctgtccgtttcctgatactgaacggctctcaattgcacaattaatatccgctccgtatacattgttatataccttttcatatgtatcattaagttcagttgtattactatcaatcataattgtgtattccttcagctcattgacagattttcttacattatctccaagacatctgttatcgaacacaatcatgttgtcagaataatcagagccttcattgccgattatacctgtaacctcatatgtttcattctcaaatgttacataatgctttccgttttcttcatacgcatatctgtactgtgaccttccgagagctacgagtctctttccataatcttcttctgatgttccgggaatccttccactctccatcacatatggcagttcttcgttcactgcaagtataatttcaggtgcaacagtggatgattttctttccgtataatataagcctaccttcttcgcccttatattgccttctgtaacaccgtccgtacaagctgatagtatgtccgatttattcaatgacacaaccgacatctctatacggttcttatacagtgctgcaagcctgtccgcttccttctggtatgccttgttatatattcccaatgccccgaatatcgtaacatacattataagctgtcctattatgaagaagcaggctgtaagtctgtatctgaatacattctgtatgattctctttattatattcataccacgccacctcatttcttcataaggtcgataagaccttttccatgcagatacgcaacaggtactatgcacgatatgactgtcataaccacagcctctgctgcaataataagaggaacatatatacagtgtgccattatctttgccatataatttaattcattcccatactcacctgctgtctgtactattatcttcccgaatgtctcccactgacaatacagccatgcagcgagtgcagatactataatcagtatcagattcttaatcagtatcatcgaatagacagcttttctgctgattccattaattatgaatatcgcataatctcttctgttaataagacactcaataattgtaactgctgatatcgcaactattgctataacatacagaagcacagatgctataaatgtcttgtcattagttattgcattgtcttgattatccttatcaagcttttctccttcattagtaatagatgcccttatccctttctcagcctgataatccataagcttactctttattacatcattgtctttataatctgcgacataatagacaggtgttgtatattccagactttctccccagtcatacttagatgtatcctttgttaccacaagtccgctctccgacagatccggtttctcaagcgttatgctctcattaacaagccactgtgcatcgtccttaagaaatcccacaaccacacattccgatgacattgtctggcatctctgtcctatctcatacactcccttatatgaacttccaagccacacaaggtcatatccttcccactctgcctgcttctgtttaatatcttccctgcttactcctgtattacacatgtcagctatatctgaatcacttattacagcattcacataacccttatcaaactgcacattgttttttataaccagtccgtatgctgatatttcttttactgaagcaagtccttccatcatgtcactctgctcagaatgagaactgttgacagaaaaagttatcttattaatattatagggatttatactgtaagccttccgctttattccggtctcacatctgttcttcatatatgtattccatgtcctgtctgtcatatagaacgatataacacatatcagtataagcatcagcgttacaaatgctctctttatatactccctgtatataataataaatttattaatcagcctcatcttgatagtatcccccttttctcacattttcctgtcgtctattctatgaacttattcttattggcttccttccatgcggcatatgcagactccccgccttcatccattacataccccatattgccagttatatagaatgaatactcacatggaatatgccccatctcaagaaccataagaaactgtttatatctgttatccttattaaattcggcataatcaatataatataaatctgttgtctctatctgtctggctgccagcaggtcacattcagagtaattattatccttaaatgtagcccaggtgttcagcttttgattcgatgaatatctgtcatcttcagaaagatatctgttccacacctcatgtggaatgccatatatactcagcttaatatccggaatagtgtcaaaaaagtcctcatatatagcaaatgatattgccagcacatcaattgcagaaatctcatgtagtaatattgcatcgtttcctccgtcccgatttccatcttcgattgtttctggatcagaaaacacctctgttactgtacaattaaattcctctacttgcttttgcaattcttcactatattcacgatatggcataccaataccaaatccgtctgcattctttattttcatgccatcgggcttattaatctttttatggatttcatatagatccatatctaaagagtaggcatcatctacatatttaacgcctcttttttatgagtttctgcaatatcaggaagatacaattccaaatccccaaactggattttcttaaatttccccgcagaagcactgtcagaatctgcacttccgctttctaatcccttagctgatgcctgtgtaacatccggtttagcaagcagttcggagctttcatccgatacaacatctttgtttcctgaacatgcactcactgtaaacataactcccaataatgttgctgttaataatccccttctcatgtgttccctccaaactttttaatacgacattatacacacaatttattttactttatacatttaattatagctgatttcatgttctatctgacactatcaatacatatacacaattagtatccgcccctttgtctcaatccccatcttctattctataaacttatccttattattctctttccacttagcataatcctgtgaattacttatgttataattcatgtcatcattgatagccactgcataatcaatcggcatttcatcaaattctgccactatgaataactgtttatatctgttatccttgttatactcactgtaatccatataatatacaccgctcttatcaattttcctgctggcaagtttatcacagtccgaataattattttcagccagtgctgtcatcatggctttagtatcattaatagaatatacatcatcttctggcatgtatttattccatgttgaataactcattccataaacatttactgtaagattaggtattgtttcataaaagctctcatataaagcaaatgacactgcctgtacatctacatgtttgaactcatgcttcatttttttatttctatcagcttcttcatctctttcataacttacatttgtttcttcatctgattctctatatgcccttgccactcttgtcttaatcaattcattctttgatttagccatttcatctcttgtaatttgcttttcttccgaatcaacagcaaattctggaaacgctgctgcacaacaacttaattgcgtattaccttctgctgaagaagttccttctggacgatttattgatttatgtacatttacattttccgcaaaatacgcgtcatacagatactccacgcctcgtattttgtcactttcttttattattggaaaatataattcatatattccatactggattttctcatattttcccgtctcatctgtttctgaattatcattaaaactttcgccttcttttgttgctgcctgtgtaacctctggttttgcaagcaattcagaactttcatctgatacaacatctttgtttcctgaacatgcactcactgtaaacacagttcccaataatgtcatagttaataataactttttcatagatgccctcctttaactaagctgtctgcctaattattaatcatctgctccgcatgcgccttcttccactccgaatataacttctcatcgcttatcttatatccgcctgctgcacatgccttcagatatacctttttccctgcatctgaaaatttatattctattatataattaatgtagtctcccttcttattaaactgggcataatcaacataatatacacctgtttctgttatatcctttgaacaaagtaaatcacaatctttataatcgtttttcttaagcgtatccttatatttcagaaattcatttgctccaaatgtttttccaaattttttcttaaaaagagattttgggactccatataccgatatattcatcttagggatatcatcataaaaatcttcatacattgccactgatattgctccaatgtcaagactcaccatcgtatctgatgtagattttacatctccagttttttctactctatatgtaaacgcataccctgcactatccgacagataccagttgggaattgtatcattcgaattatagtaaggtaatgcaaaatcaggtacaatacaggcttctacatatggtgctccataagcactacttgtctgtttattatataatgcgccatctggtatattacccgcttcaaggtcaatccgcctttctgtcgacgattttatatgaagttcctccagataagaaacaccttgttgcttattttctatatatgggatatacagaatagtatccttatcaccattgttactcttaattctgtagaatccattaattattgtataaccttcatctgttgttgtagtttcatactcctgaataatataatcagggtcaataagtgtctcgtctgctgcattatctttcttaccacaagatggtagtgagaaaatcatcattcctgataatgacacccatgctattttcttacctattctgttcatagactatccccccagtcacaatcacgaactcatttatttttcctgatatacatatatacgaatctgttttgaaaaaagttgaaacaactttttacttatttcataaatcccctccataataaaaaagctataaccaatacaacctgtttttcacaatctctgttacattaattatagctttttttatattttatcctagataaatgtcacgaaatgacgaaaaagtggcatgaaatgcattatttttctttactatccccaacaatcctaatatccactcgatattattctccacttaccgccttcagttcgagcaagataccagccataacctgtttcctcatcatctacatcaaaaccggtattctccacatctttctctttctttgacgtatgaaaatcacttttgaaatatataacctcagtaaaatcatctgtccagccatctcttttggctaattcatttatccatttcaaaacactatctgaattactggatttatcacctgcataataaactttatgaagctcaaatcctttcatatgcctaatctttctttttattaccttaatagcttcatccatatctttttgtgtatagatatctgaagttccatagtctatttctactttaggcgttgttaccacttttgttattacaaagcctattactgcggcaacacaaaggattgctattactattataattacttttttcttttttgatttattgtaacaactatttgtttgtttaatagtattatcttctaacccttccatatcttgctccatctccctcctgttcatcccaatgatttacttcttctgaagcccatgcattataattatcactatgctgtgcaattttataatcaagatattttcccgtctcattttcctgataatgatatccatcttcatacataaaatcaacatttgttacaaatcccatgtgatcccagtctccatcattatctacatctaatgaaacaaaatctcctctctgaatattaacactaaaatcaaaattatcatgagttgtaaatcctactcccatatatcttgcaaaagtatccgcatatcattgatacaaccaccataaatacacttaaaatctttttcataaaaaataccttttaagattataaatcttacctttcatatttattgtatttccacttttcccattgcttaccttagttaccccatgcctctgttatgcacaactactttgtttccttcttctttaacacatcaggctcttttggctgatacatactaaaaaacgaggcagaattaacagaagccttagctgttttcttagctgcctctgccattcctttaagaatcctcttcatgaaatctaccctcctttcgtactcccaatagtagcaacagtcctattatcagaagcattgtattaatatacaggcttatctggcataagaatgagtatttaccatatcttataaccacacctataatattcaatataaaagatataagcatagacgctattccaagcactgcacttacaatcatatatttttctttctgttccatcgtaagcttcttgttatgatgctctaatggagcattaagaacaattataagatatccagctaaagctataagccatgtgatgatggttcctcttacatacatctggattcttagcatcagcaacgaaatcatatatgttccgcagtaacatacattacatcccacatgtgtgtctgcatgatatccacctgtatacaatctgatgacaatcatcattatgttgtatacaactgcataccatatgctgcctgttatcaatccaatgataatcaccaatgctacgcttataatccctgatattatcaactccataccatatgcacacacttctttttcttcttctgtaataacatccttagaaaattaaatcagctataaccaatgcaactgaatgaatcatatacataattcctttcactttatacattgattatagctgatttaattttttaaaaaagtagtttggcatattcggtaatatatggcatattctgcacaattttaattatcaaaaagctattgacaaaccttttctaatgcgcatctgcacatcagataattatctccctgctgttcatagttgatagttccattatatttatcaataatatctctgatattcataattccgaaaccatgcatgttcttatccttcttggttgtattcatgtgtggattgttctttaatacattaccacttgtggtattacctatgtctatatacatgctggcattatcctctgctatctggagcttaattgatggcttctcacattgtcctgctgcttcaatagcattatcacacagattctcaagaagtatgtataagtccatatcatcaacacctgcaatattccccagtatataacatgccatgtcaattccagcctcgcggcattggttaatctttctgttcagcagataattaagcacaatgttatcacttacaatctctgtaagattattgttcttataaccttcactgtatttatcaagcatctctgttgctttattatactgttcatcccgtatcagttcttttataagtaatattacattcttaaaatcatgtctctgcttactattctgtctgtgcatatcaagtattgattcaatatctttctccttctgctgatatgcactaagcataacctgctgacgggttttctgttcatataccttctgttccataataagcagtaatatactgataacattaattattataatgcccgccatggcaataaatgtatatattacattcatctcatagctcttatctaatcgatataccataaggcagcatactattaccgatatagctggtatcaaagacattataagcatgtattgattatctttttcctttaacatttgttttaattttattattaaaacaaataaaacagataatattacctgaaccaatataattcctacatatctttcagcagtaccatatctatgtgcattaagaaaatctttcttaacaacaagtgataccaacccaccacctaatagtgcacttccaaccagacaacatatcatcatgacattgtagaatatcttctcaataacacttccgctcagtatcacaaaactgaacatcagtgaatatgccatatatacatagattcccacgctctcgaagaacacaagatgattagatacagtaagatatatgaatgtaattaatatcccggctgcactgacacatttcttattatacttatccttacagccaagacttataataaggaacactgtcacaactacactctgaaacagatttatgaaactttcgaatattatatctgtcatatgaacattctccttatctcatcgactctgcttctgcttatgtgatagactgtgccatccttcataataaggttatctctttttctttcctttatataatccttattgaccatttcgccctgtgatatcttaatgaaatcgaactgttttagctgctcttcatatgtacttaggttggctcttatttttctctcgccattaacacctttgaatataaggtcatgttttataacattcacagacacaatatctgaaagtattattatatcgcctttctcaattacaagtattttctttttttctctgagaaaattcataatattatacattgtctgtacaatatcttcttcaatattattctttcttataaaatcaataggagtaagaccgaatacctgatacacataattgctatgtgatgtgcagaatactattcctgcatttttatttaatctgcgtatctcctttgcaatatctaatccactcgactttccacactcaatatcaagtatgaatatatctgtgtcttctatcgcttcatcaagcatttcttgtggagactgatataccacaacttctgctatatcagtctctggcacatgctttgcatattcagtctttatatatttacctattaatctgccatgctccggctcatcatcgcatatagtaaatctagtcaagccacttccccctgtgtgaattacttaagcatttcttcccagttcaaatgccttcctgttaagctcgaggaatttagcaggtacatttttctctatggcatcctgccactgctcgtctgtaatatcagggaagtatgttgagaatcttcccataagtgctatattaacagccttggaagaacctgcctcctctgctaatgcaaggaaatctttcgcatctaccctggcacctgctgttgtaagcttctcaataagtccttccggatactctgctgcccctgtaattacaggcattggctccatcttctgtgtattggtgatgatgactccgtccttctttaagaattcaacccatcttgcagcctctaactgctcaaatgaaatgataacatcagcctcacccttatcgattacaggtgaatatactttttcaccatatcttacataagttacaactgaaccacctctctggctcattccatgtacctctgaaactttaacatcatatccctgctttaataatacatatcctaacatcttgctggcaagaagtgttccctgtccgccaacaccaactatcataatattctttgtcatattgaatctcccttcagttacctgtctatacttacattcctattgcatcgaatctgcacatctgcttgcacacttcacatccgatacataatgttgggtcaatatgtgctttcttatccttgaatgatatagcaggacagccaatctgcatacatgccttacagcccttgcaggcatcctgattaattgctattgcaggcttatgtacagttcccttaatcattacgcatggtcttctgcttatgattatagacggttctttggcagcaagctcctctgtcactgctgtctcaactgctgcgaggtcgtatgggtcaacaactcttaccctgttaaagcctaaagccctgcataacgcctcaaggtcaacctttcctgccggctctccccttaagttcttaccagttgtaggattctgctgatgtcctgtcattcctgtgattgaattatcaagaataataactgttgaattgctcatgttgtaagatatatctgtaattccagtcattcctgaatgcataaatgttgaatctccgataacacctacgctgttgctctcaccagcttctcccatagccttattgaaaccatgaagtcctgagcatgatgcacccatgcagacattaagatccatcgcattaagcggtgcaactgcgcctaatgtgtagcatccgatatctccatataccataatctttttcttgtgaagaatgtagaatattcctctgtgtgggcagcctgcacacataacaggtggtcttcccggaatctgtgcatctattgatgtgaattctggttcttccattcccatgcatttcttaataagattctgtgaaaactctccacatattggaaatgtatctttaccatgaacctgtattcccaactgcttgcagtgattctcaataattgggtcaagctcctctattacatagatttcgtccttgccctgtgcgaaatccttgataagcttctctggaagtggatataccattccaagcttaagtacgcttactttatcgccaaatacttccttagtatactggtatgatgttgatgatgtgattacacctatcttcttaccattaataagacttccctctgcacactcttcaattctgttaattccacttgtctctgcatactgtataaggtcaagtgttctctgctcaactcttacatgtgcatctcttgaattcttagtcatcatgaccttagttgggtcttttacataaggaacctgtgcaggctctactctttcctcaggacatacaacactctgtgaatgtgcaactcttgtacacattttgataaatactggtgtattgtacttctctgatatctcatatgcttccttaacgaaaagtcttgattcttctgaatctgcaggctcaagcataggtactttggctgcaaatgcataatgtcttgaatcctgttcgttctgtgatgagtgcattcccggatcatctgctacacagattacaagtcctgcgttaagtccctgatatgatattgtaaataacgggtctgctgccacatttaaaccaacatgcttcattgcacatgctgctcttactccgccgagtgtcgctccgtgtgctgcctctaatgcaaccttttcattaggcgcccactcgcagtatatttcatcatattttgctgcttcttctgttatctctgtacttggtgttcccggataacttgatattaccttacagcctgcttcatacattcctcttgcaactgccttattgcccagcattaattctctcataacaatctccattctatgtattcttatcagcctttattttcctgttctacaagtctgtctgcgccgtacatcttacgaagcttcggcttctcaatctttcctgtagcattacgcggaatatctgcaaatataatctctttcggacgcttgtatcttggaagctccatgcagaagtcttctatctcttccttagtacatgtaactccgtccttaacttctatgatagccgctgtcttttcgcccagtctgtggtctggaagtccgataacagctacatctttaactttattaaatcttctgatgaagtcctctatctgaaccggataaatgttttctccaccgcttacgataacgtctttctttctgtctacaaggaagtagaaaccgtcctcatcctgcatagccatatcacctgtatataaccagccatccttaagaacttccttagtagcttcctcgttgcggtaatagcatgtcatgacacccggtcctttaacacagagttctccgacatctccctgttttactgtattaccgtcttcatcaactatcttacattcccatctgtaacccggaattccgatggcaccaaccttattgatattctccacaccaagatgtacacagcccggacctgttgattctgaaagtccgtagttggtatcgtactggtgcttagggaagtattccttccatctcttgataagtgaaggtggaaccggctgtgcacctatatgcataagtctccactggtcaagtctgtaatctgataacttgatgtctcctctgtcgagcgcatctaatatatcctgtgcccaaggcactaacagccacacgattgtacattcttcatctgatacagccttaagaattgtctcaggcttagttcccttaagaagtacagccttgcttcctgccacaagacttcccatccagtggaacttggctcctgtatggtaaagtggaggaatacataaaaatgtgtcatatcttcctgttccatggtgcttctgctccatctcagcagcctgtgtaaggcttctgtgcttatgaagtatagccttaggaaatcctgttgttcctgatgagaaatatattgcaccgtaatcatcttctgttattgttacatcaggtgctttgcttgaacagtcagcaaccaattcacggtagctttctgcaaagcttggacagttatctccaacatagataagaagtctgccctttgataatctctctgcatttacttcaattcgtcctataaactgtggtccaaatacaataacatctacttctgcaagctctgcgcagtaatagatttcgtctgaatcatacctgaagttgaaaggcactgctatcgcacctgtctttaatactccgaaatatataggaagccattcaaggcagttatacataataatagctaccttatcgcccttcttgattcctctgccaataagcatgttggcgaatctgttcgctttctcgttaaatacactccatgtaatctctctgcggtatggtgagtaagttgtaggctcaataagcccgaactccttccatgtagttcttcttgtatccttttcatcaggattgagttctaccaatgcaacctcatctggatattctcttgcattgcgctctaagtactctgtaactggcataataattccttccctgctgcccccgacagcatgcaatttcattaagctatataatactatatttcactgaaaaaatctagaaaactcccaacctttctaccctctttcatcaaacttcccctttaattccacattaaaaaatgctatgatttagttagttaagttgcgcgtgtgtatccggctgtccggcacctgtctgtggcgcaggaatgaattgtgacaagctgtgcaggagttaagccgctgtctgcataagttcattgcacaaaagctcgtccaagcgaagcgcatttgcttttgtgcaatgtaatagactctgcagacagcggcttttactcctgctaagcgagacacactgaattcctgcaccacagacaggtgccggacagccggcctaccggacgcacacatgcaatctactatataacatctttaaagggggatatattatggctttacatgttatggacgaggccaaccgctgcttacagtgcaaagtgcctcagtgtcagaagggatgtcccatcaacactaacattcctatggcaatccgtttacttaaagagaataagcttaacgaagctggtaaaatgcttttcgagaacaacccgcttactaccgtgtgcagtctcatctgcaatcatgagaaccagtgtgaaggtcactgtgtacttggaagaaagggcgctcctgtacatttttctactattgagaattatatctcaagtacatatgccaaccagatgaccgaaggtcctaagccttctaacggcatgagagtcgcaatcatcggttcaggtcctgctggtatcactattgcaattattcttgcaagatacggatatcaggttactatatttgaaggaaaggacaagattggcggcgtattaagatacggtattccggaattcagacttcctaagactgttcttgacgacattgaatacagacatcttgccttaaaaggaatcaaaattcgtcctaacaccactatcggtggtgccatcggaattgatgatttgttccgtgacggctacaaatctatattcattggtactggtgtatggaagcctaactctcttcatattaaaggagagactttcggtaatgtccactttggtatcaattacctcaataaccctgacagctaccacctcggtgaaactgttattgttatcggtgccggtaatgccgctatggacgttgcaagaactgccaagagaaagggctctcgcaatgtcatctgtttctctatcactaaggaagttgctgcaagcaaatatgaattcagctatgcacagcttgaaggaatcacatttgaatataacaaacgccctgttgagattaaagatgatggtgttatattcagggatattattgagaatgaggatggaactttcactgatgtagaaggaactgatacacttcaccactcagacagtgttatcatctctatcagtcagggacctcagaaccgtattgtcaacacaacaacaggtcttaaggctactgcaaggggacttcttgacgcagacgagactggtcacacaagccgtccgggtatatttgcatcaggtgatgttgtcaacggtgcaagaaccgtagtagaagctgtcgcacacagcaagattgtagcagaatcaatgcatcagtatatgcagtcgctgccaaaggatagtgagtaaatagaatattcttaataattacatcaggtggaagtatgtatcagacaatacatatttccacctgattgtctgtatatgactcacgctcgatttattacgagctggtggaataccgttgtctatactacttcaacatcaccatatccgctatataccacttgccgcttctttttacgaatatatactccatatgagtagggtaatctttgaaactgccactgttataggatacttgtaaatcaaaacttacttcacatgaaaaacaatcttttgtatatgactggtaattatatactttcatatcactgaatgctggtttcctgcttacctctaaccatatattagtccttgatattctggacaggtatgagtatgcatatgagccaggcagtatgtatggtgaaagctttgcaaagctttcataattaactacatatttaccgtaaatttctgtaatctcttttatacggctttcctgttcctctatcagcttgccattagcttcaaatccaaattcatatacattatctgtgctgcttataagctccagttcactgttatacacaggacctgttgcttttatttcatgttctttatatacattctctatatgatatgttgttgtcttaggcatattaatgtgtttggcaacattacttagtacctctgcatctttagtttctgttacatattcacttcctagcttattgccatcaactgtcacttctgaattctccggaactattatctcataggtctttccttcacagctaagtcctgacacatccgcaattgtccactcatttttacttcttttctcaagatatattattatatctgttttctgcccgtctttctttaactgatataccggattatcattagtgtactcaccagatttcttagtgtatgcccacgctccctcacataatacatttttaatatattctctcacagcttcatctaacgcttcactgccttcataagcgttttcccccgtgtgtacatactttgtgaaatctcctgtatcctgtaattgtatctgttcagttatcttatccatagcatactctggtcgtgactgctcatacttttttaaagctgtccacaggatgctccacagtacaacaaatcctatcagtactatggtgacaactattatatatattttccagaataacgggatttttattgtctttttaatcattattttctcagcctccggcctgcccctttttaaacatttatttaacaattattgttgtcggtaaatctcttggtccatacattgatgcacaactgttgatgtattctccattgtaatacataagtgatgatgagccaccatcaagattagccgcattaactgcaccatactcaagcatgagctctatcacatctgaatatgacgctcccagactgtttacctggcgtccatctattactacaagcagtattgaaccatcttctctctgtccgattgctgttcttggattaagaccgcttccgctcccattaacttcaaccgcttctccattaacaacaagcaccggcccgaagcttacggcatctcttactccccggtcaagtgccgcctgtgctgtcatatctcccactacaagtacattattattgtctatacctataattccataagttgttcccagtgacccccactttaacctgccttctgatataacaagtccatccggctcgccacctgttcctactcctcctgcatcccgaaaaccgccggcattagtcgcagctattgctccatagctttccgctatctctgatactttctttcccttacagctttttccatattctccgcttgttcctaccataactcttgatgggtctcttacaatcatcatcttacctctgtaagtatccttctctatatcaataacctctatcattgatttttcttcttgtgtaagaattgttgtatctgatataagcgaagaatctgtcacttcatctgtcttctgtatggaattgattgctcttattctggctatctcttcatctgaaaaaaatagtgttacaagtattcctcctgcacttgattccattgctgaattaacaaacagatttcttgctgtctttgatggtccgaattccataattcttacaacgcctaacagccctataagaagcagaaccactgtggtaagaatacatattcctactctccttactattttcaatgctatccttttctttgtcataatttctatcctttcacacaaagtgaaaaaattatagcataaaaaaaggtcagagtaaatcactctgaccattatcttagacatattctgttataaatatattctacatatcagcaagcaattccttagccttatccatagaatccatatgaacatatatatcgcacttagaattcttgttgttattaaggaacttgaacacgcctgtgtggaaattccacttctcaaaatatgatatattgtttcttctaagaactctctctatctttctgctttcctctaatgttacatcagaacgcaataaacgttcattagttccgacttctgacatactgctgcacctctttactaacgtctgttatattagtatgttatcacattttaaatgtaaaatccactttagaaaattaaaaaatcggtctgaacacttgtccagaccgaataaatattttaataatacgaattacgcaattgtgtaaatccatcccttaggagcttcaatcttacccatctggatacctgttaatgtatcatagagcttctggattgtaggacccatcttctccattccgcttgggaagcaaatttccttaccatggtcgttaatcttaccaacaggtgagataactgcagctgtaccacaaagaccacattctgcaaaatccttaacttcatcaaagagaacttctctttcctcaacctctaatccaagatattccttagcaacaaccattaatgaacggcgtgtgattgatggaagaattgaattagactttggtgttacgaacttaccatctttagtgatgaagatgaagttagcgccacctgtctcctcaaccttagttcttgttgctgggtcaaggtacatattctctgcatatccttcttcatgtgctgtcataattgcatgtaagctcattgcatagttaagtccagccttgatatgtcctgttccgtgtggtgctgctctatcaaaatctgaaaccttgatagtaataggcttagcaccgcccttgaagtaaggacctactggagttgtaagtactctgaactgatattcatcagcaggcttaactccgataacagggttgcttccgaacatgtatggacggacataaagtgtagcacctgaaccaaaaggtggtacccatgctgcattagcttctactgtcttagcaactgcctctacccacttatcttctgggtaaactggcatctcaagtctctcacatgaatctttcattcttgctgcattcagatctgggcggaacataacaatgtgaccatcctctgttgtataagccttaagaccttcaaaacatgtctgtgcatactgaaggacacctgcacactcgttaatgacaaccttgtcatcctctgtaagtgttccgttatcccatgcgccatctttatagttggctacgaatctcttgtcagtcttgatgtaaccaaagccaaggcttgaccaatcaatattcttcttttccattgttagtacttcctttcatctaaagatactgatgtaaaaaatgttttacacgattttgagcatattttacgctcttaaaaatgtcatgtcaacatatcattattcatctccggtaatttctgtgtaatatttagcataatcggttctttctgccttagtaaatgcaattgctgttcttggatgctggttagtctgaccggtaagcatgtactgtacatcacatccccatacaacacctgatgccttaagtggaaccatatgcttctcaataaacttaagcacaggaactatattaaacttaggatttcttaagaaccctaataataattctgaatagcagttacctgcacctcttcccattccgcttactgttgcatcaagaaggcttacgccgattgagcatgcctcgattgtattggcaaatgcaagctgctggttgttatgtgcatgtataccaacattttttccatacttctctgctatcttaatgtatttgtcagcaagtcttcttacctgctccgggtataatgaaccatagctgtcaacaaggtatatgtactgtgccttgctctgtgatgcaagaagctctaatgcaaggtctaactcattctcacctgctgttgatatcgccataatatttactgtaacctcatatcccatatctgaacagtagttagccatctcaatagctgccggaatggtattaatatatgttgcaactctcaccatatcaacaactgactctgacttaggtggaatatctctcttcatattagttcttccgacatcagccataactgatatcttaagtggtgtgtcattctcgccaacaatagctctgatatcttcttccttacagaacttccactttccgaattctttctcatcaaatatatccttatcagccttatatccaaattccatataatcaacgcctgctgccacattagcttcataaagatctttaacaaactcatcagtgaattcaaaattattcacaagacctccatctcttaatgtacagtccataaccttgatgtctggtctgtatgaagtcaaattacccctgttttctgccataacctgtttcctcctgtaaaatttctccctgaaattgtttccttttggaattgtacccctttgggattgttccctcttgagattgtttcgctttaaaccgttacgctttaaagcgttaaactgttttgaattataacacatctttcgaggttgtcaactgttaatgtaagattttcagctttggcctactaatctttcataacactttgctttagtaggtctttttcctcattcttgcttacataagctgacatatcatgcgtaaaagacctactaactcacctatctctgcctgtttagtaggtcaactcctgctctccatctcttttccctagctaattcacctactaatcttccattacacttcatcctagtaggtcttcgcctaattcgctcttacataagctggcttatcactcttaaaaaacctactaaacaaaccacttctgcctgtttagtaggtctctccccacacaccaaaaaatttgcttggcatagtacaactacatatcacaactgcactgctcatccaagcaatatgccgcctcacgacttcaccatcagcctctcaataaacacatccatcaacgcattaagccccttaagatattccttcgcattagtgaatttcttcttagttacggtccatatgaatgcaggattggcgtctactctcatctggattgcaccgccatactcgtcaagaagcttctttatagcatccgggtctaattcagccttaggataaactgtcataactgtacgccatactgctgttcctgattcctgatgtgcaacgccgccctttatctctatcatgccaagtttatgtgcctttgacttgataagcgcaatcataagcagattgtcggcgcatgatggcacacttccgtatctgtctgataactcgtccctcatatctgataattcatccatgttctcaagtgcagcaattctcttatatatatcaagcttctggtactcactcttaatatatgttgccggaatataagcgtccacatctacatctattgttgtctcaaactcatactcattcttaattcccttaagattgttgaccgcctgattaagcattttacagtacaggtcatatcctacagccgccatgtgaccgtgctggctgtttccaagcacatttcctgcacctcggatttccaggtctttcatcgcaatcttaaaacccgaaccaaaatccgcaaattccctgattacgctgagtcgcttctccgctacctctgtcagtaccttatctcttctgtacagtaaaaatgcatacgcagtccttgagcttctgccaactcttcctcttagctgataaagctgtgaaagtccaaaacgatctgcatcttcaattatcattgtgttgcagttggatatatccatacctgtttcaattatagttgtagacaccaacacatctatctcaccattaacgaaatcacacattatcttctcaagctcccgtttagccatctgaccgtgggcatatgccacatttgcatcaggaacaagctcctgaatgtgtgcagccgcctcatcaatgcttcttacacggttgtatacatagtatacctgaccgtttctggcaagctctcttgtgattgcctctcgtatcatttcatcattatgctctgtaacgaaagtctgtatcggaacacggtcaaccggaggctcttcaagaacactcatatccctgattcccgcaaggctcatgtgaagcgttcttggaatcggagtggcactgagcgtaagtacatcaacattattctttaacttcttaatcttctccttgtgtgtaacaccaaaacgctgttcctcatcaataataagaagtcccagatccttgaacaccacgtctttagaaagaagcctgtgtgtgcctattacaatgtcaaccatgcccttcttaagttcctcaatggtctccttattctgtgctgaggttctgaagcttgacaactgggctaccgtaaccggaaaatccttcattctctgttcaaatgtggtaaaatgctggcttgcaagtactgttgtcggtacaagataagcaacctgctttccttcctggaccgccttaaatgctgctcttatcgcaatctctgtcttaccatagcctacatctccacatataagtctgtccattaccctgcggctttccatgtcatgcttcgtgtcttctatcgcatttaactggtctgttgtctcctcataagggaacatttcctcaaattcctgctgccataccgtatccgggccaaactggtatccttctatcctctgtcttgtggcatacaactcaacaagatctttagccacttcttcaacggctgaatgaacctttgacttggtctttccccactctgaaccgccaatcttattaagctttggctttttctctacatctgaacccgcatatttctgcagacggtcaagctgtgttgcgagcacataaaggttgctgttatctgcgtaagatatcttgatgtaatccttctcaacaccttcaaccttaatcttctcaatgcctttgtactggcctataccgtaattctcatgaacaacataatcgccaatattaagttcattaaagccggcaatattcttgccatcgtactccttcttctttactttcttgcgcttcttctctgtaaatatgtcagtctcggcaatacacacaaatccctgcagcggatactcaaatcctctgtgaaggcttccgtaagtaaccatcacaagtccacctgccatggatttattgctgtcttctgtatagaagctctcaattccaagccttccgaggtcatcaacaattctgttagctcttgttcttgagctacacacaagaagaactgcgtatttactgcgtttgtacttccttatgtcatctgaaagatattcaaagctgttattatatgagcttatgcttctcgcttcaatatgcattgaataatctatcccaaagaattcaggtgtgtattcaagtgttgtcagcacaagctgcttatgtccgttcattgaaagaacggctgtctccatatccataaacatatgtgtctgacttggtagcacataaccgctttctaatctgttcttcatactctcactgtactcatagaaagtcatgtcgctgtgttccttaagccttacaggttcgtccacgacaataagagtatctcccttagggaaatactctgccaggctgctcactctgtctgcaaatgtatatatgaatttgctgtaatctcctgtccttaacgcgtcatcaaacattctgttaagatgattgccagcctctatctgttccttagtacgctttcttttatctgctccgaacagcttcatctgttcatctttctcatgtctgattttttcaattccatgctctatctcatcctcagtaaaaaggaactctgttgcaggaaatactgtataactcttatagttctcaatcgaacgctggctgtctgcatcaaacgcccttattgagtctatctcatcatcccacaattcaattctcacaggtgcttcatctgtatatgaaaatatatctattattccgcctcttatggcaaactgtcctttggcttcaaccattccaaatctctcgaatcccatagctgtaagcttctttgccatatcctctacatcgagtatgtcacccttcttaaggttaatgactgccctcttgaatctgtcgactggaagaagcatatctgatattccatcaatggttgtcactattgtaagcggtccatctgaaacattctctgttgatttctccgttccggatttggcgatgtccgatttattcaatctgtcaattatggctgctatacatctgattcgctctccggcaatctgtcgtccctgcacatctgcgttataaaatattacatccttcgcaggataatacattacatttccgccgttaaagaatctggcatcctccgccatatcccttgctttcccctcgtcactggttataacaagctggaaattataattgctggctatagcacttgaaaaatgcagcttctgcgtgtcaatacagccacttaccattactgttctgccaccatctttagcaagctctttattaagttgtcccacaccggctgtattgtacaccggctcaaatattgctttcatattataccaccagttatccgttatatttattcataccactttctattccatctgtaagtatgcattctacagcttcacaggctttcttattagcctctcttaatgttgcatattcctctgtaggaaatttcccaagcacccagtctgcaagatcccagttcttaggcttatcgccgactccgaactttattctcttgaacttgtcgcttccaagatgtgctattatactcttgattccattgtgtccacctgcacttccctttgcacggagtcttagtttacctacgtcaagacttatatcatcgaagataacaataaaatcatctatatcacatttgtaataatccataacttctcttatacactcgcctgaattattcatatatgtcataggcttaacaagtattactttctgacctgctattacaccttttccgataagtcctttatgctttgctgtgtccacactgatattatatttgtctgcaagctcgtctattactgaaaaacctgcattatgtcttgttcccatatattctttacccggattaccaagtcccgctattatatacataacatcctcctgattaattatcatatattagcaagtatataacatatttcttcttttggctatcttaacgcatcatctgtaacctgacaggttaagacaaccttatctttatccaaaaagtcccgcaagtcataacgaccgcgggacattttgctatattaaacaattatttaattataattatttaacagatattcttcttttctttgatacaaatacaattcctgctaatgcacaaagcattaatactacatataatgcaattggagctgtatctccagtctttacagtttcacctgttgactctgttgttccattaacattattgtcttttcctgtttctccaccttctgctacatcaccctttgatgaaccgtcatccttagagataacttctttgtaatgaactggcttccatgtaccaagaactgtatcaacagcagaaacattttctgaatcaatataattaacaacagcatctaatgtactcttagtgcagcctgttgtcacaaatgcttcacccttgtttgtgttattgtactcattgaagattgctgaagccttctctccattagacatttctccccagccttctgagtcaatgtatccattagtctcacactcaataaatgatgcattagagttagcaccccatgttctaccatacttacctaatactgctatatcaccatgtgctccatctgttgtaacctcacagtttctgaatacatatgggcttgtcttaggtgcaacaatgtaaccaatctttgcattattattctcatcattcttatatgtcttccactgtaacttacagttatcaaatacagctgcaaactcaccacagatataatctacattaccaccgattgtacaaccgttgaaatatgcgtgatatccataatttgctgaaccatttctaccaagtgtatcctgtgatgaaagaattgaacagttgaaaacttcaatattatcagcctcaatatagaaagcatttgatctctctttaaacttgtaatctgatacatctgcgccttctgctaatctatctactgaaagatttgaacctgcaatatctgtcttctcagcctctgttaagtaatagttgtatgtattcaagaatgttgtattctctgcaacaaaattattacctctaacaatgaatactccaccccagagacttccatttccttcttcagatgagtatctgtccatagcaagtgtcttattgtaaagacctgttgctggatctattgaataatactttgttccaacaccataataccatgaaattgtatgtccattacccttaagtgttacatatggtgcagccataactacctgttcaaatacatcagatgtaaggttaatagttactctgcctgcttcgccttctggtctgttctgcataccaagaatagcatctgaagcttcatttaatgtatcataatcgccaggaacattaatctctgacttgaattctgtcataggaacaactgaaattcctgtaatatatgttgttgcaccaaagttaacaacagcatcaccttcaactactatctcaaatgtatctgtcttagatgttgtaccaactgatgtatagcccttatcagtttctgtactatcgtacttctctccattaactgtaaagttgaatgcatagtaagtagaaatagcaaccttagcttttccctttactggaattgtaagtgaagaatcagctcttgctactgtgtgaggctttccattctctactgcaatactacctgctgttgcaagagatggaactcttgtatagctgtaatctctcttagatgctggatcatccttctctacatatacatcattaacattctcagcaccagccttaacagatgctctgtcatatgttgttgatccatccttagtctctacgcttgttgtatattcaccaggctttacagaaaccttgtatgaatctcctgttattgttgcttcatttactgttccactagtattattagtaaatacgagctttgtaacattagatgaatctgtacctacaatcttacctgtaagttcaacatccggaacattattaagtgtgattgtaactgcatcacctgttactgtaaatgtctgtgaatcacctacaagtggcttaacaccgccatcgttagagcttactctgtatgtgtgtcccttaagaagcttaagagattttgttgttgtgctgagagatatctcatctccacctaactggtcatctactaatgataaccttaatccgctaccaattgttgcatcaatattatttacagttactggaactgtaatcttctcatctgcaacatagctgtatccagcatagaacatattattagtctttcctgttgttgacataacatatgtcttaccaggaacaactttaaatgaatatgatgttaatcctgtttctgaatcaacatagccttccttggttccatcagcattgaaagtatgtactctgaggaatgaagttgagttataataaactgtcatcatacccttagctgctggtgtaaatgtagctaaacatccatcaccctctcctggaagattaggaatattattggcatcagcatgtctcttacctgatgtataagcatcatgttcaacaccattaattgtaaccttcttatctggctttactgtatactgagtaataactccgcctactgtctgtccacctaatgtaagtgtgctgtctccgaacttgtactcaccagtcttaacaacaccatctacagcatgctcgtccataacaaatgtaaagttttctacattagcttctggctctgcaatatgctttacttcaatgcttccaatatatccatcagctgttgcaactaaatctacatatcctgctgcacctgagtattgatacttgaattctgtagtgccgacttctgttccttcaattgtagcctgcttctctttatatgatccaattgtgatttcacatgaacccttaaccggaatcttaacaacagctcctgtgttaaactgtgcccagtcacttcttgtagaatcaaacttaccagttgtagcatcaataactaagccattaacttcacctgtagttccctgaatgagctttccgttagaacccattaattcagaaccttttctgaagttccatgttctgtctccgttatcttttgattctactaattttaaattcttaatcttcatctcacctgaatcaccgcttgcaagtgtatctggtgtaagtaaaatataaccatcctcaaaagctgctgatgaaactgttacagtagcttctttatcaccattgatattaactgcattaggaagttcctctctacctgctgtattcagacagatgactgcattctctccactcttgtcaccaacataaacatatctgttattgttgttactagaaaactttaaagtaagtgtagctgatgttgctgttgggtcaacaggaacagcaataacagcatcctttgttttctgagctgataatcctgctccaccagtcttaacatatgctttaccggcagcaacctttattctgccaacctcatcaccttctgctaaagtaagtgaactgcttcctgagtattttgaaaaatcccaggttgttgttctttcgttattctcccatgtaccagcgtctactacgaccccagattcagcggtcttatcatcggctttagtattagtaatactgcctggcatgagagctgcaaccataagaactgccatgaataatgatgcaattcttctgatcttacgctttttcataaacttcataattatcctccttaaatatatttgcacacgactgtgtctttcgcggtagttttccgcttttgctatcataatacatttatgtaatgtgttttgctaccgctttttttgtttcttatattgtttttacatataattttggcttgattttttaaccatttgttaattacagcaatatttcaacatgttttttgtgcaaaatgtatatattgcacttattttgctctaaaattttccgttttttaatccatttatttttccatttatctgtgttaatatatctttaaatataacttcaggagaatgtatgaattcaaattattttaacatttcaaaattatatcgcactccagaaaattcaatgtcatcttctcatacacactctttctgggaattattttaccttaccaaaggaagctgtagcattttaataagagatgctttatatgaaataaacgaaggaaccatcttcctgattccatgtgatatttctcataaaaccatatattccaatacagataatgagcggattgtaattgaattaggagacgactatgtagcaccaattatatcaggtttccccgacttaactttttataataaatactgctgtcatttctttacttttaatctgtcagcatctaacctgattaattattattttgatactgttcttttagaatctaaaaaacacagttctatatcttcattaactataaggcattcaattcagggaattattctgtgtataatccgttctggttttgatataacagcgtcattaaatgtcaggaactcattacaaacagaaaatacaattattcagaatgccattgattacatagaacagaacttttccgccaatatttctttgaccgctttggctgaacatttacatctgaatccttcttatctgtccaagctttttaaagatgaaaccgaaatgacattcaaagattttctgaatagaataaggattagccatgctgaaagattattgcttgaaaccaatcttccaatgtcagatgttgcttcattatgtggatatgaatccggtaattattttggggatgttttcaagaaaacaaaaggtatttccccaatcaaattcagggaagcaaagggttatattgcataaaaaaggtctgactctgaaaatgcgctaacgcatctgtcaaagtcagaccttttaaatgtgttaaattgttactcctctacatcctccgccttatcataggcctcaagaacaagcttctgcagtttatctcttgtctgagtattgataggatgagcaatgtcacgatactccccgtctgatgattttctgcttggcattgcaatgaacaagcccttctctccctcaatcaccttaatatcatgtaccacgaactcatcatctattgtgattgacacaactgctctcatcttgccctctttagcaatctttcttacccttacatctgttatattcataacgcaccccttcttgaacctctgcggttcttgttatactttagtctgaaaaccttctgttgcaacttttattcttaataatacaaagggctgtcctccacaacaatccttgtaccattctccccgacataccttgaattagctttgattgtactattgctttcaacaatacagttctcaatatatgcattgtctccaatatatacgttgttaagaataattgagttcttaattacactgttattaccaacatatatcttcttaaataacactgaatcttcaacagttccgtttactatacatccacttgaaacaaggctgttccttacattagctccgaagttatacttagcaggtggtaaatcctcaaccttagaatatacatccggatactgcttgaagaagtaatctcttacatccttcttaaggaaatccatgttagtcctataatatgaatctactgtagatatattgctccaatatgtatcaagcttatagccatatatcttcttgatattcttatatcttacaagaatatctcttacaaactcatgtctgtcttcttcagcagccttttcaagaagttcaataagaagtcttctccttattacatatattcctgttgaaactgtagagaggttagtctctaatggcttctcatcaatatctgtgattcttccttcctccgtcatggcaactacaccataacgtcctatctcagaacgatcttccagattctttacaactactgtaatatcagccttcttctcaatatgatactgaagcactttattataatcgagcttatatacaccatcgcctgatgcaataactacatatggctcatggctctgttttaagaactgcatattctgatataatgaatctgctgttccacgataccagttactgctctctgctgtaattgtaggagtgaatacaaataatcctccctgctttcttccaaaatcccaccacttagatgaacttaaatgctcattaagtgatcttgcgttatactgtgtaatgacagcaaccttctggattcttgaattagtcatattgctcaatgcaaaatctatggcgcgataacttccggcaatcggcatggctgcaatggctctcttattagatagttcacgcatcattctgttatttccgccagctaatataatacctattgctttcattaattatcacctgccttaattattatgcctccgcctggtaactcaccattagggtaatcctgtaatgttgtctctcctgatatggctgtattctttccaaccttaacattgtctggaataacagaccactcgccgacggtaacaagtccagaattatatatcttagggaacttaacattctctgcttcttcaccaactccaagttcaacattctctccaatcgttacatcttctgcgattattgacttggttattgttgtgttctttccgatgtgtgaattattcataataattgagtctcggattacacagccttcttcaataacaactcccgaacctattacagaattaaatactcttccgtatacttcagttccatcacctatgatactcttctctatataggcatctttagcaatatactgtggtgggattgtatctgtcttggtgtatatcttccagaattcctcataaagattaaatataggaataatatctataagttccatattagcctcccaatatgaacttaatgttcctacatctttccagtatccattatactcataagcaaatattctcttattgttattaaagcagtatggaattacgtgttttccgaagtcacattcctgctgatccttaagcttgataagtgcgtccttaagaaccttccagctgaatatgtatatacccattgatgcaagattgctctttggatgttctggcttttcttcaaactctgtaatcttattatcgttatcagttacaaccacaccaaatctgcttgcttcttctataggtacaggcattgcagcaattgtaatatctgcattattagccttgtgataatcaagcattatcttgtaatccatcttgtatatatggtcacctgaaagaataagtacatattcaggatgatactgctccatatactcaagattctggtaaatggcattagctgttcctgtataccattcactattctgactcttctcataaggtggaagaactgatacgcctcctacattacggtcaagatcccaaggaataccaattcctatatgcgtgttaagacgaagtggctgatactgtgttaatactcccactgtatctattcctgagttaatacagttactgagaggaaagtcaattattctatactttccaccaaatgctactgccggctttgccaccttagaagtaagaactcctaatctgcttccctggccaccagctaacagcattgcaatcatttcttttttaatcatgctatcacctctgatgttaaatttttactgcttttagatattttgattatatcatactattctcattaagtaaaaagaatttcgagttttttatacacatttttatgcacattttctaaatcgtatagtatataataagaaaggtttgaaaaataagccgataagacatacaatatattaaacactaaattcaaggaaggaaaatatcatgtacaagattgatttcaacaaccctatccatattcacttcattggcataggcggtataagtatgagcggacttgccaagattcttttatctgaaggttttactgtttcaggctctgatgctcactcatcagctcttactgacgaacttatcggggacggctgtatcgtatccgtaccacagagcgccggtaatataactaatgatatagatcttgttgtatatacagcagcaattcacccggataatcccgaattcaaggcagctaaggaagcggggcttccaatgcttacccgtgcagagcttcttggacagattatgactatctacaagaatgctattaacattgcaggtactcatggaaagacaactactacttcaatggtttctgagattctgcttgctgccaatatggatcctactatctctgtaggaggtatccttaacagcattggtggcaatacaagagtcggcggtaacaagtattttgtagcagaagcatgtgaatatactaacagctttttatcatttaatcctacaatgaacattattctcaatgtcaaggaagaccatcttgatttcttcaaggatattgatgatatccgtcactctttcaagctttttactgaaaagcttccatctgacggaactcttatcatcaatactgacattgataattatgaatatttctatcaggatactgactgcgaggtcataacatttggttctgaccctgcaaagagcatgtacagtgcttctgatatcacttatgacgaacttggaagatgcacttattctcttcttattaatggagagaaggctgacactattactcttggtgtaccggggcttcacaatgtttacaattctcttgctgctgttgccgctgcaagaaagctatctgttgatatggaacatatcaaagctggtctttctaactttaagggtactaacagaagatttgagaagaaaggtacatttaacggagttacagttattgatgattatgcccatcaccctgatgaaatccgtgctactttaagttctgccgcacactatccacataaccgtatatgggtagttttccagcctcatacatattcgcgtacgaagcttttatttaatgagtttgctgatgcattaagccacgctgacaaagttgtcctcgcaaagatatacgctgcaagagagactgatacgcttggaatcagctctgctgacctgtgcgagaagattaaatctctcggtaaggaatgtgtatacattgacaattttgaggacattgaaaaatatttattaaaaaattgtatcaacggtgacttgttaataactatgggtgctggtgatgtatataaaatcggtgaagacttgcttaaatagtacattttccaccagcctgaactttttcaacaaagttatccacattatccacaattttctgttacttaattgttcagaatgattgtggataattttttattctggtaattttaagaatccagattctatgcgtttttcctacgtttattttttacttatccacattttccacattttccacatttctcctttccgcactgggcgcgctttgcatttatttttttcagtggtataatctgctcataacttttttgggagactaataccatgaataatctgaacttgtattcagagactgtttctggctatacagcagtttctgatttatttatagacgaatatgtaccatcagccaacggagactttgttaaggtctatctttatcttctgaggcttcttacaagaaagaacagcagcttaagcatttcttctcttgctgatacttttaaccaaaccgagaatgatgtcatgcgtgctttaagatactgggacaagtcagggcttgtctgcctttcttatgacgataacaaccagctttgcggcattaccgttaaagatttgaagaataattcttctcctgagcctgacagaagccgttatgctacacccgaatttaataacgacactgctgataccacggttcctgccactgctttcgccgatgaaacttccgctgatgaggctgcttcagatgtatcgtcaaatgttgtttctatggattttgccattaaagcaccatcacatactgttgagccttcaaaggtaactgctcctgctgaaaagctggatgaacttaactctaacgatgatttttctatgctgctttttgtaatacagacataccttggcaagacactttctcagcctgaggttaatgctattgtgtatttctatgacactctgcattttcctgctgaccttatcgaataccttattgaatactgtgtatccaagggtaagacttctataagatacatagagaagattgctctctcatgggctgacgaaggtattaataccgttgaggcagccaaggacgaggtatccaaccataatgaggctgtttacggtgtcatgaaggcatttggtcttaacaacagagaaccgggtcaggttgagaagcagcttatctccaagtggactgatgtattctgctttgaaaccgatatgattatcgaagcatgtaacagaacaatgaaagctacgcatcagccaagctttgaatacgctgattcaattcttaccaagtggcatacttctaacatcaggaattctgaggatatcagaaaagctgacgcacagtttgaagccggtaaagctgccaagtcttcaaagtcaggtgttatcaagcagaatgccaaccgttttaacaactaccagcagcgtcctaagaaatctgacgactggtacaactctttattaagcaataataattaattatattacaaggaggggcagccatgcctttgaccaatacacaatatgcctctattatgagactgtatgatgatattaaaacagccaacaggcggctgcagagtgaccgttataacgaagtcactgccctgtgtcctgatattgccgatattgattctgagattattgacctgtctgtgaaaactgccagagcgcgtatagaagctgactcatcggacacgaatactgatgaattaacttccagccttaagtcacttaacgaacgaaaagtggctgccctggcctcaataggcaagcccgctgattatcttgatgatatatttacatgtccttactgcaaggattccggttatgtcgacggtaaacgctgcatatgttttaataagaaggctatcgaccttatatataaggactctaatctcaagaatataactgctgatgagaactttaatacattttctcttagctggtacaacaacactgatgttgatcctgcaacagggctcacaccttatattaatatgcagaaagttctcaaagtatgtcacgatttcgttgataactttgataatacattttctaatcttttgtttatcggacagaccggtgttggaaagacttttctttctaactgcattgcaagggctcttatggattcatgccacagtattatttaccttactgctggtgagttctttgactcattcaagagcgatgattttaaggaatttggaagttccaagtttgacacttcattttttgttgaatgtgacctgcttattattgacgaccttggaacagagaaagcttccgattataatttttctaatctgtttaatactattaatgaaaggcttcttagaagaaagagtattattatatcttctaaccttgagatgcctgatattgagacaaggtactcacagagaattttctcaagacttgtaagtgcctattcaattttaagactctttggagatgatatccgctgtatgaagaaattatcaccaactaaaaggtcttaacgattatttatgtcaaatatatcattgacttatttcgcgtcaatgtttatatttttatatgtatgtttaattattatacttttatggaggattatttattatgccacgtgatgaaagacacacagaaactattccctacggaactttaggtattatcccattagcaagctgcactgaaatgggtaagaaagttgacgagtaccttgtaaagtggagagagcagcgtcagaatgagaatacttctacccttaattttgcaggatataagagagacagttatattgttaacgctaagactcctagattcggttcaggagaaggaaagggcgttcttgtagattctgtccgtggtcatgacttatatattatgcttgatgtctgcaactacagccttgaatatactgtttgcggtttcaagaaccatatgtctcctgatgatcactatgctgacctcaagagagttattgctgctgcaggtggtaaggcaagaagaattaatgtaatcatgcctttcctttatgaatcaagacagcacaagagaacaggaagagaatctcttgactgtgcacttatgcttcaggaacttacagatatgggcgttgagaatattattactttcgatgcacatgaccctagagtacacaatgctattcctcttaagggatttgaatctgtatcatgcacataccagtttatcaagtatctccttcttaatgtggacgaccttcacatcgacagcgagcatatgatggttatcagcccggatgaaggtggtatgggacgtgctgtttactttgctaatgttcttggtcttgatatgggtatgttctataagagaagagattacactaagattgttaatggacgtaatcctatcgttgcacatgagttccttggaactaatgttgaaggcaaggatgtcattatcattgatgatatgatttcttctggtgaaagtatgattgatgttgcttctgagcttaagaagcgtggtgcaagcagagtattctgcgcaactacattcggtcttttcactaacggcttcaagaagtttgatgaagcatatgagaatggtattatcgacagaatccttacaactaaccttgtgtaccagccaacagagcttctctctaagccttggtacatcaatgttgatatgagcaaatacatggctcttcttattgatacacttaaccatgattcttcaatcagcaacctcttaagccctgttgaaagaatccagcagagagttaaggaatataacgaacttcattacggtaagtaattctggtattatttatactaaaaagcggaatctgattcaattgtcagattccgctttttatcttaattcttaatctaattcacttcctatctgcaagtaaccttttgaataattccatgttccatcttcattctgcttatatacacgaagcacctgtaatccttggtctttcggctctattgtattgatgatatcgccttttgccccaatcttatatctaactcctttatccgtaataattaccagcctaaaaacaaatgttttcgataatttatctcctctaatttctcccccgcccccagcatcagcataattatctgtttcaaaatctgtctcaagcgtttctatttctccatcaatatattcatatatcttgtctactgccgtctctttccccggctgtaatctttcacagaactgttctttaagtttctcactgtcatgattttttatagcatcatagacattttctgccatatcctttgtttgtcttaatggcgacttgctggtattattactttttaccccacatgctgttatgttgaaaatcatacatataaccattaatgttattatcaatatctttttcataaaactattattgttatccctataataaatcaacatatttaattcaattcacttcctatctgcaagtaaccttttgaataattccatgttccatcttcattctgcttatacacgcgaagcacctgtaatccttggtctttcggctctattgtattgatgatatcgcctttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaagcacctgtaatccttggtctttcggctctattgtattgatgatatcgcctttacctcctatttcatatctgattcctttatctgtggtaatgattatttcaaatacaaatgtttttgatagtttatcgccccttatctttccaccaccgcccgctcgtgcaaaatgctctgtttcaaaatctgtctcaagcgtttctatttctccatctatatattcatatatcttgtctaccgctgtctctttccccggctgcagcctttcgcagaattgttcttttatctgttcactgtcatgattctttatagcatcatagacattttctgccatcttttcagttttttctaatattgtttcacttttattgttcaaatcaaatccacatgatacggtattaaatattatcaatatacaaattaaaaatagtgttattacttttttcataactggtctccaatatacatccgacattccattacaacgcttaatctaattcacttcctactctaaagacattgtttttgtaattccatgttccatcttcattctgtcgatatataattattgtttgtaacccctgattcttaggttcaatagtattaattacatctccttttcctacaatttcatatcttgtgcctttatcagaaacaacatatataccgaaactaaatccctttgacaatttatctcctctattttctccacctcctgtgtcagcataattatctgtttcaaaatctgtctcaagcgtttctatttctccgtcaatatattcatatatcttgtctaccgctgtctctttccccggctgcagcctttcgcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattcatatatcttgtctaccgctgtctctttccccggctgcagcctttcgcagaactgctctttaagcttctcactgtcatgattctttatggcatcacagacattttctgccatatcctttgtttgtcgtaatggtgacttactggtattattactttttactccgcatgctgttatattgaaaatcatacatataaccattaatgttattatcaatatctttttcataagtaatgcaatctccttagtaaacctaccatttcatcatattcagcaactttagtaggtcttttcacattgttaattgttttataatgcttcttcccaacttaaaagcctactaaacaaacactattcacacttttagtaggtctttttcttatatatctacagcatcaaagataaagtccatataatggtgtaaattacaaatttatataaaaaagagcctagagctcatctttcagttataattaagttaccacacaaaaacataattgaaaggaactgataaggacatagacggttcatactactatggtaaagtatacgcaattgatggcaataacaatccggtcgatgtatcacatggctatgaatattattatgatgtcaatgaaactcataacatgcttaactgggtaaatgaagaaggctatacacgcgctgctataagatgtgaagcatattctgtagatgattaccatggtgcatggtttggcggttactggtatccggatatctaggaggcttaataattgaaactgaaaaaagcaactttctttttactattattaactgtgttgtgcggctgcacagcacagccttctaatgataccaataacatgttagaaaccaaaacatatctatacagctattattatgaaacagaacctaatggagagttaagcacagcttatcatgaggaaaagccatccgttgatttgaatgaatccagaaatgttgaaaaaggaactgtcaatttcaaaaataaaaacgctattatatacataaaaatgaatgaaacattttcaaaaggaaattatgaatgtaccgtaacagaagcttataaaacaatatcttctgattttttctatacattagttgatgaacaatattacgaagctctggaaaaagaaatattcaaaagacgatatatttcaaaagatacaggaaaattaattaatgagaaaaattcttttttctgtgtaaaaattcatttgaaatatactggttctcaaccaactaatatgaccttttatacaactggatactcaagacagactgataatttaatgtatgatccaggtttacttgaattcatagataaagctttagcaaatgaagaaaaagatgttttatatcttgaacctggaaaagagtacgatttatggtttttctatcatgtattaggaacatattccaatgacaacacttattatattcagggtgattttcaaaattataatgaccatgacagttataatggttacttaattgaactaaataatttaattgaacttgattaaacatttttataactaacatcactacacttacttttatgggggaggattatgcacgatattttaattctgttaagaatagaacttaaacgattatttaaaagcaaattattttatgtaagtctttttataggacttgccttatctgttggaggatttattgagtgtgcgaagccgcatcttaatattactaacggctttaatgggggagtggaaacatatccgttctctgtatttaattcgtggatgggaatgtttatggggcttaagcctatatctacatcttatctgtatatatttatgctgcttgcagcacttccgtattgtggattcttctgcagagataacaagaaccagtacattctgcaatattacagcagaatgtcaaagaataagattcatgctgccagattcattgcaacatttatctcaggaggacttgtaactatgcttcctcttttactgaatctatgcgcaactatgatgtttattcctgcattgaagccatccggcaacggcttatttattcattcaggtgcgtatataatgggaaatcttttctgtgaacatccgcttatctatgtattgatatatgtattacagttctttatatatggcggttcatttgcacttgtttcacttgcggtttcattctttatcgacaatacatttttagtaataatatctccattcgttacctattacggacttggtattatctctactttatgtaaaagcgtaatgaatatttattcattcaatcctatggctctgctttcacctgcaaccaagctacaggacggaatgttatttgcctacatatgtgaaccaattatcatctgtgttatatgtggaattatattttttatgaaaggaaagaataatgaagcgttatagaataataattattggagcaataactctgcttattgcaatatttataggattcaccgtgagaatcaatatgatttttcctaatgccaaagatgtaacttacacatctgataatcctcctattattgacggtttaaagattactcctgttgattataatgtatatacaatcgacgaataccgcgagaaatcaggtcagcagcttaatatgcgtgaggaaactgcccgtaagagccgtattgtggttatgactatagaattagaaaatgtatccgataaggttgttaatttctcaccatcaatattcgtttttttgtctgacgagcttaatgcacacaacggagtaactatgtattcatcaaaagattcacgtattgtagttgttcccggtgaaaagaaagaagtgcgcctgcaatgcacattaggaagttccatggttaaagaaagtaaacttgacaagatagattcttctgatatcagtcttgtatattctttctatccaaaaaggctgcgcattgtatttgaccgtcattgataagaggcttgcctatgattaaagaacgacataaacattatattaaaatattaattatatatacaattgtaattgcaatattaatcaggactctgccatacacaagcagatattttgataacgcagtaccttgtgtttcggatttctttttgtttttttatgattttccaaacaacatttttctatgcaatctcgaacttgttgttgcagctttcatgattatatccattgtcagatatgaaatgtctgatttcagggttgtactgtattcttcaatgtcgaagctgtggcttaactgtgtaaaaaaatgtacatggataagtattgtatttcctctgattaattcagtggtactgacaggctgtgcattatcttatccttcagttattaactgtaactggctggaagagggcagtgttgcaagaaattttatacctaatggaaatattacgactgagaacacatttgtaataattcttatctgcttcctgcttgatattctgcgtgttcagataacaattcttacaatctgtgcgctgcactggattataagaaatccggttgctgattttattatcacttacgcatgtatatttactacttatgtatctgttctgccttttgagaacttctatagaaagatgtgtcttaaccagtcagatgtgtacatatccggtatctattatgctgatgatgttataactccgtttattatatggattgatatgattctgataagctgggctgtaattaaattctatagaaaggacatgcttaagaattaatgaatactttcttatgtattttaaaggctgatatcagacgcttctggtcgatgtgctggaaattctatatggttttctatatatattgcgtatttcaggctgtatcgtatttttcaaatgtatacagatgtattaagaattccagaatcagcagtatttctcttggagattccctgctgtatgtattcagaggtgcaaaagaattctctcccggcatgcagattgacattccgctgtttgagattcttatagtgctgtatatcacatttataataacttattacataactactgaccagaaagctgtcggaaagaatattcttgttatctcaggttcagcttccggctggtggctcagcaaatatatcactatgttactggctgtaattatatatatggcaggtatatttgctgctaacacaattgttggtctgcttatgactggcagcagattttcaatgtcacttaacattacaggcactgaggcagtaagaatatttttacagactaagcttgaacttgatttcaatatgcctctggttattatactgtgttttgtgtgtctcgtaactatgacgggcataagccttctgcttgcttatatcagcaatgcggtattcggattcgttgttaatctgttcttctttattgtgagcatatgcagtatgaaatggttctttttctataattatttcatgactatccgcatacctcatgtatacagcagatggccgtacggtctgtgcttaatgcttgcaatcaatatattactggttgcagccggtattatttattcaaagaaaaaagactttatctaagggggattaatatgtatattcagcttacaaatgtttcaaagaaaattaagagcaatgatatccttaaagatatcaatctgcgcatggaatcaggcaaaatatatggtttcaagggaaagaacggctgtggtaaaactatgcttatgagagctatatcaggtcttatcaaggttaagggtactgttgatattaatggacagattatcggaaaagatattatgtttccgccaagtatcggattattaattgaaaatccgtcttttattaataattacactgcatttgagaatcttaaaacacttgcatctatccgcagacgtattgatgataaccgcatacgcgagactcttaccgagattggtcttgatcctgatgataagagaactttccataagttctcacttggtatgaaacagagacttggaattgctgctgccatcatggagaatcccgatattattatccttgatgaaccaatcaatgcacttgatgatacaggtacagagcagattcgtgacatactcatcaggcacagggaaagaggtgctttaattataattgcctgccacgacgcagacgagcttaatttcttatctgatgaaattatcgaaatcgttcaggggcagattaagccatcgaaagatgataaaaaatccgcttaaaatattgacatatcatcactatacatataaggttgtccttaaagggacagccttatttatttataatggctattctatgaaaagtacgaaaacaaggtgattattatgaatacagatattaaacttgtggctcttgatttagacaggacaactcttaattcagaaagccatctatcagaagtaaacagacaggcattaattgatgctataagcaacggagtacatgtatgtatcgcaagcggacgtgcatttgacacactgcctgaggatgtcatatcagttcccggaattgaatatgcaataacaagcaatggtgctgccatataccgtattgcaggcaaagagtgccttaaatcctatgttcttacaccggaatcagtaaagacaatacttaaactcacagagaatgatattgtgacatatgaagcatttataaaaggacaggccttcgcttcaacagaatatactgcacatcctgaaaaatacggtgctacagaacactcacttaactatgtaaagaaaacaagaattcttaaagacgacattgtatccttcatacttgaacactgccatgaattagacagtattgacatagtagtcggtgatgaagaattaaagaaaaacataatggacagaataagaaaagccacagacgaagtctacatgacaagttcaataagccagctccttgagatatcatataaagacgccggcaagaaatcaggtgttaagttcttaacagaatacctaggtctgtcccgtgaaaatgtagcagccttcggtgacgcagacaacgacacagacatgatagaatacgccggaaccggaatcgcaatggaaaacgccgccccacaccttaaagaaatagccgaccacgtaacgctgcaccacgataaagacggcgtagcatacgcattccgcaatatacttaatatatgttaatcttgggctttttcaatatagttatatgcatatatgcctgtctatagctcacaagcgactattgacgagctgtgtatgagttaataccgctatatacaaaagttcggtgtgtgaagtctcgttcaagcgaagcgcgtttgacttcgcacaccgtaataaactatgtagatagcggtatttactcatactaagcgaggaaatcggagattgtgagctatagacaggcatatatgcattttaaatacaataaaaatcccagaattaccacagattaatttcaaggttgaaatgcgtctgcaaaatgtgtaaaatattatgagatttatttagcaatataaggagattaataatgaacgaacaggattgtaagaaattagcagagctcttattccctgatgtggataagacacctgattattatgaggagaaatacccatatagaaaacttcctaataaggcagaagtaacaagattaggtccaagccctacaggctttatccatcttggcaatctctacagtgctttggctgatgagagaattgcacataagaacggcggtgtattctacttaagaattgaagatactgatgccaagagaactgttgaaggtgctgttgaccttgtaatcaattctttaagatattttgatattgaatttgatgaaggtgcaggcttcccggattctgacccggttaatgcatacggaccatattatcaaacacagagagttgatatctatcatacatttgcaaaggagcttgtacttaaaggtcttgcttacccttgcttctgtacagaggaagagcttgaggctgtaagattacagcaggagactgataaggttcttactggatattatggcaaatatgctgtatgccgtgacctttctttagagactatcgaggaaaatcttaaggcaggaaagccttatgtgcttagacttcgttcacagggaagtcctgagaatgaaatcacatttacagacagcattaagggagagattaagcttccagagaatatccatgatgtagttcttcttaagaaagatggtattccaacatatcattttgcacacgcaattgatgaccactttatgagaactactacagttgtacgtggcggtgaatggcttgcttctgttcctatccactatgaattattccatgtattaggctttaagatgccaaaatacgcacatacagcacatcttatgaagtttgatgaggaaacaggtggaaagagaaagttatctaagagaaaagatccggagctttcacttgattactacagaaaagacggatatcatccatatacaatgaaggtctatcttcttacactccttaactctaactttgaggaatggcatgagaagttccctgacaaggatatcaatgaattcccattctcagtagataagatgagtgtttcaggtgccttatttgataaagaaaagcttcataacatctgtaagaatgagctttccaagttatcagaggatgatttatatgaattccttcacaactgggcattagagaatgaacctgagatggaaaaggtatggtttgctgacaaagagaagttacttgctatattaagactttacatgggtgttggtgctaagagaagaagaaaagacttcatgtatgctaagcagatatttgaacttatcagcttcttctttgatggcgagtctggtgaaagagatgaattcagattagttgatgacgaggttaaggctattcttaatgattaccttgcagcttatgaccataatgatgataacagcatgtggtttaacaagcttaaggaaatagctgacaagaacggctatgcttctgatatgaaggcttacaaggctaatccggagaacttcaagggtaatgtatcagacgttgcagaggttgtaagaattgctgtaaccggcagagctaatacacctgatttatggactatcgttcatatcatgggcgaagagcagatgaaagagcgtataagccgtttcctttaattaatactagtttataagtcaacataataaggaggctatgtaatatgtatgaccttatgataatcggcagcggacctgctggaatatctgctgcactcactgctaaagcaagaaatcttaactttatatggtttggttcaagagcactaagcactaagatagagaaagccgagaaaatcatgaattatcctggacttcctgctgttacaggaagcgaaatgcagtctgtgttcttaaagcagattgacgactgtggcattactataacagagtcacaggttaattccatatatgactgcggcggttattttgcagccggtgctgataatgagatatatgaagccaaagctgtcataatgactgttggtatgacaacaacaagagagattgaaggtgaagcaaggcttttaggttgtggcgtaagttattgtgctacatgtgatggagcattatataagaataaggatattgctgttatatgtgcatcacctaaattcgaggatgaagtaacatttttagcaggacttgctaatcatatatatcttttcacaccttataaggaaaccacgttacaatatgataacataacgcattttaacggacttcctgcaagtgttgacggagataagaaggttgcttcagtaactttcaagggagaagctatccctgtaagcggagctttcttcttaaaggattctatcaatccgggtgtattattatcaggacttgatatggctggtggacatattattgttgacagaactcagatgactaacattgatggtgtatatgcagcaggtgactgtacaggcagaccttatcagtatgccaaggctgttggtgaaggaaatgttgctgtacacagcgtacttgaatatcttaaagaacataaagataattagtttaacaggagacgattaataatgggcgagatatgggatatctatgatgtcgataaacaacttacaggccgtactatgaaacgtaatgactggaacatgaaagatggggactatcacctgactgttcttggcataatcaaaagacctgataatacatttttaataacacagagagtcttaactaaagcatgggcaccggggcactgggaagtctcaggcggtgcatgccaggctggagagacatcttttcaggctgtctgccgtgaagtattagaagaaaccggtgttgatgtatcacaggctgatggcggctttgaattttcttacagaagagataatcctgaagaaaaggataattattttgttgatatctataagtttaacatggatattacagaagcagatatacatttacagacagaagaaactgccggtttcagatttgctacagcagacgaaatcaaggttatcgctgacaggggagaatttcttcattacgacagcataaggaaggtttttgaataattagtttaaagacagggagttttatatgctgaaatatcttaaaaaatactggctttttgccattcttgcacctttattcatggtgggcgaggttcttgcggacctcgttcagcctcgtttaatgagcaccatcgtggatgaaggtgttttaggtttatcaaataacggtgttgggaatctgaatcttgtacttaccgaaggactcaagatgataatattcgtaattcttggcggattatctggtatcttatgtggtgtgtgttctaatattgcatcacagaatttcggtaatgatctaagaaaagacgcattcaaaaagattatgtcattctcattcgaacagactgacaaattctctacaggttcgcttatcacgcgaattaccaacgatataacacagcttcagaatttcatacagatgagcatgcgtggttttataaggacatttatgctttttgctggcggcataatatgcatgttatcccttaacctaagctttggtgcagtaatcgcgtgcgccctgccgcttgtaattatatgtgttatatattttctttctaaagctaatccacttttttccaggcttcagcagaagctcgacaatgttaataatgtgatgcaggaaaatgtatcaggcttccgtgttgtcaaagcatatgttaaagaagattacgaaaaagagcggttcggaaaatccaatgacgaccttgtaaatactcagcttaatgtgctgatgattttctcatatatgcagccaattatgaatattattctcaacctgtctgtagttgcagttatcaaggtcggtggtattcaggtttccagcggttctgttacaccaggtaatgtcatggcagcaattacatatgtcacgcagtcacttaatgcggttatgagaatgactaatatgttccagactgcttcaagaggtattgcttcaggcagacgaattaatgaggtgcttgcctgcgagccttctatcaaaaacggttcatttgacggaaaaccttcagttaagggtaagattgaatttaaaaatgtaacatttgcatatccattaactggcgataagaagattcttgataatattaatcttgttatcaatcccagcgaaactatcggtattcttggtgaaaccggctgtggtaaaacaagccttattaacctgattccaagattctatgatgtatgcgaaggaagcgtgcttgttgatgatattgatgtcagggaatataaccttaagaatctgcgtgagcgtatatctgttgcactccagaaaagtgaaatattccaaagcactattaaagagaacatccggtggggtcgtgaaaatgcaactgataccgatattgcaaatgcagcttctatcgcacaggctatggaattcatcagtacttcaacagacggatttgatactcttgtgacacaacagggaacgagtctttccggcggtcagaagcagagagttgccataagccgtacaattcttaaacatgcagagattattatatttgatgatgcaacaagtgcacttgacttaaagacagaagctaatctgtattcaatgcttaaaaatgcatatccggacactactaagattattattgcacagcgaattgcctctgttaaagatgctgacagaattgtaattcttgatgacggacatataagtgctgtcggcactcatgacgaactgctcaaaaacagtgcaatatatcaggatatatataattcacagttgaataagaaatagcaaggagacagaaatattatggctgaggataagaatatatcacagattaatatgagaattcccggcatgaagggaggacctagaaacaggggcgcagctgtcgaaaagcctgtcaacggcaaggaaacatttatgcgccttatgcagtattttgctaaagaaatacctgtgattatcgctcttttcatcgctgtagttgtaatggttgtatgctctgtctatgctccaaagcttcagagtcaggcaattgattatatttctttaagaaaatttaataatttaaaccatatacttatcttcatgttggtggtatacataatatacagtatatgtacatttatacagacaagactaagtgccatattaagccagagaattgtaaagcatatgagacaggatctttttgataagattgtcggcatgtctgtcaagtatcttgaccagcattcacatggcgacattatgagccggatgactaatgatgttgagaatatctccaacactgtatcacagtccatgagttcgttattctcaggtgttctcactattattggaactgtcattatgatggttgctttatccccgcagcttgcattatgttcttgcacaacagtaattcttactatatttgcgactaagaatttatctaaagccatgaggaaattctattccagacggcaggttcttttgggacagcttaatggtactgttgaggagatggtcactggcatcaagactgttacagcatttgacagacaagaaaatgtatgcagtgattttaataatacatctgatgaacttaccaaggttggtattaaagccgagattcttggtggttctatgggacctgttatgaatgtcattaacaatatcggcttcgtcattattgcaggggctggaggatattttgctattaaaggatatgtatccatcggtgtaatatcagcatttatcgtatatgccaagcagtttggcagacctattgacgagcttgccaatatatggggtcagattcagactgccatagccggagctgaaagagtatttgctgttcttgatgaaccttccgaggacaaatcaggtgaatttacaatggataattctactggcaacattgaatttaatcatgttgatttctcttatattcaggggaaacaagtattacatgatttcaaccttaaggttaaagcaggacagaaggttgcacttgtaggaagcaccggaagcggcaagactactgttgtcaatcttcttatgagattctacgatattgacaacggcagtataaccattgatggtgttaatattaaagatatcgactgtgagaatcttaggaagaatactgcaattgttttacaggatactgttctttttgccgacactgtaaagaataatcttctatattcaagacaggatgcaacggatactgaaatcattgctgctgcaaagaaggctaactgccataatatgattatgcatcttcctgatggatatgattccatgctcgccaaagatggacagaatctgtcacagggacaacgccagttactatcaattgcaagagcatttgttgccagtcctaagattcttatactcgatgaagcaacctcaagtgttgatacgcgaacagaaaaaaagattcaggatgcaatgactaatcttatgaagaacagaacaagccttattattgcacaccgtctgtcaactattcaggacgctgatgtcatagttgttatggataatggaagagttgtcgagacaggtaatcatgagtctctgcttgctgctaaaggcagatattatgagctgtatatgacacagtttgctggaaaggcaatctgattaataggacaaggagataagaaaattatggataatcgcaagcatatgagaaccgaaaagaaaacagccgtaaaaaacagttttggacggcttctggctacaggtatatttgtacttatccaggttgcgtggctggcttatcttttattatatttttacagggactacgcatggatttcattattaagcacatttattgcaattattcttgtgcttaagatatacggaacatctactaattcagccatgaaaatgccatggataattgtgattcttgcatttcctatacttggtatacttatttatctgctttttggacgttccattgttacaagaaatgtaaagaaaagatttaattcaatagaagaatcctataaaaaatctctttctcaggatgaaaacattcttaatgaggttaaagataaggatatctatatatataaccagttccattatctgagtaatcatgaaggatatcctgtatataagaatacggatattgaattctattccataggtgaggaaggtcttgaagcacagcttaaagaacttgaaaaagctgaaaagttcatatttatggaatatcatgctattgaagaagcttcaagctttgacagaattaaagatgtacttataagaaaagctgccgcaggcgttgaagtcagattattctatgatgatgtaggaagtatcttcttccttaacaaggatttcatcaaagaaatgcgtgccaatggtattgactgccgcgtattcaatcctattaagcttgcatttaatatgttcatgaataaccgtgatcacagaaaaattaccgtaattgacggtaaggtcggtttcacaggcggttataatcttgctgacgagtactttaacataacacatccatatggtgagtggaaagataccggtcttaaactgaccggcgatgccgttaagactcttacaatgctgtttctttctatgtggaactctattaagaaaacagacgagcctcaggatgattatgtcaaatatattaaagcctctgactatggctacaaggctgttaataataatcagtatgttgttccttacgctgacagtccacttaataacaacagggttgctgaaaatgtttatcttaatattattaagagtgccaagcattatctttacattacaacaccatatctgcttattacagaagagatgtccagagagcttgcaatggcagcaatgagaggtgttgatgttagaattgtaacacctggtattcctgataagaagcttacttacagcctcacaagatcatattatgcagatctcgtaagatacggcgtaagaatatacgaatacacaccgggcttcattcatgcaaaacagtgggtaagcgatggagaagtatctgttgtcggcacaatcaacatggacttcagaagtctttaccttcactttgaaaatgctgcatatgtatacggcagggaaactgctgccgacatacttaatgatttctacaacattttcagaagaagtgaggaagtaaccgacaagtacatcaataagccgagaatcctgagaatcggacaatgtatattaagactggttgcacctttgttctaattggtgtatattcatatttgtatatcaaattaataaacatttaacaaggagatataatgagagaagaaactgtaaccgtgaaaatcgaccacccattaggtagcactgatgaagataacccctcggtggtctatcctattaattgtggctatgtagatgtcgaaagaacagccggattttctgagcttgataagcagagagtttatctgttaggtgtagatgttgccgttgatgaatatatcggcgagcttattgctgtagcaagacgccgtgatgatcctgaaacagtctggataatagcacctgaaaatatatcttacacaatccagcagattgaagaaatgatatatttcgaagagcagtattacgacagttttgttgaaatagttgacgaagaattatgggatgcctatgatgagaatgaaaagctgctaggtttcgatttaaaaagaagccaggcaaaatctttacctgatggggtgtatcatgtcattgtcaatgtatatactatgactaaggatggtaagcttcttacgacagaacgttcacgaaataaaacataccctcttaagtgggaagttacaggtggttctatacttaaaggcgaaacagcggctgaaggtgcaattcgtgagttatatgaagagactggtattaagatttctactgatgaccttattccgctctacagctatgtggataagcctaagcatgccatatatcacagttaccttaatttaatagaaaaagaagtccatgttacccttcaggaaggagaaaccatggactacatgtatgttccgtataaggaatttgatgagcttgttaattctgacagattcgttccatcagaacagcgacgctataagaatcaggccgtctttacgatgctttcacgattcattcctgattcagcagcttctacataagcaattccgtatgtacctggacctacatgggttccaacagaacatccaatagagcttacaccaacatttccattaacatcagatatgtaaataagactcttattaataaatgtttctaaggattcagagcagttgatatgaccaaacatgaaatctcttgtaagacttaatccgtctttggtgagcttatcatgcataagtttttcagctgctttttttcctcttgtttttccaatcacaacaacttttccatcttcaatacttacaaccggtgttatatgaagcattgttcctgcaaatgcagcagctcctgaaagtctgccacccattttaagatatttaagtgaaccaacaactgctgtaagcttgatgtattttgacatctctgtacatgcagcagcgatatcagccgcatttacaccagcgtctcttaactttactgcctctctgattaaaagggctgttccaattgatgcacttcttgaatctaccatgtataatttctttcctgtttcttcttcaacgtctaaagcagcaaggcaggcactctgatatgttcctgataaatcagaagatatgaatattccaagtacatcatccccggcagcaacagcttcattaaatactttcatgaatgtatcagggcttggctgtgaagtcttaggtaattcatcacattcagcaagtcttgtatagaattcctcgtgtgttatctcaactccatctaagaattcttcatccccaaaccttacagatattggaacaatctgaatccccatctttcttgcatcttctttagatatatcacatgtgctgtcagcaataattcttaacataatcatactcctttaaagattttaatatactttgatattcaaagtttctttatgtgatagtatcatgagataatgtggttgtcaatagtgatttgataatcaaagttttagcaggaaattcttgaatagaaatatgttatttaaatatcatcatgtgtttttttcgtatttatatatacacagaattgatataatcaatataaatatattctaattaaaaatggggtgtgtaaagaattatgaatattacaaaactagtattgggtgcatgcagcacaaatgtatatattgtttcttcaaataagaaaaatgcaattctgattgacccagcagataatgctgctgaaattattaaaacaatagaagaaaatggattatgtcttaaatacatttttataacacatggtcatacagatcatattttagcattaaaagaagtgaaagaatattttaatgtacctgttattatatctaaaattgatgccggacgacttgaagacgaagaacttattaatgaaagaccttatgttaaaataccttataaagctgtaaaagccgatatattaatttgtgaagacgatataattaatcttgatgagttatcattttctttcttaggtatgccaggacatacagacggttcaatggcaatcattgttaatgataatattttctctggtgacaccattatgtttgaaaaacatggtaaaacttctttacctggcggaaatgagaaattacttatttcatcaatagaaaaaatgatgaacactttaattggcgattataaaatataccctggtcacagacaagagacatctcttgattatgaacgtaagtgcagactaagtactgttattacaggttattaattttttatcttaatttgcggcttgtaattgtaaataacatatttcttgacatatttaaaaataagcattaaaatcaagcacttggacggtatcatttacgaaattcacacaagaggtttcatcaattatggcaaaagatttaactcagggcagaattatgcctatgttaattaaattcacaattccacttatactgggaaatatatttcagcttacttataatgcggttgactccattattgtcggaagatttgttggaaaagaggcactggctgctgttggaatatgcaatccaataactacactcattattcttttccttaacggattatgtatgggtgcaagtattcttatgggtaattatttcggcggcaagaaaatggatacgctttcccgccagataagcacaacaatgatatcaggtatgatattctcactggcacttacattgctggcaatagtatttacaagacccattcttatgcttgttcaggttgacagatcaattatgacacttacaacccagtacttaagaataattatgttaggactcatcttcacattcctttataactttttctcaagcactttaagggcattgggagatagtgcaacacctctgtatttccttatcataagtgcagttttaaatgtatttggtgaccttttctttgttgttgtcctgaaagccggcagcaatggatgtgcagttgcaactgtagtgagcgaggctctctgctgtgtattctgcatgatatatattaaattcaaagtaccgattctgtgtcttggcaagaagtggcttgtatttgaccgttcactgcttaagaaaactataagctacggctgggcatctgctatgcagcaggctactgtacagcttggtaagattggtatacaggctattattaatacaatgggcgtttcggtttcagccgcatttgcagtagtaaacagaattgatgactatgcatatacacctgagcagaacattgcacacggaatgacagcaatgatggcacagaacaaaggtgctggaagagatgacagagtaatcaaaggctttaaagccggtattattcttgagataatatatggaatcttcatattctttgtatgtttcgtatttgcaggaccacttatgaagctatttacttctgataccgaagttataagacatggtgtgatatatcttaaacttatctctgtcatgtacatattgcctgcattgactaatggtattcagggatatttcagaggaatcggcgacttaaagattaccctgctttcaagctttatcaatatgggtgtccgtgtacttgccgccataccacttgtatttgcattaggcatgggaatagaagcacttcctttctcttatcttgctggctggattggcatgcttattgcggaaatacctctgcttgttaagaattacagggcatatattaaaagtataagatagttataatcccctcacaaagcatcagccttgtgaggggattattattatctcatcttctgaacatttttctttctcataagcaacgcaccaatacctataagtaccaagcctattgcacagccagacattaaagtaataaaaaatatatttccattaatactaagagccgtgctccaatcagacagattcatatgacttattgtaagcaccttccttttgtagagaataaactcaagaaaatcatcggcaaaaacaacccataatacagatattatcgtactaattccggctctcatcagtccatggacaggaagatatctgatcacaagaaatacaagccatacaccaagcataagtacaacagctactgtatatccgtctttcatacctgtaaaaccagaatgataatacactataaacattgtaaggaatagccacaatgtatcccatgtcattgttataagtgctttcttgtcactaagtaccggtggaagtgacacaagacatatcactatcggaaacagcactattgatataccaaatactgtaggtatagcccaaaaaaggaagtttcctccgccattcatccggtcaacgaaaaacaatataagcataagtgatgcaacgcctgcaagaatacattttaacagacggttattcgtagacataagcggaactaccgtaagtgctgcaacaagcatcatagaagcagtaacaaccgaaaatacgcctaaacccataccagttgcaagctgtactataaatgtaatgacaattggcagtagaagtattgcggcaatcacaactcctgccttgtatgctgcattacgctctttttttgcatgtctttcaagtactccttttgattcctttgcaagcacttcatcaacgttgttttcctgtaattcattatatatcttctggcagtcactacaacctgccatatgcttttcaacaaagctgcagcttgcctcactgcaggctttgtcataataaaggggcagtaagtcctgcacgatatcacattctttattactcatatctaatcaatcctttcttttatttttaatctggccctatgataagttactctggcccagttctcagtttttccaaataccattccaatctgtgcaaatgtgagttctccaaaaactctcaactgaaatacctctttatacgactccggtagttcatgaagaaccatatgaatctgcaaagcagaatctgtatccgaaactttatccgccagatcagccgtctgctgcggtaaagtctcatcaagctcagaaaacttcttatttttcctgcattcatcaattgcgagattcttagcaatactgcaaagccatgtgagctcacccgccttgccctcatacggacgtttggcagtcatggctttgtaaaaagtattttgtgtgatttcttcagcaagagactgattctttactatagtaaccacataagaatacacctgcatataataggaattgtacaatttctcgtaattcagaactggtcacctccttccgtcttacataggttagacgcacgaaatggattttcgttacaacatttttcagaatattttatagaattttttaaaatgtgtcaaaaaatgtatgccaaaggtacaggcagatgtgttattatacatattgaaatagggataccgcaatcccactggctttagacggtgggttaaggtagccggaagcggaggtttgtactatacttgcgttatgggaacgtggaaatcaaaaacagacacaaatagatgttgagaaaatatatagaaaatcaagggtaggaaggtggcgacagtgggtgttaaaagcatataaatacaggatatatcctaatagtgaacaaagaattcagattgcaaaaacatttggctgttgccgttttgtttacaatcagacattggcatatcggaaagaaatatacgagaaagagaaaaagtcagttagtaaaacggattgtaataattactgtaacagagaattaaagaaagattatgaatggttaaaagaaatagataaatttgctctaaccaacgcaatctataacatgaacactgcatatcaaaaattctttaaggagcatgcaggatatccgaaattcaagagcaaacacgataaccataaatcatacacaacaaacttcacaaatggaaatattgcggtagattttgagacagggaagataaaattgccaaaattaaaagcggtaaaagcaaggttacacagggaatatagtgggcagattaaatcagcgaccgtttcgcatgtttccagtggaaaatactatgtgtccatacttgtagaaacggagcataaggaactggcacatacaaatcataacataggaatcgatttaggaattaaagatttatgtattacttccgatgggaaagtatatgagaatctaaaaattataaaaaaatacgagaaacagcttgtaaaactgcaaaggcaactgtcacataaaggaaagagaagtaagaactattataaaacaaagaaaaagatagcattatgccatgagaaaataaggaatataagaaaagattatctacataaagtttcacatgagattatcagcgaaaaccaagtgatagtttcagagaatctacagataaaaaatatggtaaaaaatcatcatttggcaaaagccataagtgatgtattatggtatgagctgacaagacagttagagtataaggcaaaatggaatggcaggaaatacatcaaaatagatacattttatgctagtagtcaattatgttctgtttgtgggtatcagaatccagatacaaaagatttgtcagtgaggacatggatatgtccgaaatgcggagcagaacatgacagggatatcaatgccgcggaaaatatactgacagaaggattaagacaaatagcataaagaaatatatagggcagggactgcctaaattaacgcctgtggagatagtaggttacgaggtcgatgaagcaggaagcctattggcttaagacaatgggtagttcactttgattcaggagaattaattatgattagaaaagaacagctgcgtctatacgcaatcacagatacaagctggcttaacggagccagtctcattgatgttgttgaaaatgtattaaaaaatggagcaacatttttacaattaagagaaaaaaatgcgtcacatgaagaaattgttgcaaaagcaaaagcaattaagccaattacacgaaaatatggtattccattcgttattgatgatgatgtgcaggcggcacttgaagctgacgctgacggagtacatatcggacagagtgacactgactatatgactgcaagaagtattcttggagataataagattatcggcatgaccgccaagacagtagaacaagcgaaagaagccgaaagacttggtgcagattatatcggaaccggtgctgtatttggctcaagtaccaaaaaggatgctgtatacatgcctcgtgagcgactgattgaggttgcaggttcagttaatatccctgtcgttgcaatcggcggtattgattacgacaactgcggtgagcttgcaggcactggtgttgacgggattgctgttgtttcagctatatttgccgctgatgatcctggacttgctacgaaagagctttacttaaagactggccgtgtatttaattatcacagggatttcatatttgacatggacggaactattcttgattctatgccctactggagaaatgtttccaaggaatacgccatgcagtatgttgataagttacctgatgactttgacgagcgtacttatgtaatggaccttgatgaatgttctgcttatttccgtgatgaattaggcataaacactgatgcaacaactatgaggcagactgctgtggatattatgacaagacactacagcacagatattccggctaaagacggaatgcttgaattaatcagacgtgagcatgaagccggttcttgcatgtgcatatttacaagctctgacagaggctgtgttgacgctgcacttaaccgtcttggaataactgactgttttaacaacatttttacagtatacgacattccatataataaaaagaatccggaaagctacaagcttatcgctgaaaaaatgcattttaaaccggaaaacacatgggtatatgaagatgttcttcacggcattgaatctgccagacagggtggatttaagatatgtgctgtatatgatgaggattctaagaagcattggaacgaaatctgcgcacttgcagacgaaataagagatataagaaatgattgaggattagtaatgaagaaaaaagttgttgtcggcatgtcagggggcgttgattcctctgttgccgcttatctattaaaggaacagggctatgatgtaataggtgtgactatgcagatatggcaggacgatgcaacagaagccgctgagaacggctgctgcggtatcagtgctgttgatgatgcaagacgtgttgcaggtcagcttgacatcccatattatgtaatgaattttaagaatgagttcaaatgtaatgtaatcgactattttgttgacgaatataaaaaaggccgtacacctaatccatgtatcgcctgcaaccgttatgtaaagtgggaatctcttcttaagagaagtcttgaaataggagcagattacattgcaacaggacactatgcaagaatccaccagcttcctaatggcagatacactatatgcaattcagtaactgccaggaaagaccagacttacgcactttataatcttacacaggaacagttatcacacacacttcttcctattggtgattatactaaggatcaggtccgtgaaattgcatctaagattggtattactgttgccaagaagcctgacagtatggaaatatgctttattcctgataatgactatgcaggctttataacacgtgaaacaggctatacttctgttcccggtaatttcattgacgtcaatggcaatgtaattggaagacatcagggtatcatacactacacagttggtcagagaaaaggtcttggacttgctcttggaaagccggcatttgttgttgctatacgccctgaaaccaacgaggttgtaatcggtgataattcagatgtgttctcacctaagctttacgccaacaaccttaatttcatgtcgataccttcacttgaaggtgaaatgcgtgccaaaggtaaaatccgttacagccatgagggtgctatgtgtactataagaatgtttgatgagaatactcttgaatgtacatttgacgagcctgttcgtgccgtaacaccaggtcaggcgcttgtattatatgacggggacaatgtacttggcggcggaactattatttaattatttttaaaattaataaggacaatattatggaaaaacttatatatatggataacgcagcaactacatcaaccgcaccagaggttgtgtctgcaatgcttccattctttactgaatattacggcaatccttcttctgtatataattttgcccagaaaagcaagatggctattgaagatgcaagggaaattatagctgacagtattggagctactaaaagcaatgaaatatattttacaggcggtggaagcgagtctgataactgggctttaaagtctgctgcattcggccttagagataaaggaaaccacataataacaactaagatagagcatcatgcaattcttaatacatgtgcatatcttgaaaagaacggattcgagataacttaccttgatgttgacagcgaaggatttgtttcattagaagatgtcgagaatgcaatcactgacaaaacaattcttataagtgttatgtttgccaataatgaaatcggaacaattgagcctgtccgagaaataggtgagattgcacataagcatggcattctttttcacactgatgcagttcaggctatgtgtcatgtcccaattaatgtcacgaagatgaatattgacctgttaagtgcaagcgcacacaagttccacggtcctaaaggcgtcggtttcatgtacatgaagaataccgctaaattagagcctttcatccatggcggggcacaggagcgtgcaagacgcgctggaacaagcaatgttccaggcattgtcggcatgggtcaggctgtaaagcttgccttaggtacacttgataaagatacacatacaattattaatatgcgtaattatattgttgacaggattcttggtgagattcctgacgttacttttgatggaccttgtattgatgctaatgccgatgtcaatgctgtttcggtaggtttgcccatgtgcagcctgaagcgtcttccgtctaatatgcatttctgctttaaagatgtttcgggtgattctttacttattatgcttgatatgaacggtatatgtgcatccagcggttcagcatgtgctgcaggctcaatcgacccttcacatgtgcttattgctatcggacgaagcaaaggtgaaactaaaggtgctttaagattaagcatagataaggatttaaccaaggaagatgctgactatgcaatagatgcactgaaagccgctgttgcaaggctgcgtaggtagactttgcggataacctgccagagtatacttcgctattaatctgcactgataatggataacaacttagttagcatgaattatttggaatacctactaaccaactatgaattcttaattgagtaggtttttattacagctgatgtttctgttgaatagcataaagacccactcatacaacttttctatatattttagtgggtctttttcgctatctaagctattttatcagcacatttgcaacactttttcttcaaaataacccacgaaacatatattaacttcccttctagtaggtttctgcagataatcaaagattaattcatgaaaaaaaagcctactattttattatcttatcagagtatagtaggactccagcaaaattcatacaataatacagccaattctaaaacacctcccaatacacactgcaaaacaaatccaaatacacatcccaaagcacaaccaatacacatttccaaaatattttcaaaaaatatcatacaaacctattgacatagtagggataagggtttatattatcatcaacatcaagaaagcaatacatttttgaaataaattaaaaaggatggtaattaattatggcaaagaaatcttactctgaaagaaatttaaagtttgaaacattacagcttcatgtaggacaggaacagcctgatccggtaacagatgctagagcagtacctatttaccttacatcatcatatgtattccataacagccagcatgctgctgacagatttggtcttaaggatgcaggtaacatctacggacgtcttactaatccaacagaagatgtattcgaaaagagaatcgcagcacttgaaggtggtgtagcagcacttgctgttggttctggtgcagcagctttagcttatgcttttcaggcacttgctcatgcaggagaccacatcgtagcagctaagaatatctacggtggaacatataatcttcttgcacatacacttccagattacggaattgaagctacattcgtagatccttttgattatgatgctattgaagcagcaatcaaacctaatactaaggctgttcagattgaaacactaggaaatcctaattcagaagttgttgatatcgaaagaattgctaagattgcacatgcacacaacattccacttgttgttgataacacatttgcaacaccttaccttgtaagacctattgaatacggtgcagatatcgttatccattcagctactaagttcatcggtggacatggtacaacacttggcggtgtaatcgttgatagtggtaaatttgactgggtaggggctgctgataagttcccatggcttgttgagccaaatgtatcataccacggtgttagctttgcaaaggatacagcacctgctgcattcgttacatatatcagagctatccttcttcgtgatacaggagctacaatttctccagttcattcattcatcttccttcagggacttgaaacattatcactcagagttgagagacatgtagagaacgcattaaaggttgttcagtacttaaaggatcagccattagttgagaaggtaaatcatccttcaatctctactaacgaagaacagcaggctctttataagaagtacttccctaacggcggtggttcaatctttacatttgaaatcaagggtggtgctgcccaagcacagaagttcattgataaccttgagttattctcacttcttgctaatgttgccgatgttaagtcattagcaatccacccggcaagtacaactcattcagagtgcaacgaagctgagcttcttgatcagggaatcaagcctaacacaatcagactttcaattggtacagagaatattgatgatatcattgaagatcttgatgaagcattcaaggctttacaataatttgtatcgacacattctttacatatccgactaatgctgataaaatatatttaattaataaatcgtgaatgtttaggaggatatgtaatgttttgtcaattatttggtaaatttcttatcgaaaaagaggttatagataagaataagtacaattctataatggaaaggcttgcagaatcaagagcaaagcttggtgtaattgctgtagctgatggcattattactgagaaacaggcgaatgaaattaatcatttacagacaactaaggatgcaagatttggtgaaattgctgttggagagggttatattactgaagagcagttagatgttcttcttaaaaagcagggaagcgcctatgcaatattcctttctgttctttcagaagcagcagatatatcggtatcgaaggttgatgagcttcttaaggaattccagaaggagcatggttttactgatgaggatatggatggtcttaagaatgatgatttagaacagattgttccgatatttgccttttcatcaaagtcatatgtaactgatatatgcaggcttgcactttctaatatagaaagatttgtaacctctgatttctatatagacagaattaagcatatttcacaacttgaatacagatgtcttgctggtcagaaattagaaggtgaccttgatattattgttggttttgcaagtgttggtgaacagacagctatagttgatatagctaatggattctctcatagtaatatagctgatcttggaatagaagtgtacgatgctataggtgaatttactaactgtataagcggattatttgcaacagcactttctaagaagggcagcatgttggagattactccacagtttgcttatgaaaaccagtttgccaaaggagatgcttatgtactccctattcatatccatgacagtgaagttctgcttttcatatctgcctctgatgaaaccaaagctggagatatgcctgttgtaagaaagattatggcaaaagcaggtggagaagtgacattagacagcaaaggaacagtagttatcgttgatgattccggaatgtcaagaaagattctgcgtgatattcttgaagaagccggttacgctgtattagctgaagcaactgacggattagagggcgtacttgcttataagacatattaccctgatataattacacttgatattacaatgcctaacatggatggaacagaagctcttaaagaaattaaggcttatgactctaatgccaaagtaattatgataactgctgccggacagcagcataaagtaattgaggctcttaagcttggtgctgaacgatttattaccaagccatttgataaagaagagattcttaagaatattgaagaagttcttgagggttaataaaaaataatgggatgatacctttagtgatatcatcccattatttttatttattctttctaaaatgcacttctggaactgccagactgtcatatgtaacatgtggcttatctctattatcatccggaacaatatctgatgatatatccgcatcatcttcttcacttcctgaatctttcttgtgtatctcaggaatagcaagattatcatacgacagactataatccttttcagatgtattcactttattttttacctttttgaatatattaaacatatttaactcctctataattataatatattgataaaaaaagttataaccagactattcaggaaatctgcaaaaagacttcctataagtggtattaacagataagccttaactgatggaacatatttgtcacatactgcctgcatatttgccatggcattaggcgttgctcccattccaaatccacatgtacctgcaacaagaactgctgcatcgtaatcttttcccataatattgaatacaataaaatatgtaaataaaacaataacaattatctgtgcaccaagaagtataacaagcggaagagctagtgatgcaagctgccataacttaagtgtaatcatagccattccaagaaataatgataaacttatacctccaaggtcgttaatttctcccatatgaataacaagctttccatttcctgcatattctgcaatattacgcataagcgcagctgcaatcatggccccgatgtatataggaaaagtgagtcctgtcttcgtaagagcccatgaaaaaatagttcctataccaatagcaataataagctggaatacggctgatgcatacattctggaatgtctttcatgcttcttttcgtcttcaataagaagactgtcatcctctggaattgctgtatctaaaaggtttttcttctcaataagtctcttgcctaatggtcctcctacaagacttccaaatataagaccaaatgtagctgcagcagtacatattgtcgttgcacccttaacattaaaatcttcaagtaccggtccaaatgcacccgcagtaccatgtccgccaaccataggtattgagcctgtacacattcctataagtgaatcaagcccaataaccttagataaacctactgcaacacaattctgtataaatataagtactataactaatcctaaaaatatcaccatagactttccgccctttttaagtactttaagattagcctgaaatcctacggatgtaaaaaagaataccatgcatacttctttaagtgtgtcatcaaatgaaaactctagtatatgagtaacataacatatacatgtaaatatagcaaacaacagtcctcctacaacaggtgccggtatacagaacctttcaaggaatttaattttctttcgtaaatagctgcctagaagcagtacaagtaccgcaatagccagcgtctgatacatatctaactgaaccttcattaaatttctccattctttatagcattaacctgatatacggaattattctgtcaaaacattgatgccacgctctgtataataagctgctgcacctgaatggaacggaatatctactccatcagccgccgtatttatatcaaatgaaatatcaagagatgtagcatacttaaagtcatcagcatgctcatatattgtcttagtcacattcttaataacatcgtctgagagtgactgctttgcaatcagaactgccttaacaccaatagttgtcacatcagaatcctgaccattataagttcctgccggaatagtatatttttcacagagagaatacgctgataacatcttgtctatgcatttgtcatcaagacttataagacatatgtcacattccttagataactgtccaataacttctgttcttgttcctgctgtacagaaaaatgcatcaatttctccagctttaagtttttcagcagcttctgtataatccatattgaccttattaataagctcgtcagtaattccactcatctttaatatctgctctgcattcttttcagatcctgactctgatgcaccgacacttacagttttattaatcaggtcatcaatacctgtgattccagaatctttccttacaacaatctggcagcattctgtataaagtgaagcaaccgctttgtaccccttctggtattttttatcagtaaatgtaccagttgcattatatgcatcacttaacaggtctgcctggacaatagcaaggtctatatagccatcagatataagtcttaaattagcaaccgaaccagcagtagtctttgtttcaaatgtatatccatcaatctctttatctgccagctgtgtaaatgtgcttgcaattgaataatatactccgcctatatctgctgcgccaaatttcaaattcttactatgcccgctacatcctgccatcacaaacaataaacaggacattaatacacataatattttcttcattcatttatcctcttaacaataattctttttcataaactttgccatcctttatgtacattctagggacgcgcttacttactgcacatgtaagctcataaggaattgttcctgcaagctgtgccatatgctcaataggattagccttaccaaatatctctacttcactaccaacgtcaacattcattttatctgtaagatcaatcatgcacatatccatacatatcttgcctctctgtggagcaggaccttcttctgtcataagctcatatctgttagaaagacatctgaaatatccatcagcatatccataaggaacaactcccattcttgtctttctgtcagtcttgtatattcctccatagcttattgctgttccggcagggtaagtcttgattgtgcttactgttgtcttaagtgacataacaggcttaagtccaagttcctgtgcaaaatctccatatccatagagcagaagtcctggtcttaccatgtcaagccatgtttcaggatatcttgcaacagcacctgtattggcacagtgtcttatcttgaatttctttccaagttttttctcaacttcatcaatcacactggtaaacaattcaaactgatgcttagtatagctttcatattcttctccaaattcatcagatactgcaaaatgtgtgaatattccctcagcatcaagacctggaagagtacagccttcacatattccttcaacaccactttcaaaataatctccgtcacacagatatccaagtcttgacattcctgtatcaactttaatatgaatctttaatgtaccaccacatttaacagcttcctcactgtattcaagtgccttagccctgcatgttacagcctgtgttatattattcttaataagctcagatacttcttccttaggtgtatgtccaagtataagaaccggcattgtaataccattgtgtcttaattctacagcttcatctatactgcttactgcaagataatctgctccggactcctgtaaaagtctgcttacctgtacagaaccatgtccgtaagcatccgcttttacaacgcctaaaaacttaacattttctccaattcttttccgtaatgtttcataattatgtgcaagtgcatccatatctatttcagcccatgttcttcttaatgttgaatccataataatctgcctccattatctaaacatattttaatattttaccattttattgatgattagtgaatattttttaaattaattttaggttgatattttatattaatgtcagaacaaagataaaagatatcagattggagaaattcatatgaaaaagaacctttttgctttattaaatatatgtactatattattaagcctgttcttaacaggatgttctggaaaagaatctaagataacattaaacagctctcagcccgaatgcattttatctaataacaataatattgttcttgagtcttacactaatgaatcagtattagatgatgaaatccctgaacgcagcataacatgctggggtgatagtatgatgcagggagctggatgtaacgaagcatatatatactctgataatggtattgaagacatatcttactttacaactccatctgctctgcaatattttacatcaatcaatacctacaactttggtgtaggtggtgagaattcatatcagatttctttacgtgcgggcggaattccaatatacactgaccgtgatatctatataaccgaccactcattagcttatgtaaaatttgttgatgaaaatgaagaaacaatcactatggatgactacagcggatatggatatgaagataacacatatccagacacagtatatattaatgatgttttatgttgtgtcgaaagagctgatgaaggcttatatatttctatatgttctgatgcagactgtgattctgtaactgaaatgtatattaacgcatggacaagggttattcctaaagcagcttatgaccatcgcaatgatattcttattcttgagatgggaagtaatggtggctgggagaatgattatgatgaacttataaaacaatatcagaatataattgataacagctattatgctgattatataattgttggtgatactgataatccgggagaatcagctgacatatatcaggatgtatacgataataatggtaattatgcaggacttcatgcaacattatgggaacaagctctgtatgatgcatttggagaacatttccttaacaccagactttatcttatggaaaatgcattatctgactgtggacttacaccaactgagaatgatataattgatatacagacaggcaatcttcctgaacagattcgtgccgatttcacacattttaactcttatggatattattccaaagccaaagctatatacttaaaaggtatagaacttggctactggaattaatattattcgactggaggattatatatgagaatattattagttgaagatgaccgctcattatcaagggcagtttcaactatattacagaagaataattattctgttgactgcgttgaaaatggtcagacggcccttgattatctagaaaaagatatatatgatgctgtaattatggatattatgatgccggtaatggatggaattacagctttaaagaatttaagaaaacgcggcagcaacattccggttcttatgcttactgcaaagactgaaatagatgataaagtagaagggcttgataatggtgctaacgattatcttaccaaaccatttgacacaagggaactgcttgcaagaatccgtgtacttacacgctctgaaaaacaacaagataatgttattacacttggaaatatttcgctcaacacaactacatgtgaattatcttctccttcaggttcatttcttcttactaataaggaatatcagatgatgctaatgttcatgaataataaaactcaggttatttcggcagaacattttatggagaaaatctgggacagtgaatctgattctgatatcagcaccgtatggacttatatatcttatctcaggagaaaacttgaagctttaaagtctgattattctattgctacaagaagaaatatgggatattatttaaaaaataacaactaatataaagaaggtatataatgtcaaaaaataataaagcatctaattataatgagaaaatgcttacccgcttaagaatacaatttattgttctttcaatggcagttgtaataattatgcagggatttatagtatatacaagtgtcagaaacacatacaataagatggtcgctaaatccgaccatcttgtttcgtctatatatattaatattttagataagaagccaattaaagcagatgccaggtatttctatattacatttggtaaagataaccgccccagaaccattaatatcgataacatatctgatatttctgaagatgaggctttggcaatatattatgaggcatatgagacaggcgaacttgatggattttacaatggttacagatattgcatatatgaaaaagagaaacgtacaattgctgtattcgtacttcgaagtaatatgatagatgatgttaagaaaacagctgtttcgcttatagaatcatcatgtgcaggtattgcggttatgctcctgattcttatatttacttcaaagcttatcgtcatgcctattgcaaaagcacaccgcaagcagaaagaattcataacatctgcaagtcatgagcttaagactccgattacagtaataagagctgatgctgatatattacagatggataatcctgataatgaatggattgaagatataaagaaacaggcagaaaatcttacagctatgactaacagtcttgtatcacttgcaagaatggatgagcgcaacggtcatataaaacgtgtggtttttcctgtttctgaccttgcagaagaagctgtgcactcttataatgcacttgcacttgattcaggtaaacattttacttacgatattacacctgaccttacatgctgcggtgacgcatcatcagtacggcagctatttacaattcttcttgataacgcatttaaatattcatcaggtaaaggtaacatagactttaaattatattcttcaggaagctatattgttttaatcgtaagcaatgatgttgataatattgataagaatcttactgacagaatgtttgacagattctacagggctgattcaacatctgctaagataaccggatatggtcttggtctttcaattgcaaaggctattgtttccgagcataacggaagtattaaagccaaaatggatggttctcaaagaattattattaaagcacagcttcatattaaataacacatattgacccaatatgttataatgaaaaagaatttagtgtaatgctgaattctttttttgtagagtggaaaattaacatgaggggagaaatattctatggaaccagattacaataacaactatcataacagctatcaaagcgagtttaagcccaatggatttgatgaccttcatcttgatgatgaagtatacgagattaaatctgacagaattaatcctgaagatttttatcaacacagtcaaaagaaacgatattcagaagtcagtcttaggaacatgcctgttgtgcttattataatccttgccaatctgcttgcaggcattatgtgcataatagcaggcagtgatcattttgaaacaggtggacttaattaccagtatattcataataataaagaatatataaggcttctgacttatatgtttctgcatgctaatttgccacattttattaataatatggttgctctgtatctgttcggttcaagacttgaaccccgtgtcggttctcttcgtactgcaattatatatttcggttcaggacttgcatcaggccttgtatctgtatatgtatcacaccttatcaatcccgatgtaatccgctttgctgcaggtgcatcaggtgcaatattcggtgtaatgtgtgcaacactttttactaatttcagttcaaaaactgattccaataagacaactgtaatcgtatctattgcgttaattgttgtatatgctcttatatctaatggtgcaaatgtagatattctcggtcatctcggtggtgggatagcaggtggtattcttgtgttcattctgtaccatgacagtttagatggtgcattttcaggaacagtttcaacacttcttgctgtcatactcacattaataatatgttttattggtgtgacacgcgcaggcattggtactaaagccagcgcaatgcaagattcaagaatcgatacagtaaaagaacagcagatatttcaggatgaatctataacctttggtcaatgtctggataacaaatgtacagaccccgaatggactattttcagttctactgataataaaaaggttgtagaattcaacggtaaagtagtatataataacactaattcttcattgaagattcaattcacatatgatgaatccattagttactggacaattaactatatgggactaaatggtactgcaatggatagtaatggtgcagctctgcttcttaattatctgtgcagcgattatttaaattaggaggcgatgtacatgtctaagctgtttaattctgatgacgatgattttggatatcttgatgattctattcatattaactggaagaaattactgcctgcaatcataattgttgcagcagcagtaattgcattaataattgtacttattgtttctttcggtcatagagggaaaaaagtacctgcaaatgcatcttcaaccgaagaaacttcgtctgtcagtgaaacagataccgacggcaataatactttaagcgataaagatgagaaagaacaggatccgcagtattccgacaatgatggagcgatgaatcagtcagccggtaatggtgcttctgtaattctttctaacagcactaatgaaacatcagatataactattggcgtagacgtttctaaatttcagggaactatcgactgggcacaggctgcttcatcaggtgttgattttgcaatgataagagttggctacagagcgcagaaaacaggtgttatctatgctgacaccaatgcaaaatacaacatgcagcaggctgcagccaacggaattaaagttggtgtatacttcttctcatcagcagttaatgaagctgaagctattgaagaagcagactgggttgctgatttcatagcagactacagtataacttaccctgtagcatttgactgtgaaggcttcaacacatctgaaagcaggcagaagagcatgactaaggctgaaagaactgacgtagctgttgcatttttacaggaaatatatgataaaggctatacacctatgttctatgccgcttgctctgaacttaccaataacagccagtggaacattgcaagtcttgaaaaatcatttaagatatgggttgcacaatatccgtcaacgccttatccagagactccatccacatcatatacaggaacatacagcatgtggcagtatactaatcagggcagggtagcaggaattggtacaaatgttgatattaacgttgcttatttcggttattcagaaagtaacggctctctaagcggtgaaactgcagctgccgcatccccagatgtagaagcaggcatggtattcacctctgttaatgacaccgttactgccaaagatgaagtaaggcttcgtgacaagcctagtcaggatacagacgcaacagtaattgcaacacttatcaatggtgaaacaattacacggactggaacaagcagcagtggctggtcaagacttgtatacaatggacaaactgtatacgctgttacaagttacttaacaacagaccttacacctaaagcaacagaaagtcctgcaaccggatttaacacgaaattcacagactgtaacgatactgtaactcctaaggaagaggttaatcttaggaataagcctagtgtgactgatgcagattctgttgttgttgcaactgctaaaaaaggcgagttttttacgagaaccggttataatacagaggttggctggtcaagggttgtatataacggtcagacactttactgtgttacaagcctgctttctatccaataaatttaaaatgtcaggagaattattgtgagtattataatcactgatttatgcaaaacctttgatgacaatgaagttcttaaaaatgttaatattacccttaaagataattctatatactgtcttatgggatcatcaggtataggaaaaactacacttttaagaattctaataggactcgaacgtgctgattccggcagtgtatccggtatagatactaaaagcatatcttgtatgtttcaggaggacaggcttattccttacctttctgcaatagacaatgtcagaatagtgcttcatggaaaaagcaatagggaagaagtccgtaataatctgttatcaattcttccagatgatagtcttgatattcctgtaagttcattatccggtggaatgaaaagaagagttgcacttgcaagagcattatcatatcccgggaaacttataatacttgatgaaccattcacaggtttagataaggatactaagttaaatgtaatagactatatcttaaaaatgcgtaataaccgtactttgcttattgcaactcatggaactgatgatgccaatctgttaggggctgaaataataaagcttaataaaaatattaattaaactattaaagggagactgtcttatggcaatctcccttatattaatattatgtgactacatttcttcaataatctttcttgcaacatatacgccactggcagaagcatgtgataatgaatgtgtaacgccgcttccgtcgccaattatgtataagcccttatatcttgtctcaagattgttgtcaatctcaacttccatgttgtagaacttaacctcaacgccatacagaagtgtatcatcattggcagttcccggtgcaatcttatcaagtgcgtaaatcatctcaataattccatcaagaattctcttaggaagtacaagacttaaatcccccggagtagcagcaagagtaggctttacaagcccctcctcaattcgcttttctgtacttcttcttcctctcataaggtcgccaaatctctggacaataacacctccaccaagcatgttggaaagtcttgcaatactttcaccgtatccgttactgtccttgaatggctctgaaaaatgctttgcaacaagaagcgcaaagttggtgttctctgtctgcttctcagcaccttcatagctgtgtccgttaactgttacaatgccgttagtgttctcattaactacgattccattaggattcatacagaatgttcttacaagatcttcgaatttctctgttctgtatacaatcttgctttcgtacaactcatctgtaagatgtgcaaatataacagccggaagctcaactcgcacaccgatatcaacacggttagacttggttggaatctcaagcttctgacagacattttcaatccatttgcttccgcttcgaccaacggaaacaatacatttgtcacaatccatgtactcatccttatagaatactctgtaaccaccatcaatcacctcaatattgcttacaggagtattaaagtagaagtctatatggtccttcatctcattgtacatattttcaagaacaacatagttaatgtctgttccaagatgtcttactgacgcatcaaggagctttaacttgttctgcatgcataaagtcttgaacttagtgcctgctgtagaatacatgtgagtctcttcgccaccatgtgatgtattgattgtatcaacatacttcatcagattgattgcctgatccctgccgatatactcataaagagttccgccgaaatcattagttatattatatttaccatctgaaaatgcaccagcaccaccaaatccgttcataatcgcacatgttggacatttaatacacgatttaaccttcttgccgtctataggacattttctcttctctaatgtgttgccttcttcaaacacagccactctggtttcgggtgactttttcataagctcgaacgcagaaaagattccgcccggtccggctccaataataataacatcgtattccatactttatcctcctcggagaaatttcttaggatattatatcatagaatcggggttatgtggtatagtgtaggtattaattagagtatttagcatcagactacttattgatgagcagggtattatcatcaaggctaatgaaaagggaagccccagcggtaatacccaatgatgggaaacagactccgatgaaagggcattctgtatttattgcacagcatgcaacagctacctgctgcagggaatgcataagaaagtggcataagatgaagcctggtgtagagctaacgcagattcagcaggattatcttgttgatgtaataatgaaatggataaaaaaggaatacaacgattttaaaaatcagtaattcattaggcaatttgagaaaacttaagcgtaaaattcccttgtgaagataaccatgagtatttaattgacaatctgtgaatcatttgatatcattgcacggtaaataaataagacagttcgtttgtaccatcctgtctctaaataaaaccaggactattatttttataattcataattggaaattttagggaaataatcttataaggcacgggtacagatgtatccgtgtttttttatgcaatataagcaaatggagaaaagatttatgtatattttaaaaacagaggctagttttgattcggcacattttcttgcaggatacaatggaaaatgcagcaatcttcatggacatagatggaagattgttcttgaagttcaaactgaggaactaaaggaagatgttcagcataagggtatgtatgttgattttggagaactgaaaaaagatttaagaaacatagcagattcaatggatcatgcattaattatagaaagaaattcattgaaggaaactacatttgaagctttaaaaagcgagaatttcaaaattattgaacttgatttccgaccgacagcggagaatatggccaaatatttttatgaaaaaataaaaatacttggatacaacatgagagctgtaactgtatatgaaactcctgctaatagtgcaacttatatggaatgattttaaataattttaatctgaaaggatttatatatgagtaaatacgaagtagtggaaaagtttgtaagtattaatggtgaaggaactaaagccgggcagctagcggtttttatacgctttaagggctgtaatcttaactgtaaatactgcgataccaaatgggctaatgagcaggggacaccttctcaaccaatgacagaaaaagaaattcttgattatgttttatcaacaggagtaaaaaatgtcactcttactggtggtgaaccactgttaagagagggtattgaaaatgttataacagttcttgcagaaaacaatctgaacattgaaatagagactaacggcagtgtttatcttgataaaatccgtaagcttcacaaagagaatgtaacttttacaatggattataagctttcatgcagtggtatggaagctgccatgaatctggataattttgatattttaaatagcaatgatactgtcaaatttgtagctggttgtcgagaggatcttataaaggcaaaacagattatagaaaaatacaatctgtatggaaaatgtaacctttatataagtccggtatttggaatgatagaacctgaggaaattgttaattttatgaaagaaaatgtaatgaatgatgttaatatgcagattcagttacataaaattatatggtcaccagacaaaaaaggagtctgacatggaaaaacataagaaaatagacactaaggcaattgaatatcatatagctggtattcttaaggctctgggtgataaccctgaacgggagggcttaaaagatacacctaaaagagttgcaaaaatgtatgaagaagtttttgatggaatgaattatacaaatgaagaaattgcagatatgtttaacaaaacatttgcactggatatggatgaagaagagtctggacaaatagaatgtaatggtcagagcggaacttccaatatggtagtggtaaaagatatagatattttcagttattgtgagcatcatcttgctcttatgtatgatatgaaggtaacagtagcttatattccaaatggaagagtaataggtcttagtaagatagcaagaatagcagatatggtatctaaaagactgcagcttcaggaaagaataggaagtgatattgctgatattatgcatatggttactggtgccaaagatatagcagtatttattgaaggatgtcatagctgcatgaccgcaagaggaattaaaaaagctaacacaaaaacatatacacaaacattaagagggagatttaacaatgaaagcaatggttttgttcagtggtggaatagatagtacaacatgccttggtatggcggtagaaaaatatggtccagaaaatgttattgcattatcaatatcatatggacagaaacatacaaaagagatagaagcatcagataaaatagtaaaatactataatgtagaacatatttatcttgaccttgcaaaaatatttcaatatagtgattgttcattattatcacattctgataaggaaatacctaaagaatcatatgatgagcagattaagagcacaaatggttctcctgtttcaacatatgttccatttagaaatgggttatttttatcaagtgctgccagtatagcaatttcaaaaggctgcagtgagatatattatggggcacatgcggatgatgcggctggaagtgcatatcctgactgcagcagtgattttaataatgcaataaatgaggctatatatcttggaagtggaaagcagattaaggttgtagcaccatttatcaatgcaacaaaggatcaggttgtaaaaaaggggcttgagctaaatgtaccttataagtacacatggagttgctatgaaggcagcgaaaaaccttgtggaaagtgtggaacatgtatagatagagccagagcatttgagttaaacggaattaatgatccagctatggaataaaaaggagaaaattatgactggaagaagtaaagaagaaacagcagacataacattattggggaatcagaaaacacagtatccaagtgattatgcaccggagatgttagagacttttgagaataaacatcagggtaatgattattttgtaaaatttaattgcccagaatttacaagtttgtgtcctataacagggcagccagattttgcaactgttacaatatcatatgtaccaaacattaaaatggtggaaagtaaatcattaaaattatatttattcagtttcagaaatcatggtgattttcatgaagactgtatgaatattatcatgaaagatttgataaaacttatggatcccaaatacatagaggtatggggaaaatttactcctagaggtggaatatcaatagatccttactgtaattatggaaaacctggaacaaaatgggaggagatagcattcaacagaatggcaaaccatgatatgtatccagaaaaggtcgataatagataataatagataaaataacgccgataaatcctaatttatcggcgttttacagttattcaaataagtgcctaaataggtctttaatttcgtctggaaaatccttgaaatcatcttctttcacttaaaaattgctcgttacagtagtaaagtacacattttaatcgcttcgctaaattactgtttaacgaagtgagtaccacatgactcaaaatagttggttcttataataacatccactcagacataactattcttcgtcatatccgagtggattcccaatcatacataattatataattatatcaacatgcatgtcagccgcctcaaaacctttcttaagctttcggctgactttcttaatttctgtactgtattctttcttgcgattatctttttcatatgttttctcagatgcttttgtatccatagtatccggatttttaatatcagaaacctgattattattatcatcagttacattatctgctttatcctgtgtattttcggaagcgtcagtaagttcagcattatcagctttctcgctgtctgttatctcatctgatatatcattatctgctgcatcctgttctttcttttcttcatcagttggcatactctgataatctgcggatttgacaaactcaagatgtgcagcctcaatgttgttagtctttgcaagtatttcctgggctttcgctaacttggcacttttaggtattgccgggtcattgacgatactgcttaatgaactctccagttctccaagcttctgcagctttacacggtcaacctcttccttagtcttgcattgtctcagtttttccttataactttctttttcttctttagtttcacgatatttctttaaagcaacaggatcattcttttcaagataagatatttcctctggcgaaagactcccacctgacataatcttattatctattttctggcgcttctctgcttcacgattatgttctaactggtcctgaaaatcagcaatcataaactgttcagatgtccatgtagagcgttcatttaactcctgcttagataaaacattgccagattcctttttctgcatccacttgttattaagcatctgcagttgtacggtacttgctattgttcctgataatatcactaggcacaccccctgacattatacagaaaaatcaacattctgccccacattcttctcctgtggagttcttactgtatcacttaagaaaagctgctcctgattttttaccttttcaagaagctcttctattgatgaagctgtcactgttacagtctccgtatcgtcagtatcatcgacatctccggtttctttgcgtttcttttccagccgctcctcattctttttcttttctgccttcttctcggctgtcttcttagcttctttcttttctgcagcctttttctcaatacgctccttctgtgcaacacttgacttttcaagcacagcaaaatatgatgctgtaccattatcattaacctgcattccaaagccctttacattagttcctgttgctgaaagactgcttgcaagctgtgaaattccacttgcagcatttgcaataattccttcatactgttttctgtaattctcatcagaagccattctttcaatcttatcctcatcaataaggacaaccatattattggaattagcataacctgccgcattagccttggcattctctttctgatcctcacttacaagaataaagttcatattagagtactttttctttaattgttcataatatttgcttgctttctcgcttaactggggattaccgatagtctgaccactgacttttttctttccgcttgtctcatcggtcttagttgtctctgacttagaataaacagccactgtatctgcatacgaaccggctatctgggaaaaattccctgaatatacactactcataattcattcctccttgaacaaaaatttattggataaagtcctccttgacttttctaattattatatcgacacatttacaaaaaaaataatcgcatcacataaaaaatgatacgattactttcattttaattaatttctttcttctctcttcttataaaaagacagacacatataacaacaaaaacaacagttgcagctattagtattggccataccggaatcggacagacagatgcccttataagtttaagtccctgataaaatgtaaatacaccgaatatcgagaatattgcgaatgcaagtgtattaagcagtccgtccggagtcttgctctttaacagatatccgactaacataccaagaatgtcagccgcaaaaagtccgagcgaacatcctatccatacaacaagagctgcactcataccttcattagcaccaaatgttatagctgtaagctgtgtcttatcaccaagctctgcaatgaaaaatgtacagaaaactgcaagtggtgcaaacttaatctttgatttgccgctgccttcttcttcgtcatcatcatccccggcaattgttgatgcagcaaaataaagaaatgcaagtgctgcaatagtctttataagccagtcaggaatgaattcactgacaagcccacctgctaaaacagctagtccgttaagtacaagaattgctgcagcagttcctaatataatatctcttaacttatatttagaagtaagagcaataagcatgagctgggttttatcgcccatctcagctatgaattcagtaaaaaacacttttaaaaacaacagcatttgtatgttacctcatttatcttattatgatataaactgcatatatcacataaagtgcaaccattgaaaaaccttcgattcttccgattttcttctttgttccagcaaatatccatacacatattgtaaatacaataagcacacacaaatcaataatattctcagtaattatgctgattgggctgattgctgatgcaataccaagtaccataagtatgttaaatacatttgaaccaattgcattaccaagtgccatatcaacttcattctttctggctgcaacaattgatgttacaagttccggaagagatgttcctattgaaacaattgtaagtcctataagtgtctggctcattccaaggtcactggctattcttgaagcagcatctacggtaatatctccgcctactgcaatcgcagccgcacctccaacaatgaacaaaatactaagcggaactgaaatcaacttaatatcttcatcagaaccgccttcaatctcaacttttttaccttctttgcttgcctttagtgcaatcttaatcatatataaaatgtatcctgcaaatgcaccaataaatattacaccatcaaaatgtccaagtgtcatacctgacttatcaccaaccccaagtattcctaaaagcaataaaagtcctgcacagataagtgaaaatgggatatctctttttattgtttcttttgcaacatttactgttgctatcattgcacacacaccaataacaaccatcaggttaaatatattagaaccgactacattacttactgcaagctcattgttgcctgtaattgatgcagatacactgaccgctgtttctggaagcgatgttcccattgcaacaattgtaagtccaataataatagacggaacatgtagtctctttgctacacttgagcttccttccacgaaaaagtctgcacctttaatcagcagcacaaatccaataatcagtaacacaattacaagcgcaaatggcgcgttattaataaaattccccatataaatctccttatttttctgctttttctttttccgaggggtataaaaaaaactcatgtatatcaaccagattcagtgatattgcacactgaaaataattgatatacatgagtctcattatttaagatttgccagattatactctctattataatcagaatgttgacaaatcacacttacgcgctaactactccctcatggaatattaagttacttgataaataatatcaaatataattatgtgtgtcaacgatttttacaagcaagaaccttcctttcggagaatttctcttcttggcgatgtcatacagatattatgtgttttcctgttatcaatgcaggacattagcattgtttctttaagaacatatttctatgttttggattgcttaataattagtcctcttttgatgatgcagatgcagttatcgcaccttctgtaactttttccttatacttcataaagccctcaagttctttatctgttcttgtcggatgctcccttacaatacggcctctgaattttctcattttctcgtcgcatactgttacttcaacagtgtaaacatgtcctacaatgaccttattaaccccacttgtattctcatgcccctcatctcttaaccaaggcttgaagcacagaatatgtaacctgtcaaatccatctatctgcataaagcacatgtttccttccattttgacaagcttggcaattacagatgtgcctacagggaaattagcagacaaaccttcgtatggatcactatatgaacgtcttacacacttgtatgctcccgtatttactttatccagctgtccatctttcttttcgattctgctggttcttccagttaccttaaccattacttctaatcttggcttaattgtatccatcataacctctgtcattggtgaatcagaccagtcaatcatacggcatacgcctttaattccaagacctccaatatcaagaagaactgtcctgcttcccttatccacacgaatgacaaccgccctgagtggagtcaggtcatgtcttgacagcatatcagccaaagcagcctttccagcttcttttttcatgtcctttattttagtgcagcttgcatatacaactggcactgttccatgaagactgcttccaataatcataacatcaacaccctttacaagcatcttaagggtatccacaggaccatttgcaaccctctgttttaactcattcgacatcagaggatatcgcaatacaatctttacaccgtcctccatagcaaatgcattatttttattcgatattgctgtaaactttatatttaccttttctttcttatcctgcactcttttatatttttcaagagttgcaagtgtaacctcattaagctctcctgattcactaatacttccggtacttatttcttcttcaacctctacggactcaatatgtccgaatattccctcataatcaaccataatacttttcagagacttatccctacccccttctgcattgctgctattttaaataaatattctgcctataacctcaacacctacggaaccatatgaggcaagttttacttaccactaatttctgacatcatcttcttgaaattaccatcgtgaagcttcttctgggcgagtttcttctcttcgtcaacaagctcaaattctccattgctgtacttatacaggcaatatcccctatgtcttattgaaacattcctgatattcttatcgttgtcagttatccattttttcgcctcttccagagtttcaaaattcttcttcttttcctccagctcatactcataagcaaccctgtacagcccgtaaaggtattcaatacatatccaacgctcttcgttagaaattgtaaaggtattcaccggattgccaattgcaactatgcctgatgtaacacactttacatgcaccttatctgttattgcttcctcattggccactatctgctctttagttaagacattatagtataattcaacatcttcgtttctgaatcttctctcactgtatttctcataggctgcttctatatccttctttctcagacggattctgattaatttttccctgactgaaaattcgtacatttttgcatttctatccagtgtttctctttctatctggctgagtcttaataccgttcccgggcacacatacggctttccctctgaacttatgacaactggtatcttatcatacacagagagacgcttaacagcagcaaatgatatattgttgtgtcttgcaaatcgtgcaaatgaatcgtatcccaatgcatcgagctccctgtttgtatatctgactatttctttttccttaacttctcttttttctttcataattatccccttgctgcctttctttctgtatttttgtaatcaattttcaggacgaaacttattatctcatttcggtttcctaatccatactctttagctaacccataactactgtacaggaagattaattgtggaattctgtcctattaattacaaaatatatgatattttataatttttcaaggagcagactgcacaaagatagatatcccagtattcgatacatataacaagatacagccagccgtattaggatgactgtatataagtatgtcaattttaaattgcatttgcatctacaaaagctgcatcttcgtaaaaatcatcctgttttgaaataaattcaagaatatcagaagacaatgcaaatggattattattcataaagctatccactgcttttaatctagaatctttcttatttacataggtcaaaacagcaattacaaatccataatatgaatctgtaacattgtttaattttattgcgaaatcttccattgctcacacctgcctaatgattatcaactattcttaaaccacaaatagacactattttagcaaaaatctcattaatgttattggtagaagcaactaactttctttgtttcccttttctaacaatttcaaaaacatacagggttcacacactttaactggagattttgcataatcttttacatttctagtcactatacaatccatttctgtacgaatagccgtctcaaccgtaacagcatcttcataatccctaatctcagaagacactgcctttcgacaatccaatgagcctgtatctaatatatgaaacaatgagaaaagcttactcaaaatttttcgtgtttctttatcatcatgtgttaattgatgcgtcagagaatatatatccgttacaaactttgctgtaataaaccactcgaactgttcatttgcagagtaaacaaaaatcttttgtgctgcctccgcaaatggaatacgagactgtaatgcatcaataataacacaagtatcaaccaaaactcttatattccattcagcctttcttcctttgcctcttccaaagtcatatcatttggaagaattccaaacaatgatttagctatatccactctatcctgatatggattagtcaactttgcaacaacctttccatttcgcgttatatatatatcttcagtttctgcaagcataagatacttgctaagattaatttttaattccgtcgcagtaatagacataacatcatcccctttctgaactaaaaaccaccataccaatgctttatgctttgattatagtatatcaaaatcggctaaattatcaatgtaattgtacgattttatatcattgtgacagactcatcccacacagttatccattgatcttataagagcaacaataaacactataagaatcaccaccgccaaaattatagcaaaaaccataatcagccacctcttccattagacaatatgtaaaaactgccggaatacacatatgtatatcctgacagtctctagctaaaccgcaataacatactcttcttcggaaaccagagtacatcttactctaagcactcctggcaagaagtcggagtagttcacgtgtattgacaagtaattgtctcttaaagagaatactgtcattaaaaaatcgaagtaaattatgcaagaacaaggaatatactatatatataaatttttatctcaaaaccttgataaactcccatctttgacactttttaggttaaaaatcgccgcaaatgtagacagttactgcgtttacggcttttatacatttttcgtgaaaagcgtaatgttttgcgtaattcttataatcctttggaacgcctgattatcccagccattgcctttggtgttgtaagttcattatcggttctgaatcctgcattatcatgcaatgcatctgtaagttctgttcttgtatagttaggtatatagccatattcaccaacttccctgacattcattttgtgcagggtgtttatgatttcttcacatgtaaagctgttatccaactgtttttcaagtatcctgtaaatcataagtgatatgaagcatgtgagaaaatgtgcttttatgcggtcatcgcggtgaagatatacaggtcttgcatcaaattcagatttcatgattctgaaggattcttctatttcccatctgtcatgatttatcctggctatttcggcagggtcatcatcaagatttgtacacacggcataaaaaccatcatactttgcttcttcttcaatggcatttatatttagctcataggcagctttttctgcgatttcaccatcattagtgacaggagtttttttgataaatctttttgcatctgtaacagagtgtttatcatactgtgccggatgctgcaggtatttctttgctctttcaatctggcgctcacgtatagtctgctggtacagtttgtatttgagagagtatgtgacaataagtgtctggtcaaatgctatatccctttcttcatcatagccttcaacaagcatctgtttgtaaaaaatcctgtttctgttttcaggagtgtcttcgatttcagaaatatcagaagcatgtccaagattttcaattatttcagtacttctttttccatcacgtttaacatcctgtattacatgataagttggatcagtagctttgcttttcatgattctcataaatcaaaacctcctgcaaaaaactatatctattatattatatatacgattatacgcaggagagaaagctaaaaatttacaaaaaaataagaccattactggtctgagagggttttggggtgtcaaacttccgagccctggttatccccggtcttataatctgcagctgttgtcttaacgattatcgtcttatcatcaacgaataccatatcgaagtcctgtgatggaacatctccatagcctaatacctttgaagcatttactttctttgtctcaaatgtgtttccgtatccgattggagaataatcttctctgacctcatatacatatccaataggaagatcatatgctgatgatacagctccgttctcccctgttgtcattgtttctataaggtcgcctttctttacaaggacagctccgtcgcgtgatttaatatctgatgttgcatagatgtcaaactttgctccggcgagtggctttgaatcttccttgtcctgcttatgtgctgttacatttactttctgtcttgagtctgttctcactacatctgtaaatccgaccacattgtcgccatcagttgtaacttctatcttatgtaccgtggtgtcaagcatgtagccgtctgccgccttagcctctcttatataatatgttccggctttatactcataagctgattctgcatatcctccatccttcgatgtgatctgctctataaagcctgcgtctgaacaatcttcatctgcgtatacctggtaagagcatccgccgatgtatcgctcttcataaacaaatcctgtgtctttattgtatccggttaatacttcacccttcttataaagtcggagtttgtttaatttctgtatatcagttgcgcttacctcataggtctttgcgttctcactgattgatacttccatgtcctccataaatgtgcagtttggtgcgccgcttatctgatgaatgacatagttgccatacggaaggtctttcgatgttgcttttccatctgcccctgttcttaagatatccctctgggcttctgtcgcattgtcataacttccagctcccttatagtatatctggaattctgcaccttcctccggtatattctctgttaatgatgatttctgtgctgtctttacatagcttccaccatctttgattgctgtcatcttcttggtaagtgatacctttcctttgacttcctgctcaagatggattactgtactgtccgcctcttggtaagaggttgcattggtctgctttacgccattaacgtaaatactatctttaaatatattatttacaaaaacggtttcatcaagcagatatccctctggtgcttcatactcctgaatagttaaagtaccaagtggaaatactactgttccattatttcttttaaataatgtatctccacctatgtagctttcactatttctaagattaatcctgccatctgctcctgtctgagcatagtaggtatacttaggtgtctttcctgaagtcgcagggtcggtagtcatatctgtatcataatacttaatgacatattttgctcccttaagagtacctgctccgttagatacggaacctgtctctttgtttactttccttaagagaattgttacagggtcagtctctggtgtatccgatatatcacatgttactgtgtcagaaccggtaattgtcactgactcaactgaatcattaattaggaatcctttaggtgctccggtttccttatagtaataagtcctgctttcgccttcaagaatatcacctgtcgtgtaggtatccgtataaccatcactgttagttgtgagccttgttacaaggtccgtacattcagcgtcgttatatactgagatttctgcaccctgcagactataacaattgttgttattactgatactgtcattggatgagtatttcctgaatcggaaatttccattgtaataaaccggtgccggttcatcccagaagatacacagactctggtttacaccatcatcgtttgacaagaacttggcataacagtcgtaatcatcactgcttaagttgtaagcatatgaatacagctccatgcataagtcatatcctgcactacccggaccgccaaggaatgtaccgccaatagccggctcattccatgaaggatcatccagtgcataagcgacagtatgatgtgcaataatccatcttaagtcataatcataatcacttaacggacctcgtgatgctccgcttccgactgagaagaaaaatacccttgctactgtatcattgacatatgtaccgccatctgtaaatgtcgaacctatactcggctgcgtcttgtgtggctctgcacacatagccttaacaacatccccatcaggttcctcaacactgaattcccagctcttccagtcacccattccattatcaataccgctgaatacatcagcatatgatacaccgttatcataatcgacaagcgtatatccatctgctttcgcaaccagaggttccatgttcgagatgactgtaacaacagccattaaagctgctgtggcacctgcactaatcctcttaagaaaatcttttccttttcttaatcgtgttttcattctttctcctttcccataaatttgccagactggaaagcctgcacgagtggtgttgttaagaactggtaactcttaacttttcgtgtttttagctttctagtcattaaggcttagggttatagtagtacaggtcaatctaaatgtctagtagttttttacccacttctaacaattttttacatatttctacatcagtataagaatagtttttaacataaaaaagaactgctggaaaatcccctttccaacagctcttatgtcacttattatttaattgtattcagtggttattacttggtttctccacagtcacattcatagtggtctattaccggttcgtcccatgcttctttgtctactatggttactgtttcgtagtgaccttcttcgtcgtggtggatataagttacatcttctctataagtagaactgaaacaacttcctccctcatctaagcattcatactgatgcctatctaactcctcaactgtatcatactcaaatttcgttattcccaacttagcacatctctcgcagcttcctgaacgacaatgtttacaaatctcaatatacttcacctgcttctcttcccaagcaggtttatcaacaacccacctatcctcgtcatgagttacagccttgtggtgtattggagagccatacacaggcttccagttgtgagtgtgagaaggagtgtcgggagttgttgtgttgccgttgttgcccgaactgctgccactgttattgccaccattgttattattattgttattattaccgccattgttgtcactgccgttgttgcccgaactgccgccattactgctgcttccaccgttattgctaccagatgaagagccgttgccgtcagaatttccagagcttccattaccactgtcattaccactgccattattgttatttccattatcaggaatttcaataatttcatcagcctttggtaccttattctctgccgctgcggatgaaatggcttctgaggctttctcatctgttactgttacggttttattttcttctgttgtgaatcctccggcactaatctctgttctgtttccttcgctgtcggttactacaacaaccttttctccattatctttagtttccacgataccggcaacctctaccgtgttaccatcagcatcctttactgctaccgttacctgctcctgattagaagcaacctttttcttatcgtccttactgtcacctgccctgctctcctgctgaatacttgtatcaacagtcactttcttcctgccgcatccggcaaataccattgtacataacacaataagtgtcatggttttaaataaattctttttgatcatagtgtataccctcgccctcgtatctctatctatctcaagtctattaagtacaattaatcaacttgatttattataaaatatacgatatttgcttatttttcaaggagcagactgcacaaaaaatattacagaaatatttttgaggttacattttcaaatcagacatactttattggggaagatatagccgaacagccaagaaaggaaagaaatcaatccattgacaattttattctaatgttttactgttaacttgaaaaagatgctgccgtaaaacaagacggttgctctgaaattttgttaattacaaaaaagtaatcgtcattccgttgcaatgggacgattacttttttgctttatgtatatctctgccgagcatatatccggcaccaccgcataatgcgattagtgcgaattaagttctttgatctgccatatgattttcttaacaaaaccaattatgcagcactgttataatcaataacaacaacctcttgtaatattttttttgcggcatttactaaatattcaatgcgagcagatgtttcatctaaaaaaatagcctcaccacaaacccggcattcataacaaggaacattttttataacaataatgcagcccttatattcaacagtaaatgtagtcgtagttttgattttttctctagagaagcatgaattacacataattattcctcctcgtataatatctttcaatacccaaagctttcctattcctcacaatattatcaatggcgttgagtttaccactatcttacgcattgtcgagttcctccatgaattctgccttatcgttaaaatgaaaaacagaaatgccgttctctcctaagtatttaataaagtcctccttattcattccggcaatctgcgcacaataaccaactgacactccactattctgataataactcactgcaactgctaacctggcaaactggctcgcctgttcgtgattcatttgggtatcgtacaaaacctcttctggaatatcaagtattatgtgatacataatctctccaatctgcatatatattttctagttctactactttattatcttataagcttgttaccaaaggatatcgtaaagcccctttcttcaatccatattctccataacttcagaaaatctatcatatcttttttctctagtgtctttactaattcatcttgcttcctccatagcttctaccacctctggcttatactgaggcaattcaacactaaacggaagaccacctcttaatacacattgtctcaaaatattacctccattttaaaatcatacacatctctaatattctattgtaaaagatatttttattgactttattaagaaagcatgccattgttttcttcgctattaactctcataattgctcttaagaggaaatacgcacacattaaatatatatcgtcattgtcaaaattatctacaatcagtttgtataccactaaaattgcattgattaacgatgggtcagagacaatcattgcataagcgccatctactcctctgagctcatcaatttcattaatgagtgccgtcatctcatcagttctaatcttattccacacctttaacatctgtgttatctgcttatcttctcctgattctgatgcttcgaatatttcatcatatgtatttttatctaatcctctgttatttatagcttttaatccttcaagcaaattaactgctaattctgctgctttttttaattcttcatcactcatgacatttacaaaattaatattcttgagtactacttcatacctatataactcagtaccatcttctcttatggttttttcttttctaaatgactcaacaatagctattactaatgcttcttcaatcccttttctagaattttctgaaattttctgaaatttcgccatggattatttatcctccttcttattctccaatttttgtcatcatcttccttctgaactacaagcctatcatcatatcagtctcttatcctttgattattttataccaaaatcaagctattttatcaatataatcaccatttttttctcatcacatcgcctttaagatacagatttcccctcacttcttctctgacagttgtaagctgtttctgtgcaatcatataagcaatattctgccttgaacactcaagaagattgcaagcatcacctgtatcaagtacatttttacttataaatgttttaatatcattaagactcaatccagcctcttccccagaatcataaagtatttcagccggaatatctatggaatcattaaatgtagcaaaatatccatctgttccaaccatcccggattcatacaaattcttgttcttaagtatcttatctataccctttacatattccaatgtccgaagattaatttttttagtacattcatcagcaaaaaaacataataaaacattattgtccaatgttgtacaatctatgaggtttcttttctttctctctattacataagatggcaaagcattaattggcctgatgtataatgaatcctgtgaacatcttccctctgatatttcgagaaaacgcatttcatcatatgatttcattctgtgattattcagaatatctttaatattctgccttccacttggaataactctttctcttacccacataaaactgatatctcttggcattgtataaatgtgtttcttaacatacgaagtaaataataatggtgctgaccattcatcaaggaaatcctgtagttctatgatacatgttttttctttttcataatactgaagtattcctatcgaaagattattttcttcatcaacaatttcaaagattttcataaattttatacctttcataaatcatgttccagattttatcaataaacacatctgaaattacattctccagtccataaaaaatgtattctttgtcagatggcttcagctttgcattaaatacttttttaccttttataagcttcagattatcagagcatgaataagtacctataaaattctgacaacgcttatcttcaaatatatcaaaagattcaacatctttggcatccatacatgaatacatcaacgacaatccatgatcaaataatggtgcaattcttaaagtatgtgttcttgcattcctaagaacctctatattcgcaccatgcctgtctctgttaagtattatataatctactgcaatcatagtatctatataatccttccatccacacctcacacaaaaatcataatgtgactctttatccaaagcatttgcacgataataatcatccagcgcaatcttgctttctccacgattcttgaaatcttctgatgcacataaaaatgtattataaacattaccttctatttctatatcagcattaatcagctcataatccaaatgttcaaccccaagtaatgtcagtagtctgtcaacaataatctcattcacgcattcatggcctgctacacctctcactgtgtcaaaattagacaatttgtaatacttcttaacaccatttaacacagattctgatttcaaaaaagttcctgctgttccacttgaacttcttatatgcgaccatttaagatatgtcaaatcctgcttttctaatatgactttattatccatagcataacctcccttttatttgtcgtgcgtcaaatttccttattgcattataagttattatttgtcgtgtgtcaaataataacgctttaaatcattatacaaatacaaaaacctactaacgcacttatattgcaaatcgttagtaggtcttatactatttttattcaaatgtattcataattcataatgttctttattattagttgcgcctgttgtaagactaacttgtgtataattagctttcttttgcactggctcggagttttggacttcagattgctttattactgactttgcagaacttcaaagtccaatctttcatgtctagccgagacttttggacttctacatgcctttccaccgcctcaacgtccaatctggcaggcttcggcttcctatcatgtttctctaacaaatacaaagacctactaacgcgctcatataaaattcgttagtaggtcgtttatctgaataacgctaaaattataatacattacttaattcttatgaaatctcttctcttcctcatatgcaggctcacatgtaagattcatgcccagtctcttaaatgtatccttgtctaccgctgaaagaataactgttgaatgaacatcacatgcataaagcttaggcatctgctttaatgccttgtcagctaacggattggctacaactgaagatgaaagtgcaataagaatttcatctgtatgaagtcttggattcctgctgccaagatagttagtctttaaggtctggattggactgattgactcaggtgatagcaggtcaactgaatcatctattcctgcaagctgctttaatgcattaagcaatgctgatgacgcagcacctaacagatcacctgtttttccagtaacaatagttccgtcttctaactcaattgcaaccgccggtttatcaccgctttttgctgacttttcaagtgcagcattaacaacaggtcttgaagatggtgtgattcctgcctgattcattaaaagctcaatcttataaatttcctgactgtttacaccagttctcttctggtcgcataaatatttgtaatatcttctgataatctccatattagaagcataacggcatgcttcatcatcaacaatacagttaccagccatattaacacccatatctgttggtgacttatatggactctcaccggcaatgagctcgaacatagcattaagcacagggaatatctcgatatctctgttataattaaccgttgttttaccatatgcttccaaatggaaaggatcaatcatattaacatcattaaggtctgctgtcgctgcctcataagcaagattaacagggtgcttaagtggaatattccagattgggaatgtctcaaacttcgcatatccagccttaacaccatgcttatattcatggtaaagctgtgaaagacatgtagccatctttccgcttccaggaccaggagcagtaacaactacaagtggtctggtagtcttaataaattcattctttccgtaaccatcatcacttacaatcttggcaacatcattaggatatccggcaatcttgtaatgcttgaaattcttgattccatgtgcatctaacaccttgatgaaattatcaacctctggctgctggaaatactttgtgatgcagacactacctacaaaaagtccatattctgtaaattcatctataagtcttaatacttcctgatcgtatgtaattccgtaatcgccacgaatcttattacttgcaatatcttctgcacttattgcaataacaacctcagcctggtcctttaactgtaaaagcatctgaagctttgagtccggcttaaatcctggaagaacccttgaagcatgataatcatcgaacagctttccaccaaattcaagatataacttattgtcaaacttggcaattctctccttaatatgctcagactgcatttttaaatatttgtcgttatcaaatcctatcttcataatcttattcctttaagtaaaattctttaataaaattaacataaatcgcaaaatttatccagttctttagtgacaatatttttcgttttaaactttggattattgtacaatctgcctcgcgccatgattaaatccacattacgcagcaccctgaggtcatctaacggattattcttagtcacaatcaggtcagcacatttgccagcttcaacagaacctgtctcattgccaatacccgccattactgcactgttaagcgtagctgtgtatagtgcaaatgcattgcttacgccgacatatttgtggaaataatacaattctctccagaaatcatactgtgtaatccatggacatccaacatcattaccaagaacaaccggaatatcattcgcaatagctgccttagcacattctttgattccctcaaacacgatattaccattatactgttcaacctctgacgcattagaaacacttctgtcaaaaagtgcatacggcagagccggtgataatgtcgtgcataaaaatgcattattctccttaaacaaatgtattatctcatcatcaggctttgctccatgctcgattgaatcaacgccattttctagtgcaacccttacgccctccggcgactcaacatgagcagcaaccttatatccaagcgcatgtgccttgtcacatacagccttaaccatctcaggcttcatcttaagctcaccaggaacgcccttagcttttgcgtcaagcacgccgcctgtaatcataagcttaataaggtcaacattctggctctttgcaatatcaacctgaacaagcgcctcatctatattatgtgcagctactgcaacagaaccagccatatgtccacccggcacagaaattccttcattagctgcaagaattcttggtccgtcagccttgccgtttctgatatcatctcttactcttgtatcaaaatccgccaaaccaccgacagttcttatagtagtaacaccactcataagttcagtctttgcaaaatcctttacaaccttatatgtcacagctcttgaaagtgctgttcccataagcatcttaacagtcttttcattatctctctgtttcttctgtggcttcccattgcctgcaagatgaacatgcatattaataagccccggcataaggtatctgccttcaagattaatctccttaaatccgtctggtacagtgttacccatcacaataccggtaatcttatcatcttcaacaagcacagaatgaccatctaaaactttcatattcttagttccatcaaggatatgtccattagtaaaaatgtatttcataaccatccgctccttgctttcagcataatcttagattattttaccacattttcaccagtaatgtcacataaaataaatgctttctagaatagcatcacaacagcatgcacaacaaatgccatcacccacgcaatcaggcattgccatacaaccattataacagcccactttccaccaagctcacgctttaccgaggcaattgctgcgatacaaggtgtatacagaagactgaatacaagcattgcggctgcgccggctgttgaaagtgctgcctgtatgccagttccgaaaagtatctgcattgttgacacgacgctttcctttgccataacgccacacagaagggatgtacatattctccagtcaccaagtcccaaaggtgcaaatacaggagctattattccagcaataagcgcaagtatgctgtcctttgaatctgtaacaagattaaggtgcagattgaagctttgtaaaaaccagacaattacagtcgcaacaaatataactgtaaatgctctctgcaagaaatccctggccttttcccataataactgcaaaacatttttcatgcctggaagtctgtaattaggaagctccataacaaaaggaacagcttcgcccttgaataatgttcctttataaagcaatgccacaagaattcccataataattccaaagaaatataatgcacccattataaatgcaccctttcccgggaaaaatgcacttacaaagaatgaatatattggcagcttggctgaacagctcataaatggggtaagaagaattgtcatcttcctgtctctctcacttgggagtgttcttgttgccataaccgcaggaacagtacatccgaatccaatcagcataggaacgatacttcttcctgacagaccaatctttcttaacagcttatccataaaaaatgcaactcttgcaatataaccactgtcctccataagtgataagaaaaaaaacagtgtaacaataatcggcaggaatgaaagtacagagccgacacctgcaaatattccatctattacaaggctgtgaataaccttattcacacctgccgctgcaagtgcattgtcaacaacgccagtaagtgcatcaatacccatctgcagaacattctgtaaaaatgcacctatcacattgaatgtaaggaagaatattgcaagcataatcgccacaaagcagggaattgccgtatatttaccagtaagaatcttatcaatcttctggcttcgtattctttctttacttgccttaggcttaacaacattagcttcacatatcttctctataaatgtaaatctcatatctgcaattgccgcacttctgtcaagacctctctcagtctccatctgaagaacaatatgctcaagcatctctttttcattctcatcaagctgcagcagctttaatataagaggatcaccctcaataatcttacttgctgcaaatcttaccggaatatcagctctctttgcatgatcctctataagatgaattactgcatgtatacatctgtgtactgctcctccgaaatcattctcatcacagtaatcagttctttccggcttttcctgatattctgcaatatgaagtgcatgccttataagctcatcaacgccttcattcttggcagcagatataggaataaccgggattccaagcatattttccatgccattaatatcaatagaacctgaattgcctactacctcgtccatcatattaagtgcaagaaccataggcacatccatctctaaaagctgcattgtaagatacatatttctctcaatattagttgcatcaacaatattaataatcgcctttggcttctcattaagcacaaaatttctcgaaacaatctcctcactgctgtacggagacatagaatatattcccggtaaatccgtaactgatgtattctcatgtcccttaatcataccgctcttgcagtcaaccgtaactcccggaaaatttccgacatgctggttagaaccggtaagctgattaaacagagttgtctttccacaattctggttaccaaccagtgcaaatgtaagctttgttccttcaggaagcttttctccatctcccttagcatggtatttaccagtctcaccaagtcccggatggtcagacttatatattcggtctggtctttcgtgttttcttgtacgctcatctataggatcaatagtaatctctcctgcatcggcaactcgaagtgtaagttcatagccatgtatctgtaattccattggatcacccataggtgcgagttttacaagcgtaacctccgccccgggaattacgcccatatcaagaaaatgctgtcttaatgcgccttcaccgccaactgaggtaattcttgcacattgtccaatcttaagttcatttaacttcatgtgtgtcttccttttctaaataatctgcccaaatcattattgataattcttctcaataatcattgtagcacacatgacaagtgcaggacaccccttaattggcatcctgcacatttttcttaatattcggcttcacttctgcggggaataaatcacttagtagtcgcaatcatatccgcaatcgcccatctgccctcatatttcacgaaatagaatgtcgaatcaataacatcttttctcgcgccgcctgaggtaagtgtcatattctttgtaaatgcaatatgacatgaataacagtcatcattatattcaatataattatcaactgtcactcctgtatacggatttcctgacaatgtgtggtcactgataaatgttatatctgcacttgaagcataatcttttgcaagattccagtaatacgaatcctcaataagatactgctgcactgttgcaagtccatgacctgaaccgcttaaatcattagtaaggaaattatcccatatttttgccatattaagagcttcttcttttctttctgatggcatatcggcagaattgccacttgcagctacagatacattccccttagcatctacatttgcagtaacttcactgcctgatgcattatatatcttaatctccggcttgttgacaaatcctgtcagcttatattctactgattttggcatcgtagcatatttagagacattcacaaaatcaggattatctataaccttaccagtcttgtaatcatctgacacagttattccattaactgtaaatgtatacccttccggaattgatacagtataatcgttagtctttgctgaaaatacaggctcaattgatttaaccttccagtcaaacactgtgagtatcccaagaacaacatgctgatctttagcttccagagtcattctggcaaccttcttgtcatcagcatatatgtcatacataggctcttctgtattataactgccctctgatttcttatatgtatagtcagttgtaccatctaattcggacatgtacatattgacaaatgtatcttttccctcaaattcactgctggctggaagctcaatattatcagccaatgtcttatcagcagccatctttgtaaagtcattaaggaaatcattcattaccttgtccgactgtgaattctcatatttcttaaggcatgaacctgtatatgcaatcatacagattgcaagaataagaagaatcactgcatatacggcaagccctgtccagtaatttaatggtatattgattttgcctatatttatagacttcttagtattatttttcatatctacacagttctccttccaattacttaggcattacaacaaatgctgttggcagcttccatgatgaattctgataataaaatgttacgcttgtcatctcatagccaccgttatataccattgttgaagaacttccgccatcaaggttggctgcattgactgctccatattcctgcatgactgatatcaggtctgacgcagttgcaccaagatgtcctgaagcacctcttccatctgtaactaaaagaagtattgcgccgtcagctctctgtccgattgctgttctagggttagccccgcttccctgaccttttaatactcttgcttcattgttaataataagcggaacaaaatgattattagaatcagagctttcctcctggaaagcaacagcatccctgattccggcttcatttacatagctttcaaaatctgctgccgacataccatctatatctttaacaactaaaaggttatccttattaagtccaattaagtaaagacctgaaagtgctgaaggactgttatatgtaatcttaccgtcctgcactacaattccaagtggtgagccgcctctgtttcctgatgaaacatacagacctccgttaactcctgcaacagctcctgctccgcttacaatctcatgaagctccttaccgtaatccccccatgggtatgtagttccgaccttaacctgtgacggatcttttataatcagcatttttccaaagaatgaccttcctgaaatctcaaccattcttattccattcccatcaaactgctctacttctccgttattgtcaaccgtctgtgtatctgtgtctgacgatatattaataagagatgtatcaatatctgaatccatcgactccatcttattagcattaattacctcattaatctgtgcatctgtacagaaccacgaagcaagaaacttcatctgacctgattcaagaactgttgatataaaaagatttctggctgcaggtgctgaatcgctgcatattctcttaatcataatgaataaagttcccaccagcattactatagtaacaagtaccaccagtaatactctgcctataattctggcaattttctttcccataattttctccctattctatgttatatattattccagtctcattgccttagatatcactgaacctgaaatactgaaaatattaattattatatcactaatatggcggtgtttgccatatataatttgaaatactcatcgctgccactttttcttatctattctcatcgctgtccgcacggacagctcatatgccagaactgcgttctggcattgtcgcgacgctcctcgaatatacaagaagaagtcccagcccatgcaaacatggctgtcacttcttcttgtacattctcatcgctgtccgcgcaaaaaaagagcgacggcaaattaactctgccatcgctctttttaaaaaaatatgagggagaaaaaatgttttctttactccatcataatacaacatactttgtgatatgttaatatatattgtataaagcatttataaaaaaaatataaactggcattcatcttattccggtcgtccaagataaaatccctgcactaaatcaataccattatcccttaagaattcatactcttctcttgattcaataccctcagcaagcactttgatgcctcttttatggaagctgtctctataataatagtaatactcctgcttatcaacatcattctcaatatctgttatcagacttctgtccagctttacaatatgcggtgcaaatatatccactgccatcatattattattgcctgttccaaaatcatcaagtgcaatattgaatctgcttctgttaattgaattcttcttagactgccatttgtcaatgtccagtgctgtgtattccagaatctctattatccccttatctcccagaacatcggcatagaattcatcaaaaacagcctgctcctctgcagtaaatgattccgcaggaaatgaattaattgctatatatgaatggtatcctcgctttgcataacactgtactgctccaaatatagttgctacctcaagtgtatgcaaatcattctttatcctgaactcttcaattaaatccataacaccaatattcttaggtctcattaaagcctcatatgcatatatatccatgccattcggataaaatataggttgaaatgcataacttatttccagctttgcaagcttgtctttaatctcttcatcgagcggaaaaatgctgtagtctaccatacttttgtcaataccctctcacattatttacaaatcatataaacagattttaccgctttattacattctttgcaactgttatattcattcacaatcaatcataaataatcatcataaaggtgtaagttctgacattttactgcaagcacttctgaagttttctatcttcatatcagaataactgataacaaagctgtggctgtattcatctgtattattatgataatactccgataacgcatttatatggatgccttctgcctcaagttttctttttacctcattatcagaaagtaatgtattaagttcaagaataaaatgcagccctgaatcagcctctcttactcttccaacacatttgaacggatcctctttaagtaccgaaagaacagcctctctctgtttcgtataatacagccgcattctgtttaaatgtttctcaaaatatccttcttctataaatgcagcaagtgcatactgctcgaaattagatacagtacatgcataaaaatcaagtttttcctgatatgttgctgcaagatgtggtggaagaaccatataactgattcggattgttggggtcagtgttcttgaaaatgtattcatatatataaccttttcgcttatatctatgcttttcatggttggaattgtctttcctgtcatacggaattctgaatcataatcatcttctattatatatctgtccggcttttcattagcccatgcaagcagttcaaaacgccggcttaccggcattgttatacctgtcggataatgatgtgtaggacttatatgaacaatatctgccatacattctcttacagcttccggcttcattccttcatcatccataccggcataacagaatttcacattattacttgcatatatccttgctatcttagaatatcccggatcttcaacacaatacactttatctcttcccaaaagctgtataagaagactatacatatattccgttccggcgccaatgattatctgtccgggtgttaccttcatatcacgaaatgaagccagatgcatagcaatcgcttttcttaactcccatgttccttctcccggagaaattttcataagatcatcctgcctgtctgttataacacgtctcataagcttagcccatgttgcaaatggaaagcttccaggatctgtcctgtttgatgataaatctgatttatatccggtcttcttctttgcggttatttcaggaacttcatattttaccggctttatccttgcaacacctgaaatatctgatacataatagcccttcttaggaacagaatatatatatccttcactcataagctgtccatatgaattctctactgttatggtgcttattccaagattgacagcaagcgttctctttgaaggaagatgctcacccttaacaagtctgccttctattatatcttttttgatacatttgtataaatattcatatattgattcttttccaatgttttcaaacgagtatgttaacataatctgaccttgtttcttttgcagaaatcttcctttatattaatgtcagttattataacatacattatatttcgtgacaatctgtcaacatgcatatatcaagtgtaagttatctgataaatgtatagttacagactccagttagcagctgtaagctgtgtgtttaccatacctgcgtatattccggattttgccataagttctgatggtttaccgctttctgctactttaccattttttaatactactattttgtcggcgtctgctactgttctcattctatgagctattatcattactgtcttattctttataagctgtgataatgattcctgtatcattgtttcattatcaacatctaaggaagctgttgcctcgtcaagaagtattactggtgcatcttttaagaacgctcttgctatggatattctctgtctttcaccacctgaaagctcacagccattctctccaatcattgtgttccagccgtttgataatttttcagcaaattcatcacaatgtgcaagttttgctgctgcgataacttcttcgtccgttgcatccatttttcctatcctgatgttctcgataactgtattattaaacagtgtaacatcctgaaatactatagagtaaagcgacattagtgtctctgggtcaatcattgatatgtccattccaccaactgttatctttcccttatcagcgtcccagaaacgggctgcaagtcgtgaaactgttgtctttcctccgcctgacggaccgataagagctgttacctccccctgctttgcagtaaaagatacatcatttaatacaacatcacctgtatcatatgagaatcctacattagaaaactctatgtcataccccttgttatcaagcttctccgaaccttcctgcacatcatgtgaaagtatctcgtctaatcttgcactctgtacatctgatgcgataattgccgcaagattctgtaaagatacctgcattggatcatatattcttgatacaaccataagaaacatgaaaaatgtgataacatctaactttccactggctaataatgctccgcctaccaaagcaactgttgcaataccaagcttgagaatcatctgtgcacttccaacaaacacagcagttccaagttctgtagctacagcatgcttctcaactgccttaattttctcatcaagtcccttcatatactcttcctgagtattatatgcccgaatatctctgacactttcaaggcactcctgaataccatctgcacacgttattttcagtgccacctgcttttcgttaagctttctctgaacttttccagagcagctgactataatgaatgatatcggtagtacccacagtgctgctattgccattctccagtcaaagaagaatagtcctattgctacaaatgctgtagatatgcacgctccgacaagctccggtataaaatgtgatgatgcagtctccatctgtgcgcaatcagccattatagtacttgtaaggtcagacaaatccttctttccaaagaatgaaagcggaatctttcttaacttctcagctagtgtaattcgtcttacaccactctctacatatgttgataaaaatgttgcattatactggatatatgttgatatcgcaatcaatacaagtgtaataataactccggcaatatagaatccgcctcttcctgccagattcccttccatataatctttaacaagaaaatacaataaagacacaggtatcatcagtatcaaatcagatattgtaactgatatgaatgccttaatcatatccttagcgccctgacttgaaagggcatatttatgcataagcttttctttcatattacacacccactttccagtttactgatttattatattcctcccacatatgtgcatacaatccgcctgactctgccagttcattatgctttccactctggttaatctgaccattctttaatacatatacacgatcaactccagtaactgacgacaatctgtgggcaatcataataactgtctttccctgtgaaagcctttcaaatgctgcctgaacctttgcctcgttatcagggtcagcaaatgcagttgcttcatcaagtataagcataggagaattctttaacattgcccttgcaatagcaattctctgggcttcgccgcctgacaggtaagttcccttcgaaccgattaccgtgtctattccgtccggaagcttctcgataatatcatcgcactgtgcattctttaacgcttccataacctcctgtcttgtagcatttttattacccatacggacattatccagtatagacatcttaagcaggtggctgtcctgaaatacgaaagatactgtatccataagctctttctcatcaatgttcttaacatttacaccgccgattaatatattgccctctgtgacatctgcaaatcttgcgataagccttgcaagcgttgtctttccaccaccggaaggtccgacaaatgcgacctgctcacccgcatttatcttaagactgacatcatgcagtgcatcatttaccgcacccggatatctgaatgaaacattttcaaatgtgatagatgtatctgcagggtgcttcttatcagcggtctgctctaacggctttctttctataatactgttaattcgcgaaagtgcgtcctcaacaaccattgtattctcgcctgcatacatcatctttgtaagtgtgactgtaataataggcgtaataattatataaaacatcagattcagtaaaaatgtgttgtttaccgtgccgctcttaactccgccgaaaaggaatgttcccgcaataagtattgcaaatactgcattaatggctgcagtataacccatcatcgggattcttaaatcctttgtgtaagatacagtccacttctcatatttcttgatagaatccctgaatctcttgaacgaaaatactgactgtccaaatgtcttgacaacaggaattcctctcacatactcaaccgcctcgctcgacatttcctccaatgcattctggtactctgccattttctttttcatgttgtcgcccatcatgcagctcattactacaaatgcgattacaaccggaataaggcacagaagtccaagtcgccagtcaaacactaaaagaagaagcacaagcccgactggtgtggctgttgcaacacatttgtcaggaagctggtgtgcaatataggtttctgtcgcagcgcttgattcattgacaatctttcttaccttaccgcttccctcttcgtccatgaatccaagcggaagtgtaagtatatgtctcataagcttagagcgcatattggcctgaatcctgaatgctgacagatgcgaacacatcaatgcacctatgtaaataagcattgctcctattgcaaatgcaacggcactccagccatatacagacaggttctgcgcattgccataatcaggtgcaacacgaagcacctctttaattaatctccatataaaataaaatggtacaagtgcaacgaaagcacttatcgtagcaagtacccatgacgcaattgtcagatacctgtaattaccggcatattcaaacaactgcttaattgtatctggcttttcctctttctttgccataattatcctccttgctttactgcttcgttatataacactattcagagtaagatattgctaacctgtgcctttaaataaaggctgccattactgacagccatatattattatttacattcatcgtatattacgctccagcctgcactgtgatacttttcaagcagatcaatatactccattgcctcttccttagacatattatgtcttaccacctcgaaaaaactctcaaaaagtgcggtattcataatatgcatgaaatcctttgtcaaaggtctgccctccttgaacttaagtccgaccgcttccatatatttgtatgtataatctgtctcaatatcaactagatgttcaacaaaattctgaaacttcgtaccataagaacaattcaccagaagattaaactcctcaaaatggttatacatatactcaacaagctgtatcatcccatttcttgaatattcatcaaggctttctgtctgcatctcactctccatcgcatggaatttcttctggacatcttcaaagatttctgtaaattcccttgctgccggctcaaccaatgctgaaaaaagaccttcttttccaccatatcgtgaatatattgaaccagttgtagttccagcttccatcgcaattgttcttaacgaagcatcaacataacctttactcttaaattcttttcgggcatattcttctatcttttcagtaacaccttcaaccgccttagacacttactcctcccatctataacaatgttatataacatcgttattagtatattatctttatattttcatgtcaatatttcacatcacaaaactcatttattgatatatttttatcattaaccatcatgctttgccttatcttttctgtcacaccagatatagaataccacatttaacacaattccaaaaatagttgctacaggagcagccagaccaatcttagtaaggctcgcatcaggctgtatactcatataatacgcaaatggcagacggacaagcagtgtctgtgtaaggccctgaatcattacccataccgtcttgtcatgaccattaaaatatccaatcatactgaataatatcgcagtaacaatcgtctctaatgcaaatcccttaaggtaatcatatccattctgtataacagcctcgtcagttgtaaatattgctgtaagaaggtcacccttaaacatcacaaacaggaatactatacagcctatcacaagtccaacaccaataccggcaaacatcgtcctctttgccctcttttcattgcctgcaccgacattctgtgaaacaaatgacgccattgactgcataagtgagcttggtatgagcattgcaaaattaactattttacatgcaacaccatatcctgacgatgcctgtaatcccagtctgttaacgaatgcacataaagcaaggaatgaaatctgtgtaagaaattcctgtaatgcaagtggaagtccgacctttaatgctctcctgcaatgtctgttaattgagaaatctttcttagttatcttaaacggaagttttctcttaaaaagtaatacaagtgcaaatacaacacttaccgcctgtgctgcgactgtcgcaatagcagctccggcagcattcatgttaaaccctgcaacaagaacaaggtcacctacaatattaataacacatgcaactgcaacgaatataagaggtgatttgctgtctccaagtcccctgaatattgctgaaagaagattatatgcaactataaagaatattcctgagccacatatttttacatatacagatgtaagacctactgcttctttaggtgcctgcattataactgcaatctgtcttgaaaaaataatcataacaacgaaaagcaccactgaaatcattgtaaacacaacaatagctccgcctatcagagcacctatctgctccggtcttttctcaccaatatatcttgcaataagcactgtaacacccattgcaaactgtgttataacaaatgtaactaaattaagtacctggcttcctgtcgatactgctgaaaggccctcagtagttccgaatcttccaacaacaagcaagtcaactgcaccatacgccgcctgtaatattaatgccccaagtattggcatcataaaaggaatcagcttccctaatatacttccctgtgtaaaatctgattttgaattattcaatgtcaactttcctttcactcatcaccttgtagaatttgttaatagtttcgatcatagaatcagcctcttcatcactaatatccgtaagatatttgctaagccggctgtaatagtcagcatcatatttcttagacaactcttcacccttatctgtaaccgtaatataagttatccttgcatcttcctgtgaagtagtcttcttaagatatcccttagcttccatttccttgacagtacgggtaacacctggtcttggcagattaagccagtcactgatgtccgaaaccttaacacagtcatttctctctaacagatgatgaatcacatcaatatactggatataagcaggtgcaaccccatatggcagctctggcagcagttccctaatccttttagccagataacaggcatccagcattctcttaatcttgtctggtttcataacacattcgtctccttaaattatatgcttatggaattaattatctttgttaattatcataggtaattatatatgtatattcttgtggcgtcaacatgatttctatgtaaattcctgcttatcgttgtgaaaccggtttgattttgcttgtaattctctatttccctttcaatatagctcgatttgcattttcatgtaaccatctttgtatttccttgtaacctcttggtttatgctacttttattttcatgtggattcttttatgtgatttttattttcgtatagatttattcatgtggaattaccgttcctataaatatcatttttcataagcacatataggtactttttcactcatcccaataatttccaacaaaaaacacctataagacgagtcctatgaactgtcttataggtgtttacagaataattatcaaaataatacatgatttttccttatttctacctataaatccgccgataatacgactacaaataggtatcacatcaaaaatgcgatgttccccaaaggggaacgagcccatcccacaacaaaaccttccggtcaacaaagaagcgatgttccccgaaggggaacaagcccatcccacaacaaaaccttccggtcaacaaggaagcgatgtttcccaaagggaaacaagcttgagcccacactcaggcaggcctgttttatggtgtgttgcagcttcagaccgttggaagtgcgccggcacttagtgaacgcactcccaaagggagcagtgaacttagtaccgctgcgcacttccacgagcgggagcgtgtctgaagtgcaatacaccataaaacccttactctacatttttcaatgcatccgtcttaggaatcttagaaatcttcacaagctgaagcacagcaacaaccgcatagcatacaattccaagaataaccatctcaacaaagcagcttcttctaaccatgtatggaatatatcctgtcatcatagtgtaaagatatgatgagaatgcccatttaagcatagcatttactataggtacagaaacaaccagtgatataactaccataattgaagttgcagctatatacagtcctccaatctctccattcttgaagccaagaatcttagtcattgaaattgactgtgcattcttttcaataatctgtttagataacagatacataagaagcacgaacattataattccaaaatacttcagtatatacatcatctcgcccattgaaaccttcatctggttagacactttgataaggtcttcatatgtaactattgaagcaacatatttatcatcaatatctgtgagcttcttgtctgtgaagtatccagtgaagtaatcatcagccttgtcaaatgtatcaataaagttttttcttgtcatgaatactgcaagtgcagcatcatatttataacttcctgctattgtgaattcgtactcttcatcagaataaggatccttcaatttaaatgtatcaccttttttaagtccgtatttgaccattacaccattagatacaattatctcatcatccttgatatccacatcaacatacctgctgttatcctgaataccatatatcataatatcatctgtcatatatttttcatcagttgtatcaagcgatgtcacacagtacttttctgcaccagaagcatcagtttctgcctgactttttaacacatactgataatcacatatctgtgacttcttaacaacatcagcataatcatcaataagcggctcgaacatgatactgaatacaacaagtgcacctgcaatcagaattcctaaaaacaatgtcagataattaggtatattctggaacattatccttaatctgaatcttgtcatgaaaggaagcttgtggcttaactttataagcttctttctctttctgttagtaagctcatgtcttaagaacttaagcggagaaagccggagcttcttttcaagcacaataagattaacaacaaacataataataatcggaacaactgttgtatcaacaaatgcttctgcattaagcagtgtcgtgtaagtacacaggctgtagctgttataatacacatttacaaaaaacttttccagaagagtgtagccaagtatgttaccaacaacagcagcgaccattgttacagcaacaggaaggaccatgtaatgtcttacaatctcactcctcttatagcctgatgcacggagagttccgataacccctgcctcctgactgattgtgttagatgttgtaacagcgaagacaaatgcaattacaacaactacaatatagtcaaaaagcataattgttgccttatctgaacccatatcatctcctgtgaaattaacagccttgttagtgtatcttggaagataatcagatatgttcataatctcattattgccactcattataagctttgtatcatattctttgataacatcgccaagatttttaagaaaatcttcagaagcctctttttcagccttatctcctataacctctttgttatatttccatgcataattatatttgacatgattacttgaaacattttcaaagcccttatcagtcataacagcaatagaaaaattagttgcgtcaaacatcatgtctgaattattctcaaaaaggcagctgtaatcaggaactgcaacaaaaccggtaacctttaattcctttcctgcgagcttaattgtgtcgcctatcttaatcttcgcattctgtgcatacatacggtcaagtgctatttcattatcggcagcaggcatttcgcctttcataacgcactcaagattaacctctgtcctgtctttatacactctgattgtatcaccgctgtcagcctcatcttcctcaaaatatcttaagtcgtaaagcttgctgtcagtcttattctcaatatcattaataagtgagctgtcaggctctttatctaatgcaaaatgtccatcttcaagattatatttttcaaagccctcatcatatgagtgcttaacgctgttgtctgcaacaaggaatccgctgactaacgaaatcatcataaccataaacaagaatatcacaagatatttaccaaaatcatgctttaattctcttggcagacgcttatttaaaggatttctcataatcatttcctcctaccattcaaggtctgctgccgttatcttgttatcattaacatagttcttacggattctgccatctcttaatgtaataactctgtctgccatattcttgatagcgtcattatgtgtaactattattatagtattaccgtacttcttattaacatcttcaataagctttaatatatccttagatgtgttgtaatcaagcgctcctgtaggttcatcacacaacaggatatcaggattcttgataagtgctcttcctattgaagttctctgctgctgaccacccgataactggttaggcttcttgtcagcatggtctgaaagtcctaatgtgttaagaatctcatctgtattaagtgccttatcacttaagtaagcaccaacctcaatattttcccttacagtaaggttaggtataagattatacatctgaaaaacatatccaagatgctttcttctgtactgtgtaagacgcttttcattcatatccgctgtcttctcaccatctatagatatgtaaccctcgtctgcatcatcaataccaccgataatattaagcagtgttgatttaccagaacctgatggaccaagcaatacaacgatttcccctttattaacctctatgtctattccattcagtacttccacccggctttcgccttctccataatgctttttgattcccttaatctctaaaaacatatttacctccttcgggcacgccctctcatatcattatatgaacaatcgttcatatattcattatattagcacttattaattttgtgtcaataggtgaaaatttatcatcaacaggcacaaaaaaagtaagcgtaggttagaatgccctaaccccgcttactttatcacatttcactatataattcactatatcttattgataaatattatcaataaacaaactgcatttttacttgtctttacctgtcaactcatcaataagccttattgattccataatcatactgtcacaatgagccttcttctcaccaccctttaaagcattgtctcttaaaaggtcagcacagttagtcattccattgtgattgtcccttattgttctctgaaatgctccgacagcacccggactgcttacaccaagtgcgccgagtaccataagtccccctgtgattgcaccgcatgttccaccacatttcatgccgccaccaaaattacagccaagacattctgcctgtgactcactcaatcccagatcatcagcataagccatcataatagtttctgcacagttataacatttttcaggtgaacggagttctttagctttttctatatgtctgttcatatcttatcctcatctttctgaattatatccgttactgttccataaatgcgaacttcttctttcttaccctgataaagaagaatacacttaacgcgactgaagcaagctctgcaataggccatgcccaccatacaagattaacattccctgttttcgaaaaaatataagcacatggcacaaggaatataatctgtcttacaaatgatacaagcatgctgtatatgctgcttccaagtgcctgaaagaacgaactgcatataatacatattcctgcaaatataaaacttattgatatagtccttaaagcaggaactcccattcgtatcatatctgacgatgcactaaatattgacagcattggaaccgggaatatctgaactgcaatcataaaaagtatcattattatctctgcatacattactgcaagcttaagtgtctgtataactctgtcttctctcttggccccataattaaaagctattataggaaccattccactgttcataccaaatattggcataaatgcaaagctctgcagcttaaaatacacaccaaatacagcaaccgctgttgatgtaaatacaaccagaatcttattcatgcagaatgtcataacagaaccaattgccatcataataactgatggaattcctatgaataagatattgcaaattctttttcctgatggtctgaatcccttaaaagtaatatgtatctctttattaaccttaatattaaatatcactgccataacggctgcaacaatctggcccgcaaccgtagctactgctgcacctacaataccaagctttggtgcaccaaacagaccaaatataagtatcgggtcaagaataatattaattattgcacctgtaccctgtgtaatcatgctgtaaaatgttcttcctgtagcctgtaataacctctcaaatatcatctggaacagacaaccaaagctgactataagaataactgaaagataatcataaccatagtcagctatcacttcattagcaccctgaataacaaaaaactctctggcaaagaaaagccctatggcaagaaatattatatagctacaggctgttatgaatataccctgcacagccatcttatcagcttcttcatgccttccttctcctaatgcccttgaaagcagcgcattagtacctacacccacgccacccgcaacaccaatcataagattctgcattggaaatgccattgaaaccgctgtaagcgcttcctcacttattcttgcaacaaatatactgtcaacaatattatacaatgcctgtacaagcattgatatcatcattggcagagccatattaataagcagtttattaacaggcattgtacccattttattttctttcattgtattactcataaaattcttctcccttattctcctcgtcaaaatattcgtattctctcatattatctttggttttattctgctcgtcaatggcattgccaagacccttcaatgctgagaaaggcaggaatatcttagccctgctttccatatccattcttggtcttttactcggtactggccatttcatattaattatatcatcatattttcccataagctatgccctgtgacctccaatctgaccgtttctttcaattgcggttgccttgctctgcaggttattagctttcattaccgcattcttaccatattttttcttaatatcaagcattgcgtgctgcatctttttttcgcgttcaagctgagtctggtctgtaaacatgtcaaactgctgaaagccctcattagtaagattggcaactgtaagatttaactttctgatatacagctttctgtcagtgtatttatcatatatatcaagaaaagcttctcttaactgttttgatgaagatgtacatgtcgtaagtgaaacagatttgttaagtccctgtggaacttctcttccatatctgtctacatggatttcacccttgtaggttcctttatcaacatttaccctgtcataagttacatttaacgcaatcgaatccgtcacaaagcctttatctactaaatcaagtgcaagctcatctgccatctctccaactacaatccttgcatcttcaaatgtgtatggttcttttaacacctgtcctgaacacaggctgctcgccttgggcttatatttcttaatatctgcaattgtacatggttcatatccccatgcgtgatctataagaatctccgcatctacaccaaactgcttatacagccagtcctcatcttcaagggacattctcgcaatatcccccatagtctttattccgtgtttttcaagctgtcttgatattcctggtccaactctccagaagtctgtaagaggcgtatgactccataacatttttctgtaatcattaacacttaattctgcgatacgcacacccttgctgtctgcctgtatatgctttgcaactatatccattgcaatcttgcacagatacagattcggtgcaattcctgcagtagccgttattcctgtcgtataatacacatcctcaataacttttgcggtaagctgtcttgccgtcatattatacagcttcatataatccgttgcatcaataaacacttcatcaatactgtatacagttatgtcatccttactgaaatatttaagatatatagaatatatctttgacgaatattctatataaagtcccattcttggaactgctactatatattcaagcttctttcctgtgcgttcctctatttcttttgccttctgttctacctcaaaaagcctgcttcgtccggaaagtccatatttcttaagagaaggagtaactgcaagacatattgttttggctgttcttgattcatcagctacaacaagattagtggtaagcgggtctgattctctttcaacgcactcaacacttgcatagaatgatttaagatcaattgcaatatatactctttccatcacatcctccttcccgaatttcagaaagacacaccagttattacgataccagtgtgtctttaaaatatatattttattcttttattacattgttataagctgcttcattatatcaaccggaacataataacttactcctaaaggattaataactatccctgaagcacccaattcctttactgtcttaagaagttccatatatgtgtaaagcatatcctcatgcttacctgcataacatttttccatctctaaaccatctgtaaatactggaagtgcaagaattttctcaccttctttgtggcttactttatcagtaatatcaacatatggatgtgaaattgatacctcttcatctgtctcttccttagtacaaggaaccatgtaatccgcattacgtatagctttcttaagttctgcttctttatctcttaaaattgccgccttagctgttgaatctcctggctttctgtactcctggaagaacttgataagtgcattctgaagtcctggattagtcacgaaatcttctcttatatactggtcatatgttccaatctcttctcttgaaacaataagctcgttatccctgccatctgtgaatctgatattcctgcatccgttacgatataaatgagctatctcatactgcattgaatccttatcctcaataccatatgaaatgtcatatccatattttccaagctgttcttctactctggcatgattagtataatcatataatacaactatatcatcatcaaccatatatggataacctgtgctgtcacaatatattgtccataagtggtcagcattaagaagcttatctacaacaatctttctatacacattacctatttcattaaaatatccttcatcattgacattattcttttcctgtgccttcttgataagctctggaagaactttagtaagaacttctactccgtctgtaattgaaagtccggttacatactcaacacccttgtcttcatccttaaaaatgtgtcttataatgtcctgtgctttaattgaatccattaaactctcctcctggtaaaagcatttttaaatgtgtctgaatcactattattatctaacaataatgccagcataattctcgctttcgtaggcgatatgtctgtatagaagatactatctccacagtctgcaaaatcacctttcatatatgcatcttcactacatgatactactacaatacccgcattctttcctgatacaacttctgaaagttcttctgaaagttctccatcagcagttgaagaaactataactatagcatcattaagatacattttcttatataatgcatctgcatcaattccaacataatcatatacaatatctatgttgtctaatctcttagtgtccgcgatatcaaatatcatataatcattaacattaacccaaaatccttctggtaactgattatcggcattatctgtcttatcaagttctttatcaatatacttctttgcctgcgctaccttataatccggactgccgttgttataatcatatggtattatcacaagaggtttatcatccttaactgtaagcgacagaaaatatctgacatcttctgagtatttcttattgagaacaagaacaactcctttaacatctttattattcatatctgaattaatgtctttagctattgccagcattccatcgatggaataatctgtattatcttctgttccatatacacgtatatcaggctcactgttactgtcatctttgttatcgtctacagtttctgatgttgtctcattatctttatctgcattatcctgtctggtttcgtcctgcgaaagaatatatttcatcggattctttaacattgtgctgcatcctgtcagtgtcagaattgacataagtgtaaccattgcgattataaaacattttttactaatcatacaaaaaacctcttgttaacctctgccgtaatatcttacttatcagattatagtaagaattccaagtgatttaagaagaagaaggaataaaagaattggagcaacccactttaccataacagtataaagccactttcttcccatcttaattcctgttttctcaacttcatctataacagtctttggcttaagtatccatccaataaggatacatgttcctatagaaactattggcataagtacattattgctgacataatccataatatcaagcacctgtgcatgtactccgttagggagcttaatatcaaataacagtttattatatcctaagcatacgataactgcaacagctataccaattacggtctctattgctgtagccttgtttctgtttaacttaaactcatccataaaacttgacacaatagcttccataattgaaactgcacttgtaagggctgcaaagaataccattgcaaagaatattgcaccaattacatttcctgcaaatcccatagaatcaaataccttaggaagcgaaacaaacataagacttggacctgatgctgtcattccgtctcttcccatgaatacaaatacagcaggaataatcattacacctgcaagaaatgcaactattgtatcaaataactcaatctgattaattgactttccaaggttagcatcatcacttacatatgaaccatatgcaatcataatacccatagcaacacttaaactgtagaaaagctgtcccattgcgtccataagaactgtacagaactgcttaacagtaattcctttcatgttaggaattacataagcgcctaatccctgtaaacctgttcttgttgtgccatcaatgtctgtatatgaaattgtaagtgaatatacagatactccaagaacaagcacaataagtaatggcatgataatctttgatgatgattcaataccgctgttaacaccacggaatataataaacgcaacaattattgtaaacacgagcatcattatgattggctctgctgtctgactaataaatcctgaaaaatatccgtcctgtgctgctacatgtccattacctgtaatataaacaagaagatacttaagtacccatccgccgattgttacatagtatggaaatatcattataggtacaatacacgctataatacccagtggcttccacttactctttaacttgctgtaagctgtaagcggactctgctttgtctttcgtccaatagcaatttctgttgtgagtagagtaaaaccaaatgttaatgctaaaacaatgtaaataacgaggaataatccgcctccatctttagctgccagataaggaaatctccatatgttaccaagtcctacagcactacccgctgctgcaaggacgaaccctatagagcccttgaatgaattacgattttcgttcatttcataaccttcccttttttaatatatacttataaattatacctaataatctatataaggtcaaggaaagcgttacatcatattagtcttctctacatacaatatatacattggaataacattatttttgataatatacttagcctcaaatgcttgtaaagtgctcttttgcaaactgcatatcctgtaccacttctacagttccaagataaataccttttttgtctctcactgcataataagttactaaaaatggttttccttgcttttccatccagaccggaacgctatccctagtatgatttttaaaactttctataatggaacgaaccattggctctatcttaggcggatgacaagagaatacttctctgtcaattgccataccaggtcgtttgaacactttcgctccttcgttaaagaaacgatttatattattatcatcgataaatgtaatctctattggcaatgtattaagcatagcttccagctgtgctacactcatatgtccacctcccattactatttcaccttcattaatagccgccttatgacgattctttttatcctgcacatatttttctgcttcttcccatctattctcaatgccatacactaatgcatagtctttggcatcttcatagattccataccattcttcgactgtaaaattcactgcgcagatagggaacaatatattattctctttataaatcatttcatccgctcttgttaaaacagcctgtactctattaatccattcttcgtcatgattgctttctttatctattgctgctaattcatctctgatttcatcatcaacagtccacataacatccgatggccctgaaatttcatagcgaactttaaggagtggataaatcaaatcacccttttttgcatagtgtattgctatttgtctaaaatctgatatttttttgcttacatcttcgcccttttctagtgcacctctaatatctgatatttctttactaaacttctcattttcttctgtaaaagaataaagaggatgcccctttgtttctctgagtgcttttgcaagctcatgttttctgacatacgcatccggcataattttcatttcggatctttcttctttttttaaagattcttcgactgccttttcagcatttgctattttttcttctttagttaagccatgaaacaatgcactatgcacatcacacagtttctgcacctctgtaataggtgttccctcttttataagttcctgctctgccttcatgatttcagaagcttctacatcagaaaaattttgaacaaaatcttttttaacactttctaaatcttctccatttccaagtctctttaaataatccttcagcaattctgtattgctagtctctttgacttgaaattctttgcttctcatagaagaaatatctggcatattaccagtaatttcatccaccgaccagtttaaattcatttttttattcataatattttaccacctttcacctattttgtttggttccctcatgattatttatttaataacttttttatatcctcttcaggtgtactaattgtagaaagcccataattctctaccaggaaattcagcacatttggcgaaatgaatgttggtaatgttggtcctatgtgaatgttctttattccaagataaagaagcgtaagtaaaatacatacagccttctgctcgtaccatgaaagtaccatcgatagcggaagttcattcacatcacattcaaatgcttctgctaaagcgattgcgaccttgattgcactataagcatcattacactgtcccatatccatgattcttggaagtcctccgattgttcctaaatctaaatcattgaatctgtattttccacatgcaagcgtcaaaataatgctgtctgcaggagactgttttacaaactctgtgtagtaatttcttcctactctggctccatcacatccaccaaccaagaagaaatgtttaatatctccattctttaccgcttcaatcacctgatctgctacagataatacagttccatgtgagaaaccagttgttacctgtattccaccattaattccagtcatatgctgatctttggtatatccacctaaggcgagtgccttttcaataactggtgtaaaatccttttcttctcctatgtgtacaatttctggataagatacaacttctgttgtaaatactctgtctgcatagcttggttttacaggcataagacagttcgttgtatacagaattgctccaggaatattatcaaactctttctgctgattctgccatgctgtaccaaagtttccctttagatgagagtacttcttgagttctggatatgcatgtgctggaagcatttcaccatgtgtatagatattgattcccttatcttttgtctgctctaataaaagttgtaaatcttttaaatcatgacctgtaataataataaatggtcctttttcaattgtaagaggtaccgttgttggtacaggagttccataagttgtagtatttgcttgatctaaaagctccatacatcttaaattaacttttccaacctctaatacgataggaagtagtttatccattccccaatctttcattccgattgcaaaaagtgccttatagaagaatttgctgattgtttcatcggtatatccaagcacacttgcatgatatgcatatgcagccattccacgaattccaaaaagtattaaggattttaatgaacgaatatcttcatcagtagtccagagagtactcatatcaaaattattgtttcttccacatgagtcagagcatgtaaagcaatttggtactaatttcttttttgtatcttctatcttatcaattaaaagctttaatgtttcatcattaaagtttacatttgtaatagttgtaaataatccctcaagaactaattgattcatctcttcagttacaagctgctcattaccctcagttgcacgagcaagtccaattaatgctcctgtaagctcatcctgtaatcttgcagtattggcagactttccgcatactcctgtatttccggtacatcctgtgcatcctgctgtctgttcacattgataacaaaacatcttattttccatgttcttctccttttctattgctttattcatcatcttttgttgcttaatggaactatatcaaacttacattaatcattctgttgtctaggcaacattttcgtattattttcaacttttgtgatatactaaggaaaagataaaaagaaggatgaaaaatctcatggaaaaatatattaacattttaaagaatacacctttgtttcaaggaatttcagaagcagaaattcttccaatgcttaaatgtctatctgtcagcattaaaaattattcaaaaggcgaatatctgttaagaagtggagataagatacaaactatcggcatgattctatctggtcaggctctcataataaatgatgatgtttggggaaatcgcaatattattacagagctatcattaggaatgctctatggcgaaagctatgcctgcatcagcagtgttcctgctcaaatcagtgttattgctaatgaaaatctcactgtcatgcttttcaatataaatcatattgttacaacctgttcttcatcttgtagtttccatacaagattgattcataaccttttagagataatagcacgaaaaaatgtaagattgatgaacaaaatagatcatgtttctaagaaaaatttacgtgacaagatacttaattacttgtctagcgaatctatgcacgctggctctaacacatttacaatcccttacgatagacaagggctggcagattatctgaatgcagaccgaagtgctctatctagtgaattgagtaaattacaaaaagaaggtgtactctcttacaagaaaaacaccttctctttgagggtataaaacccttctgggaaagggaatggatgtggattggtcaaaaacaaatcaggggcgcaaatactataacagacagtcggctgtggattttgcggcggcggggatttcgcatgtaagaatccgtattgcggacaaagtggaccaagaactgttggagggacttgaccggcagattcgggactgccttgataatgggattattcccattatagcttatcaggcggatgcattcaaaaatgacccaagtgataaaaatatagaaaatgttgttacgtggtggtcggaagtggccgaacactatcaggataaatctctgataccatctccagccacaataaaatgaagagcagccaatattataccgataactatcaatataattccatacgattgagctgggtagatgccacacagctcttatagagtctcctgtacatacatatttttagtcactataatgccttcttaggacatgctttgacgcattccatacacagaatacactctgttccattttctcttttacgggaattatctgttacatcaacattcatcggacatactcgcttgcactttccacaggaaacacatctttccttatcacacttcacacgaagtaggctaaaataactcataggctttaagaatacggtaattgggcagatatatttacagaatgccctattatcccgaaacgcaaatgccagaatgattccaatggcataatacaggatattgccaacaagaaatgcccagaacataatttgctcgatattctccacgtggcataaaaacagtgctcccacaaaaacaagtgatgcggtaaaggtgatatatcgaataaaaccgattcttctggcatgtctatagtttaactgaaaaagtaacagccctaacgctattgccgagcctatataactgaaattcagaagataaaacagattatccttggtcaaccataatgtaactgcaacaatttcaaatacaagccacattccaagtggaatcagtcattttttctttgtattcaatttctgtttcctccgtaactttatacttcaaaaatttttcttccccttattgctcctgttctatccttcgcaattatcttatccagtaatcaaccatgtttttattttacagtttttctttcaaatatatattctctatccgatgatatatcatctctgaacacatatccaagatggtcaaattccttaatgtcatctggattttcaatatgattttctgccatatatcgtaccatttcaccacgagccatcttggcatatgtgccttttgtgataagcctgccaccagactgctcacaaaatgaaatagttatatacctgtcatcaggtgtcagatatttttcaatacatttagagtattcttttgaagccagattaataataatcctgctgtcatctataacttcccaatacaaattatctccccagaaatcatacagattcgtggaatcacctatcgctgcctttgcctgcatttcaagcctatatggtgtgataccatccataggttttaatactccataaaatgctgataatatcctcaggtgttcctgcacataatcaaaatgcccatcttcaaatacagctggtgccatatattgataagcaatcccttcatatgccaatactgccggagtaagctgcttttgaaaattcattgtcttaatccgttcaatattctctgtcgtaattttatcattgcatttccacaatttctttaattcttcttccgttcttccctgcatccacccaagaatttcttctgttttctctaaaaataccggactactcatggtatctatgctgtcagtatccactttcatcttctttgcaggtgataatattatcttcatcagcttaattcctgtaacattttttccggatcatctgcagcttttactttgtcatttgcctttattatgataccattctcatcaataagatatgttgttctgacaactcccattgacacttttccataattcttcttttctttccatacatcataagcctcaatcactttgcgctcagtgtcagataaaagtgtaaatgcaagtccatatttttcctcaaacttcttgtgggatgcaacagaatccttgctcaccccgagtacaacagctcccttttcgcaaatctgcggatatctttctgagaaaccacaagcctgctttgtacatccagatgtattatcctttggataaaaatacagaattaccttctttccaagatattcgcttaatttatgcaattctccattctgatctggtaattcaaaatccggtgcctttgttcctacttctaacataacgtttcctccaatctacacataagctggtatattatctactcttactacagctctaatgtttcaattatattctttaatgcgtctgctgattcttttagcttcaatgcttcttctccactaagattaatcggtatatcagattcaattccgtctgcaccaacaataacaggcatacttaatacaacatcatcaatctcatatactccatgtatcatgtgcgatacaggaagtattgatttttcgtcacgcataattacttcacagatacgttttactgacattgcaattccataatatgtcgcatgcttcttattgataatctcataggcactgtttttgacagcatctgcgatttccttcgtgttttccttatggttataatgtcctctcatctcacacatgtcactaagcggaacaccggatacattggcagatgaccatgccacaacttcactgtctccatgctctcctactataaatgcatgcacacttcggctgtccactgataaatgctgtccaagcttgcttctaagtcttgcactgtcaagaactgttcctgagccgataactctttcctccggaagtcctgacagtttgattgcaacctgtgtcagaatatccacaggatttgctacaaccagaaggattcctccaaaatctcttttggtaatttccggaataatggacttaaatattgccacattcttatttaccagatcaagtcttgtttctcctggcttttgtcctgcacctgctgatataattacaattgcagcatctgccacatcatcataatcaccagcatatattttcattgggctggcaaatggtattccatgactgatatccatagcctctccctctgccttattcttatccgcatctatcaaggcaatttcagtgaataatccactctgcataagcgcaaatacagatgctgagcctacgaatccgcagcctatcataactgccttttttgaatttgattttttcttattcatgcaatcatcccttccttttgttattctacaattctttcaaatatgtattcattacctgacgaaatttcgtctctgaatacataaccaaaacagcaggtgtaagtagtttatacagattcatagaattaattctcactatgttctgtgcgggtgatactataatcttcatcaataatgaaatatcttttttaagttaaagattattgattgccccagccagttattttgtctgactggggcatactttattaaaatataattgcgtaacaaacagttctataatctttcaggattatcatatatatttatatattcagctacagatctgtcaaatgtcttgatatgaccaaacagccagtcaataacattgatttttacctgctccataaacttttcatctggtccctcattttcatccagataatcatagagttccttaacagtatgcctgaactcctcatgcttctttatatgttcctccaagcctgggtaatcaacgtctttctgcagtttttcttcttctttgaaatgaaattctgtatattcatcaagataatcaagcattttaattgcctttactcttgcatcttctgattcacatgcactcacaaactgctgaatacgatcaatcagctccttatgctgctcgtctattgtcttattgcctgttattaaattatcatcaaatgtaattactgtcataaaaacctccttacaatccacctcatatatgttaaaataaatgttactataatagaaagctggtacttatatgcaaatcaaagacctgtctattttccataatctggatgacgctgaatttaagaaaagtctcgtttgtactcagtccgtcattcatgaatataagaaaaacgattatatattctttcagggtgatgttcccaataagctctacctcattctcaatggtgaagtagaacttggctccatcaatgttaatggtaaagttcttcgtattaccaacatttccgaaggggaagattttggcgaagttgaactttttcttaataaagaccgctatagcggatatgcaaaagcaaaaactgatgtaaagcttcttgagattgcaaaggacttctttggtggcaggtgtgaaaaaaactgctctcatcacagcaaagtagtttttaatatgctggaactctttgccaaaagaactgatgaaaataaccaacagcttgaagtccttaccagcggtaatctcaaacagcgcattgccacatacctattagagcatgcagataacaacaatcttgtatcattatccatgaatagagaagaactggctctgtatctgaatacaaccagaccttccctttcaaggacgcttttatcacttcaggaggacggatttattcatctgtcttcaaggaaatcaatcaaaattcttgatgctgaggctttactctatatcgaataaactagtcttcttattcgcttagttcttcaaaaacatctttacccaatccacagattggacatacccaatcatctggaatatcttcaaatggtgttccaggtgcaattcctccatctggatctcctacctctggatcgtacacataaccacatggtccacatacatatttcttcataataaaaatctcctttcagattctgttttatttatcttatgtatgtattatagtatttaggcaaaccatattccgtaacatatgttaccaaattgcataaatattctaatttttttctacttcttcacttttcttaactgcacctttgaccgaaatatacatgctaatgcacccactgcccaatatttatgagttttcacgatttcaccttcaaattcattcttatctcttatatctgtgacgcatgatatacttcgtgctgtccttggcaaactcagtatttaattggtcttgtatgttttgtaaatccatatatatgctcctaatccaatttgtgcagacggtctgcataaattcattttatttaatctagtgattacgaatgtccgataggtggtcactaatcggacacttatcggatactattggtcatttactggtcactactggtcacttatcatatattagtgaccacctactggtcacttttaaataaaaatgaccagcactgaccactatctctattccaatattgtataaatggtatttgtattctctccaactttttcaatcttgccggattttattaatttctctaataaatttcttgcacctgttctagacttgtaattgcacaaatccataaccttctgcgttgaaatatttccattctgtctgatatactctaatattctttcttctttcgacattgactttagttccgcttggtctgtattttcatttctaatatctgccgcacccggaatataaacaacctatccaacttccagttttaatgtcactctatctgaacgctctgaaaaatcaaactccggttctttccagttacctgccatacttaccagtcctcatcaagctcttccatcgcatcatctacaccatcagcatagtccttatctttctgatatctgtcccagtcataatctccatcatcatagatagaatcatatccgctatcataagaagcatatggattgctcttattgctagaagaatgactctttgtcgaataactgctgccagatgcttgtttgttgtcacattctgctttaatacactttggttcacttgcttcaccgattgcaccaatgatgtaaagcgacaaaaaaggacgcaggattttctcccacatcctcacatctatctggctttatctgtctttctctttatgttatgactttactttatctgtgtaattccagaataatatatgttttataattatattcacccagcttttttcctatatagatatctcttttcaaactcgttaacatcaatagctttagaaaaataatacccctgaaatacatcacatcccagctttgtcagattatcaacctgctcttctgtttcaaccccttctgtaataatcaaaagattaagctcctttgccatttttatcacagaagcaagtattatgcggcttttcttaacattcttagtctcttttataaagcccatatcaacctttaatacatcaacattaatatcctttaatgtattaagcgatgaataaccgcttccaaaatcatccatttcaagtgtgaatcctgcttttcttagttcttccagctctcccatcagattaggtacatctgacataatcgtagtttctgtgatttcaatttttagattagatggttctatatcatatttctttataagacctgcaaatgtgttaaatatatcaatataataaaaatccttaggagatatatttaccgatatgctcatattgataccagctttcttccactctcctaacttagccgctgcctgctcccagatatatctgtcaagtctgcttatgagcccagacttctcatatacaggtataaagtctattggtgaaataatcgttccatctggctttattcttcttactaaagcttctgcacctgtaagcctccttgtttttgcagaaatctgtggctgaagatacatcttgaactcaccggcttttatagcatcatcaaattcatcaactattgtcttatatttaatagcagcttcaagcattgtgtcatcataataagcaataaagctatgtgtatcatccttaatcgaggctactgcaaatgaagccttgtcacacataaatgataatgattcattcatattatcagtcctgtatatcccaaaacagactctgacattatatactgaatcagaaagcacattctgtaatgtctccctgcattcataaagatattcttcattaaatgtagcttcatctgcaatcactacgaaatgattttcaccaactcttccgtataaatatccatctaccgcatgtttttttattatatctgcctgcttaagcaatatttcattacctttttctattccaaatatttcattaataagcttgaattctgctatatctgaataaatgataagtctgttctttttcttatctggcagttctttcattttctgcataagatgctcgggattgcataatccagtaagcttatcatgtccggcctcatgtcttttatccttgtctatttttatagtcatatactgaaacactattactgctaataataatgctactacaattcctgttatcatacgtttaaccttctgccatccaatctttttcccttcattaaccgcttgttttcgtacatgcggctgtctgcacgcttagtaagctcttccataagataataatgctctcttgtgcttatttcatatcctttggcatatgaaatcttaatattgtttttttcattgtaaacatttatttttctttcaagactatccagaatctggtgtatctctactgcatttgtcttctccagaataacgcagaattcatcaccacctatacggtacgcactaatacgttcattctgcacgcctgcaagtatagctgaaaagctctcaatatatctgtcccccatctcgtgtccaagagtatcattaactcttttcagattattaagatcaaacattataactcccactaaaaatgtatcatctgcattattaagtctgattatatgattctggtatgccagcttgttattaatccctgttacatctgtataagccatactgtcaacatctgcgtttatccttgaactgacaaagaatacagcaagtatgattatatcaagaatcagtgctgtacacgaaagaatcctcggaagcatttcgttatgttttagcacataaacagtaagatatatctgtatagctatcaatatagtcatcatgacactcattccaaggagtaagcttttaatatatttcctattagacataattctctcctttacatcaggcaactataatacgcttaacatactccttagcaagccctattttaatatccttaataactactacataattttcattgatttcagatagtacacttatcttactacccacaacaaatccaagactttgaagcctgtgtaccatatctttatttccaacaattctctgaattatatatattttgtttttatctgcaagatttagtggcataatcaaaaatctcctgtttaatgtgtcaataggttagcatctgctaacttagcagatagaattatatcatcctctttttatctgtcaataaaaacaccatacctttttcctatgtttttattaaaatacacccgtttgattcacttatcctgttgatgaaatatctttgtaaagtaagagcgtgataacagataactctgcaactaatgcaaataacatgctatattattagtttaaaaaaagagatatcatatcaaaatgatatgataccccttattttcattacattatttaattattatcagattagttattaccacgattatcaatcttggcaatatcaactatagataattcctgattattgaatgcatgctcaaggcttgatataagtgcatgggctgtatcaagacttgtaaggcagtgaactcctgtctcgatagcatatcttctgataaggaatccatccttggctctctcaattccattctctggtgtatcaattacaaggtcaatcttatgctctaagataaggtcaagaagtgtaggtgcttcctgtccaatcttattaacctgaattgcatgtactccattttccttgagaacctttgcagttcctcttgaagcatatatcttataacctaatgcttcgaatctttgtgcaatatcaataccatcctgcttatccttatctgcaagagtcatgataatctgcttatgctttggaagtctgattccagctccctcgaacgccttataaagtgcctcatcaaagctcttagatataccaagacactcacctgtagacttcatctctggtccgaggctgatgtcagctcctctgatcttctcaaatgagaatacaggcatcttaattgcatagtaatctgctgccttctgaagtcccggctcatatcctaattccttaattgtcttaccgataataacctgtgttgcaagcttaacaataggaatacctgtaaccttactgatatatggtactgtacggcttgaacgagggttaacctcaattacatatacctggtcattatatacgataaactgaatgttaatcataccctttacatgaagtgctcttgcaagtcttcctgtataatcttcaatcatatctacaatcttaggtgatatagacttagctggatatactgaaatactgtctcctgaatggataccggctctctcaatatgctccatgataccaggaataagaatatcctgaccatcgcatacagcatcaacttcgatttccttacccataaggtacttatcaacaaggattgggtgatcctgcttaattctattgatgatattcatgaattcaactacatcttcatcagatacagcaatctgcataccctgtccaccaagtacatatgaaggtcttacaagtacaggatatccaagctcattggctgccttaagagcttcatcaactgtaaatacagtctgtcccttagctcttggaatctgtgtctgctcaagaatctcatcgaaaagttctctatcctcagcggcatcaacatcttctgccttagttccaagaataggaacccccatcttcataagtgcttctgtaagcttgatagctgtctgtccaccaaactgtacaactgcaccatccggtttctcaaaatctacgattgattcaacatcttctgctgtaagcggctcaaagtaaagcttatcagcgatatcaaagtcagtagaaactgtctccgggttattatttacaataattgtctcaaagccctctttcttgaatgcccatgtacaatgaactgaacagaagtcgaactcgataccttgtccgattctgattggaccagaaccaagtacaagaaccttcttcttatccttagtctctaccgcttcgttctcactgccatatactgaataatagtatggtgttgtagctgcaaactctgctgcacatgtatcaaccatcttaaatgctgcatgtatattatactggtctcttaattccttgatttctctttctgtgtgacctgttaaatcgccgataacattgtcagggaattcaattctcttagcttctcttaaaaggctctctgtaagaggtcctctcttaagagcattctccatatcaacaataatctggagcttatcaataaaccataagtctatcttagtaatatcatgcatcttggctgcagaaatgtgtcttcttaaaccttcagctatcttccagattcttctatcatctacaattgcaagctcttcaagaagctcttcatctgtaagtcctgtaaagtcatatgacataaggctgtcaacatgctgttcaagagaacgtatagccttcataagaccaccctcgaagttatcagaaatactcataacctcacctgtagccttcatctgtgttgtaagtgttctcttagctgagataaacttatcaaatggaagtctaggaatcttaactacgcagtaatcaagtgctggctcgaaacttgcatatgtctttcctgtaactgcattcttaatctcatcaagtgtataaccaagtgcaatcttagctgcaaccttagcaataggataacctgtagccttagaagctaatgctgatgaacggcttacacgagggttaacctcgattacacagtactcaaagctgtctggatgaagtgcatactgtacattacatccacctgtaatgcctaattcatcaataattcttaatgcagatgttcttaacatctggtattccttatcagaaagtgtctgtgaaggagctactacaatactgtcacctgtatgaacaccaactgggtcgatattctccatgttacagatagtaatacatgttccgttgctgtcacgcattacttcgtattcaatttctttccagccggcgatacaacgctcaactaaaacttcgccaactcttgaaagtcttaatccattctcaagaatttctcttaattcctgcacattgttagcgataccaccgccgcttccaccaagtgtgtaagctggacgcagaactaccggataaccaatcttagcggcaaatgcttcgccatcctcaacgttgttaacaacaagtgatggtgcacatggctcaccaatcttttccatagtttccttgaacataaggcggtcttctgccttcttgattgtaagtgcagttgtaccgataagctttacattatgctcctcaaggaagcctgtctctgcgatttccattgcaaggttaagtccagcctgtccaccaagtgtaggtaagatgctgtctggcttttcctttaagataatctgctttaatgcttcaactgtaagaggctcaatatatacctcatcagcaatatctttatctgtcatgatagtagcagggttcgagttaaccagtactacctcaattccttcctctttaagagaacggcatgcctgtgttccggcatagtcaaattctgctgcctgaccaataacgattggaccagaacctataactaatactttcttaatactctcaatctttggcatgttcttagtcctccttcttcatcatatccataaatctgtcaaacaggtacgctgtatcctgtggacctgcgcaggcttctggatggaactgtactgtgaatatattcttaccaacatattcaagtccctcattagtcttatcattaacattctcaaatgcaggtactgcaaccttactgtctaatgtgctttcatctacaacataaccatggttctgtgatgatatataacatttgccagtctttaaatccttaacaggatggttagcacccctgtgtccgtacttaagtctgtgagtatcagctcctgtagcaagtgccataagctgatgtccaagacagattgcaaatattggtacattgctgttatacagcttcttaatctcttcaattatctctacacattccttaggatctccaggaccgttagataacataattccatcaggattagattcaagaatctcttctgccttagtatatgcaggatatactgtaacttcacagcctctgttattaagtgatcttgcaatattcttctttgcaccaaagtccataagagcaaccttaggtccttttcctggaagaacatacttttctgaacatgtaacctttcttacaacgcccttaacactgtactccttaatcttaggaagtacctcatcaagattataattctcattagttgtaatcataccgttcatagtacccttttctcttaatatcttagtaagggctcttgtgtcaatcccacaaatacctgggatatcattatcaagaaggaatttctggataggatcttcatttctgaagttgcttgccattctggaaagctcacgtacaatatatccatctggccatgctttctgggattccatatccttatagcacactccgtaattaccgataagaggatatgtcattgttactgcctgtcctgcgtatgaaggatcagtcagcacctccagatatcctgtcatagatgtgttaaagacaatctcactaataacttcgcgggtcgaacctatgctggttccttcaaagaccgttccatcttcaagtatcaaaaatgctttcatgaatgccaccttaattcctttcgtttatttaatttaatcatatgccaagaggcgctaaaatgacttttgcgcaaaaaaaaagacacaaaaatgccttttttctctcaaactttacaatatgttaccataattaaatgtaattttcaagcaaatatttatctatatattgcataaaaatacataccttaaaaacagcccccaaaacaggaggctgtcatctataatcttctgttatatcatctcgttcttgagattccttctctgcttactgaccacacctgaacacagtctttatcagacttattcatcatattttccaccaatgtattattattctttccaaaccagttctttgcaagagcttctgctgcgggattaatcaatgatttaagatatgaattagaagaaactttaagacacaactttttcttcttcttccattgagcatatattgtcatattaccgccatcatcttcaacaagcttcgaaactacatctttattttcgtactttgtaccttttccatcttcttcagtgttccatgaatcaaaatcatatccaggtcttagtggcggatccggaagttcattctctttctcatatcctgtgataattgtagaaccggcatcatatccaccattagaatcaatattaatattgtatatattctctttccacacagctgacatatcaacaactgccccaagcttatcagccagattaagctttccaggcacgccgccttcaacatatgtgccgtcttctgtttcccagcctaaacctgtccaaccggtaagactatatagctgcgatacacacggaagctcatcttcttcatcatatgtatagaatctgctgtaataaccttcatcctcataccagtcccagtctgaattatcaataatcttcatcatctcacttgattcttccggcttattgcaatacaaatgtacttcataaaaaatcggctgccatatcgcatacagaacagcctttccgctatcatcaggcgtcaggtcaacaacagacatagttgaataaaactttcctgtatcatcacttttcgtattccagccagacaaataatacccttttcttgacagactgcttcctttaagtctgattctgctgccaagctttgatgtaatattctccatataaccggtaacctctgcgtctgtgttattatcaaatgtaattatataatcccatatagcatagacagtcacatctttgttataatcactcagatcttccggttctaatatgccagagtcaccatatctgtcaaaggaccatccggtaaatataagtccattatcagcagatgcaccctcagtaaaacctgtcagttcatcccctcttccataataagcatcctcatcatccggaagataagctttaatgcctctgtcagctgcaactcctgcgctataatgaactgtaaatgtctgtctttcccatattgctttgataacaatatcttcttccgtataagcccctatttcaacccgaatgccattctttccataatcagtatgccatcctttgtctcctgaaacttcccagcctttcagaatatatccatccctgcttaccgcaccaattcttacatatggtgtaactcctacacagtcataataattagatgttaccgcatctgctttgggcacagatgccttataatcaataatagtatggtattctccataacggtcagcaagatattccccaattctcagatcatcattccattgtccggcattatctccattatcaatctgcgactgataatatatcttatcacatgttcctccaccaagatcaatagtaatattatgatgaaccttatactcgtcttctgctgcatatgatatcaccgcccagccaataaccagtatacctaatagtacagctgctgctatcaggcgctttttctttccatgtctgcttttcatattacaatctccttatgaataatcctcattcacgtccagcgtccataagaaaatgcatatatcaaaaaaacatgcgtggtattataattccttttgctataattataataccacgcatgtttatattgttcaaatagtttttacactttaataaatatttaatcttttatctcaacctggccaatatatttccatgtacttcctttatcagatgactgatattttgccgctgtttttccatcattgtaaacagcatttttgccctgggtaagatatattgttataattccggtagaatcaacaaccggtgtaagagcttccttatatacatcgccccatcttaactgttctgaagaatctgcaccgtttttcccggaatcagttttagtttcagtctcctgcccctgtggattcgcagctgaactgtcaagttcctgctcctcaagcattacctttgcaaatgttttaccaccatcatctgtcttataaagattactatccataccttcaacataatcataacagaaaaagccgacatctgatgacacatacacgacacccttaattatattagtagcaggtccgcttccaactatgtcccagctttccccaccattacttgtgctgtatatccttgatgattcattagtatcattactctttgcatatccgcaaacaatcaccccattgtcagaatcaaagaattttacataataataatcagccgtatatatcttatcaagttcacatgttgtccagttttcgcctttatcatccgaataaacaacagtaaccggaattttagtgttattaactgtctttcctccatatacaaaagcagttttttcagtagttatcatataactgccttctttaagtgttgttgaactgttaggctcatacaacagataagaataagatacaggaaccgaaatatatttttctctatcataagtgacaagaagtgaattatcctttattgaataattagcaagctgatccttgttagaattacttgtaatctctgtatctccgcctgaatcaattccctgctgtgcataatactgtttcagtccatagtcttctgaactcatgactgaagtaacataaagcttcgcagtattatcatagttgttatcaagataaaacgaaaccacccactcacattttattcttccgtcatcctgaataccttcccacgaagaaaaataatccgaattaagattctgcggaataacccagaaggacagaagaactgtattgcttgaaaggtcaagcacgcttactgaatcaatacctgattttacaatatactttgaatatggaacatatttctgtctgtactgtgagatatatttttcgagccatttagttccaagcccaaccatatccggattagtaaaattagacacattatcattatcataatcagatacataatcatcagatacaacattccactgatcatcaattcttattgaaaatgtataacgtgatttaatatccagcttattttcctgatatttagatacatagctgtatacaaacactcctataacaagaagactgaatataaccagaactgcatatgtaattatttttgtctgaaatcttctgcttttctgatacataatcaccctcctgctttaattaaaattctcttttattatgcattgcctctcttattatcacacgataatacttataccaccacaggaaatacattgcacctgctccaaccagaagcataacacagacaacaaacggatgtattgcatatatccagcttgctgcaattctgccattaagcacaggcagtccatacgcaagtattacgcatatagccattattgtaccattaagcacacttctgttttcgtacacacttctgaagtggtcaaatgttataattgccatcatctcacccacaggtcttgcacatgctgtaacaaagcacaacataagtgcattaaataccggctctccaagtattataagtgtaataaagtagaatacaaattctgttactatcttatatataagctttcccagaaaattcatatacggactaacaagcattatgcgaatcataagataatccctgtcacccattgcaaatattgttgtattagcaagacttccacatatagttgaaagcattataaacagatatattatagaaatatcctgatgaatccttattagtgggaagaaatatgcaagtattgtatatggaacatatataagaagaattacatacatgaactttcttataaattcccatgcaagcataaatatctgtgccatagttccaacgatagccctgctttttgatttttcaccaaaagcatcatccttcaccagtttccttattacaggaaaactctttatcatcttaattcctgcctctgttccctcataatatcgtaatattttctcagcaaacagctttctaaataatttcattgtctgcctccccaagtatgtctaatacagcttcttttatctctggaatctgcatagtttcatgtgatataggattgagttcaccattgttaagaaccagcacatcctttgatattctatgtgcaatatccaacaaacctgttgatataagaattatatggtcattcttatattcattaagaactgaaagcatatcatcaatatattcatcagtacaataatcaagtgcctcatcaaacatcattacatatggtttctgaataagaaaagctgctaactgaagcctcttcttctcctcaaaactgtaatctgcaatatgtctgtctcttatcagccctgtaagcttcactttatcaagataatattcaggcttttcgctgttcttattcatatcacagagcatactgataaactgatatcctgtaataagcataggcagaacactctgctttgcagcaaagaaaagcgtgcacttctccttagtctcaacagtgcctgagtctacagcaatatctcctgcgatacactcaaacagagttgttcttcctgctcctgcaccgccaagaaccggatatatatttccttcttcaaatgtatattcaatatcagtaagaatttcgttcttaccaaaacttttcttcaaatgattcaaatgtaacatttataaatctcctgcatccaatgtgtcatatcattatattacatatttatttggtttgtaaaccttcaaaaccttattatattgcatttattcagcaacaatgatataatcttgaaatattttgctaataatataaaaaaatgtagaggtgtacagtattgaaagatttttttaaaagaaaaggctggagaatatgctttgcagcatatatatttatataccttccatggttttcaactcttgaaaaagtaattaacagtgattatcccgggcttcatatcatcaatattccttttgataatatgatacctttctgtgaatactttataattccatatgtattatggtttttatatgtggttgcagcttgcatatatatgtattttaaggcagataataaagaattcatacagtttgcgttatcactcataatcggtatgtcactctctcttactatatgcatgatatatcctaatggtcttacattaagacctgattatatccctgataacttctgtggaaagataatcaatgcactatatacaatagatacttcaacaaatgtattcccaagtatacatgtatacaactcactggcagttaattttgcattactgcgttgcaaagctttaaaaggacatataataacaaagacattatcttccattctttgcatccttatatgtcttgcaaccgtatttttaaagcagcattctgtagtcgatgtaatcggagcaataattctttatatcgttctttacattttcatatatgttattgactacagctgtttaaagaaagcttagtggattctctttaaacattttgaaagaagttctataagaagaactacaacaaacaatacaataagaattgagccaacggcgtcccatctgtaattgttcatgtagacaatcagtggggcgccgattccacctgctccaacaagtcctaatgtacttgccgaccgcacattcacatccagtctgtacatcacagcatccttaaactggaacttaagttcaggcaccgccacatgccgtaatcttgctataaatcccgttcctacacatttacacgcattccatgccgccatattccagttatctactgcaactgtgaatctctttgtcagaagtccgatactgcacatcatcattgtaagcactccggcaaagctgccaggtcccgtaacccttataaatataagcccatacacatacacaggtacagttcttattgccataacaacaagcctgccaataaaagccataggtgctggaacgaattttctcgaattaatcaatgtaagtattactgcaaacactgctccggcacatgttcccgcaactgcgattgcaatagtttcaagcataagatacataacgccactctttccggtcataaacatgtattcccagtccggatgtgtaattccgtgcataatcgcaccaacaaccttaataccaagctttgatgttgatacatctttaactgcactgagactgtatacaaaaaataccatgatacatacacttataatcacatttgcagttgtatttctcttaatacgtccatcaagatatgctttcaggaatgtacttattccctcaatcacaagcactgcgacaaaaagcataacaagaatcattccaaccctgctgtattcacgccagcttatcttttcattaagcagtagtcctattccacctgcacctacatagccaagtattgccgcatgtcttatattagcttccagtacataaagcgaattactaagatatcccggcagcagttcaataataactgtccgtgaaaatgctttaaattttcctgctcctatagctgtaactgcttcgtatggcttcagtgtcaggccttcaatatcctcaccaccaattcttgccattacagcccatgtcgatacagctattgcaatagttcctgctgccgcaccaagcccccatataaatgttgctacaagtgcaagtataagcacaggtattgttcttacacactgtacaataactctcaccacaatccttacatatgatttcttaataagattgcctgcatataaaaatgcagtaaaaagtccaaacacagcacctataaatgtacccgcaattgacatctgcacagtcttaataagtggttcaataatcttaccacaatatcctgtatccggtgggaacattctttttatgaataatacagcctgactgcctctctttataattacattcatatcaaagcctgttacagcaaaacagaatattattataaaaagcattaccagtgccgtaattcttctgataaccttcattctattcatgcttttcatacgcaccaccatatatgaattcaatatcctcgtttgttacctctgacgactttttatcaagcacaagtctgccatcagcaattcctataattctgtccgatttcttcaatgcaagctctaccgaatgactgttcataataaccgttatattgtactgcctgttaagctgtacaagaatatccgtaatctgttctgcactatatgggtctagagaagcaaccggttcatctgcaagaataatatcaggcttctgcattagtgcccttgcaattgcaactctctgtttctgtcctcccgaaagttttcccgcatatgaatacattttttcagataatcccactgcttcaagctgctttcttgcatattccttctgttccttagtgaatataccaaaaagtgcctgaaaagcatttctatctgccaatgccccattaagcacattgtctaagcaggtaattgtatcaacaaggcagaaatcctgatatatagtgcctattgttttctgaatatctcttttctttcttcccttaagctttgtaaaatcctggttattaataataatacggcctgcagttggcttaatcattccattaagcaagcgaaaaagagtggtctttccagcaccactctttccaattactgatatgaattcgccctgttctactgaaaaactaatgttatcaagggctttatctccacctttatataatttactcacactgtctatctgtaacatgtatattgtcctcccagacagcttaaaggtgaattatttctttaacatattctgcgccgcacgctctgcatcataatcagagctttgggcatactgatatccaatatggcttaatacattcaaaactttaagtccgtcttcactttttcctatattaatacaagcatctgcaaatgctttcttaaagccttctgacataatatctgaattcttactaacacatattgtatcatccattatctgatctgtcactgccaaaactgcagtctgtttataacaatcatctgtaccaccgaatttgctcatccagttagctgcatattttgctctcatatgtgcaaatccgacaataacatcaacctgtcctgctgcaagtcttgacatagatgttgtatatgaatcagactgtacgacattggcaaggtcacttatctgcttcccataattattgtaaagccacagacttgggtatatataacctgatgctgatgaagcacccattacagcccatgttgcaccattcaaatcatcccatgtaagcttctgtcctgcattgacctttgcagcaagctcctgtcccttagtacttggtcctgcaagaattattgaacggtaatatgttgtaagattatctgtaaatgcttcctccgttccgtcattccagtccttggcattaagagaatccttgttaatagcttttctctgtgcagtaagcagaacatcacagtcatcatcatatgtaacataagttccgccagaaataaatcctgcatctgctgttccggcacttaaagcttctcctactgcactgtaagaagttcctactgtaatctcaacgttgcctacattatacccctgtgtagcaagttcatctttaatcatgccgccaagaggctcaagtcctgtaagcagcgtatcagcatcctgatacggtgcaatcattattctgaatgtatcaatatccttagaatcttctttagttgtatcttttccacagcctgtcagccctgctgataatcccatgcaaaatgtcgctgtaagtaacacagccattccttttttcaaatattttgttaatttcattattttgtctctcttccaatttcctttaacatattcttatcgcttctaattgtagcacatgcaacagtagtaagcatattacctgtaatggtagcagacgcaccagactgaaatgccttgattccgtctcctgtaagaagtgctcttcctgcaccaagtcttatatcagcctccgggttaatatatctaaagaatgctattgttcttaatatctcaggctcagtaagtcttctctcattctcaagaggtgtacccttaattggcataagtgcattaagaggaatagagtcaactccgacttccgcaagacttattgccatatcaagtctgtcttcccagtcttcacccattcctattataccacctgaacatgcccacatgccttctgcttttacaagctttaaagtttcaatcttcatatcgtatgtatgtgtagtgcatatattagggaaatttcttcttgaagtctcaatattatggtgataacttgtaacacctgcttcatgaagtctgtgaagctgctcagcattaagaaatcccatagatgcacacagctcaatatcacattctttattcatagtctcataagcatgaacagccttttcaaattcctccccggtaagagcttttccagctgtaacaatcgaaaaacggtcaacaccttctgactcattcagcttacacgcctttacaatatcctcttctggaagaaaatcatatacctcacagtcagtgtgattgtgtgcagactgtgcacagtacttacaatcctctggacatttgccgcttcttccattaattatagaacataagtcaaccttatctccaacaaaatgttttcttatcctgtctgccccttcacaaagttcatccaaatcgcaatccagaaaaaatgtcaaatcatcctgtcttttaattcttcttccgttaataatctcttctgccagttctaatggtgtcatatatacatacctcttttgaaaaatatttattagattatagaactgaaaaaggcgaatgtcaacaaattgtgccttgcagttgacattcgccatatgtaattacccgctggtattctttatctcttacctatatctgccatatcatgtataacatcagatatattctctacagttgaggttattctgttattaagatctgtacagctcttagcaagctttcctacctctaatgctacaactgaaaagccttttcccgcctcaccggctcttgcagcctcaatagatgcattaagtgcaagaatattctgctttctctgtatgccatcaagctgcttggtattctccttgatatctctcacatactcttcacagctcttaacaccacctgtaagctttgtaatcaattgtccattgtacttagaattatattctgaattaataaaattattaagtactgctcctagcaggttagctgccgcattaatctctgcctctgttcttactgtaacttttcctaacgcctcaatatactcatcctcattaatacccagttctcttgcaacacctctgaatttctcttcatccggatgctcaggtaaaacctgacctccgattacagagccaagcactgtaccatcgcttaacttaagcggaataccaaaatccacaagtccagcatgacaatgatatacaccttgtccatcagcatcacatttttcacatcttctgcatccttccttacttcctctggtaagctttatacagaaatctgtaaagttgtaacattcggaaatatacttcccatcagctccaactgcaaccgtggctaatcctgttgccacagcccagtcagacataattgattcaaatttctccatatcagcaaaatcttgaatcttcatgcttaaaccacctctttttcaattgtcacatgtattgattgagtaaattttaacaaataagacctctaaagtcaatgaatatgagtaattatcaacatttttatgtactggctctgtattaatgatggaacaatctcattcctgtaaagcacatagccattcctcgcttattggctgtttctataacctgattatctcttacagaaccaccaggctgtgctacatacttaacaccagacttataagctctttctatattatctccgaatgggaagaatgcatctgaaccgattgttacatcagtattgcctgcaagccatcccttcttttcctctgttgtaaatacagatggtttctctgtgaatactctctcccagtcattgagaatatcttcatactcatcaccaatataaatgtcaattgcattgtctctgtcagcacggcctacgccttccttaaatggaagattaaggacctttggattctggcggagataccagttatcagccttctgacctgcaagtcttgtacaatggattcttgactgctgtcctgctccgataccgattgcctgtccattctttacatagcatacagaattagactgtgtatacttaagtgttataagtgcaataatcatatcaatcttagcagactctggaatatccttattctctgttacaacatttgataaaagttccttatcaataacaaactcatttcttccctgttcaaatgttacaccaaacacctgctttctctcgattggttcaggcttatactcagggtcaatcttaatgatattgtagttacccttcttcttagcctttaatatctcaaatgcctccggctcatagccaggtgcaacaataccatctgaaacctcatgctggataagctttgctgtagcaacatcacatacatctgataatgatatgaaatcaccgaaagatgacattctgtctgcacctcttgctcttgcgtatgcacatgcgattgggcttaattctccgattgcttcgtcaacccaataaatcttcttctcaacatctgtaagaggaagtcctactgcagcacctgctggagatacatgcttgaaagatgtagctgctggaagtcctgtagctttctttaactccttaacaagctggtatccgttaaatgcatcaagaaaattaatatatcctggtctgccgttaagaatctctacaggaaggtcacttccgtcttccataaatattcttgaaggcttctgattagggttgcatccgtattttaactgaaattcgttcatattctttctccttaattactttacattcttgttaataattcttgtttcgtattcacctgtagcaatatcaatatatcttacaaaaagtgaaaccttgttatctgcattaagattatcccagatcatctgtgtgaattcttcaatatcacctgatatcttaacccatgtaggttctccctcatagcttggaagtggattgccatcacccatatatgtatggatataatgtccttctcctgcaaatgctgcatcatatgtatatgtgtgtctttcacagatgtcaggattaccattatggctctttaatattgacattgcatatgaatattcattattctcaacatgaagcacacttgaaattcttggtgtatagttaggtgcatcatgctcatattttcttactcttaaagattcttcaaatgtttttccttctgaaagaccatcataaaccgtatcagtctggtctccattagtaactatagtattattgccaagtactcttacaggggcatagataataagctctggtgcaactaaaagtgttgatgggtcaaaagcttctgttctgataccctctccgtcctgtacaaatacacggttacggctgctctcgcttcttcccataataaaataagccgaaactgccttcttaccatcctctgacataccggcaacaattcctctgcccggataagcacatcctgataattcctctgaaaggttcttaattgtcataactgacctcctgttaaatgtgatgactgcgttcgctattctttttcatgagcagcgctcgtaactcaaatgccagaatttcattctggcattgtcgcggtgctcctcgagaatccatataagtttcgcattatgtgcaagcacaactgtgaaacttccatgtcttctctcatcgctactcgcacaaaaagccgaccatctgggaacgcagcttatagcttaacgttgcccaggcggtcggcttttcttaatatatactgtactccctgtgggttatcccacaatgcactttatgcatcttccgccagttgtacagcacttattaataacatacaacaaaatatgttaaattgcaacaccattcttcttaagaagttctcttgctgattcaactgaatcaacacctgttgcattcttaattggtgcaaattccttttctcttactacctcgaatggcagacagctgtcaagctcatgaatcatatcaagaacaagaccctcaaatttatatccgttaggcttttcaggcttaacaagattaccattcgcatcaatatatggaatcttcttctcaacaatatgcaatggaagattctttccaacaattctttcaagatcagaaaccctgaacagatagttaagaataacaccgaaattatatgctggatcgccctttgcattcttagcatccatcatctctttagtaagttcataatactcaacaatggaaggctttccatcttcaagacacataacgccaaccttctcatcaggagctgcctttcttacaaccttagaaccaactgcacagtgcttttcaattgtagcaccgataaatacagggtctgcaattctctgaagaacattgtcaacagcaaatacattaagccactcaattccgttattctcaagagcctctgttaatccagccttctttaaagagatataccagccaccattaccattaggtgatgtagccattcttcccttatcttcaagatatatcttaccatcataatcagtggctgctgccatctcctgcttgaagaaatgtacatattcactcttatatccgaagaagtccttctcttcaaagaaagaaactgtagcatcattattcttctcactagtcataacaaataaatgtatatatgtacctgtttccttaacaacatccataagattattaataaggcactcgaatatataaagttccctgttaactcccacgttatacattcccttaggattatcagaaccaagtcttgttcccattccacctgcaagaagaattgctccaacttttccagctttaattgcctctacacctgtattcttaaatgtatcatagtcagcttctatctcatccagttccattgcatcaagaggtgtaatctcacctttcttaacaagctcagacttatgttcaattgcagataaaacttccatatcagtcttatcaatctgctcaataagtgctgtcttctcatcatctgataattcatcataatatcttaatatctgttcctgaccgtactttgaaagcttcagctttgcttcttctaaattcactctaattccctcacttatctaatagcttattgtctgacgacatccttataattctaacacattaatagtttccaagcaacttaatagattcagcttcttcttcaatacctcttaatgcgttcataacttttggatcatcaatgttaccagcaaaatcaacaaagaaccggaaattccatctctttccttcaacattcccttcaataggtcttgattcaatcttattcatattaagtccattatatataatatgacttaaaagattatatagagtgcctgcttcattagctgtttcaaacacaatactcatcttctgtgcattcttaacaaactttcttgtattagtaacaataacgaatcttgttgtattgccttcctggtctgtaattccagactttaagatatcaagaccataaagctctgcagcttccttacttgcaatggcaacatgagtcttattatgctcctgaaaaatcatctttgccgcaagtgctgtattagcctgactgattctctgccagtccttgtgagtatctaagaatctgtcacactgcataagtccctgtggatgtgaatatacagcagttacgttttcaaggtcagttcctggaagtccaagtaacaaatgttcaatcttaacataagtttctgctattatgtaattattatattcctgtaacagatcatacacatcagcaacaattccagcattggaattttctataggaagtacagcataatcagccttcccctgcttaactgcctccatgcactctctccatgtaggaacattgaaattatcaacatccttgccaaagaaattaatcatggcagcatatgaatatgcccccggtaccccctgatatacaaccttacagttctttttattaatctcatcaattgcctcatatggttctctcaaagtctgtcccattttttcaagcaacatatactggttttttcttgagttagccataatctgtgcaaacaaatcatcaatagcatgcacattatcaggattcttgacaagcttctttacagattctaacttagctttctctcttgctggatcaagaactttctttcctgtctcaatcttatattctgcaacctcagttgtcagtttcattctctcttcaaacagttctacaagctgactgtcgattttatcaatattatttcgtatttcattaagatctaacatatacttctcctctttaaagcgatgtattgttcttattgtatcacatttttaatgatatgcaataaaggtactttatgttatacttaagaaaatgttcttaaataatgttcataagggagtagtgataacatatgaaaaaagccatcacaataagtgtaataactataataggattattactcgcagtattaatatttttatctatacgaagcagccgaatcgtatacaacaacgataatgctattggcaattcggcaggcaacctcaataacggaggtttgttctgcgaatacaataacaaaatatattttgccaatccatacgattataacaaattatatgtaatgaattcagactgcactaatgccatgaaattaaatgatgacagtgttgcatcaatcaatgtctgtggcaattacatatattatgtcaagaataatttcaagcaggaaaccatcggaacaatattcaggggacagctattcggtgtttaccgctgtgacttaaacggtgagtcactgaaagcattatacgacagtctttccggaacaatagccttatctggtaactcgttatactaccagcattatagtgacacaacacctctggctttccataaagtagacattgcaggaaagaaagacaccaaaatttctgacacaccttactcacctgcgtgcgtccataacggaacaatatatttttctgatcctgccggaaaacataacatattaagttacgataccaaaactgataagacctctgtattatatgattgcaattcatatcttgcagatgttgagaacggctatgcatattatattgacttaagtaagaactattcacttgtaagacttaatacatctaacaaaactcttgaattattgtatggagaaaaaggaaacaaagtcgttaattataatgtgtatggaaacaaaatatttttccaggtagaaagcacagatggaatgacaggcctttacaggatgaatattgatggaacgcagattgaaactattgctataggcaatattaccaacattcactgcacatcaaaatacacatttttccagtattatgaagatcagggagtcctttacagagtaagcacaagtggtgctgatacatctgttgaacagattactatcaaataacatttttataaatatcataaataaaagccccgcactttcaaatcagtgcagggcatttattatatcttactcttcagttttctcttcttcaatcttaattgaaagctcatcaagctgcttagcatctacaacatcaggtgcattagtaaggagacaagatgcatcctttaccttagggaaggcaataacatctctgattgaatctctcttagccataagcattacaagtctgtcaaggccataagcaagtcctgcatgtggaggaacaccatacttgaatgcgtcaagaaggaatccaaacttttcattagcaacttcatctgtaagtccaagtgccttgaacattctgctctgaacatcagcctgatggattcttactgaaccaccaccgatttctgttccgttaagaacaatatcataagccttggcacgaactgcaccaggattagtctcaagcatatcaagatcctcatccataggcattgtgaatgggtgatgcattgcaacaaatctttcttcttcatctgaccattcaaactgtggaaactctgttacccataaaaacttataatcagacttatcaagaagtcccatctgatcagcaagttctactcttaaagcacctagtacattccatacaatcttatttctgtcagcagcgaataaaagaagatcccctgcttcaccatccatagccttaacaagggcattcatctgatcctctgtcataaactttgcaaatgatgacttatatgaaccatcttcgtgaatcgcaatataagcaagaccttttgcaccatatcccttagcaaaatcaacaagtgcatcaatcttcttacgaggcatgcttccctgtccctttgcgttgattcctcttacagaaccgccattctcaagtgctcccgtaaacactccaaagccacaatccttaacaatatctgatacattctgtaattccataccaaatcttaaatcaggcttatcagaaccaaatctgtccatagcttcctgccatgtcattctctgtattggaagctttacatcaacatcaagaacttccttaaaaaggtatgcaagaagcctttcattaacatcgattacatcatcaacatcaacgaatgataattccatatcaatctgtgtaaattcaggctgtctgtctgctcttaaatcctcatctctgaagcatcttgcaatctgcatatatctgtcatagccagaacacataagcatctgcttaaagagctgtggtgactgtggaagcgcataaaacttacctggatgaatacggcttggtacaagataatctcttgctccctctggtgtagacttggtaagcataggtgtttcaatctctaaaaagccttcatttgcaagaaatgctcttgtaagagttgcaaccttgcttctcataataatattagactggatatcaggtcttctaagatcaagacatctgtacttaagtctgatatcttccttagtctggatattttcctctattgggaatggtggtgtctctgactctgaaagaattcttaatgtcttagcagcaatctcaatgtcacctgtctttaaattctcattaacagcaccgcttctcttaataacttcaccctcaacagcgattacaaattcattacgaagtgtatatgccttgtcgaagccttccttgccaattatattttcatcaaaaagaatctggagaattccacttctgtctcttaaatcaacaaaaataagtgaaccaagatttcttctcttggcaacccaacccattacagtaaccttcttaccaatatcagctgatgaaacctccgtacatctgtgcgatctctttaagccaaccattgactctgccatcttactttacctctttcctgtaattaaatactaatctgcgaaggatagaatatcttcaagactaagattttctaagtctaccttactatttcttattatctcaaatgtttcttcctcgtgaatcattcgctgaaactcaataaatactctcatatcaagattcttaatctcttcaataagaatattcacagccgtatcaatgtcaaatgctttcctatacggccggtcagatatcagcgcagcaaattcatctgtcaccttaagaattcttgcccccaatggaatatctgttcctttaagattatcaggataaccacttccatcgaaacactcatggtgatagagaacaactttcattatattatctgaataatcataatttttcaatacatcaaagctgattttagagtgcattctcatatatttcatctcttcgactgataattcgcccgaatttctgccatataagtattctgataatttaagttttccaatatcatgcatcattccggcaatcttgagttcataacattcccgttcatcaagcttaagtctcttagcaagcccatatgtaaggttagcaacaagaatcccatgttctataccactcttatagtcattaaaaatatattgcaaatgttcattctcattaatgtccgtactatgtcccattagtaatctccctgctgccagtataatatttattaacaaattcattagcaggaagtggtctgtcaaaataaaatccctgtataacatcacaaccataagaaacaactgtatcgagctcctctttagtctcaactccctcaaatacaagttcatattctaccatcttaagcatctcaatcagtgactttataacctgtcttcctttattgttctttaatgacctgctcgcaaatactctgtcaaatttaataatatcagcaggaatattggcaatctggttaagtgatgaatatcccgagccaaaatcatcaacattaatcttaaatccctttacccttaatgcattaataacatcaatcatagcatccagtgcatcaataaatgtcgtttcaagtatctcaagttcaataagtgctgaatcaatctgatacttatcctgcaactgaagcatatattttaacaaatcttcacttgtaaatctctgccttgatatattaaccgagacaggaacaggcttaattcccttatcaatgcattgtctctggaaagcaaaggttttatcaagcataatatcatcaagctttccaatcattcctgtatgttcaagcaccggaacaaatctggctggtgaaacaagctcacctgctcttgtcttcattcttacaagtgcctctgcacctgcaacacaattatgcgatactgatatcttaggctgaaggaaaatttctattctttcttcctcacacgctctcacaaattcattagacatatccatatgttcaagatattcattgcaattatccgctgaatatacacaacacggaatatcaaatcttccttttgttgatttctttgcaagattagcacggtcaactgccatacgtacatcaagtgacggatcgtcataaaaatacaatccaacataaacatgctgatacacaagcggatatctttctgacaattctttctcaaaaatgcgattctttcttgcaatatatcccaccacatcttcattcgtcatattatcaactttataagcacccctgaactggtcaaacccgattccgtgtgaagcaaggcacaatggttcattaataaaataaaagtctgcaatatcctgcataaccttgtcgccttcatccatgccgtaaaaatcattaatatacttaaaattacttatatccagagctaatagaacaactctgtgttcattagtgttcacaatctcacgcactttattgttaaacacatcatgccctgccattccaagataacagcctcccataacgattccactcctcatatacatccgtactttcaatataatagaattatatcacaataccaatagcaaatccacctgttattaatatatataattcaaatcactttaaaatcaattattaacgccatgatgtgacattggtgtggttgatgtcataggtaaaaatgtatacccttccgataacccccactgtattatctgctcaactgcatcaacactgaaattctttatatcatgctgtaaaactactgatacattattacttttaattccttctataacattagccacaacctgtgatgtgcttgttgttccacctgcatctccactagaaacattccagtcacaatatctgaatccacgttcctcaacagcacatacaagctggctcattatgccatagcagtatttcttacttattgtgttactagaaccacctggaaatcttacaagatctgctgcttttccagtctgtgcagttataatactattcatctcgtcaaaatctgcaaaatatgcatctacactctgatatatctttgcataatcatgtgatgctgaatgtattgcaacagtatgtccccgctgtgcttcttgtgcaataagattctgataatccggttttccattagtaacaaaaaatgttgccttaacattatatctgtcaagaatatcaagcagcttttctgtatatggtccgggaccatcatcaaaagtcagataaacaaccttatcacccggattaactgcatcatctgacattggtgcaactaccttcacagttctttgcacttcagattcattaccacaattatcagatacattgtatgttactgtatattttcctgcattagctgtatcaacattcccagatactgataccttatcagttacatctccatcacatatatccacagctgtataccccggttcattatatgtatctcccatcctgatataatacacctcaccgccggtaagtgatatctgtggagctatagtatcttctacatgtataacacgttctgtaaatgcttcattaccagaagaatctttaactgaatatacaattgtagtatcaccttttgtatatgtatcaacctccgcagaagtatccactttatctgtaatatcaccatcataattatcaactgcagaaaatcctgcttcttcataattacttccggcttctatggtaatctctgtatctcctgaaagactaataacaggtgcctgagtatccacaacttttactgctacttttctagaaatatgtttcttcttttttgacgcaacaatcttaatgtcatactttccaagctttgtgacatcaacacttccctcaatctctatatctgtcttattatctttctttccaagcacattcttcttaatagtttcattaatatccgcttcatcatcagtacttccatactcaacaactaaagtatcagggcatgacaccacaagactgttctccttaacagacctgatgataaatattatcaccagcaccataagaactgtaacagaacctgccattaaatatttaacccatctattattcataaaacataccaactttctcatttgaacataatattgtatgggtattatacttctttaatgcataataagccagtagaaacattaataaaattaaactatttctataattcttcccatttttgcattagttctgtgagatattgatataacagtcctgttcttgcttaccctgtttaatgcatcaagcacatttttctcagtatcagcatcaagattagctgttatctcatctagcagaagcagttcaggctttgctgctgcagcccttgcaattgacaataactgccactgtccctgtgagaaatcttctggcttgcatatagtatcatatccattgtcaagttccataattgcatcatgaatacctgctgccttagctgcttcaattacatcttcatcagtaattgatacatcatacagtgttatctggtctttgacagttcctggaaccatatgaaaagtctgctcaacatatccatatattctcctcttttcactatccggaatagccgtagccttctgacctgcaattgatacgcttcctttatccggctcgtaaagcccaagaaggagcttgaatattgtactctttcctgtacctgttcttcccgacagagtaacctgctcgccctccttaacagaaaaacttaagttctccacaacatttttatcatcatatgcaaatgttacattattgaaatcgacaatcacatcactgtcagcttccatggctgtattctctgcaatgtatgaatccttgttaactgataattcatccatctcgaaaaattcatttattctatgtactccggctattgctgactgtatagtctgaatctccataccaaggctctcaacaggagcaaatatctgtgaaatataattaattaccgcaactgctgtacctgctgacatgccaaaaaatgcaagcactgtctggttacctgatgctgaaaaaagcattaccacagcaacaacaattgcattgagaataagaattacaggtgaatatactgcatcatagaaattagttttctcaactgctgcgtaactttcacatatatattcatcgtatctttctgccatataattttccttgccaagtgtatgtattgttcttatgttgtgaagagtttccggcacatgtcctgatgctcttcctacagctcttctgttctcaatctgtgctgccagcatattcttctgtacaattcttgtgaatacgaacaggaatggaagaataacaagaagcacaatggcaagtcccttattcttaaaccatataacagcaactatacttattatcttacaggcatcagcaaacatactgacaattcctgatgtaaacagattctcaactgtatcagcatcaccaacaaatcttgaaacaacagttccaggttcctgacttgtaagaccacttgttgtaagacagctgtacttatacatcaacgcacttcttaatgagtgtgtaatcttttgtccgaatactgtaagaaaagtctctcttgcgctctccataagacctgttataagaagaaatccgaaatacataataatcatataaaatgccggcattgtatctgatgtaattgtatcaataatctttgcaagaataagtggtggaaacagtgccattacaattgcgccaacaacagtaattacaatccctgctgtaagcagccacttttcttttattgtgttcaatataaccctgccaacacttttattcttcatcagatgcgcctcccttctgttcattataaagaaccgcatactgtgggcatttattcataatctcatcatgtgtaccggctatggtttttccgttctctatccatataaccttatccatctgtgggaacagatataatctgtgtgaaataagaatcacaatacaatccttggtgtattctttaagattagcaaatatctctctttcagtgtccttatcaagtgctgaaaatggatcatctaatataattaacggcttcttatggcagagtgttctggcaagtgcaagtctctgtgcctgtcctcctgacagtctcacacctgtattcccaacataagtgtcctgtccgttttccatatcatttacttctttgtcaaagcacactgccttaagaagcttagccacatcctcatcatcacccataagaatattgtttctaattgtatcattaaacaattcaggatcatgtcccagatatgctgcaagtcctgcctttttcgcatcatcaagttctgatagttcattgcctgcaatcttaatgctccccttatatggatattcacataaaaacacctttccaagagttgacttgccacatgcaacagaacccgttactccgattatgtcacctttttctgcttcaaatgttacattttcgaatatatcatggcctcccggataagcaaatgtaagtccttttacttcaagtgagtcacactttacactgttatccgcatcttcataattttcatgcttcataagcggtttaattctcttccatgacacctgtgccttatgtactgcattaaacagctttgctgcatgtgaggacttcttagaaagctttgcaaagcatgatacatatgtagctaaaatagcaatatcccattctttccagcctgttcccagaacatttctgcttccaaaatataatataaatataactccggcaagtgctataactttgtatatcggaggaaatgctgttccccatatattagcccttactgccgacttttcataggctgtaagattatcttcatacgcctgttttctttcctgctcacagccatatacacgatatgtaaccgcattttctgctctgtcaagcgttgcctcactaagccttcctgactgtaccttatattctgcgcctgtcttctgtacaacagccttcatcttttctgcaataatataagatatcggcgggaatatcatacatataagtccaagtctccagtcatagaaaagaagcattccagcatatgctgccagcgcaacacccgtatcaaatatctcagttgtgaactttctcatcccttcagcacaatcatcaacatccaggatagccttggtaagaatatctcccgctccttcttcctgtaactgtggtcttctcttatgtacaaggctgttatacaaaacctctttcatgttcttattaacattattagcgaatcttcttacatagaatctcttgatataccttgatatctgcactactgcaattgcaatcacataacatattacaagaataagcatatctgtaaatgttgattttccaccaagtatattaacaagacagcctgtcattcttccttcaaaccacggacctgcaagaagtccgagattgtatataaggccagatatcgttattatcagaagtatattccactgggatttaaaataatatgacaccctgtcggtcatgatattattccttcctgtgttactcatcttcatcatcctctgtttatcttcgttatctttcttttaaagtcaattacattaacacattattgtgacagtccgttactaatatatatattttttacattttcaagtgcttccttaaacagcacattattaaactgtgcattatctatatctttaaccacctgttctgctttctcattttctccattattcacatacaccctgtaatcaacagcttttttatatgcaatggcaaatgtatagtagtcctgcgtatctttatcaatatctttgcctatgcctgtgttatattctgtcttttcaagaagcccttcataattattttctataaaatcattataaagactgtcttcttcatagcccgacattcttcctttactcctgaatacatcacctgatatatctgaaacacatgggattataataataatcataattgcacacagtacataagccagaagtgatatattaaattttttcttttttctcattcaaagctcctccttgtaatgagtgtaagtatatctgcctgtgacatatcaggaagtccggctatgtcctcatctgtcagattgcagtatgcctttaacagttcatgtgatttttcatatatatcatttatatacttaatactttctttcgatacactatgatatgataaatttaaacgtctgctgacaatatcttccatgtccgcaacagcccttgaaatcgtattcatatattcgtcgccataatatgatgaattattcctttccatcatacttattataccttttcttatatacacataatcacctgcgacattgtaaaaatcattccatgcgtatttatcatcattatcctttattgaacaatctcccacataatccatactgtacagagttgcatagtctcctgcttctaacagaagctttagttttgtctggatttcatcactatgggatgaataatatttctgctgattttttcttgctatatcatatccaatcattgaatttttaccaataatagccaatgtaagtgcagtcattgttataacaagagctgttattggtgcaatataattcacaaaccatttgctgttaccaattactttggaacgtgtgctgttaaactttttattatattgttccatatcatcaatatgcttcttaaattccacatttggcgagccgcaattaggacagaacttctgattcatctgtataggtgcgccgcaattattacatttcatcagttgttccctccctcattatattttttataaaatgactcttcgtagctctttccaagcttgtaatcataatagccattctgatacaattcattaagcatatcattaatttctttgtccgtcgcctttgcaacattcttaagataattctgtgcttctgcaacccagccgtccacagtttctttttcttctgccgtacagccctcatacctacggtaattatatccgtttttattattaatgaaatatatcatgtcaagtgactcttcaaagcctgttccaaactgataatcactcagtttttcgcctttatgaaccataatgtagatgtctgccacccttttataataataatcataaatattaataaaattgtaatgactccacttttccaaaacacttgaactgcccttataactatctgtcagttctgaaatgcctgcatagtcccgcttttcatataataaattaagttcacctatattattattgtaccaatctaatgactggtgtatctctttcctgttgtgtgaagaattatacatgctcttatatgaaccatatccaaacatacttccggcaagaactgctgccgctattgccgcacatactatacctacacttttcattgtactttttatgatgtattttctggtattcttatccagcttctccattccttcattcagattgtacaggtctttcatgtacttctgttcagaattctcatactgcatagcaccacaatatgggcatgcagtctcgttatctcctatatctgctccacaattactacatatcatagctatccccttttatcagttattgtattatgcagagactcctttatcctgcataatcatcttttataatactgtgcaattgtaccaactacaacatccatctgtaaaggttttgacagatgagcattcattccggcttcaacacattttctggcatcctcctcaaatgcattggctgtcattgcaattatcggaatctccacagcatcaggtctttccatatctcttatagcttttgttgcggcaattccgtcaagctttggcatcataatatccataagaatcacatcatatgtatgtggtgcacaccttgtaaattccctgacagcctgctcaccatcactgacaacagtaacattagcgccttcatccaccagaagagtctgtgcaatctcagcattaagttcattatcctctgctagcagaatcttaattcccgaaatatcattactgctcttttccttatcgaccttcgtttcttcaactttgcttgcaatctcgaaaggaattctgattacaaatgttgagccttccccttccttgcttgtgacactaattgttccattcattttgtcaaccagactcttaacaatagccataccaagtcctgttccctgataaacacttctggcatctgtcttttcctgtacaaatggttcaaatatatgttcaagaaattcttcactcatgccaattcccgtatcagtaacagtccattcatatgtaacaattccatcctgtgttccaatacatttaaaatatgttgaaaccattcctcctgctttattatatttgatgcagttagcgtatatatttagaaataactggcgtaaatgcagaggacttccgtatacatatggatacataacttttcctgccaccttgtcatacttaagattgacacctgaatctgaggcacgctgttcaactatagtaataatatcctttgcaagcttgttaagatccacaatctctcttgaaagctcaatctggccatcctctaacttactcatctggagaatgtcattaataagtgataaaagatgattagcagctattgacattttctttctgttagtattaatcatatctgtatcttctttatggctctcatcaattcttaacaatccgattatgccattaagcggcgtccttatatcatgtgtcattcttgataagaaatcagtcttggcagcattagccttttcctctcggcgtactgcctcctgtagctgttcatttttttcctgcagtgtctttgcatactgctgctgcatttcatactgttcacgctcatatccctgaaccgttttccagcgcatcatattaagtacaagtacagcaaacatataggcaacaaatgtatactgcatatttcttggtgttgtcttaaaaacatttctttccggcatataaacatacacataataatctctcccacgttccataagaccataattatgtgaaccccaccttctgttactatcagcatgtactattttgccacttgcaccagtctcctttatcttcttaataacattatatttatcaatatcttcaccaaccatactgtcatcattagacgctattatctgatttccctttgtaacaacaatctttccatcttccctgtcatcataacctgataatatatgtgtaaatgaaagattgtaattattaacatactctgccggtgtgtggtaataaacaacaactatcccacttgaatccgccataccacatgctgcaaggtcaacatatgaaccatcttcacagtcaattcttattgcgtatgttttttcagtattatcaacaacatcaataagtgaagtactgtcaagatattcgttaagctcatctgcaccatattcatctgtatattcctgtgctataagattaccttttgaatccatgattataactgccgtcagataacattcctgcatattctttttgataaattcttctgtaaatatatctttatctgaaaggctgcgctcatatgtgatattatgttttatctgctgcgcactttcaattaccctgagcaggctcttggtttctgacgcaagattaagtcttgtaaagctgttgcactgttcattaatataatgcgcagtatctgaaagtgtttcctgtgtagtttttatatcaacatttacagcaataaaaaacacaatcatcattataaacaggcctgctataatctcaatcggccatattctttttcttttctttctggtaatggtattattttccataactgtccacctccagatatttatcagcatcaggaatatatctgctgattatcttcttctctgtaccatcatttctcatctggttaagaatttctgtaagctgcttctctatcccacggtcatcatttttgtcaaatgctactcccagtcctactgtctctaatggttcgtcaagaatcctgaacttaatattataatcttccatgtactggcgtattgcagtttcatgagctgccagagcatctgcatagcctttgcttaaaaaaggatatataagttctctcttctgcaaagctattaatgaccttatagccgggatacgctcatcagtcttgctaagaaatatcttctcaggtcttgttgtagtctgtactgcaatcgtctttccttccagatcctcaagagaatatatatcactttccatattcacagcaacaacctgacggctggtcatataaggtcctgcccatctgtattcattctccctgccgttcatgctaaagcttccccatgcacaatcaattgttctgtcagcaagaagattcttcttatcttcccagtcaatatatatgaatctggccttgtaacccattcttttaaatgcttccgtagcaagctcaacatcaattccagtagcattgccatctgtatcaacataattatatggcggatagttgtcacttcctatgactatttccggcaatccagcctcattattgtgactgtctgaccattcttttttcccacagccataaaaagaagctgcatatatgcttagcatacatattataatcaaaaagcttttaatcctacgcacttactttccatctcctacatatttataaaatatgttctattataatacaaaaagctgctgattactaatcagactgacagttttcgttcgacataattcgacaatttttttatagtcagttttcatctgaccatattcctgatttattctgaccttattctggcatgtgacatttttattaaattggatatttctttatgaccagttgtgcaatattatatgtaaaaatcaattcataaaattcattttcaaggaggtcagttatgacaacaaattcacaatatgaattaaacaaaggacttgcacagatgttaaagggtggcgtaatcatggatgttactactcctgagcaggctaagattgcagaggctgctggtgcatgtgctgttatggcacttgagagaatccctgccgatatcagggctgcaggtggtgtttcgcgtatgagcgaccctaagatgattaaaggtattcaggatgctgtaagtattcctgttatggcaaaatgccgtattggtcatttcgttgaagcacagattttacaggcagttgagatcgactatattgatgaatctgaagtattatctcctgctgatgatatatatcatattgataaaacccagttcaaagtacctttcgtatgtggtgcaagagatttaggagaagcattaagaagaatcaatgaaggtgcttccatgataagaacaaaaggtgaacctggtacgggggatgttgttcaggctgtacgacacatgagaaagatgaattctgaaatcagaaaaataacatctatgcaaaaggacgagcttttcgaggaagctaaacagttacaggttccatatgaccttgtcctctatgtacatgataatggaaagcttcctgtagtaaactttgctgccggaggtgttgctactcctgcagatgccgctcttatgatgcagttaggtgctgaaggtgtatttgtaggttctggtatattcaagtctggaaatcctgctaagagagcttctgccatagttcaggctgtcactaactacacagatgctgcacttattgctaaattatcagaagatttgggcgaagccatggttggtattaatcctagcgaaatacagataatcatggaagaaagaggcagataatatgaaaataggcgtacttgctgtgcagggtgcattcattgagcacgaacatattattgaaaaaatcggacatgaagtagttgaaatacgtcaaagaaaagaccttgatggcattgacggaattatccttccgggcggtgaaagcactgttcagggacagcttctaagaaagctggatatgcttgctactattaagtctttaatagcagatggtcttccaacacttgcaacctgtgccggtctgattcttttagccggacacattgacaatgacgacagtgtacatattggaactctgcctgtcactgtaaaaagaaatgcatatggaagacagttaggcagctttgtaagaactgctcctatgaagggctttgatgaatttccaatgatatttatccgtgcgccatacatttcatcaattaaggataacgttgatgttcttgcagctgttaatgacagaattgttgctgttcaatataataaccagattggtcttgcatttcaccctgaactttcaggtgacactagaattcatgagtattttatatcactctgtgaaaaataatctgaatcataatatttaattgacacatttacacatatatattagtataatatcaataagagggagtagttagcatcgtatccggtgcaatagtaatcgtcatcacgctgaacagccggttattattacaattaacgagacttttatcaattcatttttgatgcgataaaggtctctttttatattattccattcctttatcgcaagaaaggagcttattatggaatatttgttgctactcatcggtttcgtgctattaataaaaggcgcggatttcttcgtggagggaagttcttcccttgccaaaatccttaaagtaccaagcgttatcatcggacttaccattgttgcaatggggaccagtgcccctgaagcatctgttagtattaacgctgccctttctggcagtaatgacattgcaatcagcaatgttgttggttctaacatatttaatggtcttgtcgttgtaggtatctgtgcatttatcgcaggattttctactaaccgtgacattctcaagcgtgatatgcctgttaatatcataataactgctattctttgctttatgtttattgatggcagactttcaagaattgaaggcattattctccttgccggaatggcagcttacatcacatgcatgataatatcagcacttaaaaacagggaagaagctgaggattgtaaaataatgcctctgcctaagagtcttctttatattgccggtggtcttatagcagtaatattcggtggtaatcttgttgtagataaagcctgtatcatagctgccaactttggtgtaagccagaatttcataggtcttacaatagtcgcaatcggaacatccctgcctgagcttgtaacttctatagttgccacaaggaaaggtgacagcggactcgcacttggcaatgcaatcggctctaacatatttaatatattatttatcttaggaatgtctgctgcgatacagcctcttcacgttctttctgaatcacttattgactgtatcatacttcttgccagtggaattgtattatttctcttcgcatttaccaagaagacaatgagcagatgggaaggtgctgcatgtattcttatgtatgtgggatatacggcatatctttttgtacgctaaaggtattttaaattaattatgcataaataaatgcaccgtaagtatatctctaacatacttacggtgcatttgtgttaaatattatgttcttttcttcttttaacaatcagccacacaaccattaacacaactcctgcagcactaactaaagccccctgccacagatacggatgactcatcttaataacagttgttcccttattcacatacataagattattcctatgtgttatatccgatgaagagctgaatatatcgtgatatgcaagtgttgtattaacattatcattattagatgtaattgtaatctcattgtttccgtattccacctttaaaggaactatctttctgtctggaagttcctctgatgatataccactcatattactaagcaactgtccaacagatacgtcatcagtcagactatagaaatatgtaagattaaggccagtcattataatattatcgttattaacagtcccataaaaatcgagattcaatccattatcataaaaagttccccacacagtatcaagtccatcaatatacactgtattccatgtagtatgtccctgaggaaacatatctggatatatcgttccaattcttgtatccatatccggatatccgttgtgaaatgttatcaaactgcatgttacgccaaggaaattctgactatgtgtacgcttatcctttggtatgccatcggcatatataatcaccttaactcctgctctgcttagacgcagtacaaggtcttctgctgtttctttatcatcatatgtaaaaccattcaggaacacctctttatatcccgacagttcttcatatgtgtaatcattaagattagcagaatctgctgttttaactgcagggaactgcattgatattgctgctgccccagagcctatcgcaactgccctgtaactgctgataactccccagttgtcaggtgtttcaatatggtaaagaatgtaatcactgttttgttccactttcttatatccaaccgtattcgcagctgcttcaagatcatataaagaattattatattgtttaagcaatgattttttcacaagtacagaatcatcccccagttctaagcatctgtcgaagacatacaggaaatctccctgtgcaaatgctttgttaagattaactatattagcagatgtattagcagcttctcttcctgcaccaaatgtagcatcaaccggattgccataatcagaaaccagccatgaaccggttgcccccagtatgctctcgtccatcagggcaagtctctgctttgtgactgcctgagcacttgaaataagagtactgtcctgtcttgctgccattctttcctgaacagatatatcattatgttcaccaacaataaggcttaaagatggtatagtatctaccaccagtaaaacgcaaagcatcaagaccagagtcttctttaacctgtcccacataagaaagctcataagaatcatacataatgcaatggatatgaatcttaacatccataaatactggcttcctggcaagtgtttcaaaacggcatatgctgatttagttgtcataagcagtataatgaatcctgttacaaagcctgttctcgatttcttatatccaaataaaatgccaaatacaataacaaccaaagctgcaaatccgaaataaaaatattcaaaacctcttgttaatctttcaaaaggattaattgttatccataaattctggaagaaattagccatattttcagaattatcaagtgaagttattccacctcttaaggacgcaaccagccatattccaagcagcataaatccaaaaatcattgatattacaacatcaagtactgccttctttctgcccttctgtataatataaacaattccatatataatcacagctatagccaccattccagcatatccaagatgacacaattccataagtaaaaatgtaaataccataaacggtatgtatcttaatttatgattgtataaatatttatatacagaatatatgaataccggcaaaaatatcatactgagacttctggcaagatttccttctataaatattgcacacagattattaggcataaagaaccagaggagtccgataaatgctcccagataaggtctgttaaagcctcttccgataaatggccatacacatgcgcctaaaaaacacactcctcctatataaaaaagatatgcaccaaactggcttccacccgcaagatactgacaaaacgccataacataagcaggaaatggagaccaataccttaaaatctccacgccgttataccatgcaggatcatataaaggataccagttgcccgatttaatcgcattatatacataatctcctctgtagacatgatacatagtatctgaacctgaaggatatattccacttgtctttaccagccagacaacaaaacatgctgttgcaaaatacacgaatggcataagaaacagcaggtaaattgctttatttttctttttcaacttcttctccaatccgtcttaacaacatcactgcttaacaatatcgtccagcactgcgtccataacctctgatattatcttttcatcagctttcttattcaatattgaattacgttcctgctccgctatatttacaatgtagcttcttgtaggagtttcactagcctcaactcttgtgagcatgccacctgtcttatatataatcttaaaaaattcttctgcaaaataatcagtaacattctcaagtgtaggcatcattgaatcaaacggctctgcttcattaagaatcttattctgatactgttcaaggaactgcgaaattccatgttcaaatatattgaattcaacaaataaatttcttgaaaacttaatatccagtgcaaactcccatgtatgtgggtgagtttcacctttaacctcattaatgataatataatgtctcatattaaggtaaaatttcagtctgtattccctgtacatattaactgccataattccgcctcccttatattacctgtccattctatctgacttcatacttaactcttaacttatctgcatccgctttgctcttaatagtaattgcatacattatctgcattgaattttccattaaaagctgaaggctctgcttagaatgctttctgttcattccaacaaatataagaacaatatcattatcttcatatgtaaatctcaaaacatttttatcaagaatataattagctcttgctataaactttgcccgttctttattatcagcacatgcaatatgcataaatgttacgggataaatatctcttgccactaatttatcaagaaaaggcatgattgccgtattatcccagacattattgcgcgtatcatgcaaatccttctctaaaagtttcttattcatcttagaaaccatactgttaagctccgcaaccgtcttatcagattcactaatcgacttctgcatccgtcttagcttatgtgcaagcagcatagctgttattataagcacaaaaagcagaatcaccacataagtctccatctgaatcttaatctgcatataactgttattatccataattgcattcctgcctgtaagcaggcacagcttatatgactggttcttatattcaaatgtaacacctgatgctacataactattcccatcaatttctatgaaatcatgagtaactctgttattctgaagattattaagaaatttcgtggcactctctgactcataatatgtagctgtggtaacacctttatacctgttagtttcaagaacatcttttacaaaaaggattgactgattcttagaaaatgtccagtatttattagaagatgaattcatcgtcccaagaatatcattaataatctgttcatcatcacgattgcttttaagattaatctggtctaaaacaagctgcacataagcgtcctgctgtgttgcacacacctcaaggactccttcttcgtacttattaatccttgtatatgcaaatactccggcaataaccgagaaacatattacataaatagttgtgataacaagcacattttttggctttttattcttcttaacacgcttcttattaagcttcttttccatgttcttccctctgattattgttattattatcttctacaacatcataattaagtgcatttcttactttctttattgcattaacaggcttactgaaatcacttttaaccacatctgcaaatgccctgcattcctctgacagattcattgttttccatgaactgtcagtttcaatactgttaataattcctgcaagtcttataaagaagacagcaaaattaaaaaatggcagaaacagtatgcaccaccagtgcctcatgtaatatcttcttatatccctattaattcttaggaaatatgctacaacaataaaatacagatatccgataagcgtatataaaccaaatattattgctgtagatagaataaccgttttcccagaataacccacaacaatcaggcatataagtgccagataccatataagtcttggaaatgcaaatgtatggtcatacaaaagagttttgacacttatattagtaaaaaggttctttacattgaaagacttgtccataaacatcttggatacttcaaggcttcctctctgccatctctgtctctgtgtatatagtttattaacattttcaatcggatcaacaaaaaacagtgcatcctcacacacttcaacccgttctttctgaagatacctcatctgaaatgtaatatgtgtatcctcacagatagtatcagtattgtacatccatgatttcagaacagctgattttctgaaagctgaaaatgcacctgacaatgtatacacggagttaagctctgatgcataacttcttcccgcaaggaaagcctgtgcatattccataaactcaagttcacggagcagtcttgatggtcctgctttgtattttttaatctgttcaggcactgtaagaatagatcctgtcatacagttaatagccgtatcattctcaaatcttgtaatcatatttacaagtgcattcttctcaagcattccatcactatccagattgataatgtactttccatcactgttataaagtgccagattaagtgctcttgactttccctgttcagaattcatccactgcatcagaagttctggaaattcctgctgacactgtgcatatatatcaaaactgttatcttttcctttattattaaccagaaaaattcttatcctgtcattcggataagtactgtcattaatcgatctgatacatccatatagtgtatctgccgaattatatactggtattataagcgtaatctctggataaacctcaagttcctttttatggattttatttctcagattccttcttataagaagaaaaacacttcctaacgcaggaacaatttccataataaacggtataattatccagccgccccagaaaagaaatgaattaagaattatttttaccatatgagaagtttcctactttcatcttaacaatctgtggtttcgtaaatacataaaaatacagatacacactgagtacatagaagaatattcttcctataaatgtatgaaatacataatatgcattcatgcctaaaaaatgtaccgcaagacatatcattactattcttaaaacattacataacataatgtaacagaagccaccaattcctatcatcagcttctcactccagttatacacattaaagaatattagtaatgacagaaatgccatgatttcaatgattcccgaacactcaaaatcaataagcagtgtcattgacgatgcacccgtatgtataaatataattccgtatttaaagtatgctgtaaatgcacctgttatatctcccacaatacctgccattgctgcaacgcatcttgcaagaggcattgtaagcaatggctgtaccgtcatcatcataattacaaacagtccgagacttccccacatgaagctccatgcatgaagctttgctctcttcgttacagaaagtatatacagccatattattataattgcaattactataataggattcattccgcttatacctgtatgctgcctttctttttcttatatacaactactccacatgttccagctatacatatgaaaagtccaagccatgctccagatgatgcacctgctgtattaatccattcctgtcccagtctaccaaactgtgcactaatctgcttgaaatcacttacatcacagccaagtttctgagcaaccttgtcaagatcaaaataaaactcacattcatccctgttgcttccaactgtaactatcatctttccataacatatatctgcatcattaagttcattaatattcttagatgttccccatgcacttgtgtcaaacatatagaattcatatgttccatcactaagtccgtcacgtttagggttccagttaatatttccctgttcgtcaactgttacaaatcttggatatagtacctgattatagctgtcattaaacttaaatgtcactgcctgtgtaaactctcctccagcttcattaagatgctccggcataactgtatacacatgtccaagaacagtacttccattactgaataatgctcccgcagaatccaccatattatgatgtgttccggctgtagaatactgaatagttgtgtgtggataatattcccagtcaccatacaatccatcatacctgatatcgtatattatcttatcatccgaagatccatcatctttaatattagcagttcctgatataaaaggctcggatctgtataatccaaatgatattgtcttgttataagccggcagggcactcttaggaactgctatctcccactgattaccaacatgcctgcagtcaacaccgtctacaccattaacatatcctttgctgtcaagctgaaaaacaagttcgtaacccagatcagtagttatcgaatacctgccattactatgagttccggctcctgaagcatcaccgccagttccatccttcacatacacatatacataatcaccgtcaaacatcatagctgtcttagatatacattcattatgtgcatcattaggacatactgcatcatacttcttaacagcatcccagtcagcaaactcaccatctataacaatgccattatacacagcttctgtatcatctttttcaaccttctgtccgtctaatacttcaatatccttaatatctacagttgttcctgcaaatgtaatcttaaaatccgaattggcaaaaaaatcaaaaggaatagctgtctcaaccacataaggtccggctgtattaccatgtgcattattaacagttacagtctccgaattctctatatccccataccatgaattctttgcctgtgcactgtctttccatccagtaaactgaatcttatctgatattcccgttgttccgtcagcataagtaatactcacaggattacttcccatatagctgtagtcccattcggtctgaacagttccttcatacataaaataaagctttgaataatctgatgaaaccgctgctttccacagcttaacaccagcagcatctgctgttcttgatgtaatatcatcccagtcatctgtatcagaatcgaccacaatattacttcccttaacaactggatttcccttcaaagcagatacatcaacactccccaaaacatttgatagattagcagtatatgtgttccttatctgtcctgcatatactgataccggcattgaaacaagcaacgctgtcataccagctaatgcagtaattctcttataattgtgtttcatggcaacttcctcccgtctttagcaattataataaatagccgcatccatttaatcattatcgttcaaatgtattcaaaattatccatatcattagtatattaaatcttcttatgtacattttaattcatcggcatatctgtgtcaattatttaacagatttttcacaaatgtattgaatgtctggggtcggctggctcaatggcctgtcgtctggctcaatggcctgtcgttcctataaattttattttttgcttcttttataggcatatttcctaaaaaaatcacctaaactaataaaagcaactcaaaaatacccataaaacaacatttacatgctatcttatgggtatttcataataaaatccacttataatatcaaaaatcgctgaaattcaacctataaatctatcatcaatacgactacctataggtatcacgtcaaatcctgccttatacaaacagtttattgatgaccatcggtttatctccggcaggcagtttatcgatgacaggcggcttatcagccatgaagtccagctgactgacgaatcatatcctcaacaacaatatcgtatatctccccgatagtactgcaatactcaagtaccttccaaggctcattagtatggaaatgaatcttgataagatcctcatcacctgctgcaatcaggcagtttccttcaaaatgctctgtaatataatctgcaataacgtcctcatctaaatcttcatctcttctgtcaataagaagctgtgtatcataacgatatgcaaactgatcatcttcaacatctacactatgtatatctgacataaaacattcctccataatctgtctttatgtgtggcagccaatttgtttcacctgactaacccggcacattatctcacatatcagcaataacttcaagtatcagaatattcttctgataaaattgtataatccattattccatacactgacctcatgcgctcccggtcttatatagaaaatgtggttaattccatgacttgacatataatctgaatagttaatagcagattccttgcagtaaggatcactgtcgccagttacaataagagtaaccaaaggctgctgccctccatccttaacaagttcaggcagaagaaatcctctgtttccataaactctttctccacttcctgtatcaaccactcctcctaccggggcaaatgcacctacatatccaaacacatcaggatgtgcaaaacacaggaaaagcgattctcttccgccaagtgaatatcctgctattgcagtattctctcttcccgttctggtagaataatgctcgttaatatatggaatcaatgcattaataacatcatactcacacgcatcatattttgctgtaagttcagagaaatcatagtctgactcctgaccaccatcagcatctgtgaatacagtaaagctcaccataatcacaggattcctgttataatcatcaactgcattctgtgcaacatacaaagccccaattctgttatattcagaataacttccgctcattccatgcaaaagatacacaaccggataacgctgtgactcatcataatctctcggaagatatacacaagccttgcgttcacttccggttgtcggtgaataatagcttatctcatcaacatttccatatgttacccctggtcgttcatcattataatcatctggtgtgtcataatctgccgtcacttcattaggcaccgttctgctcttacagcccgacaatcctgtcactgtaaatgctgctaccagtgccattaacacagaaaccgccttgtatatatttcttgaaatcataatccggtacctcttacaaaccttcttacaatctctaatccaccaaccggtgcacagaatttctgattatgctttctgcactcttcatagacatattctaggttgaaccactcaacgccgtccaattcttccttctgcaatgtaagttcatctatattgactggctttgtgtatacatagacaaatgcaatctcactgtccttaaacatcttgccataaaattctttttcatattggattacaaatgtatcaacaaactgtaaatcatcaacagaagccttaattccaagttcctcatgcagttctcttatagcagattcctccggttcgtcaccggcctgaatatgtcccgccgaagaagtatcatatcttccaggaaatgagtccttattcatagcccttttctgcagcagtacctctgctccctcatcagactttcttacaatccacacatgcgccgttctatgcctgattccctcactatgtgcagtcttacgctcaacagtctcgcctgttggttttccattctcatcaacgatatcaagtaattccatgtcaaatccgtactccatcataataaaaaagccaccagctatcgcgagttctacgggaaaaataaagtgattggacctagactccgatagtaccgctttcgcagcacccctcccaggactggtggcttacatattatattactatgtgattgaaaattccatagggtataatatcacattttaaaaaaccgcactaagcaggaagaacaatacatatattgcaaatgtttctccaactgtatataatgcggtctttacccatacattaggcttctccacatgctgtacagttccagcatttgcagtaatctttttctgatattccttaataatcatgattcccacaaccgcacctataacgcaagcaattatgtacaaataatatgaaaacatcggttttgcctgaacatagccaccatattcgtcgttcattgtattagtaataacaaaatatagacttatcaacgcaagtgcagatgagccaaatgcagcaactgcctccttaccccagccttttccttcattcttgaccatacatatgcaaaatgctgaaataggcgcaagcaggaatacaatcattcctacagtgccattttcttcttcatctgagtcataataatcataatagctgtcctgagttgtatcttccgtttcaaatgttaaatcagccatacttacacttccaacattaacccctgcacatgacactgtaaacataggaaaaaagaagcatgctgcagccactattgcagcaatcttcattataagtctgcccttaatcttatgtcctgcaatattaattgatacatcttcttctacaggctgtccggctgctgcctgaaccggctgctgtggcataacgtattcataattatatttctgtccacctgcattaacataactgttatctggtttattattgccaaccgcctcattaaaatcaacaatactctgaaaacattattgcgactggttttacttttctttttacaatctcaccgtctttggtacgtttgtaatccatctcaagataacggctctcatgtattgcctgtccgatgtcccacattttatcaagaaattctgacttatgcgtaagttcaacataatggaattcttcattacttatcaggtcttctacaagttcctgactgtcctttggtacacaacaatcaatcatccggtcaagtatgcttgtcatctctttcttggtaaacgccctgctgtccagtaatatcttgcatatagcaagtatctcgctgtttgtcagcttcgttttatgtatctgacttagataatgtccgcctttcttcttatcgtattcaattgtgttgattactccgcttttctccgcttctttttcaaagaaattattaattgcacttatatctctctggattgacctcgcagacacgctatattttgcagcctcagcttctttatctattacttccccctccataagacgctgataaaggcttagtactcggcttactttatcattgtagtcattttccatatgtagttctcctcgtttcttctaataagataatacattgcaatatttcacgatttaatctattaacattttagcactttattgtaataaatgctaatacaaaataaaatttttgtgtatttttatgcaatatttttacgaattaatattttaattattgtgcattatacaaataatgaaaatatattaaatcccgaaaacacataaataatataaagcaccattacaagcatgcaaaacatatatatacctgccagtatcggatatcctatgcttctcaactttataagccggcattcctcataatattcttcataattaacatacggagctttttcctcatctggcagcttgttccacacctgtcttgaattgtacctgatattaaataaatatggtcttttcagatatacataatcactctcgttatcattttcaacattattattgtcgctcatcttatgcctcctcattttgcttctcttttatgtattaatgataacaaacaggttggacattatatgtcttagtgtcatattttgtctttttatttttaaaaacttttaattgtctgtggctaattttattttagttgtagataattatatcatcagccaatcaatattacaattatatgtattgtatttatcatctttatagtgagggatttcatgaaggatattgattttgaaagtattggaaagaagttaaaagaaatacgcttatctaaagggttgccacaagacgctgttgccagtgccgctgaggtcaacacttctcatataagcaatattgaaaataaccgcgtgaaagtctccctgcctacacttatctatatatgtaatgcactaggtgtaactgtagattatgtgttatctggtgaatatactggcgattattcttcaatcgacagggaaatcatgaaagagattcaatctctttctgatgaagaaaaggaacgtgttttaagggttgtgcgtgccctcaagtaatctcacagcatagttaaatcctgccatgaagctttcttttttcgcaacttcagcaactgccatatatttatcacgctcacattcataatcgatccatgttgccagttctttgaactgcatcagctcatgttcaatctgtttttctactaattcatccacatttttcattatatctgtctgacttacaagcatgttatataatccttctaattcattctgcataattattccatcctgtatataatttatggtgttcaagctgcctacataattactcccagcctatttcctttaaataataccagttatgtcagacacttattgtcatattattttattttataaaaaatcaggctttggatttctcctccgcctgatgcatcatccatttatttaatcttcactacatattgagcatccatatattcagcaattgcatttgataataactctgcaaatcttttctgtacatattttacattcgtattatgctcttgttcgttatcatcaggatttctaaaagataaattcaaaatattatcttccacattttctaccctgagtggtttaatccatgtactcatctgtatatcctgaatattatattctgtctgaagaactaataatattgatttccagttattttggatattagcaacaggactatcttctatgctgtccgtatcatattcctcctgcacctcattataatcttcttcctcgtcttcatcttcatcatagtcgtcgctcctcagcttttcctcatagtaatgcatttttgcatttgcaactgctccttcaatattagctttcacattagcccagaaaaatcccataataaatgtctcctttcatctgtacataaatcgactgtaaatacaggttgtttgtatattaagaatagcattcaagtcagacatattgtgtctatacaattttttatgcttgcaaattataaaaaatcaggctttggatttctccgccgcctgattacaactctattaattcgattcaattttatcgctaaacccactaatcagcctttttctcttgccacctcaaactcctgctttatctgtgcaagaagctcaggattaacaagaacatcgcatattgaatcagccattatctttgctgcgtatactatagcattatgcgcggcatcactctttccagctttaaggtaggcttctgaatgtggctgtgcatccttgtctgtgaatgcaattcttatacatgagcctggaacttcatataacacattgccgaaatctgttgaaccagtcctttcgcgtggtggcgcaatcgatggggcattctcatatgctgcatttgccataagcagatcattgaccttatggcacacaaccttgcttttgaatggaaggtctctctgaacctcatatgttgttccagtcataagcgcagcaccttttaaaatgttgtagaatctctctacaacttcatcaaggtatttcgtgctgtatgaacggagtgtatattctgcaacagtaaggtccggaactacatttggaggaccacctgcattacggattgtgtaatgcattcttgtgtcatctttaacatgctctcttaacatctcaattgcatggaatgataataacgctgcatcaagtgcacttcgtccttcttcaggacttattgcagcatggctttttactccgtggaatgttaccacgaaattctcgagtgccatacatttttcatctactgatgtattaggcgagccatgcgacataaatgcaaggtcaagctctttcatataacctttatcaagcataattatcttgccgccaagagtttcttctgccggagttccatacacaacaagtctgcatggataatcctgaaggcagttcttaactgcaatagctgcacctattccggcaggtccctgaagatgatgtccacacgcatgtccgattttttcaagagcgtcatattcaacaagaattccaatcaccgggccgtcacttccattatcccatgttgccctgaatgctgtttcaagtcctgttccacgctctaccacaaatccttctttttcaagataactgcacaatatatcagatgtcttgtactcttccccgcttatctccgcaaggtcgaatatctcatctgccatctggcataaatcttctttatagctgtcaataaccgctccaagctgcttcttaatatcgtctgacataatatctgctcctaatcaattctaatatccaatcattaatgcgcccagcataaacaggcatccaagtgctgtccatataaggaacagtggcatcatgaacttaagccatttgctataaggaatctttgatacagcaagatatcccataagtgatgatgacattggaagtactgagttagagaatccgtctcctaactggaacgcaagtactgatgtctgtcttgatattcctacaaggtctgaaaccggtaccataagtggcattgttactgctgcctgacctgttcctgacacgattacgcagttaataagtgactgacataagaacatgccgacagccttaattgaatctggcataacatttacaatattaacaattccgtacacgatagtatcaagaatattggcatcacttaagattacctcaactgtacgggcaattcctattataagacatcctacgataatgccctttgcaccttctccgaattcccttgcaattctgctaggaccgtaaccgctgataaatccgcatattacacccataaatatgaacagacctgacatttcttcaaagtaccagcccttctttgaaaggccatatataagtattccaaagccaagtgccataacaataagaactgcaatctgtcttaccgtaattgtgtctgttgcattgtcaaatgtgtactcctggtcttcaggaattccatatattacgcttttttcaggatgtgctgcaacctttcttgcatagcagattatgtatgcacttgtagcagcaagaagcacaacaagaatgaatactctgtaagccattcctgagaacaactgcaattctgctatatcctgcgcaactcctacattgaacggattaagtaatccggctgtaaatccaaccgctgcaccgagtgcaatcatcgctgttcctgtaaccttatcaaggcctaagaataacgcaagtgttattccgataggaacgaatatcataacctctgatgacattcccattgtgaatccgaatatagaaaataatatcaaaaatacaggaattacaacatatttgtgcttagaaaatgtcttagataacttcttgcataacgctgtaagtgcacctgttgatgtaattacctgaaaagctccaccgattatcagcataaatgtaattgttgacgctgatttcacaattccggtatagattgctgaaggaatctttaacggattaagcggacttgatgctattctgtgataacttccagcttcaactaaagtcttgcctgttgctgcatctttaaatcttgtaaactcgcctgccggcacaatatatgttgccgctgcagcaataagaataattaccacaagtattacaaatgtatgtggcgttttccattttttctttgcttttgtttccatgaaattttctcccataacaaatttatatttttatacattttaatataaatcatactaaaaataaaattgtatgtttttatcgaaagtataaatctaatttatagtttcgattgattgatacattttaattatgtataattattacattattattgaaacatgcactattttagaaagggaattcatatgattactgaaaaagacatgcaatatgttcttacaattgctaattacggaaatcttaccaaggccgccaatgctctgttcttgtcgcagccggctttgagcatacatcttaagcagcttgaaacttcacttggcatacagctttttgaaagaaaaggccgccgcatgattcttacatatgcaggcgaagaattcgtgaaatctgccagagatattactatgaaatgctttgaacttgaggaccgcatgattgatattggcaaaaatgtggctgttaaactccgcattggttacatggtacgtcaggttgagtctctctttccttctgttatgactgcatttaacagactgtatccacagtcagttgtatatgccattgacggacatctctcagaccatgaagagcagcttcttgccggtgaccttgatatgttctttggatataacagcgtgagcaacaccagactttcctatgaaaccatatatgaagactgtcttgttgccattcttcccaaaagccaccctgctgtatctttcgcagagtctaaagaatcatgcatctatccatggcttgatcttgcgcatgtaagaaaagaaagattcatcctgcagcacagcaaccagagtataagacagcttgaagaagacgcccttttctatgctgatgtcctgccagagcttacctataagataagcagtattgacgcaggaatccgacttgctgaacagggatatggaattgcatttacactaaacagttatcttacttcaatgaagctttcacctgattcagttgtattacaggttggcgacccagacatgcgtataccattctccgccgccttccgcaaggaagatgaaaaccggaaagaactgaaagaatggatacggctgactaaagagcttgtttccggacaataaaataaccggctgatactgcatttagctgtaccagccggtatcttaatattattcaattataatacttctacaagctcaatcctgaaattcagttcttttcctgccatctcatgattagcatcaaatgtaatctcagtatcagttaaagcagcaaccctagctgggaatggctgtccatacatattctgaagatatactttatcatcaactttaagttcttctgcaccaggaagctcacttataggcagtgttatgaaagctcttggatcggcttctccatacgcctcctctggcataagatgaacatcaataacgtctccgacattcattgttgcaacagccttgtcaaagccctgaatcatcattcctgctccacaagtaaattcaagcggttcacctctgtcgtaagaagaatcaaactgtgttccatcattaagagttcctttataatgaacctttaccttctttcccacattaggtccttcaaatgatggtgtaaatgtaccacagccaccgccgcagccgccacaaccactaccacagtctgattcaccttcatcacttccacaatgtccgcagcctgactcttcatcttcatggcttccacagtgtccgcagccatgaccttcttcatgatcgtgatgatggtcgcaattaacacctgctgatgttaaatcgccattaagatatgcctcaactgctgcatctgcttctccatctgctcctgaatatacatcaattccagcttctgaaagtgctgtgactgcaccgttaccaattccaccacatataagaacatctacacctttatccttaagaacagctgccaatgcgctatgaccagctccatcagtgccaattacctctgcacggacaatattctttccttctgcctcataaatcttaaagctctcagaatgtccgaaatgctgaaaaatctgaccattctcgtatgttactgctattttcattaataatcctcctgattaatatttattctcatacaacgtatgaaaaatcatttcaaaatcttaaacaactaaaactcaatattcaccgaaccatttgcatatttcatataatcaaaaagcttagacgccgtaagaagttcaagcggatctctttctatatcatcttcctcaaatatctttgccacttcctgtatttccggattagaaagagaattcatatattctctcagttcaactatcggcatattaaaaagttcttctttgctcttcataaattaaaatctccctccaatatctattccgaacggcctgtgaatattaccttgccgctattccacaattctgctgttcttttagctgcatcaagcctgtcttcatcattttcgaaactaaatgatgctgactggcagccgcaatccatacacatcacataataagagtgattttcctcttctaatatagaaggtccaaaacatcttggacaatcctgcagatcaatcatttcataaatttccatgctgcaactccttgtaataataatctgattatcatttaattttacattctattagggatagaaatcaagtggaaatcattatatatcttacatatttacacatattttatgaattatacaccttcagcagattcattaaatcattaatctcctccgcaatctgctttccgttatcagtatcctttacaaacacccgctgcttttccacataaacaacctgtgattcagactcaatgtccctattactattaattgccatattaatactcataaacggatgatgttctttaatcttcattccatgcgaattataaataagtgtataaccagctattcctgtggcagcatgatatccttcgcagaaaccgccatctataacaataagttttccaccagcccttacagggtgctgcccctcttttgtcctgacaggagtatgtccattaataatgtgtgcattctcattataaagattaaactcccttaaaatcattttacagattctttcattttcatactgaacatagtatggattcttatcctcttcgattgccttcttatagtcagcatttctatccttgtcgaggaacgttcgttcaaatgttttgatacaccttccagtcactggtgataatatattactccacagaaaccacataaaatcaactgcatctgaatcaccggttcttgcctgccttaccattgactcgcaataatcaagatactcacgacctgaatacgacttgcaatccacaacaattccatcaaacaccccttgttcatcaagtggcacacaaccatgaaatagaagatttccattatgaatcttataaatgctgcctttgtcatatagaaaattgatatgcctctcaagcgccatactgttaatgaaatctgccctgaatctccccatcagaaacatttcttccatagtaagctcatatggattattcatgtcaacagttggaaattcattagtattaagaaaataatccttatcccctattcttactgttcctttatccagattcatcttatccaacagaagtcttccttccattctgtattccgggtgtctcttaataagctgcccttcaagcttgaataaaatcacagaaatagctttatagactgcgtcatcaacatttttatctgaatatgtattaactgcgaactgtagaagaaatcttaggcttattccataaccattctcaagaattgacatagttttgtacttaatattattcctgaccacaagtgccatacacaccggattgccacaaaaagctcccatccacaatatgtcatgatttccccactggatatcaacgctgtgatgttccatcagaagatctaatatcttatctgcatgtgctcctctgtcatatatgtccccaagtatatgaagatggtccacagccagtcttttaatcagatcagtaagagcaacaagaaattcatcgccattatgaaggctcagaattgtttccataatctgtctgtggtacacactcctgttgtcatcttcatccttctgcgcatgaataagttcatcaatgatatatgcaaaatccacaggcattgcttttcgcaccttggatcttgtgtacttagaagacagaagctttgcaatctgaatcagctggttaagtacatttctgtaccattcatcattcaccttattctcatccataagtatagaaagcttctctctcggataatatatcagagtgcacagctcctgctgctcatatacagtaagttcatctccatacagcatcgctaccttctccctaattactcccgaacaattattaattatatggtaaaatgcatcatattccccatgaaggtcactcataaaatgttctgttccctttggcagattcataattgcattcaggttaataagttcgcggtaaactgactgttttgtgggatatttttcctttaaaagcttcagatatttgtcatactccttcatatatattcctcttatcttctggtttattcactacttttaatatttcctgacaaccttgccccttttattatcaaaactcattctccccaaagaacttccgctttctctcaatcatctcatcaattctctcgacatagcttctgacatctttgacattctcgattcgctcaatacgcacagaatggttttcatctccttcattatggaacacaaccttagttgaagctcctgcgccgcatgcaattatcgtctgcttctcctccataataagaatattatatatacattcaagtcccgggactgcatagccaacattctcaaaattacctgccatattcttctggcggtacatataataaggctgcatgttaagatctcttgctgtctgctcagtcattgcgataatgctgtctgtgttcttaattgaaagctctgtgtactgctgacgcaatatgttaagtcttgaagctctcttgattgcaagtgaatgaacggtaagactctgcggccgcatctccttaatttcattaagtgtatggtaaacctcgtctacaccctctcccggaagtccaagaatcatatccatgttgatattatcaagtcctgcttctcttgccattgcataagcattcttaatatcttcaaccgtatgctttcttccgattaaatcaagtgttttctgattcattgtctgcggattaatagatattcttcccacattatgagctttaagaaccttaaatttatctggtgtcacgctgtccggtctgccggcttctacagtaagttcacggcatctgctcaagtcaaatgcttcttcaaccactgtcagtactttatctaactgtgctgcgcttaaagttgtaggtgttccgccacccatatacactgtatcaagtcttctgcctttcattgattcagcgacgaatcttatctccttaataagcgcatccacataattatctacataatctttgtatgcaccaagtgcatatgatgaaaaggaacagtacaggcagatacttgggcagaacggaattccaatatacaggctgtagcctgtcttataatccatatctgtaagtatatccagttctttccttgctactgtgagcgcaagttcagctttatcttcacttgcataatgcttgtccataaaatgtttcttaatctgttccttggttgcaccctcttcaagcattgtatacgcaatcttacttggtcttactcctgtaagatatccccacggaagcttcttgcctgtcttttctgaaagcttcttatataagctgtccttaaacacttcgtgggcattcttcttatcaagccctgtgacatcaggaacttctattgaaagaatctcatctttctcttccggtttggaatctgcctttagtgccataacctcagttcttggataaaatgaacggacaagcacaaccgcatcatcataaaatacatcattatcaatcttaatatatatcatcgttgcttccttttcgcgtcagtttcttttcgcctgctgattccatactcgcaaacccgcactatcgtgcttctccgcctgcttcgcaggctgtttgctcgttgatgccccgcgaaaagtaaataacgcttcgcgttgcttccttttctcttgcgggcatcacataaacggattgttctgcttttcatatccaatcgttgtgaactctccatgtccaggatatacatctgtatcatcaggaagcttgcagagcttgtcatgaagagattcaatcattgcagcagagcttgctgtagggtaatctgttcttccgactgaaccggcaaaaagtgtatcacctgacataagtgtcttgtctgattcgatataatagcatgttccgcctgctgtatgtcccggtgtatggattgcttttatcttaagtcctgcaagttcaagaatatctccatcattatgaagtacatctgctgtaaccctaagactcatgccgtatgcattcgacagatttcttacaggtgaagcaagaagcttttcctcgtcacatgatgcatatatcttaattccataatgctcacgcacctcattagccgcacctatatggtcaaaatgtccatgtgtaagaagtattgcctgtggcctgcttgctgaacgcacaaccatatcatatatagactctggtgaatctgccgggtcaacaataatgctctcgttgttatctaagttaattataagatagcagttagtagctaccggtcccaatactcttgattctatcttaatcataatctgcaaacctttcttagccggcagttcttgttatatcagtaactccgtctatctttcttaatttatctataattctgttaagctcttccttaccatgaatatcaaaaccaacacttatggtagcgaattctttcttattaagacggcagttcatagactttacatcaatctccgcttctgtgaacatccttgatatatcaacaataagacctgttctgttgttggcaaatatattgatttcaacctcataggtatcgcctgctgtctgtccctgctcccattcagcctctataagacgagcacgctcattagctgggaagttgattatattaacacagtctgttctgtgaattgatatacctcttcctcgtgtaacgaatccgacaatctcatcaccaggtaccggattacagcactttgaaaatctcacagcaacatcatggattcccttaacgacaattccacctttgccttccttcttctttgacttttccttagactcagcggcaacgatttcctcaagcacatctttgtctgtaacttctgccttcttggtctttaaatgctcctcattaagcctgtttactatctgactctctttaagtgcaccatgtccgacggctgcaagaatagaatcccagtctttaaagccatatttgttaagacatttttcaacatattcaggcttggtaatatcagaaagaacaattcctttagtcttacagtagttagcaaccatttccttgcccttaatgatattatcttcctttaactcctgcttaaaccactggttaatcttattctttgcctgtgtgctctttacaattgaaagccagtcacggcttggtcccttggaattctgcgatgttataatctcgattctgtcaccattcttaataacataatcaatagtaacaagctttccattaactctcgctcctaccatcttattacctacagcactgtgaatgctgtacgcaaaatctatagggcatgagcctgccggaaggttcttgacatcacccgtaggtgtaaagcagtatacgctgtctgagaaaaggttaaggtcattcttgattgatgataagaattccttgttatcagacatttccttctgccattcaagaatctgtcttaaccagctaagctttgcttcctcactctgattgtccttctcgccagtttttccctctttatatttccagtgggctgcaataccatactcagcaatcttatgcatttcgtaagttcttatctgtatctcaaacggctgtccgttagatgcaataagtgttgtatggagcgactggtaattattaggcttaggcatggcgatataatccttgaaacgtcctggaataggcttatacatttcgtgtattacaccaagtgccgcataacagtcttttactgtgtcaaccttgattcttactgcaaatatgtcatatatctggtcaagcgtcttattctggttgaccatttttctgtagattgagaagaaatgcttaactcttccgtctatctcagcctcaataccggcattgcttatatgcatgccgacttctttaattatgctctttataaatgcttccctgcctggtctgtttaagttgacctgttcaacaagatcattatatacatcaggcataagatatttcattgataaatcatcaagctctaccttaatcttggaaatacctaacctgtgggctattggagcatatatttccattgtctctcttgatttctcaatctgctttgccggcgactgatactgcattgtacgcatattatgcagtctgtcggcaagctttataaggataactcttatatcctttgccattgcaaggaacatttttctaaggttttctgcctggacctcaatcttatcatgctggtaattgagctgtgtcagctttgttacaccatctactaacagtgctacctcatcaccaaattcttttgcaacatcttcagttgtcataactgtatcttcaacaacatcatgaagaagacctgcaataattgactccttatcaagctctaattcagccagaataatagcaacacataaagggtggattatatatggctcacccgattttctgaactgtccctcatgtgcctttcttgcggtctcgtatgccttctcgatatcagacagatctgtagatgggtggtatttctttatagctgcaataagatccttatataattcctcaggacttgtaaaatctgctggtgtatccaccgctctttcaacctgattagttttgttatggcttgcgcctggtaactctatattctctggcatacgtgcctccattctctggtaattgtccagcgttatagttttcttaagcccattatttatacactggcatatgttctttccataaattctcttgtagccactgcattctcaggaacagtattttccaatgtacagtgtacatatggcttatgctccttaatcttctttaacagaagtggataattaagacctcctccggtcaccggattaccctttcctgtacctgctgccactgacttaagctcactgccttcaacaatataatccttgcagtgaacaacagcaatatcctttaataacagttcaaatgctttctcaataatctcatcctgctgtgcaagattatcaacacataacaggttaaccgggtcgaatataatctgaagattaggtgaatcaatagcgtcaagcacctttcttgcacgttcaacagtgtatacaatgtgcttccatacaggctcaattgctacaatgacgccaaactgttcagcatatttaactattggccttaaattatcaataaagcactgaagtgcctcctcactgtgattagctggctcatacttatactcctcattaaccgcaccagtctcagtaccaacaactccacagccaagaatacttgcaaatcttatatgtgccttatacttctcaacaatctccttatgcttctcaggattaggattgcaaaggttaagataacagccaagtactgcaacatcaaccttattctctgtacataattccttaatatacatagcgagtcccggtgtcatagtctccacgcccggcttaaactccttaatagacttactgagtgcaatatgcatacagtgaaaaccctgtgcatgtatattaggtataagctcctctaatggagcgtatgcaacatcatgtgctcttattccgattctcataaaaaaccacctttccgtcaattacaaacacttttgaaagattatactatatattacataaaaaaaccagtaaatatctgcgacttttccaagctgtgagggcgttaatgctgctatatacaaaagaacggtgagagaaagcccgcccaagcgaaacgcgtttgctttctctcaccgtattaaactctgtatgcacctttatctcaattatcaatacagctttacattattaattaatcctgtatctccaagtgccttataatatgtaacaagtggtataaaactctgtgcaaatcctttcgtactgtcaccagaaacaataacagcatcatctataacctttttagaaccaattcctgcccttcctgtgttattaatattagtttcaaatgttttgaaaccatactcaagatatttcttatcacctgtaagttcataggcaattgccagtgattccagaagaagtgtgttatttccattccttgaaagtgaaggaagctccttataatagaacaaaccattgtcaagagtacaattctctacaatatcatcaattgctcttataagcatctgcttaatatcttctcttgggaataccctgtaatatctcattacgcttcctgcagctactgatatcataaatcctactcttataagagtattgtccgtatacggagcaagccagttgccatactcctcttcccatatcttaaagctgtcaataatccactcgcattttgcaagccatttttcatctcttgtctccacatataatgcaacaagtgcacgtaaagcccagccagtttctctcgcattggcttctcccggttttgcatacattggtgtatccagaagtcttaatatgttatcacctatacttatagctgtctcaagacctctctcatcacctgtaaaatgatagtaatcaatcactccttcaacccattcatgtgagcataccattattccattcttacaatgacctgctgtatgttcccactgtccacctattcttaatggattcttgctgtaatggcatacatcaacatccatctgatgctttgctgaaactattaaatagtcaaggaatcttctgattccagttcttgcatacataagagcacatgaatgcggataatcatattcattattactccatacaggttttccgccgcctcttccctgtaaagtatatcccatatcaatagaatcgccccaattcagcatgccgtagcatcttgaatgattatcagcccttgcaataagtgcgatttcaacttcattcacaagatgttcagggaatacatccatacacacttctgccttcttgaattcctctggtgctatgcatggtctgtcaggcatctggtatattgtacttctgttatcaagctcccacatctgcatatccggttcatggaaatgcatcaggaatctctgttcctttgccataccagactgcataacaacatttccaatatcctctggaacaagcataacagctactccgccgtcatatgccttaactgccttcggataattctgctgtgcctgatatacagttatacacaatccatcatttccatcagtataatctgcaagaaatgtaccatagaatacctctgcaaaatgttcatttgcttcctttacaagatatgcatcatcgataatcttattaacctgcactccatctcttccaatatagaaatcagtcttataattagagcttccaacaagtgttcttacattggaaacaggtgctttaccagatatcatctctaattccccggttcctcttgtgtgatacacaggtccattctctttagaattatccgtaagtacatctccacatccggtagaatcattacccatattaatgtgcatatcaaacaaatcatcacttgcagtgactgtctcatcaggctttgcataaaataccagtgatttgatatgaagttcatcataagtcgtattaataattctgtatgaaacatcaatccatgacttagctgcatatgatgtaagtgttatctcaaaatcaacttttttattattaagaatgttacttcctttagctctgattacacattttacaggacctgcatctataatcttccactcaccaatattaatgtcgtataatcccatatcatctttcagatatggtccttcaaaattctgagcggtataatgttttcttccatcatcaagtgtttcaaatatattctgggaattattctttactgtaaatgtaacacagcctgtgtcaacacacagcccctgtccagtctgagtaacagatactcccttttcttcgcagcttccatcagactctttttcaaactcaagcactgcgcccttattagccggaatatcagcaagaaaatccacatacaggtatcttatgcttccatctgcatgcttcgatgtaaccttcggctgaaccatgcattttctgccattctgtgtaatagctatcctgtcggcagtctttaactctccttccttaaaaggaagtgctatgcctgccggttcctgtaatctgtcatacctgtaaagcttgtcaaaataaattttcattatatgtaccctccattgtttgtcacgagcaaatctgctataattgtacaacagatttaaatcatttgctatagtcttaatatagcattcataattctgtaattcatgtgataagatgtcattatttgctaataatacagatttattgcagcttttagaaagaaggtttatattatgcattatgccgagataaaaacctgtgatattgctaacggaccaggggtgcgtacatctctttttgtaagtggatgcacacaccgatgcaaaggttgttttaacgaaattgcatgggactttaattatggcagggacttcacagacgatacaatcaaagaaatcattgattcccttgccccagactatgttacagggctcacacttctaggaggtgaaccatttgaacacagcaaccagcagggactccttccattgctgagggaagtacgcagaatatatcctgacctgagtatatggtgctttacaggatatctgtttgacaaggatattgttggaagaatgtgcaatgaatggaaagaaactaaagaaatgcttcaatacattgacgtcatagttgacggcaaatatgaagaagacaagaaggatatgatgcttcagttcaagggttcatctaatcagaggacaatccttgtaaaagaatctctcgaatcaggtaatatcgtacttctgtacgattaataataaaaaggagtttacacaatgtcacagaaagttaatattaagaaattaaatcctaacgcctgtatcccaacatacggaacagaattctcagccggagcagacctctactcaggaatgtccgaagccgtaacagttatgccaggcacaactgaattcatcaaaacaggaatagcaatggagataccaacaggactagtaggtctaatctatgcaagaagcggaatggcatgcaaaaaaggtcttgccccagccaacaaagtaggtgtaatagattctgactacagaggtgagatcatagtagctctccacaaccattcagataaacctgtaaccatagaaccaaaagacagaatcgctcagatagtcttagcaccatacatcacagcatcattcaacgaagtagaagagcttgacgacacagaaagaggcgaaggcggcttcggctcaacaggcacaaagtaaaaaaaatccatcttgcaacatgccaaaggtataagcaagatggattttttatcccaccacatttcatagccaccccggtcacacatcaacaatccgccttgcaatatgccgaaggcataagcaaggtggatttttttatcccaccacatttcatagccaccccagtcacatatcaacagcccgccttgcaacatgccgaaggcataagcaaggcaagaaagaattaacgtagattggaaccggcagcatattattgtgcgagtccgatttaaggcgcgaaccatgtgggagttatgccgctctatacaaaagagcggtgagagaaaactcgttcaagcgaagcgcgtttgttttctctcaccgtaataaactctgtatagagcggcatttactcccactaggtgcagccgccataaggactcgcacaataatatgctgccggttcccacacacaacctaaattctttcttaccttacttatacgcaatattggcatgctcaataacataatcctgtgccttctgcacaagcatagccttaactacactatcttttccgaatttctcaacaaatgcattctcatcagaatatccattgtctcctgcgaattcatcaagatcgcccttgtaatcatattctctcatagagaacttctgatctttcacgattgcttccataataagctgctgtgctgctgatttcttgatgaaatcatcatatgacattccatataactgctggcaatactcttcctttgactggttagtaaaatcagcatagaatccgacagactggtcatatctgtctcgtaatgtactgagcagtgtatctggataaccacttaccttacatgtatcctgaagtgttgaaagaacctgtttctgaatctcatcatcaaccttagaatcgattgtagatgctaatgaatctttaacagaagctctatattcttcgattgtatcatatccaaatgtttccttaacatatgcattagtaagcattggcacattaggctgtgaaaccgtctgcactgtaagctcaaacactactttagttcctgcatatacggtattgctatatgtttccggcaagtcgattaccataaccttagtctctccagccttcattccatagagtgcttcatcaagctcttctatatcaagtccaagtttatctttgccaagtatcattgtaacaccatctgtattagacagccctgttgactgtgaacccgaacttgtagcaacataagtaaccagtatctgatctccatcaacagcacctctgctgacttctgaataagtagtattattctctatatcttcagcaatcttatcatcaacaagctgattctctatagatgttttatcaactgttacagctatatcctcatatttcccaagctgtacataatcattaacattataatcgtattttacttcaatctctttattacatgcagttgccataagcattgttgctgataataaaactattgatgcttttcttaaaaaactttttctcacaataaacctccgctcttacttctttatacagaagtaaaaaattgactttcatactatatcacataaaagagattttatccatatctgttcatattagttcacagaaatatcatacattttaaaaagaaaagactgccgctttcacgacagcctattatctctgatatataatatataatcaattatgcaagcttagacttagcaacctctgcgagcttagcaaatccttctgcatcgttaacagccatctcagataatacctttctgttaagatcgatattagctaacttaagaccatacatgaacttgctgtatgaaagtccgttaattcttgcagcagcattgattctggcaatccataactgtctgaactgtctcttcttctgctttctgcccttataactctctgtaagagctctcataactgactgcttagcaactctgtactgcttagatcttgctcctctataacccttagcgagctttaatactctgttatgcttcttctttgcgtttaatccgcctttaattcttgccattttataaattcctccttaaactatatctctaaataaatgttgttataccattaatcttagagataaggcataatcttcttcattgtcttaacattagttgcgtcagtcatagctgcctgtctaagatttctctttctcttagctgacttctttgtaagaatatggctcttgtatgccttcattctctttaacttacctgttccagttactttaaaacgctttgcagctgctctttttgtctttacctttggcataataatcctcctaaaaatgtctgttagttgttatttattttaacgtttttcagttaaaaacatcatcatgctcctgccttccatcttaggagccttctcaattacagctatatcgctaagcttttctgcaaaatcctctaatatatgcttagtagagtcgatatgagccatttctcttcctctgaatcttaatgatactttaaccttgttacctttctcaatgaactttcttgctgagttacacttagtattaaggtcattgacatcgatgttaggtgataaacgaacttccttaacttctactgtcttctgtttcttcttagcttccttttccctgcggagctgttcgtacttgaacttgccataatctacaattctgcatacaggtggattagctgatggcgaaaccattaccaaatctactcctgcatccttagccatgtttaaagcatctcttaatgccataactccaagctgctgtccttcttctccaataacacgaacctctttgcatctgatctgttcgttaatcattaactcgttaatagcggtacacccccatataaaaaattaaagtgaatagctcagctatccactttctttaatcaaaacacaatcctatattatgtgtaattcttaaatatcaacccgagtcgccctatgcgctgaggtgagagtggatactctgctttgctttgcaaccattgtatgatatcatcctaaacaatatatgtcaaccccattattaaaatttatttgcaaaatttattacaatgcaattaatcttatatcttggaatatcacttcattaatgatattataatacagaaaataaatcaagaaaggatctgacatttatgaaagattttcttatatcaactgacacaactgccgatttacctgcaagttatgttaaagaaaacaacattgatatccacactcttttttatgcatttggtgaagtaatctacggaacagataacattatgcctgagaaggaattctttgaccgcatgcgtaacggcgagatgccaacaactatggcatgtaatccgcaggattgtaagacaatatttgaaaagcgtatcaatgagggctttgatattcttcacattgcattttcatctgcactttcaagcagttacaataacgcctgcatagcagccaatgaagttatggaagaacatccgggagctagaatcgttgtagtagattcattagctgcttcaatgggtgaaggtcttatcgtgtataaagctgttgagatgaagaaatcaggaaaatctatggatgaaataatagattttgtcaacaatcataagcttaatgtagtacataattttacggttgatgaccttaaccacttatacagaggaggtcgtgtttctaagactactgccattatcggtacgcttgccaacatcaagccaatccttcatgtagataatgaaggcagacttattaatataggaaaagtccgtggcagaaagaaatcacttattgctttagttgaccgtatggaggaacatattggttcatacagagataagaatgatgttgtattcatcagtcacggtgactgcttacaagatgcacagttcgtagcaggtcttgttaaagaaagattcggcatagataacatatggattaattatatatgtcctacaatcggaacacattccggtcctggaacagttgcactcttctttatgggtgaatcaagataatatacacgcaaaactggcagagtgtttaccaccctgccagttttgttatatgttctaccaatgtattcacatccacaggcttagatataagtccgttcatgcctgccttttgcagcatacctatatctgtttcaaaaccatctgctgtcattgcaattattggcacttccatacattttccattcttagtccttataatcttagtggtctctatgccatccattcccggcattctcatgtccataagaactacatctatgtcgtccgcctgttcactttcaagcagttcaatcgccgaactgccatcttctgcctcataaactgttatatcctcgtcttcaagaatatcttttacaagttccctgttaaaatcattatcatcaactatcaggacacatttatccattctgttctctcctaatttaacacttactaaagtacgttattctctcttatttctgaaacaagctttcttctgtatgccctgcagccattttcattccaatattttctcttttcaaccttaataacttcaaatgttgtatggaatatatctgtcttatagcttgtataaggctctcttcccggataaaatactgttatcgaatctgcgcattcatctatcttaaggccgtaatccttagcaaattttcgtgattcataagggcttcttatcatcttgatatgtgcataataacccacaagataagcgaaatagttcatatcaaatttatcaagccatctgccatcacttgccataaatactataacaggaaatgttctttcttcctctgcaatcagtgttgtaagatcatcgtaatccttgctgtcctcaacgtatcttacagactccctcattctttccacatcaacaattcctatgttgtctgcaatctctccaaagaaattaggtcttgaaaacagaacattttcattatctctgtatctgtctgctggttctgcatatctgttagataccgtgaatttcagtctgtcaccttccctgcatataaccgcttcagatatccatactcttgttggtatcttagtatcaagatgtgtagttttttcagaaaaatacacattttctgcatcatacgaaagattaactgaatatccaggctctgcattaacataagtttctgcactctcaggtaaatctgtgaatacatcctcatatcttgacttaacccatgaatatatgtaccctgtggcttttctgaaagcatcaggcattgcaagattgcttaagtcgatatatgtatcagccttgaataccatataagaaccaagctgtttaaacggctcaaaccttcttctcttggcaacgctttctgtctcctgtttcttctcatgttctatctttacaaatgcttctttgagtctctcatcctcaggtcctatctgattaactatcttaacaatattattaacagtaatctccggacctttatctcctgtattatcccatagctgtcttagtaacggttctcttttaaatttataaaacttcttggcaagctctgtatcttcatcaaatatctcttcaatatatggatgcagcggttctcttgtaaacttcagtctgtaatgacatcttaacatatagttccattttctgtctttgtaatgctgatgtcctaaatcttcaatcagacccacaactgaatcatcacataactccagcgttgcaagaatactgttcatttttcttgcaagtgcttcattacccgtgccaaaggctgaacctttatatctcatatcatgttcaatctcatgccagccctcaaaagaattagttcttacctgtatctcaaatgtatcatccacataatctccaagctccggattaacaatggtcttgctaagatatcccggcagcttgaatataccattaatcttcattgccctgaactcatattcattagcctctgttgtattccacacgcccggcatagagaatattgtatcaagaaaattcttaacaatttcaacatcatccgcataatacagaataattcttattcctataagatcctgcatctttttatcctgattgtctgtccctggtcttctgtaatcctttaatataagtttatcaagcattgaatcaggagctttcaccctgtatgcaaccctgtaatagaatcctgctttcttaagcttttcttctataatacttagcagatcatccttaacaatatccggaacatatatcttttctacattttctttagtaaataattcattaacttcattcataccctaacctctgattccagctactttggcaaactgtgtctccactcttgcccttaagcggttttttattccctctgttgtaaatgcagcttcaacaccattcattatcagttgcttaacatctttcttctccatattgaatgtatctgcaaccaatgcaagttccctagcctctgttgtgttagaaaccatcatattatccgtattaacagtaacttttatccccttattcataagctgctgtatcggataattttctattgtctcgtatattttagtattcagattgcttgtcggacataattccaatgcagtctctctgtctgcaagctcctgcataattaaaggattctctgtacttcttacgccatgtcctattcttacagcctgaaaattcaatgcacattcaacactttctgctccggccgcctcacctgcgtgaatagtaaacggaacgcctctctgaacggcatctctgaatacatctgcaaatgtatctgttgcataaagtccttctgcccctgcaaggtctgccgccacaacgcctcttcccctttcggcatataatgcagcaagtcttactgtctccatattagcatccttattatcatccgaacgcatacaacataatataagattgtgacaggaatatgacttccagtactttcttgattcatcaagtccctcacatgctgcttcaacaatctcctgctgtgacaatccttttcttgtatgaagctgtggtgcaaatcttatctcgctgtatattactccctgttcttcctgctctttaacaagctgacacacactatatttaacagcctcacgcgtctgcaaaagctgaagtgggaattcgaacttttcaagatattcattaagattcttacaatctgatgacacactcagcttcgctgacaattctgcatcatcacctgtttctatattctgcataccacaaagatgtcttacagattcaggcgacagtgaaccatcaagatgtacatgcaggtctgtaaggcaattcaatttttctatccattctatattgcttatattcaaaaaaacaccctctaacataataatatcttacatacactttctacattttaaactgcattcagtttatttgcaacagtgataaggctttacatccatattttaccaagtattatgataaattttatgattaatttatattcagcacatttgcattaaatatacatgcgtgttataattcatatatcaatatcgttataagtaatcgggggatataattatgtcagttattcatgaatcagcagaaaactatcttgagtcaatattaatgttaagtaaaaagcttcctgtggttcgttcaatagatgttgccaatgagttaggtttcaagaaatcaagcgtcagtattgcaatgaagaatctgagggaatctaatcatataacggtaactaaagaaggttacatatatcttacagaatcaggtaaagagattgctgagatgatatatgagcgtcaccagctccttacatcatggctcataaggcttggtgttgatcctaaagttgctgaagaagatgcctgccgtatcgaacatgatataagcaaggaatcattcaacgctattaagaaagctatatcttaatttttctcatataatttccttctcggaaagagccatgccggattatccggcatggctctttctattttacatattctttttatccagcaaattcctgtgcccagtaatgactgtaccttcctgctccacagcctgaattactataacccagccccatttttgtatatataggatctaatatattctctttatgtgcaggagaattcatccaactttttaccaattcttctggtgtcatttcgtaagttgctcctgcgatattctcaccacactcttcccatgagactccgcattcatccaaagctgatcccgacatattatcattttgaggtctgttaggtctactatggctcaattttcctgtgtaatctaactcagccgctcttataccagccgccttacacattgctgcatctaattcaagcggttcaataccgcacttttgcctttcagcgttcacaagttttataacatctatgtcatattgtctaaaaaaacttgtattataattttcttcacaggaattttccaattcagctttattgttctcattcttttctcctaaatgttccacatctcccgaatcactgtcttcccatgattcctgtccggaattattctcataaccacctgcctgtgacaaatcatcaaaagcctgttgttctgatgcctctgtattaccagcaatatcattatctgtcaggttattctcttcactggttacttcctgtgtaaaatccccggtttctttatcagctgtcttaacattattaccatcagttttggtttctccattgacaacggttcttactgtagtctgtgtctctacagtattgtcagaattcttcccattagcattattgtatgcactgccacagcttgtaagcagtcctccaataatgactgctgtcattaatacagctgcattttttcttctcataattgtatacccctgtttcctctctacaacagcaatgctgctatttagaataataacacaatgtcatatattttaccatatatcttttttaccatttattaccatatcaacctatataattaccatattttaccattctcaccactaatatcaggcttataaaatgttatttttcttatagtggatttgcaatcagataaactatggaggaataccagatgcaggaatatcataacagaatccgtgaattacgcgaggaaaaacatataacacaggtaagattaagcaccgagcttggagttgcccaggaaacaataagtgcatacgaacaaggaaggcatcttccaagtgtctcatctcttatgaaattaagcagtatattagatgcaagcatggattacataatgatgaaatctgatgtcagaaatatgattcaggttcagtctttatccgacaacgagacaagattattaggctactataagaagcttaatgcttcaggaaaggaaaaggctctttcatatattgaaggccttaatgacggtttaaggtcaggctgcaaataatttcattaaacacattaagcccccggacgcaatcttgtccgagggcttattatttctatttcaatatcttatttttcaagatatcctgtgtattctgctgttcttaatatatcattagctcttgctatctgttccttatcaggtggcattacatcagaaagtgtatacggaattcctaattcctcccacttaaatactccaagtgtatgatatggaagcacttcaaatctcttaacagtctttaaactggcaacaaaatcccttaactgttcaaggtcttcctgtgcgtctgtcactcctggaacaagaacatttcttatccacatatccttatcatggtcagaaagatactttgcaaggtcaaggatgttcttattagtccaacctgtaaggtccttgtgcttctcatcattaatctccttaatatcaagaagaaaaaggtctgtaacagccatcagcctgtcaaacttttccagatattccggctccatcttaaaaggattacctgacgtatcaagagttgtatgcacaccattctttttcgcaatttcaaagagttctgtcacaaattccatctgaagaagcgcctctccaccacttacagtgattccgccaccattcttccagtaatttctgtaacggtaagctttatcgaacacttcctgcgctgtttctaatgttccgccttcttctttccatgtctcaggattatgacaatatctgcatctcatatgacagcccttaagaaatacaatatatcttacccctggtccatcaactgaaccaaagctttctacctgatgaattctacctttaatactttcactcatagcattttcctcttccaataattattactttataaatgtattatcacttaataacgataatttactccaaaaatgtctacattttataaaaacatatatttggtgcattaaatataacatatcccctatatattgtcagttcgaattgcttatgtttgcataaaaaagcaaaatgtagacctttttatctccatttatctgctttatagcgcattctttccagcttatttatctcgtaacatttttcacacatgccaaatctatgattccattccagtctcttcccacagcgtttacatttgttgaagaattcaccattagtaagttctcttactatgagttctgatatcttctctttaagtattctgatacgctcgtcatattctgatatattaagtgcattacaatatgaattaagcagatccatcttcttatacaactgttcaaggtcatccagcttcatggcttctatatcttcagattcagtatctacataataccacatcctgcttaccggttcaccgtcagctgtcatatcaacaagatcctgccacaaatatttaagtttctcgctattctcatcaaatggaatgttaataagactgtattcaagatctttattaatcttctcaccatgttttttctcaatgtattcagcaagtttaatcctgttctttaagtcagcaactgaaaagcatttcttttcaatcgtctttaaccatatcttaaatatctctgaaaggctgtatggcatatccagaacttttcttggcggctgtataacgcagcttgttatctgctcatatcttccatgaagcagttcacctatctggtccctgtcctctattgagttgacatacccctggtcatacatcccctttcttcctgctcttccggcaatctgcttaacctcactcatattaagaaatcttttggatttgccatcgaattttttcgactcagtaaatattattcttcttataggaagatttactcccattccaatagcatctgtacatactacaattctgctctctccatttaagaatctggcaacctctgcttttcgcacactgtatggaagtgaaccgtatataacacttactttatacccttccttctttagaagggttgcaagcataagaacttttctacgtgaaaatgctactaaagcatctccatcccgtatatcatctggaaatatgaaatcatggtcttcaactataagtcttgaattccttttatgtcttatatccgtatatgtatctccacacatttttataagcattttaacaatatgtattgcattcggcgacatgcatacatgtacaacatcagcattaacgccaagaattgcctctgtccacgcccagcctctgtctgagtcggctaccatctgtgcctcatctattacacagacatcaaaatgtctactcatatccattttctcaactgtacaggataaatgctttgcaccatctcttatatccttctcctcgcctgtcgtcaacgaacagttaattcctcttgcaagactcatctcctgaatctcaagtgcaagaagtctcaggggtgcaagatacattcctgaaccggcattataaaaatcttctagtgcatcatgtgtctttcctgtattagtctctcctatatgaagtataaaatgtctctttatatttctggcttcaggatacagctgtgttatatcctcaggaatactctccattaatgcagtctttatcttaagttctttaagacttgctaaatctttaggtacgaatttcttctttttctttttatagtaatatctagccatttattttcctattgttttatgaaatataaacaagaagcatgacaatacataaaacattacatattgtcacgcttctttctgtaaggtcagtctgattatttagctgctgcaggattattcttcttagtagcaatctcatctttaagcattgcaacaaattcgtccttagatactgtagttgacttctgctctccgtggagtctgtagcttacagttccttctgctgcttcattcttaccaagtacaataaggtaaggaatcttctttacctgagcttctcttactctgtatccaagcttttctgctctctcatcaatctcaactctgattccattatctgcaagataatcatagagaccatgagtataagcatttaactcttcatcttcattcttaaccggaagaattgtagcctgtacaggagcaagccataatggaaggttaccctttgtctcctctagtatataagccatgaatctgtcaagagaaccaaggatagctctgtgaagaactacaggtgtctttctctgtccatctttatcaatgtatgttaagttgaacttagatggaagacagaaatcaagctggcatgttgataatgtatattcattaccgatagcaggcttaacatttacatcaagcttaggtccgtagaatgcagcctctccgatttcctctgtgtactcaattccgatatcattaagaacctttcttaatgcgttctcagcattgttccacatttcatcatcatcatgatactttaccttatcctctggatctcttaatgagagaacacagcggtaatctgtaatattgaaatccttgtatgtctcaaatataaggtctacaaccttggcaaattctgactcaatctgctctggtgttacgaaaagatgggcatcattctggcagaaatgtcttcctctctcaataccctttaatgttccacttgcctcaaatctgaagtcatgtgcaatctcaccgattcttataggaagatccttgtaagaatgcattttgttagcatatatcatcatgtggtgagggcagttcattggtcttaagacaaatgattcaccttcaacttccatagctgggaacatgttttccttgtagtgatcccagtggcctgatgtcttgtaaagattaactgtaccaacacatggtgtcattacatgaaggtatccaagctttctttccttgtccttaatgtaattctcaagctcctgccatactgtatatccctttggtaagaacattggaagtccacggccgattaagtcatctgacatgaaaagttccatttctttgccaatctttctgtggtcacgttcctttgcttcctcaagaagcttaagatgttcttcaagctcctcagctgttgggaaacatacaccatagattctctgcattacatgattgttagcatcgcccttccagtatacaccagaatatttaacaagcttgaaattcttgcagagcttagtattatcaacatgagggccacggcagagatctgtgaaatcaccctggtcatatactgtaatgttgccatcttcaagaccgcttataaggtcaagcttatacatatcatccttgaacatctcaagggcttcttgcttagaaacttctcttctgtatattttcttaccttccttgcagattttcttcatttctttttcgatagcttcaatagcttcgtcattgattacattatctccaaggtctatatcataatagaatccctcttttactactggtccaacccagaacttagcatctggatataaatgcttaactgcctgtgccataacatgtgcacatgaatgattaagagtattcagtctttcatcttccttaaaattaaccatgataaatctccttttgtgttaatattttgctcctcgaatatccatgcaaagtccacaccctgtgcaagcacagttgttgactttccctgtatattctcatcgctactcgcgcaaaaaagccccttatacagtggctttccagcttgctgtataaggggcgaatattcaatccgcggttccacccttattattctctcaatcaggagaacatctcattatgattataacggaatcaccgtgccgtattgaggccgctcggaggtggttttcccatatccgtattctaaagcacttccaccatatatgcttctctctgtagaaccgtaacatagtactcttctcgtcaacgctttagttagaagtatatttcaaatttaacataatgtcaacctgttaatcattgatttttgtatttaaaaatgctattatttttatattaattttcgaacaatttaatattatttttagggaggaactaatggataaattacattcacacaactatcttattgttttagttggaacaattgcattatcagttatgacatttttttcagaagggattaatatccgtgcatttatcggaattggcataatgcttgccagtcttattgctgccggtattggtaagttcttaattcagaatcattttattaaagctttgctcattaatcttacgccttcaattgctacatttgtatatgcttttgttttaggcggcaactcagttgcatttcttgccaattttgtatttctatcaatgatggcattatattttgataagaagtacattatatattactctgttcctgttgctaatattgcacttatatgtgccatatttttcccattcgttattgatggggctaattacgacagagtagatgcctttacaaaggtactcctttttgaccttgttgctgttgttttattcaaagctgttgacagaggtcgtgagcttctttcccagagtgaagaaacaatctcgacaattaacagcaattcacatgcagccaatgatatagccatcaatcttaattcagctatcgaaaattgtaagaacggtcttgataacttatctgaacaggcaactaaggtaaatgaagctgcttctcagatgaataccgttattgacgatacaaccaatgcaactatatctgtaactgagagaattcaggatgccaccgatgaaatcaataagaattatgagctttccaaagagcttgatgctggctttgaaaaagttgatacatcagtcagagccggtaataacgaggtaaatgttgttaaaaacactctttcggagatggcagaaactgttggctctgccagaggagctatgtctgagcttatgaacgagatgtctaagattacttcaattcttgaagaaatcaacgcaattgcagcccagactaatcttctttcccttaatgcctcaattgaagccgcaagagccggtgaacatggtaaaggatttgctgtagttgcagatgaaatccgtcatctttctgaacagagttcagaagctgcagacaatatacacaaaatcattaacggtctttcaggtatgacagatgaagtttctaaccgcgtgaatgcaggtgctgaatcagctaatgatgttgtttccaagatggacactcttgtcaatgtcctcaccggaattaatgattcaacagaagttgcacacaatcttgtaagggaacagtataaggtaatcgaatctgtcaggacagcttttgacaacgttaactcagacattcagacgcttgttgctacctctgaagagaacgctgcaatgatatctaatatttcagagagcatccgccagcaggaagaagccgtttcgaatgttgacgatggcatcgagcatgtcttaaagctttctggtgaattgaaagaacattttaattaatatgcatataaaaagtggcagtcttcagaaatacctgaagtactgccactatttttaacataaacctatctttttatccaatctagtttctccaattaagttcccctaatcaagaaagcttcatatctccatctttaacccagccaatctttttaagaagcatattaataagcggacatatcactgccggaagaatgaatgatataagtatcaatccagcccagtcaaatcctgtaattgcagtctttgttccattagcaatatcagctacccaaccagaatatacaccaatctgtccaacaaatccgcaagttcccataccagatgataccggagtgccattcatctgcagcttaaacaggcatgttgccataggacctgtaattgcagacgtaactatcggtgctatccatattctcggattcttaattatatttcccatctgaagcatagatgtaccaattccctgagaaacaagtcctccccatcggttctccttaaatgacataactgcaaatccaaccatctgcgcacagcagcctgcaactgctgctccgcctgcaagcccagtaagtccaaatgcagcacatatcgcggctgatgatataggaagtgtaagtgcaattccaacaagaactgatactgcaattcccataaggaaaggctgaagattagttgcaagcataataagttcgccaatcttcattgccgcttttcccaaagccggtgcaataagagccgctactcctgttccaacacctatagtaacaagcggtgtaacaagaatatctatcttagtttctttagaaatcatcttacctgcttctgctgcaataatggcaacaaaatatactgcaagcggaccacctgcaccaccaagcgcattagatgcaaatccaacagttataagtgaaaacagtacaagtggagggcatttcagtgcataaccgattgccactgccattgccggtccgctcattgctgacgcaagccctccaactgtataattgacaccgctcactgttgccacagtattagtaagaaaaccaatatgcagctgtgttcccaatgtattaagaattgttcctataagaagtgagcagaacaatccctgcgccattgcacccagtgcatcaattccataccttttaactgaaacttcaatatccttgcgtttcagaaatgtcttaaatttctcccacataataaacctcactttgtaaattttcattatgatagcatattatggggggattgtgaatatagcaatttttactcaccctatatcatccaaatttcttttaatataactcatacgtcagcttcctttcggctaatttctatttttattatattttagccgaagcataattgttttattccaagagccatcattatatgaaaaattttatagcattattattcaaagcattataattctaattaatctggtattaaacagactgaatatagcaaatccgaaagcatcaaactttttaaggtatgtgtgatttacatatctttgtttatcggctaataatgtgtaatctttgtttacatctaatttttccataattccaaccttaattcttctattgttttttgaatcatcaaagtttgacttatcactgccggaagaacgaatgatataagaatcatttcagcccagtcaaatccagtaattacagacataactataaacagcaaacagaacaatccctgtgccatcgctcccagtgcatcaattccataccttttaactgaaacttcaatatccttgcatttcagaaatgcctaaaatttttccaacataataaatcacttttgtaaattttcatcatgatagcatattatggggaattgtaaattgtccatggcggattagaaattaatgtttatcagaaagtaatggtgcctattatcccatccattttcccaagagctgattttctttctcttatagccctctctaatgacattttttcataagatgtacctttaagttcttcaatagtccattcatctcctaaatctgccatctcatcaataaaaatttctttttcattttctttcataaccatatatcctccttaatgtgacctcaaattttccaataattgttctgccatctcaataagttctgccgtttctgactgattatcatacatattattaatcttttctttaagaatcattacctgctcatctactgtcatgtattcaagctttgctatttctgataatctgtatccaaaccgttgatacaatcttatctttttaatcttttttactgcagcatcatcatatagcaggtaaccatacttattctttgtagttgctttaaccaagccatagttttcatatgtctgcacaatctttctcgtcactcctgtttccttgcatacttctttaagtgtcattaaatcattcctcataggccctcctttaacctatgactgctccaacggagcagtcaaatggtttttacaaaaaatttgattttcataaaaggccatgtaaatttcgcgaaaaatgattgtgatgatgcaggtgaatgtaagaaaaaagcgccctagtcaattgactagagcgctactcttaatattcaacccccaattacatgtaaataattgtataatcttcatatcccgacaaaaatccttttataatattttttatattttcagacgctttatcataaatgcccttagattcaacatcttcaagtcccattcgttcaatttcatctactatttcctcatactgcgaaaactcaataggattcaaaatattatttgattctgaacatgttactgtgtcccatattacataattatcattcaactgtatttcaggcaacttaatatatattttactactatcattatcaacattaataaccattttgctcatatcatatccgactttaacaacaccacttgcttttatttcaatagaattcgttgttccgaaaattttgatgttatcaagccaatatcttgcagtatctttaccataagttacagtatactcaccactataacttgataattcagctattcctttcagctttgcctctacttcttcaacagtaactatacttttttcattttctcctggtaatttaaggtctatgccactttgattattcttttgctctaatttccatttgccttcatttcttaaattagcagtttgaaaaccagcaacaaatgtaagtaccaaaacaaaaatactcaaaattatcttaaaacattttttcatatctggtctcctatgtccatgccgttacaatcactaataaataaaacgccacaataagacctataattgttaataaaatacctaaagcttttttcattggtattacctcctaaatttatctttcagttaactgattaattattctaattattatataattatataacaccattatcagataaaaatttcctatacatatcttcaactcttttcaaatcatctttatgaaaatctcctatcttaaatataaaactatcttttgtcagaagagttacttttgatactcttgcggtagatgccaatctcaacccagcttcatcccaataaataataggtatatcatatggatcttcaattttcgccttgtgttttgtaatcttaacagataatacacccaataaattttcatcaagaacaattactggtctatttaagattctgtcaggatcctcctctaatggaaattcaacaaaccatacctcaccctttttcattaaatgttacctctttcttttttcatctgctcaaatatatcatcccattctgtttcatcattccattcatccgcagatgatacagttgcttttcctgtattgttataattcgtattcttcatagccagcttatacgcctgcattccatatataccactattcatatctgggtgaaatggcaacgcctgttcccttacggcctgttttgctgccattgtaaaaaatgtggtcatatccaaccctagattagacataagttcctgtaactgacttttcaatgtttcatcaattctcatagtaacatttgtatttgccattatcatcactcctttcatcttctattttattatattctttcgcatatttttgccaatgcattgttataacagtgcacatattatatcataatatgaaataacatatcaattctattcccttaaatctctcctatttttaagggaataagcaatataataagcgaatatctccttagagttctatccatgctcagttctcaatatactaatcatctatattctgtcacacaaatataatacaatctaacacctgatacctatcaatagtcgcattttacaacttcttatgggtaattttcccatcaaatcatcatattcaagccaatactgcatcaaaaaagcctataagatgttcaagcaaaacaatcttataggcttttcaactctaagtattcaatttacctgccaaaactacctatcagtcaacataaaaaatgtttcttataggaagacgacaattccacactatattttatacattagcgactgaatttcctcatgcgaaatcgccaaagctgccagatctcgccgatgcattgatgctgccatcaccaacgccgcagcaatcaagcaaactagccagcaagcccctaagacactctcgtctcacgaatcaccttcctcacagccagcactttacctgctgaaactgaaagctcatcgacacccatcttaagaaattcttctgtgagtgttgtgtctgcaccgagttcaccacagatacctgcccagatgccctctgcatgtgcattctcaacaaccattcttatcatggcaagaatggctggatgatgagcatcgtagaaatcatcaagctttgtattctgacggtcaatcgctagcgtgtactgtgtcaggtcattagttccgatactgaagaaatccaccttcttagcaagctgacggctcataattactgctgccggagtctcaatcataattccactcttaggattaccgaattcaattccctgctctgtaagctcagccttgacttcattctcaataaccttaatcttatcaacttcctgttcgctgattatcataggatacatgatagatatgtttccatatgcgcttgctctgtaaagggcgcgtaactgtgtcttgaatatctcaggtcttgtaagacatattcttattgcacgaagaccaagagcaggattatcctctttatccagtccgaaataatcacactgcttatcagcaccgatatcaagagttcttataatcaccggttttccggccatgctttcagctacagtacgatatatgttgaactgttcttcttctgttggaaatgtatcagattcaagatatatgaattcacttcgaaacagtccgattcctgctgcatcattggcaataacatttgcgagatccttaatattaccaatattagaataaagcttaatcttcttgccatctaaagtcacatcttccttgcctttaagttcctgtaaaagagctttcttctcattgtctttgcgctgttgctcctgcattactgacagggttgcctcatcaggttcaatatatacgacaccgttagttccatcgacaatgccaagcttgccattaagagattcatcaataacaatatccgaaccaattaaagccggaattcccattgttcttgcaagaatggcagtatgtgaattaactgaacccttctgtgtaacaaatgataatatcttgctcttatccatctggactgtctctgatggtgccagatcctctgccaccataataacaggctcatctgcatctacaccgcttcctgtattgccagaaagtattcctaacagtctttctgtaatatctttgacatctgctgctcttccacgcatatattcatcgtccatggctgcaaacatctgtgaaaaattatcccccgtctgggctatggcatattctgcattcaccatctgactctcgataatatgctcaacagattccttataatcgtcatcctcaagcatcatctgatgaatctcaaatattgccgcattagcctcgccaacttcgcgaagtgctttatcatgaagttcccccagttgtttaaaggctgtttctacagcttcataataacggttcttctctgcttctgcatcagtaatctttacacgcttaacctgatgttcacctttctcatacaccattatcttacctatagcaatgcctccaaatacactttttccagtatatttattcatgtgcacctcctgactgctacatattgctcttcatgaattcttcaatcttagctgctgcagcctcttcatcttcaccttctacagtaattgtaacttcatttccacattttactgcaagtgccataacaccgaagattttcttgcagtctcctgacttgccatccttagtaattgtaatcttactgctaaattccttagcaacctttacaagctctcctgctggacgagcatgtatgccttctgcatctgtaataacgtacttaaattccttcataattaaaaaccacctttcttaggctgctttcttcttaaagagccctaaacatattgttgaaatgatagttcctgccacaagtgcaatcacataatatattgcattgcctactacagggaatacgaaaatgccgccatgtggtgccattaaagtacatttgaaaaacatactgacagcacctgctgcacctgagcctatgatacatgctggtattacatgtaaaggatctgctgccgcatatggtattgcaccttctgttataaatgcaagtcccataataaagttagttggaccagcatctctttcttccttagtaaacttattcttaaaaagtattgttgcaagagcaatcgcacatggtggaaccataccacctatcattactgctgccattatatcataattacctgctgcaatggaagcagttccaaaaacatatgctgctttattgaacggaccacccatatcaattgccatcatggctgcaagtatgaatccaagaagaaccctgcttgtacttcccattcctgcaaggaagctgttaagtcctgtgttaatcccacccattacaggctctacaataaatgtcattccaagtcctattaccagaatacccactaccggatatataagtacaggtgctatcttttccaatgcctctggtaacttatcacatatctttcttaaaagaactataatatatcctgctgcaaaacctgctaccagagcgcctaagaatccagactttccattagctgcgatataaccaccaacaaaaccaagtgcaagtgccggtctgtcaccaatggccattgcaataaatcctgccagaacagggagcatgaagccaaatgctgctccaccgatagacttaaacagtgccgcaacaggtgttatcgtaccaaagttgcttcgttctgcctctgacagtgcattcatatcaacattaagtccatcaataagaaatgctatggcaatcagaatacctccgcctacaacgaaaggtaacatatgtgatacaccattcataagctgtgtatatatcttatgtccaattccgccgcctttctttgcggatgtgctttccttcttttcagaagttcctgccttatatacaggtgcatctcctgcaagagctttctttataagttcatctgctttattaattccatctgaaacctgacactcaattactttctttccatcaaatctctccattggaacctgtgcatctgccgcaacaataatacactctgccgattcaatatctgcatctgtcagtacattcttagctccgccagaacctcttgtctcaatcttaattgcacatccagccttagctgctgccttctcaagtccttctgctgccatgtaagtatgtgcaatacctgtagggcaggaagtaactgcaagaatcttagccggcttattgtcttccttttcaagtctttcatctatactcttggcttcttcgtcagccccatctatgatttcaatgaattcctcagggcttccagctttcataagctttgctacgaaatcctcatccataagaagcactgataacttacttaatacatcaagatgtacgttatccttagtatccggcgctgcaataaggaaaagaacctttaccggctcatcatcaagcgattcaaaatcaactccatccttaataatcattgctgcaagtcctggtgcattaacagcactgcatttgccatgaggaattgctattccttctcctacacctgttgtactttcttcttctcttgcatatactttagccctgtagctttcaatatcatcaatctttccgctctttgccataagttctacagccatatcaagagcctcactctttgtcttaggagcagcattaagattaatgcttctcttatcaagtaaatctgtaattctcataaaatacctcctttacattatctcttgcaggtaacctctacccgctttaatacctctgaaatctctctttttgttgcaagattttctgaaaatgcactggcacttcctgttgcaatgcccattctgaatgcatcttcataattacatgtctgaagatatcccgccataaatcctgcaaccattgaatcacctgcacctactgaattcttaagctcgccctttggtgcatctgcttcatatacgtttccatgttcatcaataagaactgcgccttttccacccatcgatataagcacattgacagctcccatatcctgcagcttccttgcatatggaataacctcttccttagattcaagcttaacaccaaatatatctccaagttcatgctgattaggcttgataagaaatgggtgatattcaaggacattaagtaaaagcctgcttgtcgcatcaactataatcttaacatctcttccctgtagtcttcccattattcttctgtatatatcgtctgatatacatgagggaatacttcctgcaagcacaagaacatctccacttgaaagtctgtcaatcttacttacaagagaatggagattatcttctgatatctgaggtcccattccgttaatctctgttccatctatgttcttaatcttcatgtttattcttgaaaaaccattatcaacctgaataaaatctgtattaatgccatactctgataccatgtcacatatctgttttccggtaaacccggctacaaaaccaaatgctgttgtatcaaattcaagattattaagaactattgaaacattaattcctttaccccctggaagcatatgctcatatgatgttctgttcgtcatccccagttcaaaactcttaacttccactatataatccagtgacggattaaatgttactgtatataccattgtctctcctttctggcttcacgacctttttgttataattataatacaatcacattaattcaaaatcaatcacattcattcacaaacttttagattatttttgtgcatttttcacaaattatcgtcaaaatactttctctaaatatgcattgtgtatcaacttcataactttcagtatcggtaaaaatcaaaaaatatgccagaacttcagactcagccaaagttccggcatattagtattatatattattatattaatgttttcccttaagaagtggtgataatggcttatatataagcattgatatccctacatctataagacctttaactattgtaaaaggaagattaaagcatatcagacactgcatgattgatttcatagatggaattatagcctgatacagacttaatattacaacctctggcattgccagtttataatacacaggatacactattaaataattcgaaaacacactgaatacacccattgccatggcaccgcataaaccgccaagcaatgctcctgtcttagactttttcttcttataaacaattcctgctgtaaacacgaatacggaaccgagtataaagttagaaagttcaccaacaagcatactctgtgaagctgccagatgtacaacattcttaatgagacatattataatgcctgccactggtccgagtgcataagcaccaagtaacgccggaagatccgaaaaatcaaacttgataaatcctggcataataggaatcggtatttccagatacataagaactactgctactgctgaaagcatacccgtcaccgctatcgttctcacattattcttagtattaacattactcattgcttttattctccattatattctgtaatattattctgcctccttaaggtgcatcttttttgatgcatgctccatagcttcaacaagagttctcatatcactaagtatctgtgtagttctttcttcaccaagttcagcaataacattaccataatattctctgttattgtcctctctttttttcaagaaatcccttccagcatcagtgaatacgagatatgtaccatctgttcctttgccatcatgtttccataaagcatagcccatgtccttaagactgcttgcgattgccgatgtctgtggaattgatattctcataaatgaagacaaatccttaagatatgtcttatccttgccatcaatacaatctttctccattaccttgagcgcaatataatctgcaagctcaagaccattgtaaaaattctttcttctctccttatccatcaggaacctctgaaatataagttctgtagataattcgaagctttcaaaactattgttcatgcccctatctcctctctgttttaaaataatgattcgatagatttatattatcagaaaaatccttatatgtctgtataacaatcatgaacaattattaaaaagttataaactatggattacagcattccgctgccgtatatcccgctccaataagttcttctctttcagcataagaatatatcttattcttagtccctattcttgatgccttttcgcattccggtttatgaaatgtcattgttttactgttaagaatataattataatccattgaagaatcctttatctgtacagctatatcaaggaattctcctgtatattcagactctcctgttgaatatatgtaattaatacccggctgtacattatataaaaatatattaaagcatattccttctccactgtcctcaacagaataagcctccataagaaccccccggcacataagctcttcgccaacaaataccggagtagtcctgtacataacgtgattagaagttttctcaagatatcttgcaatctttaccacatatgcattcatatagttcttcatatatggagttgctgttatataattcttcttatcagtatcagaacctccaagacaccacgcaatgctctgtactctgctctggcagtatccatctcccgcaatactgtcatacttgatattattccatcctgtaggacagatactttttgattcacctttcttatcatcttcagatggcattgaatcataatctaaacatgccattgcagaagtaactcttttgatactgtcaagcggtccatattttatataggaatccttaactatctcagagcttgtaaaatatggcttattatcattaactacaacatatggattatttccattatatgccggaatatcctcataggaaaactgtatactgtttgaattaacattattagcagacacatttgcaaaaagtttatatcctccaaacacaatcaacacaagtaatattatcccaattattttctttctcatttcgtatcacccttcttcattcctggtacctgtgccagaataaccgctgcaaacacaagtacacaccccattatctcttttggttttaacaattcaccaagtaaaatccatccggcaagcaccgcaaacactgattcaaggctcatgacaatagacgcaaccgaaggctgtgcgtatttctgtccaaccatctgaagagtatatgctatgccgcttgacaatacacctgcataaagtattggaacaagcgctgctttaattcctgcagatgtaacattttccttaaatatcatagcaaatgttgaaataattgcaataacaataaactgtatacaggacattttcatgctgtcagcacttgaaaatttatcaataaccagaatgtgtgttgtaaagcatattgctcccaggaacacaaggacatctccaagatatattcctgatacaccaccagacatacataaaagatacattccggcaacgcatcctgcaacagaaacgccggttatccagtgcattttcttacccataaaaaccgaaactaccgaaaccataacaacataagttgctgtaataaagcctgaccttcctgatgccgcgaccccttgtggatatacacttattccatactgctggaaagtcatcgctgcaaagagaacaattccacatattatgcctgcacccagtggccatgtctgtaaacggcttccattctctgtactaatcactttccctgaattatttcttttatccaatacatttttaattataattacgactgccagaaatagtgctccgactatagaccttgcagcattaaatgtaaatgttcccactgctcctgcaccacttgtctgtgcaacaaatgccgttccccagataaatgcaacaagaagcagtatcaggcttccctttatattattcattgctcttacccttattaatatatttgatacctgtaaatgcacctataagaataactaaacctataataagaggaacaacaggattctgtacaaatcctgcaataacatatgtcacacaagaaataactgcaactacaattacatatggaagctgtgtagacacatgattcatatgattacactgtgctcctgccgaagccataattgtcgtgtcagatattggtgaacaatggtctccacagacagctccagccatacatgctgagattgatataatcatcattgtatggttcgttcctgaaaatgtatttacaacaataggaataagaattccaaatgttccccacgatgttcctgttgcaaaagcaaggaataccgcaaccagaaatataactgccggcagaatatttaaccagccacccgatactccttttacaagtccggcaacaaactccttagcgcccagactgtctgtcattgctttgagtgtccatgcaaatgtaagaataaggattgctggtaccattgccttgaatccttccggtatgcatgagcatgattcattgaatgaaagtacccttcttactgcatagaacacaattgttattataagtgcaaagaaacttccaagcataagccctaccgaagcatcacttcctgaaaatgcatcaacaaaacctactcccttgaaaaaatctcctgaatatagcattccaattatgcagcaaactataagtgtaataattggaaacagcagatctaacactcttccgcgtcccttaattacatcttctgttgcgttagcatatggcctgtcaggagttgtatacaagtctcccttagctgcatttgcttcatgaactgccattgaaccaaagtcaacctttaacgctacaataagaatcattgctgcaatagtaaataatgcataataattgtaaggaatagccttaataaatattccaaaaccatcttcgccctcaacaaaacctgttaccgctgctgcccatgaagatataggcgcaataatacagattggtgccgctgttgcatcaataagatatgcaagctttgctctcgaaacattatgcttgtctgttactggacgcataacgcttccaacagtaagacagttaaaataatcatcaataaatataagaattccaagaagcaccgtaacaagctgtgctccaactcttgtcttaatatgtcttccagcccattctccaaatgctgcagaaccacctgctttattcatcatgcacaccatgattcccagtacaacaaggaacaccagaattcctacattgtaaggatctgacaatactcctacaagaccatcttcaaatatatgaagaactgatttttcaaaactgaacccgctctggaaaatgtttccatagaacagtcctcctattacaattcctacaaaaagtgaactgtaaacctctttggtaattaacgctaatatgatagcaaccagtggtggtataagtgcccagaaggttgcatacagattaggtacatactgaataacttcttccattgtatctctccttaataaatgtatatcctacactaattgtgtattctgctttcactgcaagtaaaatatataacctgataattctttgcaatctcgtcgagaagcttcatagcccccttaatgttattatcatcaagattgacaaatgggtcatcaaatataagaaatggtttctcttctttatacattgcctcaacaagtgccattcgcatgcatactccaaccagatcctgctttcctgcactaagatatccaatatctcttggcatattctgctccatgacagtaagctttgtatctgcatcaagattgtatgcatcaggctcacagccagtaagtatagtgtaatacttcctaaagcctgacataacaggtcccatatattcagaagtaaaagactgctttgaatcctccataatctgtttagtaagcttcagcaatctctctttattcttttcgctttcctgaatatcagtaagccggttaagttcctgcctgcagttttcacactcatcagcctgaatctgaagattctctaattgcttattgcactgagatatctgttgtgcatattcttcaatcatgttgtcaatccgtgtcatatctgacgctatatcttccagtgaaatcttatcagcatcattttgtgcagtgaacatactgatatcattctctgactcaaaatcagctttaatcatcattgctttatcatactcacttttagcacgataatatccatcaagctttttgtcaaggtttctaagtgtttctccaatactttcctcacccttaaagcctttaatatattttctcagaaagcatttaatacctgacatattctgctcgtactgatttctatagatatcctgttttgatatttcttgattaattcttttatagtccgctatgtcatttcttatacgttcaattgtcagactataattattaccattagcggcacaattatactgtttcaaaaatacatccagcctgttctcaagctgttttatctgttcagataattcgttgtcctgagcggccgcccgtttctcaagttcacgataatcttctatatcatgacataaacccgaaagctcccatgcaatattatctctgctaaatgtaatctcatattcttcacagaactgccttacaacattctccgttccgctgataaaattcttatcatcattaatatccgcttcaattgccttaagcttattatcagattcagcacttatattcataaattcactatcatgctgtttcttcttcacggttccaatcactgaaaatactactgccatacacaagccgacaataatcatggcaattccaacttccattacaggcacaacaagcacaccacctattacagccattacgattcctgctataattccaggcacacatgaatttttatataacttagctctttcaagtcttgcttgttcattctctcttgcaagatccagcttcatttccttgccaacaatagaattctgcttgttctgtgctgagatccagatatcatgaatcttaccgactttgttttcatcgggaattcctctagcaaaccttttcttatacccttcaagtttttccagttcatcatcagacaaacggttcttagcagcatcttctttgagttcatctaattgtcctgcagcattctgccattcatcaatagtttcactgtcaggaatcccctgttcaaacatacctctaagttgttcaagccttttactgtcataatcatcaatgtgtgtgaattttccacttaatattcctgcttcatcaaagatttcaatctgcttgtgcacatcttccttttcaggcagttccccattaaagtaatgttcatattgttcaaatgcgttcttcttattattacattccttatcaagcagctgatacttctctttcaatgcctgtatatccttctgcacacttaaatgcttctgctgttcctgcattttctttctgtcagctctaagttcttctctcttagcacacagattatctcttatatctgtctgctcttcaataattctgtctgtctgtgaataattgttaatcctggcagcaagctctgttattcttgattttctcttagatatagatcctgtagacctcgtacttgttatattattaagcaccgcggtcagtcttcccacagcagtttcaaaattattaatatcatctgtattatctgcaagatttccaatcttagcattaatgctgtcagtagttgccgtaacacaatcactctgacctataaacacagttctctcaaaagactgtgcatctatcttgaacaattcttctccaatataacacgaaaaatcatcacattcaacattagtgtcttttcttacaagcaggaattcatcatccgcctgcttttttccaaaggttcttctaagtgaataaaccactccaccagtttcaaatactatctcaccaccataaacacccttctgccacggcataagacgatttctttccttatcgactaatttcttcttgctttcattcttaaatccataaaacataacacggataaaggatgcaagtgtactctttccccagccattatcctcacatatcgtattacattcaccagagaaatcatatgtaacattattcagttttccaaaattttcgattgtacaactgataagtttcatcagactatctcctccccctgcaatgcctgtaatccatatcgtataattacagctttatcttgttcattgatatcgtctctccccataacatttctaataaattctcccttaagtgaaacatcatgctcataagacatataatcaaccctataagcggtgcagtcctttatcttaaatgcataaaacctgttctcaaactgcttacacagatagtccgtatctttctcacattcaacatccaattcacctgtaagctcaagcttaaccagactatctttcgtaaaacctgcattgttaagaaaactgcttaatttctgttcaatttcaaatgtgctttcacaccctgtaacatcaacctgtgcaacataaatatttcttcttgcaaatggaacaaaatatgtatcagaacttccagaagtttcatcaatatcaagcaccacaaaaccatgttctccagcctcatcaaagccccttccctcaaggcatcccggataacaatacactcctctggcatccagcctgtcacttgaatattcatgcacatgcccaagtgcaagataatcaattccacggtttcttaaatccttaagacttattatctgtgcgttattcttagaaacatgagaagcctcctgcccatgcagtacaacaatattataattgcctgcattgagagaaaggcttccatatatcttaccaacattatcactgtcaagttccacgccggtaataacgatattctttgtaacaccgccattattaattataccggtattgtaacttgtccatccttttccaaacatacgaagattagcaggaatctcatccagatacgacacaaagcttccattgtcatgattaccctgcagataataaaatgtaatacccggattgttaattattatattatatacttctttctttgctccgactgatatgttccttgtatcaaacaaatcccccgcaattataataaccccgatacactccttcacagcatatccaaccatatccttaaaagatgccagcagctcactcctgcgttctcttgccttatctttatcaagattagccgtcatcgctgaatccagatgaatatctgcacaatgcaaaatcttcatatcttctcaacctcaactaataaatactaattaatgtgtagaatacgctccttcaacatgaaccatctctgttgtttcattctggatatatattctgtatgagccgctcattgtcagctcaaatacgtgtgaatcattgccattggcaataatatatcttttagaaccatcaggctgtataattcccgctcttacgctatgaaatggttctaccgaaaatacacttaaaactatcctctgtccagaagatgcatgaaagcttgatgttgacctccttacaccggcatatacatcccatgagattgtaccatttgaagcgcatggcattatttcatcaggattaacatcttcttcatacatgtctgtaacagctgaatcttcataatcagcagcctcataatattctgtttctaatacctgtagctctcttttttcatcagcagttaactccgcaaccttaactgatgtttcagttacggttgtagctgctcccgccaccataacagaactcataataacaaataaagtcagtatagctgctgcaacagccattggtcttttcttaacataataactcttcataacatgctccattctttctcttaaactgcttttattttcatacagacttgcagacagcatgtcataaagattattatttctcacagcaatattaaatattgtttcataatattcatgtagtccattctctgacatacatacagaaaagtcacatgcatactcagcatatttaataaatcttctgtaaaaaatccatataaccggattaaagaaattaagtatacttgccaccgcaagaagatatctgaaccatatatcattatgaaccacatgtgtaagttcgtgtgcaaatacaactctcatctctttctcagaaaaatgatctgcattaacaacaacacacggtctgtgtattcctgtcacatatgcagtagttgtcctgtatgactgccttaatgtgattttacattttccaagtcccatctgttcttttatctcacagaaaatcccgttcatctccttattacaggcaaacgattctttccttattgataaaattctgaatctcttaaacacataaatcattattgcaacagccagacctgttatccacacaatagcaacagctcttgtcacattaataataagcggtgatgtatcaaatgcgtaacaattccacacgaaccttaatcggtcaatcattcttattgcgtaatacattaccggaattatccagaacaatacaacaacttttccaagtctgtatgacatattaagatatcctgtcttatcaagtaaatatgaagttataagccatgcaacagtaagtacgctacccgtaaatgtagttatgacaatcatgtaaaacaaatctgtccatagcataatctgctgcactcctaagttaaatatattaatccgacatataaataaatatatcacatttttatataaaaacatagaacttctttgtataaaatggtatacttaatttatatttattgttcgtattaatcatatatacagaagggagtatttatgcaatataatgtcaaaaaatgggggcttctccccgatggtacaatgtgtcatattattcagctttcatataatgacatatcgctttatgtttcagactatggtgcaacattccagtcaatgttcgtgactgattcagctggtgcacaacacgacataatccttggttatgatacaccggaagaatattattatgaccagcagaacttcggcgggacaatggggcgattcgccaacagaattgcaggagcatgcataactcttaatagcaaagactggcatcttcctgccaacgaaggtaataacactcttcacagcggacacggcttcaacaaatgtatgtggcagtatgatgttaatcctgaggctctcattctcacacttaacagcccgcatctggagaatggattccctggaaatcttaaagttacccagacaattactattactgacaggaattcaatacttgtgcattatgacgcagtatcagatatggatacagtatgtagcttcaccaatcatagttactttaatttttctggggtaaagaacgtctgtaattatatagtatctgtaggagcagattactacacccctgtagacagcagcaacatccccacgggtgacattctgcctgttgaaggaacaatgtatgatttccgtagaccaagaagagttggaacagattatattgatattaattacgttctctctgatgcatatgaatatgccgctaaagtaacagatcccgaagcaggtataagcatgtctgtaaagaccagcttcccaggattgcagctatataacggtaattatataggtaactgtactggtaaatacaatttaccatataacgatcagcatggcatatgttttgaacctcagtttttccctgactcaatgcatcataataactttccgtcccctgttcttaaagccggagagcatcttgacagatatatagaatacattttctaaacagaaactgcattaccaaagcgcacgacgcaaaaaagaaccgcccctgaaatcaggacggttctttttaatccaaaagcatatctaacctttaacaccaccaagtgtaacacctcttacaatgaactttgaaagacagatatatactataattaccggaacaatagcaaatgctatcatcatatatacctgacccatatcaaacttcaggaaatctgcactacgaagctgtgctattaacaaaggaagtgttttcttacttgccttgttaataaggagtgaaggtataaaataattattccatgatgatacgaaagtaaatatcaactgaacagccagagctggcttcataagaggcagaacaatctggttaaatattctaaactctcttgcgccatcaattcttgccgcctctataagttccattggaagcacactgtccatatactgcttaataaagaagaatactacaggcgctgcgattgaaggaacaataagaggtatatatgaattcagaagtttccagtctccgatcatcttaacaaatccaagtgctgacacctgtgttggcaccatcattacaagaagaatgaatgtaaatgcaaacttctttagcctgaagttatatgcatgaatagcaaatgctgtgagtgctgagaaatacactgacagaactgctgaacatgctgcaacaaataaactgttaaacatacccttgataacaggaatattctcattagcaagaacattcttcatattgactataaacgactttcccggaaggaatgagaatcctttctggatatcggggtgtgatcttgttgtattaataataagtacatagaatgagaaaaggcacaagaatgttataagaataagcacgatataacataacgctctctccgttgtaagtattatcctgtctttcactccagcattagtgcctttaatatcggcacttgcagaggctttacttgaattactcatattacttcgcctcctttgcttttttcttcttagcttttcttattcctgccgcttccatatccttagttatataattaaatacaaatatactaagtactgctgttacaataaacagaataactgaaagtgcacctgccataccataattcttactataaagatgcttattaagatacatgataaccgtcatacttgttctatccggattaccattaccattagtaagaatctgaggaacatcgaacatctggattccaccaatcagtgatgtaataagtgtgtatgccagaataggcttaataagtggaagtgtaatctttccaaatatctgtcttgaattagcaccatcaattcttgctgcttcaaaaaggcaagggtcaacgcccataatggcagccataagaattattgttgtattaccaaaccacataaggaagttcataagagcaatcagtcctcttgctcctgctacctctgcaaggaatctatatgtaggcaatcccatactgttaagcatgttattgattggtccctgatctgcaaatattgcgtagaataacatggcaaatgcagatgccataatcaaattaggcatatagattatagttttgaaaaatcctgtacattttaatcttaatctaagatctgtaaaccatgacgccagaagcaatgatataagaatctgcggaataaatcccatcagccacattatcattgtattcttcagatagagcaatgtatcaccgttaaacagtatggccttgtaattgtcaaatccaacgaacttaggtccgacctgcataagtccaaccatatagttctcaaaaaaactattataaaatgtagatatcagtggtattaatgaaaacacaatatatactgcaaagaacggtataagaaatatgtatccccattttgcatagcttacaaactttttcttctttttattcatacatatctccattcctgccatataaaaaggcacagccatataacatacttattataatgactgtgccttaatgactagcaattactaattactttgaaaggtttggatatttctcaatagctgccttatagaagttatcaagagccttatccttagttacattgccatcgaagtaatccttcatagccttctggaattcttcgttaagaccctggtcataagaagaaatattcttcatgctgatcttaggagctgacttagcaaataacttaatatgattctgaccgccaaggaaatctgacttgaagttactgctagcgatttcattcatacctgatgttgtattagtgtaatcctgagtatcttctgtaatcttcttcattgttgtcttatcacagcaaagtgtcttcataacatcttttacaaggttagcgttatctgttcctgctgctgcacagatccatgtaccaccccagtagtagctctgtggaccttcacatactgcatagtcgccgtagataccgttaccaacttcttccttaccaccttccttaacaggagtagcaagtgagttacctaaaagtgtaaagttaattccccatgttgagtagaagaatccgaataccttaccagaaggtccctgatctgctgcccatgttgaatcccaaagagatgacttattattatagcccttatctgtatatttcttagtctgatcaacccacttcataatgttatcatcaataacaatcttgttattagaatcaacccaaggagctgatacattgttagagaatactctgtatgaatcatcataacctgaaagcatcttgtagcccttagtagcagcctgttcagctaccttatcaaacttatcccaagttgaaagtgcttcctgaaccttatctggatcatctgttccaagaacatccttagcaatagaacgtctgtaagcaaagagtcctggagttgcctgccatgttgtagccttaagttttcctttgctgtcagttgcgatatcctttgtgtactgatacatgtccttaagatcatcatctgtaagacctacatcttttacatcaagtgtgtaatcactgttaacatactttaaagcataatcagcttcgataaggaacatatcaatcttatcatctgctgctgcatccttctgctttaataatgcagcatcaagagcattctgataagcgttgttttcgttaggagtaattacccagtttaccttaacatctgaaggaacattcttataatatccttcaaatctgctcttaaactcatcgttccagcagtaaatgttaagtaccttaccctgttcctcaggcttagtattaactgctgccgaaccaccatcctttgatccacaacctgctaatgtggaaagcaccatcattgtaccaagtgccagacttaataatctctttttcataaaaaaccctccataaatcttagacgacacctttagtttcctattcttttaattgtttccccttcgattagttccgcatctacaacaaccctctttactatcgttgccctgggattctctatagcacttataagctcatctgcggcaatcctgccgatttccctggtgttctgacgaattgttgtaatcttaggatttaacatctgcgagaatcttgttccatcgtaacctgcaacagacacattcttcggactatgcaatttcatattcttaatagcattcttgcctccaacaacagataaatcatctggataaaaaatacatgttggcggttcctttaattttaacagctcatatgtaagcttctcagcttttatcgaatcaagataggttgattctttaatgtattcatctggaacttctacccctaattcacccattgtcttataaaaggctgccagacgttctttcgtaacctctgattcaacgtttccataaatataagctatctttctgtgtcccctgctgtacgcgtaacgtactaattcactcatccctttcacgttgttagaattgaccgatgtactgccattgaaaatgtagtcgatggtcacaactggtaatctcccgttaaccatttcatagatttcaggattgctgaaatcctcacaagctacaagcacgccatcaaaattcctgtataaacagtgttcgtagaaagtcatcttcttagagtgattgcttacaaatgtaatatcataccccttcttctctgcttcattcttaaaactctcaagaacctcggcaaaatactcatgtgcaagaccattattaagaagaactcctatgttatatgaacggttcgtcttaagtgctctggctgctgaattcggataatatccaagtctgttagctgcctctttaactttcctgcgtgtctcttcactgatgtcactatggtcattgagagctttacttactgtagcaattgaaaccccacattctacagcaacatctttcatagataccatagattcattcctttcatgcattacttaatcgttttcgtagctttactataactcatatcagatataaatgcaagtacttttgtaaattttacttattttcctgtatattatcgtattttttgtgcatttctaccaattcttattcaaattcaaaataatcattgatttaatccaagccttaaaatatacttattactataaaatcaatattagaacttgtaccttaatgcacttaatcgttttctatatattatatgtgtacaggaggtataatatgcaattcggtttttttgatgacatcaataaagaatatgtcataaccacaccagaaactccattgccatggattaattacttaggctgcgagaattttttcagtcttaagagcaataccggcggaggatactgtttctataaggatgccaagctgctccgactcacaagatatcgctataataattctcctttagataacaacggccactacatttatattaaagatgaggataccatatggaatcctggatggcagccatcccagacaccagttgaggattatacatgtcgtcacggacttggatatacagtgatttcttcatctaagaatgacattaaagctacacagactgctctcgttcctattggagataattgtgaacttgataaacttactattaagaacacaggaaattctgttaaacatttatctgtatattcttatatagaattctgtttatggaatgcagttgatgactgcaacaacttccagcgtaacttcagcacaggcgaagttgaagttcagccagagattaatattggcaccgctgccatgtcagcaatatatcacaagacagaataccgtgagcggcgtaaccattatgctgttcatgccgtcagcactgctgccaacggtttcgatacaagcagagaaagtttcatcggtacatacggaagtcctgcaatgcctaaagctgttaaagaaggtatatcttataattctattgcaagcggatggtcacctgttggatctttcagaatcgatattaaccttgagccgggcgaggaaaaagaatatgtattcattataggatatgcagagaaccctgatgataagaagtgggaatcattcggaatcattaacaaagaacctgcatatgcccttcttgaaaaatacaacactccggcaaaatttgatacagctcttgctgctttaaaagattactggactcatcttctctcgtcttatattgttgacacagaagacaagaagctctgccgtatggttaatatatggaatcagtatcagtgcatggtaacatttaacatgtcaagatctgcttcctattatgagtctggaaccggacgtggtatgggatttagagattcctgccaggatttacttggcttcgtacatcttattcctgattcagcaagacagagaattcttgatattgctgctactcaatttgaagatggaagtgcttatcaccagtatcagccattaactaagaaaggtaattctgatattggttcaggctttaacgatgatcctctctggcttattgcaggaacagctgcatatcttaaagaaacaggcgatttcagcattcttgatgaaaaggtagcatttgactgcgatacaagtaaggcacagccacttatggaacatttaagaaggtccttcaattatacaactactcatcttggaccgcataagctgccacttatcggaagagctgactggaatgactgtctcaacttaaactgcttctcttctgctccgggtgaatctttccagactaccggaccatcagaaggacctgttgctgaatcggtatttatcgctggaatgtatgtaaaatatggcaatgaatatgcagacatatgccacatatcaggtctttcagaggaagaaaatgctgtacgttcccatgttgatgacatgtataaaactgttcttgatgcaggctgggatggtgaatggttccttcgtgcatatgatgccgaaagccgtaaggttggttcacatgaatgtgaagatggacagatatacattgagccacagggcttctgtgttatggcaggtataggtgtcaaagaaggactcgcacagaaagctatggattcagtagaaaaaattcttgatacaaagtacggaattatgattttacaaccagcttacaggtcatatcatcttgaactcggcgaggtatcttcttatccgcctggatacaaagaaaatgctggaatattctgtcataataatccttgggtatctattgctgaaaccgttattgatgataaaaacagagcattcgaaacatacaagaaaatatgtccggcatatcttgaagagataagtgagatacacaggactgaaccttatgtatattcacagatgattgccggcaaagatgccgcaagctttggtgaagccaaaaacagctggcttacaggcaccgctgcatggacatttacaagtatatctcaatatatacttggtgtaagagcttcatttgaaggactcaccattgacccttgtctgcctgattccattaagaatctgacaattacaagaaaattcagagatgctgtatataacattactatcagcaatgagaagcacgaaagagtttcttctcttattgtcaatggcagtgaaatcagtggcaacactgttccatataataaagacactaaagtatataatgtaactgttaacatctgacaactataaagaaaggaattattatgtttgataagaactttttatggggtaccgcctctagttcctatcagatagagggagcctttaccgaagatggcaaaggtctttctatctgggacacattctctaataaaccgggtaatattgcacatgatgagaatggcaataaagcatgtgaccactatcaccgctatcgcgaggatattgcacttatgaaaaatcttggtattcaggcataccgcttttcaatttcatggtcacgaatatttcctgatggaattgttaaggattctgacggcaatatccgctacaacaaagccggacttgatttctatgataagattgtaaacttatgccttgaaaataatatcaaaccattcataacgatttatcactgggatttacctcaggcacttgaagataaaggtggatggctcaaccgtgagacagctttcgtatttgctgattacgctgaattcatatgtaaacatttttcagaccgtgtaactaatattgctaccatcaatgaaccacagattatatccggactcggatacatgcttggacttcatgctcctggcaagaagcttgacacagtatctgtcctgtctgtaatccaccatcttgcactcgctcatggtcttgctgtcactaagatgcgtgccgttgcaaaacagcctgtaaaaaccggtttttccagcactggcgacttgtgttttcctgcaagtgaatgtgacgaagacattgatgctgcaagagctgaatgtttcaatattgttaaaggcaacatgacatttaaccacactatattctgtgacatgacatgccttggcagatatcctgacattgctggtacagaattacatcttgaacctgatcttgaaaaaatcggacattatgaagaactgccattcgtaaaagatggcgatattgaactgatacatcagccaattgactatcttggcataaatgtatataacggacatgaaataaatgcagccggccatattaacaaaaaaccaggcagtccacgaacagctcttggctggcctgtaactcccggtgttatgaattatggtataagatatctgtatgaaagatataatcttccaatatatatatttgaggatggacttgcctgcaacgatatcataagtcttgatggcaaagtccacgacagcaaccgtatcgactttctgacaagatatctcacagagcttgagaaagcctacaaagccggtgttccaatactcggctacttccactggtcattcacagataatttcgaatggcacagcggctacgacccaagatttgggttagtattcgtagactatgaaacacaacagagaattcctaaagattccgcttattggtattctgatttaattaagaagtcatccaactaaatattggtattcataagtgtgcatgacgccgtggcatctgtatatatgacatgttctcatggattcctgcatctagtgtgagtaaatgctgccatctatagagtttattacagtgctggaaatcaaacgcgcttcgcttgaacgagatttccagcactgaacttttatagataacggcattaactcacacacgattcggaataaatcgaacatatcatatatacagacgccacggctgttattcacttcatatacggcaattcattaggatatgcatatatagaagtacctcggcggttgtacgccctcatgcccataacccaatttaatcattcctacgattattaaagtacacaaaattatcaattgcatcgaatatatcatcaaaattctcccttggagctgcgtctatgtatgcttttagaattgcattttctttctcgcccttgtaacgtccatagaatatgtcatacaggttatgtcctctgacatattttctgatattctccatgttgtctatgatgtcctgtcttgtctcaattgttatgttcagtttttctaacatattcttagtgctgacaaggcggtacaggtattctttatatttggcatataatatatcatagaactggtctacactttttacgacgcctattttagtcattatctcagggtcaagaaaataattctcaaatgaataatattttaatataagcacattacggtctgttactcttggcagattgccataatcctgctttgcacgctgcttatagtaattggtaagctggtctcttaaacggtcagcatccttaccatctccatctcttatcataaggaactcatccttaagatataatgtatttatatatttcagattggcataagtcttgatgtttgtacaactgttagttgcaattatcgctatacgattgagattgccattctcatctataacttctgaataatatttctccagaagtagcggcagacggcttctgtcctgttttccttccactataaatacaaagctcacattcataaggtcattagcagcatacccaagatcatctaatatatcatcaatatccgcctccggagtagcaactgtattattatctctatcgttaatcacctgacgaatctgtcttgtagtaaagttaaataacatctgcggtgaatgcgtgcagaatataacctgattctttcttgaaagcttgtacagaatttcacttgctatcttctgtaactgaggatgaagatatatttccggatcttcaatcagaataatgtatggcacagtacttccatattccgcataggtttcaagcagtgacaggatgtagatactgttcagtccatcagaaaggtcattgacatccccatcagtgtcacgcatttcattgtgaacaattgtatcaacatgcatgagtttttctgcatcaaatgtaatctgataatgaattctttctccaatgccaccattgttcttaaatttttcattaagtttgttctcaaaattagcaagattaaaattaaacagcttatactgcataagtctcgctgtttctaataaagataactgttccggtttcttgcggttaataattcctatgcaattaaagcactgattacacatcttatgcttatcaaatatacacacgttatctttaaggtctgcatattccgttccaccctgcagcatgataagatcttcctgaattgatgacttacgtctctcgtggtcaacatagaatattctcggaaggactgtttttatataaatattgttcttcttaactccgtccctgtacttaatcttaccatcacggctatatacatattcaaattcaagaataccatcctttaacgatggaagtttattgcaaaaatccttataccacaagtcataatgcttaaaagaactgacctgtcccttctgatacaatacagccagatcctcatcttcaatactgatgcgaactgtaatgcttatattaccttcgttatcattgaaatctcttaatgaaacttcataatccccggtaaccgctcttattgcgtcaagaaccacactctttcctgcattatttctgccaacaagaatcagtacatcttcaatatcattaatctcaagttctctgattgatttaaaatttctgattaaaagatattctatcctcatacctgtcctctgccccctgatacatttctgccagcatatattctggtgtattatcattaaatgttgatattcctttacccgtattaggattctttttggaatataccatatccacaacaaatgcaactatcagtgccgcacacactgcaccaacaaccctcagcttaatctttctgaagaaattatcaagaagcggtgcaataatatatacgattgcaactcctccaagtccaaatactaaaagaccttcagcacatattcttccattaaggttaagaaaatacccgttataattccaccatcttcttccgcagctgatttccagatacagcgatgtaaaatattcaacaaatccgcataaaactactgatgcaaagaattccacaacaggcttatttcttaattttttaagacatatcagtatgagtatcccacctgaaccatatataggaagccatggtccatgaagaacacctctgtttacaaatgtatgtgacgatatcagatgaagcgtaacctcccatatccatcccacaaaacataatgaaaagaatatcagtataagcgatggtattgaataattacgcatatacactgtattttcaaggtcaactctgtgttccttaagattgaaaaggcgggcaggataggcttttccaactgcttctgctttattcttactcatacgaagcatttccttctttttttcttcaaattccagctctgccttgctgttaataagtattatgccaaatgtgttggctaaaaatactcttaatttcttcaatcttcttattctcgaattgtggtaatcatcaaaatcaatctgtggctgtggactatctataagtttaaatacatctgcatatacatttttaagctgctcttctgatggtctttcatacagatatgaatcattaagccactgaaccgcctccggttctttttcaagatatactgctcttacatttgcatagaattctgcataaaatgcagctttataaggattcacaaacagcactcccgcaactcctaatgttgccattccaatcactgtccagccaacgaatgataatccatagagaaacgccaaccatttgtagcctttcatcatctttcttgataaggttatagcctcatttgccttcatatcaggattctccgcgataatgtatggcacaagcatgtatgaaaaatgcttcacaaatatacccacaattgtaagtgaccataatatttcatatacattattgacaataagcacccacgatgccttcatccacctttttacccggagaagaaacatgaactttccaggtggaacagcatcatatgtgcgcgtttcaagcactattcttcttgatataacaagataagttttcttgataaaaaatgttataaacacatataccataagtgccgctataagaagtataagcactactgctcttcttgaacttatgactgatgatagtgaatccacaaatgtaaatacaattccacctgatgttatagcattaactaaagatgcaaatactcctcttgttctgcccaataccttggttgcattgtctttggcctctgaaaccttcgcatcagactgcgtccttccaaaatcatcgtcacccgtgattactgcgcccattgcctgaaccactgaacttacaaccgaactgttagcgacagtatcaacatttgcttcaaccgatgctgcaccctgaatttcatcgttaactgttcctaaacttttaaaggcttccattgtctctgaatattcagagccaatgaaagccgcaaaaaggcagactgctactaacagccagtaatgtttttttaagtttttcttagcatttttagcaagttcttttctcttaaaatccatattccaacaatcttctttacttattaagtacagtcttgcgtactactccaagcggatctttaaccataagtatgacaagccatatgataagtccgaaagctacaactgataagcccaaaaatgcatcattaagcatatctgatgacgccggagtaaaatactctgcccccagttcaatatattccacaactgcatctaccatccacataagtgatgcaccccagtacataagcacaagtgttccaagttttaacttcgaacgcttatcattaatataccatataatagtagttataaccgctgcaaatacagctataagtaatgtcataattatccctccaatcctttaacttctgcttccttagctgctttcttttctactcctgaagctattgctaccatgccgacccacacagctgtaacaaccactgccatgccaacaccggcagttgccatctctttaagcatctgcacagcatcctgagcgttgcctgctgctgttaagaatggaaagaaaggagtaacttctccatgccatacatgctcgaatgcaagtaaagctgtaccaccccaaagcatattattaagccactttaactttcttgaaaatggaagcgccttttcttccttaactgcttctacagcaccttctgtctcgcacgaacatatttccttcttctctttcttttcaacaatcttagttatcgctgttgtaacgatagcttcagtacctggtactataaaacatgccatattaaattcctcctgattcacgatgtattttcatgtctgaaaatgcatatatttatatgtattttacctatttcacattggattgtcaaacattgtaaaatatacattttcatatatttttttctttattccctctgctgaatatgatatagtaaagcagatgggattcactttggaaaggagatgttcttatgaagaaaagctttaaaagactgttaagctgcatatttgtaataacatttttccttattggaatgtgcctcgacagggctcgtgtgaatattcctgaagtggactctttttctgtatcagaagctaaggtattcgctacaccaaaagcctctgtcagtgataccatgccatgtacaactgaaatgcttggacttgtgagaacatcaatcaccaatcttacagcagacagaagcagttcccgcaatgtattacgcatattccaattcttactttgcggtctgtgtgcagctatcggtatcagtatctatttcaaacagacaggcgtaatgcatgattctatcacatgcagcaccactgtcactcttaattatatccaccagactgacggcaaaaaataacagattatcattaaatcagaacattttctggtaatacattatttttatatattattagtaatattaaacaactatgtaaagaggcaataaatatgaatattttaatgataatcggtattattctgggtggaggtgtatctgttgcatccaccgttggaataactgtaggtattttcgggaccattgtatataaattttacagaaagcttcgtttcggaatatctatgttcgactaagtttgaaaggatgaataataatatgttaggtaatataacagtcggtatcgtcattgttcttgctgttgctgcctgtggacttggtgtgtggcttgacagagccaagtcagacagtcaggacaacagcactgacgcacagtctaagaattaaatgataaaggcggtcacatcagattctattctgatatgaccgcttttcttaccacttttacttgctttcatggtagctgttaagcaaatcttcaattctcatattaatattttcaggaaatgttgcatcatttccgattttaacccacaaatcaatgttcttatatttcttctctcccattgtattatgtctgtcctgcttcgaagatacttctatctttaccattgcacgcttctgctcaagtatcggaataagcacataatataatctgtcatctttaaatgatatgtatcccgcttcttttcccgaacgagtcattaaatacagtctatgcttttttattcctgccggaaacagcttcattccagctttgataaatccagattcaggtgacatttcaagcattgctccgacataaaatacatttgcagcatcatcaattgatgtaagaatatttcccaatgtatctgatgttgcagtaaactgctgtgctaacagatatgcaagttctgcctgatatatgattttgtattctgaatcatgcactcttcctgtttcttcatcaattctgttaagaagttcctcactacattcatatatactgcgcagaaacaacttaaaatcctcatctggcatccacatatatctgcctcgtgcaaccttaaatcttccaatgttgttgccattgtaatcttcagcataatgatacacattgcgttggcaaaaggcatgttcattctctggagctgtaaaatcatattcttcattttcctgatcagtgccataatatttctcatcatattcggaatatttataatcatatttatagttactcttcaatgattcctgcccagtctgattgaaaagaacagtatatgcttcattaatttcatatgcactgtatctatatacattttctttgtttgatttatctctgtttagcacagcatccggatgcaccatatgcataagccgtctgtaccgcttcttcaattccatcttagtaatatctgatctgacatcaaatattttatatgcctgctgaaccgtcataaatactgtattccttctacattttttctaagttatcatacaccatttttaaaaattttactatttttattattcctgttgacagttatattgttatagtgtactattgtgctagtacacaggtacgcgtcatgtgtacattacctattacaggaggagggattatggattataaggctaatacaccgatttatcttcaggtaattgatgacattaagagaagaattcttaccggagagattaagcttggcgacaaactcccttcgacaagggaacttgccgtacagtacacggtcaatcctaacactgctgcaagaatatacaatgaacttgaacagtgtggtctgtgctataccaaaagaggtcttggcacatttgtatcagaggatgtgcatctgattgatacattaaaggcagaactttccagtgaaatgattgagactttcgtttccggaatggcaagccttggtttttctaaagatgagattattaatctcattaagaattatcacgaataaaatatggagggatttaattatgctgcaatgtaaaaatgttactaaaaagtatatgaagatgactgccgttaatggtgtttccattgacttcatgccgggcagaatatacgctctgctcggctctaacggaagcggtaaaacaactttaatgaagatgatagcaggtctggtaaaacctacttccggggacatcactctttcaggtgttccaataggagtagaaactaagaaacacatagcttatatgcctactgaaagttatttttataactatatgagctgtgctgatattggaaaatattatgctgatttctttgaggatttctcacttgaccagtactacaactatcttaatgagatgaagcttacgcctgacatgaaagccagcaagatgtcatcaggaatgatggctaaacttaagcttgctgttaatctttcaagaaatgcatctgttattatgcttgatgaaccacttaacggtgttgatattgttgcaagagagcaggttatcaatgcggtaatcagcaaggcttcacctgataagattatcatcatgtcgagccaccttgttgatgagcttgaagctgttattgactacgcagtatttatcaaagacggtgtgattgtttcacagggagatgctgaaaatttacgaacagcttcgggcatgtcaatcgttgaccagtacaaacgcatttatgcatattaaaagggggaatcttcaatgttaaaattaacaaaatacgaattgagaaagaatcttctcggtataggaatcgtggcaggtattatctgtgtacttcaggctctgtttatgtttttctgcctgactgaaaatcttaactatacaagccttttcggaggacttttaataatagctgcctctgtaagttattttattgtatttatatttggagttgtaacatattatagagaactttcaagcaaaagcagttacctgatattcatgacacctaattcatctcttagcataattacatcaaagctgctctatacactgattattggaataggaatttcagcaatattcatcggctttggagttcttgatatattcatgatggctggtgtctttggtgatctggctgacgcactcaagaatttctcagaaatgttaaagattatgggtattgatgttgtcaatataattattaatattgtagctggaataatatcattccttatagctttcttcttccttatatcacttgcatactttgccataacactatcttcaactgccttgcagaacaataagattaaaggatttatctcagttatattattctgtgtccttgcatatgcaacaattaagatttcttctttgttgcctgaactttataagaatccagacagcttatcccaggcattaatgtcaagccttccagctaccatattccagttattaatggtggttgcatgcacattcggaagtgccgtgcttcttgataagaaggtaagtttgtaattcgtattcttgtggacggggatgttggcaaaacctactaaaagcttcatagaatttaatctagtaggtttaattcttacaattacatatgaattttgtttaaaagacctactatcttgatgttctcatcgaatatagtaggtctttttatagttattctgttgttcaaagacagatttcatatccaaaacacctactaaatttcatatatcattctatttagtaggtttccagacctaacactctatgccgcgcacagccaatcgacccactagtctcctgattcatctctatccagtaggttttcagcctgtaattccagtcttttacttattcttccacatagtcaaaagctacagtttccatgtgctcattgaacagcttattaaacactgcaattacacgtccaacgccaatcattgaaaggattgttccaaggccaagaagataaaactcccatctgataataagtttatttctgctcttcattcttaattgcctcccagagattattctctactttatctgtcatggaagataacatcttaatctcttcttcgctgaatcctttaaatattacatcatcaaccttattgaatattttaataacttcatcggccttttcatgtccgcagtctgtgagaagcacattccatgagcgcctgcttgccggattattttctctctttaacagaccatccttttccattctgtctaatgttcttgacattgtggtcacatccataagacaagcatccgccagctctttctggttcatagtcccatgtttccttaattccttaagaattcttggctgtccctgtccaaccgtaagaccaagttcaataaaaaatggccttatcagtcgtcttcgaagcatttcaatatcaaaaaacacatttttaatttcattatccataattacatttcccctcttatgcactgatttcatgcggtatacaacactgtctaatcaagctcaaactgtcctgtatacaactggtaatatcttcccttctgctcaagcagttcatcgtggctgcctcgttcaatgacttcacccttttcaagaaccattatggcattagaattccttactgtcgaaagcctgtgtgcaataacaaatacggtccttccctccattattgcatccattcccttctctataagccgctctgttcttgtatcaattgagcttgtcgcctcatctagaataagcaccggcggcttggcaatcgctgctctcgcgatagcaagaagctgtctctgtccctgcgaaagattgctgccatcagcagtaagcatcgtgtcatacccccgcggaagtcttgttataaatgaatcagcattggcaatcttagctgcctccctgatttcctcgtcagttgcatcaagctttccatatcttatattatctgcaatagttcctgtgaacaaatgtgtatcctgtattaccattgcaagagaacgccttaaatcatctttcttaatatcctttacatcaattccatcatatgtaatcgtacctgactgaatatcatagaatctgtttataagattgacaatcgtagtctttcccgctcctgtcgaaccaacaaatgctatcttctgtcctggctttgcaaacaaggaaatcttgttaagcaccctcttttcaggcacatatccgaacacaacatcattaaatcttacatcacccttaagttcaataagctcccctgctggcagcttccatgcaaaaaatcctgtcttatcagaagtttctgtaagggtattatccgcatttttaatgacattacacaaagttactttcccttcgtcaggctcctctgcctcatccatcatgtcaaatattctctcagctcccgaaagcgctgaaagtatgaaattaacctgctgtgtgaactggtttaatggcatggcactctgtcttacatacacaagatatgcagatatgctgccaaggtccatgattccttttattacaaatatacctccaacgcaggcagaaagcgcataattaaaatacgacaggcttacaattacaggaatcagcattcctgaatatgcaagtgcattagttgattccttcctgaagctctcattcatctcacagaatttttcaaaattctcctgctcatgattaaaaaccttctcaaccttctgacctgccatcatttcttgaacaaaaccgttgatattgccaagctccttctgctgtctgtgataatatttcttgctgcgtttaccattgtatttgataaagataaacataagaataagaaaaacaacaacaataatagtcagccttacacttaataccagcatcattgttatagttccaaaaagtgtaagaaagctctggattaccatcgcaaagctgttgttcatcgcttcctgcacagtgtccacatcattggtgaaatgactcataatctcgccatgtgtattattgtcaaaatattttaacggaagcttctgtgtatgcttaaacagatccattcgaatctcacttaccaccttctgggaagtatgcaccataagcctgttgtagccaagcgttgacagtgcgccacacgcatacattacacccattccacacacagccataataaggcctttaatattgcccggcacaataaaattattaactacaggttttattaaaaatgttcccataattcctgcacctgcacttataaatacaagaattgctataagcaggaacgcccatttataatgacccagatataaaaggagatgcttaacagtctttttagtgtcctttggtcttttatatccaacatacttagccattaaagatcagctccttccttctgtgattcatatatttcctgatatatcttattagtctttaacagactttcgtgtgttccgattgcgtccacacgaccgccgtccataataattatctggtctgcatgacacactgacgatattctctgtgcaattataatcttagtcatatcaggcagcttctttgcaagtgcatttcttatctttccttctgttgcagtatcaaccgcactcgttgaatcatcaagaataagaaccttcggcttctttaatattgctcttgcaatacatattctctgcttctgtccgcctgatacattaacaccttcctgtcccatctctgcatcaagtcctccagggagcctgtctatgaattcatcaacacacgctatgctgcatgcctctttaatctcatccagagtcgcattttcatcgccccatcttaagttatcaataagtgagcctgaaaacagcgtattcttctgcaatacaactgagattgcatctcttaaatgtctaaccggatattccttaatactaattccatctatcttaatttcacccttacttgcatcataaagtcttggaataagctggataagcgtcgtctttgatgaacctgtctggccgattattccgactgtctgtcctgcattaatgtgaaatgaaacatctgacagcacatattctttagcagtatccttatatttaaaccagacatgattaaattcaatctcacccttcttaacttcaatgtcctttgcattctcatcagttatatcaatcggctcatcaattaccttcatgattctttctgcagaagcaagtgaccttgtcataagaaggaacacatttgacatcatcataagagaattaagtatcagaagaacatagctcaagaaagaagtaagctgtccaatcatcatctgtcctgaattaatcagtcttccgccaataagtagaataccaagaattgtagaatacataacgaactgcatagcaggcatgttaagtacagctattccaaatgctttctctgattcatttttcagattatcattaacattcctaaatttttcaatctcgtagtcaccacgcacatatgatttaacaactcttactgctgtaagattctcctctatacacctgtttacaaggtcgactgctccctgcattcttccatatcgtggaccaacattaatgattattatgatgagcaggactgccagaactggcagtgctacaagaaagaccagcgccagtgttgaattaatctggaatgccagagtcgttgcaaatatcagcattaccggacttcgtccaaatggacgcattcctgtcgatacagcattctgaatattggttacatcacttgtgagtcgtgtaaccaatgacgaaacactgaaatggtctatattagaaaatgaataaaactgaagtttcccgtactcagcctttcttatattagcacccagtccctgacctgcaagtgcagaaaatcttgcacttcccacacctaatataagtgcagcaactgcacatacagccatctgtatacctttatttattatatatggcacatctgaattggtcacacctatatcaatcaggtcagccatcagcttaggcaccataatctcaagcacgacttcaacacctatacatataagcgccagccatgcgtatttcttatattctttcatataagaaaaaattcttctcaacattacttgcacctccaattgttgtatatgcaactattgtatttccaagttcaagcaatgtcaagaagacatttttataattattttacatttttcctatataccatataagaaattacggatgtaatcacctctgtaatccagaaagcatgccatacgccaacagctccgactatccttgacattatgaatgcaacaggaattattacagcaacatatctgcatacagatataataagtgacggaaatcctttcccaagtccttcaagtgcacccgccgaagtaactgataccgttgatacaataaatccggcacttattattcttaacgctgtctcgccggcacttattgtgtctggattatttgtaaacagaccgataagtgaccccggtattgcaagacagagaattgtacctgctgccataatagcaaatataagtaccattgatgtcttatatatctttcttactctctcatgctctcctgctccatagttatagcccataagcggtctcattccctgtacaactccgttggccggcagatacagaaatgtctgcagcttgtaatatactccaagcacgaatacatacacagccgagtacgcagcaagtattacattaagcaccgatataagaatagatggaagtgcaaggcttaagcttgccggcataccgatagaataaagtctctttgccatcgaacgttctattctcatctccgattttctgaatttaaccggaataggcttaacaatatatattatgatatatagcactgctgccgaagtctggcctattcctgtcgcaagtgcagcgccttctattcccattgcaggaaatggatctattccgaatatcatcatcgggtcaagcacaatattaactatacagcctgtcataaggcataccatagaagcattcattcttccaactgcctgaaacaccttctcaaacataagctcaattccaagcattattgaaaatgcaaatgcaatattggaatatttaagtcccagtgaaacaatctctgcatcttttgtaaacatttttaagaataccggcatacccgcaatacatataacggtaagcacaacagcgtgtatacaacttaggagcatgccctggctggctgctttatctgcctgcttctggttctgtgcgcccataaaaaatgatatgaccgcatttattcctattgcaaatcctatcataaccgagcttataagattctgtaccggaaataccagtgacagagctgtcatcgcattttcacttatcttggcaacaaagaagctgtcaacaatgttgtacaatgaattaaccatcattgagattaccattggaagcgacatttttaataacaatgggagtatcttctgctccttcatatatgtctgattcatattaactacctgtccttttcgtaaaaaaagagccaacaagtggctcttttttaatgatacacgataatatttaattattcaaccagattctttctcgtatacataagcagttccattataagtatcagtggcattgtgaatatgcaccatactgattctcttaatgcttcaagcatacagattcttactatcgttccccttctcatccccagaccatgaagcagcttatatctttcttttctgcgttcaatcctgtttcttacaatgattgccattataagaagctggattacaactgccgctgctattgttattccatattgaagaatattgttgataagctgtgttctgtatatattctttgcgtcaacattagaaccatatgcaaggtcattattctcgaagtacactgacagcttgttattagttgctgaaaatgctgatgataaatcatactgtacactcaactggttataatgcaggctgaaatcaaggtcacccgtcatctcatcacctgtcattctctccataaggtttcgctggttatcaactgcctgctctgccagtgacattccggcaagtgctgtgtaataaccataatcgaccattattccgttgaaatcctctcttatatcatcagttacttttataactgctgcaacagtcggtgatacacatgccccgaataatacttcatatccatcaataacctgctcccttacaggattttctgtacctgtgcctcctatcatatttcctcctgagacataatagtgggcatgcagatcaattttgcctgaattattgtatttatcgaaaaatgctttatcatatggatatacatatcttccacctgcaatgttcattggaacatggaaactggcatctaccggcagttcataataattgtaattaagtgtatctcctgctttaagcgtatcatcatagcttccatcaggtgcatcctgtaagaataccacaacctgtctgccattgacgaaatcatcatagtttctgtactctttatcaatatatttttcaagtttcttataaagttctttggtcggattaacatattccgtagaaaatatataacgataaccataatctgtaatcggtgtatctcttgaattagacatatctggcgatatcatatccagccccatcttatgataatcctgattatcccagaaccattttctttctgattcataggcagaatatgatattgattctattccgcctatattatcaagttcttcaaggaattcactagtgaaaccgctgagcagattagtgttacctcttttacagtacctgcgtccatagtgaatatttatctcttctaattgcagtaaatcttcatcattatatttaattctcatgaaggaattattcattttaccttttaattcatcaaagcttatattaaacctgtttcgttctttccatgctttattaagaagctggcttctttcgctgatgccatatatatcatcctgtttcggtatattataatatccttttatatatgaataatagtacagagtcatttcatactcagaatctgacggatcaaggtatccatatatatcaggaagttcattattcttcttatagtcagcatatgattttcttatcattacagctgagaacacaagtattccacatatgcataatgcaaatatcctgagtcctgcaatcataaacaccccatcattttgcatcagtctctggctgattgtcgaagcaagattatatggcttaatgcgtgactgctttccttccatatttgcaggtacatttttcttattcttactcttaaccttaccgcttttatttttttgccactgattagcaatcagacctgccagctcttctacaacaattgcagcaattactgaacacacactctttattattatacctgcagtaattttatagaaatgaaatccattatgaatctcaagtccctttcctatcgcaaatcctgtgagcagtgccagaagaagccccacaatacctgctggtataattataagtgcattctcagtgatatacattttacgcatcatggacttgtccatgccaagtcttctgaatctctggtatgctgtctgccttctgccgcggtactctattaactggtatgaaagtgcaagaattccaattaccatgacaactatgtacatataagcatatacaagttccgaactccatggctggtaatcatatactgccgaattatactctgtctccgtctttgcgtcttctttaatcttcttatacacagtattgtaatctgatgttctgaccgattctttcaacgaatacaaatatgaatttctacactttgtgttaaatactgaaagtgcattttcagttacgacagcacctggcatcttcctgccatatttccatatgcttgtgtaattggcaaatatgccacacagacggaactgtctttcctgtcttgctgacgcattatacacactgttttcttcacaatatctgattgtgattgtctcccctatctcacccacatagccaagcgacaatagtgtgttccaatccattgctatctcgtcatcattctccggaagatgtccctcatcaagcttaagtcttccctgttttacaaatgcttcatcaaagcttcctagtatgtaccctgtcatcttccagtcctgattgaacatatcaacacatgtaactgccttaacaggcggactaagatatgcatgttcacttaaagacttattaggttctttagatgtaacttcacataaaaaccagtccccaaatcttgatttattagacgacatctgccactggtacatattctcctgaaatataagaaccgctgttacaaaaaacacggctgcaagcgtagtacacgctgctttgataatctgcggcatacgcctttttatactcaacagagtaatcccaaataccgacatacgcaatccccctttcgtatgtacttctatgctactggcacacaccatctacaatagtaattatcttatccgcataatctgccatctgtctgtcatgcgtaaccataattatcgtctgattgtgcttctggcttgccttggataacatctgtgcaactgttcccgcacttcctgcgtcaagattaccagtcggctcatcagcaaggattacagccggatgagtaatcagcgctcttgctatcgcaactctctgctgttcaccacctgacatctgcgatggaaacttattcttacaatgcgatattcccaattcctctaacaaatcatcaacttcattctcatcaggcttcttgccatctataagaatcggcataacaacattttcatatgctgtgaattctggaaaaaggctgtaatcctgatatatatatcctatatttcttcttctgaactctgacaattccttgtccttcattcctgttatcttctttccggcaataataacacttccggtatccggctcgtcaacacttccaagaatcctcaaaagtgttgatttacctgaaccactctttcctattattgctgtaaattccccctgtccaaactcaagtgtgcagttcttgagtgccggaacatcaacgcttccggcatgataagttctttcaatgttctccgctcttaacataatctcgttcataatatacccatcccttctatccatatttttatagtttcctcacaaatccagtaaacatcagcagttccattaacaataacaatggcattgtaatcacgcaccataccgattcccgaaatgcctcaagcatacatactgaaacaatctttccacgcctcattcccagactgtgcaaaagcatcattttttcttttcttctgttaatacggtttcttataacaattgccataattaacagctgcataactatcattgcaataatagtgattccatactgcagtatactgttgataagctgtgttctgtatgtattcttgatatcaacattactgctataagagatatcgttattgttgaaatacacacctatcttattattggttgctgaaaatgttgatgtcaggtcatactttatgcttatctggttgtaacacagttcaaaatccatatcaccgcttaactcttctccaataagtctctccataatatctttctgtctgtcaaccgcctgctgtgccatgttaatacttgcaattgcggtataataaccaaatgtcggaattattccattgaaatcctccataacctcgtcagtaactttgacaacagcagcaacctgtggagcaacgcatgcatcataagctgcttcgagcttttccataagcttataatcaggattaaaatcatgtgtattgttgtaatctaataaatacctgttatatgctttatcataaggaaatattgaaaaatatgaagaatcaattatattactctcatcaccatacgtattctcatctactctgtaataattataataaagtgtatctccggcattaatagtgtcatcatatccaccctctggcagatctcttaagaataaaaccacctgttttccttccttaaatgcttcataatcaacatactctttatctatatatttctccagtttgctgtatagttctttggttggctgtgcatattctgtagaaaacaaatacctgtctccataatcaggaagatgctctttatgatatgaacttttttcaggatgaaatgtaaatgtctgcatcttttcataatcctgtgaatcccagaaccagcttctttctgattcaaatacagaatatgacacggaatttattccattaatctccatcagctcgtcaataaattccttagaaaatccttccagaatattattattaggatcttttaaatatttactctgccccatattaataaagccaagtgaccttcctatgctgtcactgtcattaaccttgattgcatcattccagtcccacatatttccggcttcaactaattcctttatcttatcaaaatgtatgttatatcgtattctctgcttactgacatactcactcatgtcattcctgcttgtgatttcaccagtataattcattgacttcagcggcagattattatagtccttaagataataccagtagttcataaataatgccgttttatcctgattaacatcaatatatccatatatatccggcacactgtcattgctcttatattctttaaaagcattttgaatcttcaaagcagaaaatataataactccacatatacataatgcaaaaagccttattccgacagccatcaaagccccatcttttcttataaatcttgaacttacagaccttacaagattatgcctgttcatacggcttttcttataacgcatatgtaccggtctgcttacccatttcttggacactgctttctttctatagaaatgtatgttggatattattccgctaagttcctcaactataactgcaatcaccaccgaactggcacttttaataataacctccatattcaccctgtagaattcataaccagacttggcttcaagtgcctgtcctgtaaagtgtcctactgccagtgcaagcagaatgccaataattcctgccggaatcagtataaatgcgttctctgttatatacattttacggatgcctgctttagtcattcccatctggctgaacatattatacgacttgcgtcttgtattcctgtattcaataagctggtatgacaatgcgagaattccaataaccatgactacaacatacatatacatgtaaactgttgctgacttccatggtgaataatcatatactgccgcattatatactgtctcgcaccttatgtcttcctttatcttcttataaacatttgcatattcacttgttcttatcgaatccttgaatccatacagatacagattatcaattttataatcaaaatcgtttaacttctcatctgtaactaatgctcctggaatcattttcccgttctgccatatattggtataattctgaaatattcctactaatgtatatgtttcgattctttgatctgactcataattaatattatctgcacgataataatatattgttatcttctgtcctaactcccctgcatatccaagctttaacaatgtattccaatccattgcaatctcatcattattctgtggcatacggccttcgtcaagttttaatctgccctgcttaatgaaatcgtctgtcatgcttcctatatgcaacttcgtctcattccattcactgtcatataactccacactgcttttcgcgctgaccggctcacacagataattatgtgtgcttaatatttcgttagcttctttcttacttctctcacatatgaaccagtctccgaatcttgacttattggatgacatctgccactggtacatattctcctgaaatataagaaccgctgtcacaaaaaacaccgccacaagtgttgtaagcgccgccttccatatctgcgagaaccgtctccttatacttttgaaagtaatctttaaaacattcattcaagtaccccctgtaagatttatgtatataccttattaccatgcttatacattatcatgcgaaccttacaaaaaccttacagccaaatatttttatatgacttcgcagttctttgtccattttatatgtgtaatgctggtatgagtgtctatagcacaaaatttgaatatgacgagctgtgcaggagttaatgccgctatatacataaggtcagttcacaaaagctcgttcaaacgaagtgcgtttgcttttgtggactgtaataaactttgtagatagcggcatttactcctgctaagcgatgtcatcctgaaagttttgtgctataaacactcatactgacaggggatatatatgatatggacaaacaactgcgaagtctctcttaattaatcttccaccggtagccgattccgcggattgtctctatataagctctgccgtcctcacggtttccaagctttgtctttagcctgctcacagtaactgtcagcgtattatcctctacaaatgttccgtatctgtcccacattttctgaaaaaatgtatctcttcttacaataagtcccttgttgtttataagtatctctaatacatgaaattctgtcggagacacacatatctgtttatctgcatgaataattgacttattcttaaagtctactgtaagagttccatctttataaatgtctgtgccacctgatattcttctaacattagccattattcttgatacaagctccgcaaccctgaacggcttcacaacatagtcatcaccgccgcagtcaagtcctttaataatactgtcttcatcatcacacgatgttaaaaatattattatctgacttccgtgttctcttatcttcctgcagacatcaaatccattgccatcaggcagatatacatctaacaagaatacatctattacagcttcttcctgttcatatatattattaaactgtcctacgcttgccgcttccacaactaaatatcctttttcctgtaatattcctgcaagctgctgccttataaaatcatcatcttccaatataagtatcttggtcatattccctcccagacagtacattttctatattgtaatgcactaaccttacacatatcttacaattcagcctttctcttaagaaaatatcttggtatctgtacccttataacagcaccctttccgtcctcgttattacgcacatctacggttccatgatgtgcttcaataatgagccgggacaggttaagtcctataccggcatgccctgcggcagcacttcccgttgtctcaaacctgtcaaatacatacggtatccggtcctcttcaaatccacttccattatccttaatattgactatacatttgtcatcacggcatgcagctttaacttcaaccttatcgcacaactcgctgctgttctgtattatattgataaatgcttctcttatccattcttcatcagcattgatgcaatagtctttgtcatcacattccaccgttatattgcagtcattcttaggaagctggttcacaacatcacaaagcatgctgttcacattaatgtcctgctctgtcatgattatcttgcctgcttccattctgcttattgtcatcagcttacttataaatgacctgattctttcaatctgttcaaaacatctttcaagaagctccctgttctcaccgctctcctctaatctgtctaatgcaagactgagtgcagtaagaggtgtcttaatctgatgtgcaatattctctgtaaaattctgcagtttctcattacgctcaacaagaaatctttcatctgctttctgttttttctttaattgctggttctctgtatctagattaataacatatgaatagatatcattatgtccgatttttacaatcatccttatacatgctgccattacaactgtaattataattattcctgccactgcaattatccactgaccacttctataatacatatatgatgcaccattctctgtatagccgcactccttgactacgttcttatactttgatacatcactcaatgaatacctgttataaaacatcatatctatcagatattctcctgatttttcatctatgttatacaagtctgctgccagtgccctgaattttaattcataaaatccagtcgtaacagcaattataagtatagcaattcctgccataacacaaaaagcagccatcatcttttttctgatgacggctactttgatggctgctatatgttctatatctttttcttcctctattaatactgtatctgacataaatcccccttaactacatgcattagtttctgggaatattatatcattttattctgttaaagcatatctgttaattaatatgaattgattgatagcctgttggcaacagtttgttggagaaaacccactaaacgcctgtaaattctcgatttcgtaggtatattttccaacttaatacgttgatttcaaccattaaacccactcattcattatccagatacattttagtaggcttttcccagcaattattctccaaaatagatgcatttcaactgaaaaaagcatactaaacttgatatatttgcccacttagtaggtttctgcctcttctcatcttataagcttccttctaaagacctactacaatatcgcgcaagtcatttctagtaggtttctgactcaaaaagccagaaatccaactcacatcacggcaagctcatatcttacttcttccctttctgtgtcagcagaactgacattatcaatgaagttatcggcactgtaagtattatgcccattgttcctgatattccacgcattatctcaattgcaaccgagtacatgttaagaatctggtgcatctggtatgaatatgcgtatattatcatgacaagtcccagacttcctcctgcataagcaagaataagtgtgttagacattgttcctatcatatctcgtccaatattaattcctgaacggaatatttcccttgctgatatgtcaggtctgttttctttaatctcatgtaatgatgatgaaactgacattgcaacgtccattacagctcctaacgatgcaatcagtattccagaaaacagcattccgcctatgtcaagctttgaattctggcctacatatataaggttctctatatcgtcaacattgtatcctgttacatgtccaaaatgtccgaaaacaagtgctataagacctgatacaaccactccggctattgtaccaagcatagcgccaattgatttcttctgaaaatctgccagtagaataaatgttatcagcgtaattatgacaactgataatgtagctgcaataaatggtgaaacacctatatacatcatcggaatatacatcattactacaactgcaaatgtgaatataagtgcgagtactgaattgaaacctttctttcctccaaccagccacataagtccgaaaaatgctgctaataacgcaattatctccggttcacggtcataattatatacattggctgagagatttccattatattcacttatattagctattacccttgttccaaccttacagttggctccgtacagatatccgttaagactgtacgcttttacttcttctcccttgtggcttcctgatttaatacgtaaaacaacctcctggctgtcgccactttctaagtcagcggcagcctgaaggtcttcattatcattctgtataaccactgccttaacaaacttagtattgtctttggcaagcagtggttttctttctacacttgtgtagaatagaaacatcgcaatcataataagtgccacaacaaggtatttaccaaatgtgtctattatctttcgcaaatgtcttccttctttctgattccaactataacagcgccgatacctgctgcggcggcagccatacaagcatatactcttgcaagcatgttatctcctgtctgtggagctttgccattatcagctgatgaattggttgaagtattatctgccggtgcagatggttctgttacagtattgttatcttcctgtacagtaagtgcattaattgcattaacaactgcagtttttgcatcctctaatgccttggcatcaatcttaggtgcattctcagacttataatccgcaagctgtgcctgtgctccttcctgtgcctgaatgtatattgtcttgtccagaagcgttgatacacccttcttaaatctgttaacactctttccgctctcagacgttgacttgtctgctgcattctttacagaaccatatcctgacactctgtcagtatctttaccataattatttacgatatctgcaagcattggatccttgtctgttgtatatgctgccttaatcttctttaatgccaagagagcatccttaagggaattcatgctggcttctgtataattaatctctgtgccgttaattaaagcctctgcattattaataacctcatccactgacatatctatattagtcttattgattgtaaaatcatcagcatacttattaccattgtagtcatatgtcttgatagtaagtgagccgcttgaaaaatcaattgtcgagaatgatgggagacatgcattagttctttctgcaatatagtatggtgtatagttaagcagattgtagtacttagaacctgagcctgaacctgttgttatataaagagttccatccggattagttaccgaaccgctgcttatatcatagtcaactacatttccatcgagaatctgataacttcttgaaaatgtgtggtcatgtcctgtaagacatatatcaacgttaaattcatccattaatggtgcaaatacaattctgttagtagcagcatctgtatctgcatgtggctgtcctgaaccatagatatcactatggaatattacaaccttccactttgcatcagggttgcttgcaacagcttttttcataaatgttctgtgttcctcctgattacggttgttgctgtttaatgatatgaataacacatctccataattgaaatagaaatcgcttcctgctgctgtacttcctaacttatcctctgaattaggattgttaaaatgcgctgagtaatccgaacctgccatatcgtggttaccgattgttgcagcgattggaaggcttctgaatactgatggataaagatatcctgcatactcactctctcttgtctttttatcatcatccttagctgcaccagactggttaatctgatcacctgctgacaaaaggaatgatgcatctggacatgtctttaatgcctgctgcattgtcttattccagttgtatgcatctcttgcaacactggcatcattagctgatttatctgaactgcttcctgaagcaccaacctgagggtcaccggtaagaataaccgaaaacttatcagttgccttagttgtgtaatcatattcagcagaccatacactgtcatctcctgtgtaattgtctgtgtactggtaatgatactgtgtgttctcttcaaagtaatcagctatgtttaccttattagctgcactgtatgactttccctgccagttctcagcactgatagactcggcattacctgttacaaccttggctgatgactttgagccatccttccatacctttactgccggtgttccttttccagctgaataccatgaaaaattaagatctgccgcatatgagcctggagttaaagctacattttcagtctgtgcataagctttttctcctccctgccatacattagaaagccagttctggaaatccgctgaattatctgtatcctgcttgaatgtactctgactcacatccgcctcaccatatgcaaatgcattaatgagtggtgcctgacttacaagaactgttgacattgcagcaagtgctgcaccttttcttaataaattcttacttctcttcattttttcctccacataatgagatatatttattcgtatactgttgtgcaacgaattgtcattactatatccccatgtggtaaacttacaataattgtcttgtaaatcttgtgtaaaattcttgttttaagcaaaaaacagacacagatgttaatgtctgtgtccgattttttcaatttatttattttcaagctttgtaatacatttatccagagatgttgcaaaccagtcaatatcgttctctgaaaataccattggtggacgaagctttaagatatttccgtaatggcctataactgatgtaagaatatgctcatctcttaacatctctattacattcaacgccatatccttatcaggtgtcttattgccatcattcttaacaaattcaaatcctaagaacaaacctgcacctcttacatcacctactgattcaggatgtcgctcctgtacctctttaagtgccttaaggagcgctccgcctgctttcttacagtgttcctgaagattttcatccttaatatatttaagaacagcctgggcagcggctattgatacaggattaccgccaaatgtgttaaagtaaggaagcttgtcgctgaaggctgcaagcacatcctcctttgcagcaagtcctgagattggaattccgttacccataggcttacccattgttatcatatcagggacaattccgtgtctcgcaaatccaaagaatgcctgtccggttcttgcaaatcccggctgaacctcatctgctataaatactccgccattcttatgtacaacatctactgttgcttttaagaatcctacagggtcaggatatataccatctgatgagaatattgaatcagcaaggaaacaagaaaacttatatcctgcctcatttaattcatctatagtcttttgcatctctgacgcataccatgctgtgaattcttctggtgttccaccatgacggtaataatctggtgctgttataagccttacattaggaagtaatggctgaccggctccaagtgaaggtgaacagcctgatgttaatgcacttgttccgtggtaggcttcctgtgtgataattataccggtaccacccgtataggcttctgccacacgaagtgcaaggtcattagcttctgaacctgtacacatatacattatcttattaatctcatcaggcataagtgcaagcagttcttcactgtaatcaagaattttttcatgaagatatcttgtatgcgtattaagagttttcatctgctctgtaacagcctctacaacagcagggttacaatgtcctacaccagctacattgttatacatatcaagatatttgttaccttcatcatcccacagataatctccttctccacggacaatgttaagtggctttctataaaaaagtctgtaagcacctccaaggtatttttctctcttactaatcatttcccttgttttaggacttaacatagatgcatattcttccttaaaactgttagagtccataatacttgattctgttgccataatttcctccattctgcaaaaagaaaaagcacagaacctctgatttctcagaaattctgtgctcctttgcactgtcatacagattcattctgtctgacatatataatagcaacatttggttatttgtcaatttataatcaaatgcttattaatcatatttcttatttatcttaagttttacagataatgctattaaagccacgacaataatacctgcaagaacccatacccacacaggaacattcttaatgttataacatcttacattaatccacatctgattaattcttgttgtctcttcagcatcaaaatactgcataatagcacttctatccataacctcctgcgtaggatactgtgctgataactgtctgtatgtctgttcttctggaactttaagtacatatctttcatcatcagaatcacctgaaaagaaatatcccagaggataatctacaacatctgtatcactttcatctgctccatagttccactttacatagtcaaatacaacatcactgtcaccacctgatataactgatgtatatccaatatagctcatgtttcttacagcattttcaggttttgacagaaagttaataaagctctgtgctgcctgctttttctctgaattgccattaattccagactttaacattacccagccgtcaaaataaaggttagtacattcttcaggtactgcaaaattaagctgaaaatcatcctcgtcagcctggtccatagtatatacagcatctccagaccactgataacctgcgactacctttcctgttatcatatcagtcttggcactgtcagtctcgaatgaataggcattattcttaactgactggagatactcctgaatcctgtccacatttgcctcagaagtatcattcatctcctcggcaagtttttcacgataatcaggactgtttataaatgacgctgactttaacttgtctgacttaattgcaccaacagctgcaaacatggaatctcttacattatccttaatcgttatctgacgtctgaatttgctgttatcaattatcgtccatgtagatgcttctttttctgtcaccttatcaggattgtacacgattcctgttataccccacatatatcctgcagcatagcggctccatgactcaccattaatcttattctcgtcaaatgttttcttgataaatggagatacacccttagcatagtaattattagcaatcgatgtatcatagaaatcatctgaaaatggctcaagccagtcctctgccataagcttcattatcatatattctgaaggacagattacatcgtaatcatcacccagagtaagcatgttgtacagttcctcgttagttccaagacaactgtactgtaccttaactttcttgccataattctcataataccagttctcaaaatcagtaattatcgaattctcaccctttatgcttccgctctcaaggtcaattatatcatcatcactccagtctccggtatcaatatattcttcccagttgcacacacggagtatgattgtatcgtctgctgccaccgctgtaagacggtttgtattaaacactcctgttactgctgctgtaccgcttactatcattaaagctgaaagtattaacgcatttatctttccaataatcttattcatcagctccagcctcctctcgtacagcttttcttgctggtgcaagattaattgctatctcaactacaataacaataaggaatattattgtagataaagcccacaaagcagtcttgatatcagtctgtgaacccttggttgcattaacaacataagtacttattgtgtcaaatgttgcaggcttagtgtatgttgcaacgaaataatcatccagtgataatgtaactgccataacaaatcctgatgctataccggaaacaatctgaggtattattatcttaaaaagtgcatacacaggtgttgcaccaaggtcaagtgctgcttcatacagacttggatccatctgttttaatttaggaacaacagccagatatacgaacggtgcactcagtataacatgtcccacaacaagaggaatatacgtatccttactgacacctaatacaactacaagaagaatacagatagaaaaacctgtaactacatctgcattgacaacaggaacctgattaagaactgacattgctccttttacttttccctttgaataaaatgcacctatagcacctgttgttccaagtattgttgcaagtacagcacttccaacagcaagcagcacagaaccgattatcatattaataagctccggagtcgtaaaaagtgttacataattatgcattgaaaatgcatgtattgctcctatattagcggcatccgtaaaactgtatactgcaagcacaagaattggaatatacatgaacaaaaggacaatgcatataatcatatatttcagaaatttcttcattatacaagtcctcctcttccagcattttctgattctttatcacccgaaaccagagtgacaatacatataataacaagaagtatcagtgctatcattgagccattgtgccagtcatatgcactgaaataacttccaatcagactacccataatatatgtgctgttataaagcatatcaagaactacatagttagtcattgccggaaggaataccattgacacaccactgacaattcccggaacagacaatggcagtataaccttgataaatgtctggaaattatccgcaccaagatccgatgctgcttcaataacactcttatcaagctttgaaagcgttgtatataacggaagtatcatgaatggaagaaaatcgtatgtcattcctattatcgtattgataaacggataatacgcaagatttccctcaatcattgataatatctctttaagtgcggtaattcttaatgtgaaattaatccacataggcataacaaaaagcagaagtattacagcttttctctttaacttactctgtgaaagtatatacgctacaggataagcaattataagacagactgcagttgcaacaaatgcaagtacaagactgtaacacagagttccaagtgtattagggtctgtaaaaaaattctgcagattaaccatgctgaattgtccctgtccgttagtaaatgcataatatacaaggacaagcagtggtgctgcaacaaataatataagaaacagcccataagggattccaagatatttgcgtgaaaaagacatatttctatccccctacttcttcaactggaatttcatcttctcttcaggcatgataagaccaacctgatcatccatattccagagatattcatcatctacaataaggtcatgtccatactcagttcttattacataactgtaatggtcacccttatagataagattaataatcttacctgatacaagacctgctgttacatcatcgctcatttcaatatcatcaggctggattgaaacaacaaccctgaactttgaaacatctacattttcaccattttcatcaacaagcactccatctgacatcttagtcttaggaataacctgtgttaaatcacagcttattatcttgccattaaagtcgagcgtataatctccattaattgttgtaacaaaacttgtggtatgatcctctgcaagcattacatgaattccatcaggctcaagctgcattcctactgtatcaccgacatgataacacctggtagttcttattatcatctcatactttccggattcaacagcaacctcgtaatgcattcccttgaatataactgaagtaacttcaccaacaacagttccatcctccggctttgtaataattacatcttccggtcttataacaacgtcaactaaagttccctctggaacatcatccattccgacaaactctccgccacagaatcttactttcatgtgtcctgtcataatacctttgaaaatattgctctctccaataaagtcagcaacaaaagcattcttaggctcattatatatatcctcaggagttcctatctgctgaatcttaccctctgataagacaacaatcttatcagacattgtaagtgcctcttcctggtcatgtgttacatatataaatgtaattccaagctggtcatgcatattcttaagctcaatctgcatctccttacgcatctttaaatcaagtgcccccagaggttcatcaagcataagaatttctggctcattgacaagtgctcttgcaattgcaattctttgctgctgtccgcctgacaacgtagatatctttctgtcctcaaatccttcaaggtcaaccatatcaagaacatgcttaaccttttttcttatttcttctttaggaagcttctttaacttaagtccaaatgcaatattttcatatatattcatatgtggaaacagcgcataacgctgaaacacggtattaatcggtcttttattagctggaagctgtgatatatcctctccgttaagaagtatctgtccgtctgtcggaagttcgaatcctgctatcattcttagtgtggttgtctttccacatcctgatggtcctaaaaatgttacaaattccccccgctttacttcaagattaaagtcatcaaccgccttaaatccattatcactatataccttactgatatgtttaagttctattatattttctgatttaccagacatatccaacctccgcaattaacatccttcgttacaccgtccaacaactatgcaaccacttcctatttaatatcaaaaacgggtacaaatcaagtaaattcttgatttgcacccatggttttttcattatgtaaacaactggcaaatatatgttttaaggtctgtgatgaagctcctggacagtctttcctatttcttcccttatagtctgtctgtcttccggaatcttctgcattcttgcaagtaaatccgctgtatcatgctcagaaccaacttttcttaacgactcacatgctgcgaatacaacatcatcatctgcatcatcaataaatcttaacagcaagtccacactggtctgatcatcacttgcaccaagagccttagctgctgcaatcttttcttctttacttcctgtaattacttcctgtatagcataccagtcatggtgctttacatatttctccattttttcatctaatgtctttttcttaaataacataccgatgccttctttcatctttttctatattatagtattgcattttcgatatgtaaaatgtatatttaatatgtcacttatatcataattatatattggagaattactatgaccttagattattacagaatattttactatgttgcaaaatataagagtttttcaaaagcagcccgcatgctcgacaataaccagcctaatataacccgctgcatgaatatattagaaagtgaacttgactgcaagctgcttaaccgttctcacaaaggcatcactcttacacctgaaggaaatacattgtattctcatgtatcaatcgcaatgaaacaacttgaagacgctgagaacgccattatcaaaagcaaaagtctgtccggtggtacaatatgcataggagtaagcgagattgctcttagaatattccttcttaaaaaacttgagaaattcacagaactttttcccgatgtcaagataaagcttaccaaccactctactaatcaggctgttaatgctctaaaagccggtctggtagactttgctgtcgtaaccacacctgtcaatttaactggcgatatgaaatctgaaagtctatgctcattccatgatatacttattgcaggtccaaaatacagtcagccggataataaaataattcatctggaagaattgcaggattatcctttcataagtctggcagaaggtaccggtacacatgaccactacaccaaattcttctatgacaacaatcttcactttaaccttgacctggaggcttcaactacagatcaggttcttgcaatggttcaggcaaacttagggcttggcttctatccggaggaacttgcctctgaatatataatgcgtggtgaaatatttcctgtaaatctatacgagtccgcacctgacagagatattgttcttatacgcgaatcaagacatactgaaagcattgcagccaaaaagcttattaatttcttaaagcatacaactgattaaaatgtcttagttacgcattcaagtgtcgcacagtagcctgtattattcttgctcttatacatggcactgtcggcatgtctgtacagttcatcaaaatcaatatccttttcccctttataaaacacttcacccatgcttacatatatcttctcatctcccatctctggaattcttatgtccttaagctttgcaaatactctcatcgtgaagctttcagcatctttagtttctgttattcccgggatgaacattgcaaattcatcacctcccaggcgcatgcatatatcatgttccctgcatacactctgaagacttcttgcaaccgctataattactgcatccccgacaacatgtccatatgtatcgttaacattcttgaacttatcacaatcaagaaggcacataagccccttagttccttccttaataaggtctgtaattgcttcctctccgcttcctctatttcttattcccgtcataaggtctgtttctgaaagatataaaagcctgttctccttacgtttctctgcatcgataacttcaacggcatatacaacatgccacagttctccgttgctatcctcatctacccttatgaatctttcacgacaccatccagagtaatttccaaggaattcatgaacaatcgtagtcttgttcttcattctctccggaagtgttgatatatcaacaaattcaagtacactttctacatacttcctggaaggaagaatcttcattacactatttatctgttctgcaaaagtatgctcgccttttatcatattatcccttatgaaatctgttgactttatttcatgaaattcccctgtctttaaattgataatatgcattgacagatatattccggcaagtgctgaatatgcactgaacatagcctcacgcttggattttttaaatacatttctctgttttaatagcagtactaaaaatgtgcctatcatatcaagaaagcgcgaaatctcgtccatctcactttctggtggattgtcaacaccaaagaagccatatatctcgtccttatatctgaatggacttactgccaggctctttacattctgaactttgagcagttcatatgctgcaggatattcatccttaatctcctcaatatccttagtactaatattccttccagcatcaaacgatgtataccaccagtctataattgacatatctacattctgaagaaactttatctgaggctcaatcccatccgcacaccactcataagtattattagtaaccttttttctaatattatcttcaaatatgtatattctttcagacccgatatgttctccaaagaatctgataaattcattaatctgatcatctggattttcataattcattgctgccttcattgctttattcataattgattcgtactttttcgtcttcatatgcatctccaattcaatacatttataactaccaacatagtaacatatattaacaaaaaacgcacccttttcacatgtaaaaattgtgaaaaaagtgcgtcctgatattaaacaaaccgcattcgccgctaataattctctacatagccttaattgcattcactgttatattgtactgtttctcaacttcttcaaatgcttcctcagctcctgcaagttctcctgcacgaaaaatctctgtaatagctgaactcgccttataaagattatcaaacccaagatttaagcatactcccttaagtgtatgtgctgccctgaatgcttcttctacatttccagcagctatagcctctttaagattggcgtagctgttgtcatctaaaaatttcaatacaaattttttaataaaagcctcatttggaaatctattcaaagtattctgataatctgctcccatcgcatcatagcattctttaattgtcatgtgcctacctgcctatatattgttaaattataactatgcatataatgataaatgatatcacgattaatatagtattgtcaaagaatgatttaataataaaatataatttcagataattattttacatattcgcaaatatactgtatattaaatatattgctgtctggcaaaatatatgcgggggaattgttttatgaaaaaacgagattcttttaacaacaaatggggattcatccttgcctgtatcggctctgccgttggtatgggtaatatctggatgttcccaacaagagtatcaatgtatggcggtggatcatacctgataccatatttcatattcgttgcacttattggtttcactggtgttatcggagaaatgagttttggtcgtgctactaagtcaggacctgttgatgcatttggatatgcatgcgaaactaagaataagagaaagcttggtgaggctatcggctttattccagtacttggcgcacttgcaatggcaattggttacactgttgtaatgggctggattcttaagtacatgattggagcttttacaggaaagacacttgcacctgctgacacagaaggctttgctgcttcatttggaagtatggcaagcgcatttggtaataatgtatggcagattgtagctcttgttattggtattattatccttatgttcggtgtcggacgcggaattgaaaaagccaataaaatcatgatgcctgttttctttattctttttgctttacttggaatatatgttgctttccagcctggtgcaatagaaggctacaaatacattttcagagttgaccctaaggcatttgctgaccctaagacatggatattcgctcttggccaggcattcttctctctttctgttgctggtaatggtactcttatatatggttcttatctttcagataatgaagatatccctgctgctgccggacgcgttgctctgttcgatactatagcagccttgctcgcagctcttgttatcattcctgcaatggcaacaaccggtgcccagcttaatcagggtggtcccggacttatgtttatcttcctcccggcactttttaaatcaatgccaggcggatacatagtcgcaattatattcttcgttgctgtatttatggcaggactttcttctttaatcaacctgtatgaagcacctattgcaactattcaggaaaagcttcatcttggaagaaaggcatcttgtgccataatcgctgcaatagcacttatagtttcaatatgtattcagggaattgtctctggatggatggatatactttctatctacatctgcccacttggtgcaggtcttgccggaattatgttcttctgggtatgtggtaagaaatatgttgaaactcaagtcaatactggtcgtgataagaaattcactgacatgttcattcctgtatgcaaatacatttactgccctgtatgtatccttgtacttatacttggaattgttcttggcggaatcggctgattaagatattataataaaaggaatcctgtgagcagggaggtattgcctttctgcttatgggattccttttttcatatatttaattatgctattcatgctttgcatcacattttttcacaggaatatttcctcaaaagcagcaattacaagcttaagagttgcttcgtccatatccgaataatgaattacaagtattccgtggtacttatccgcatcagcgaaacaatactctgaaaggcagttaatcagaatccccttctgcctgactgcccatttaatctcaacatcacttaaggaagtcttcacatgcagcagaaaatgtgttcccgcatcatcctgatatatcgtacttatctcactaagccttgattcgcgaaacatcctgcatatcttttcacggcgtcccctgtaatcattgacaagccgcttaatgtgacgctcaaagtatcccttctcaataaatgctgccattgcatactgttcaaagcccgacaccgtacacgaataaaaattcattgttgatatatatttttccatcaacttttccggcagcaccatatatcctattctaagcgaaggaaccattgtctttgaaaatgtattcatgtatattaccctgtgacttctgtctctcgactgaatggacggaattggtttgccctgcatacggaattcacagtcaaaatcatcctctattatatatctgtctggctcctccgccgcccaattaagcagttcctgtcttcttgcaaccggcataacaaggccaattggaaaatgatgttcaggacttacatgtgctacatttatgtctttcattctaagttcatcgactttcatacccttatcatcaatattaacataatcccagtccacaccattttcatcatatatcttggtaatcttacggtatccgggattctcaacaccaaacttcacatctggacctaagagttgtaacaacctgttatacagatattccgttccggctcctataataatatggtctgctgaaacctgcattccacggtatctgttaagatggtctgcaattgcttcacgaagctgcagcacaccgttaaaaggtacagtcttaagaagagaagtgttataatcggtcagggtttccctcataacctttgcccatgtagcaaatggaaatctatcataccggatattatttgccgtcaaatcagcaagataagtctcctcctggaatcttttcacaggagcagcataccctggtgcaccacctgtaaccacggcaatcttattaacataataccctcttttttcctcagatcggatataaccttccagaagaagctgctcatatgcgttctccaccgtcttgacacttatctgcaaatgctgtgaaagccctcgctttgatggcagcttctcatcagccttaagcttcccgtcagatatatcttccttaatcagttcatacagatattcgtacattgttttgtttccgcgtttatctaaatcatatgtaagcaaatctggtctcctattatatatgtgttttggatatttaaaagatatcaattctaattataataagctcataagcaaaaaacaaggaggaaaatccctctcctcacctgaagggttcggatttttcttcgaaaaacaaggaggaatagaaatactatgggaatctatgctattactggtgcttcaagcggtatcggtgcgaaaactaaagaattgttaatacagcagggacataaggtaattaatattgatcttaaagacggtgacatctgcgtaaaccttgcatcgcaggaaggcagacagtctgctgttgatcagttacatactatgtgccctgacggacttgacggaatgatatgcaacgctggtgtttcaggcgcatgcggtaatctcggactcattatctctcttaactacttcggaacagtagccgttgcaaatggtgtatatgaccttttaaagaagaagcacggaagctgtgttgtaactgtttctaacacaatttcacagggtgcaggccgtaaggatatcgttgatcttcttaataacatcggtgatgaaaagcgtgtattaagccttatttcttctatggacagcactaacctttcagtaggaaacagtctttatgtttctactaaatacgcacttgcaagatgggtacgccgtgtatctgcaacatgggctgccaatggtgtccgtataaatgctgttgctcctggtaatgtacacacagccatgactgcaacaatgagcactacagcaaagatggctcttaacgcccttcctatcccaaccaagtacggtcaggagtgtctcatggctccagaggaaattgctgaggttatggtattccttgcttcagattcagcaagaggcgtcaatggaaatatcatgttcgttgatggtggaacagacgcattattaaacacagagaaagtatattaattaaggagggcattaaacatgacagcaattgaaaaatatgtagaagcaatggaaaacaaagattacgcaggacttgccaatctcttttctccagacggaataatcaacgattattgtactaactcagcagcccagaacgaatatcatatatatggacgtgaagctatcaacatgttcttccgtaacaagttcggcttccgcaaatactctatcttagatggtgaagttgtgaattctacccaggcagaattcatcgctaacttcggcggttacaacatcatggccatcgctacagtccgtgaagtaacagaagatgggcttatcaagagacttactgtaagacctaagtaattaaatattaaaaatcgtgtataaccaatcagggcatttgaattgcaagttaatcccttgcaatccaaatgccctcatttttctttttaacataaacaataaacttttcaagagatgccttttctctatctcaatgtccaatctgccactttcttgcggctgttttggactttcacttaccttctattcgcttctaggtccaatcggttatacccgcgcggactttttggacatccacttgtctcttgaatatattcaaacctgtattttaatacagattgacctgtttttccataagtctgctgccttcatacttaagctttatcgagaaaaatctctcctctcccgaaagaagaaggttaagaaataccctgtcaccctcccatgtcggaagctcgggaacttcttctttatcaacccaagccagttctccttcatcacattcaataagctcacctgtaaagccatctgccgtaaatacacacataagctctggctcacattcattacttataaatgttacaagcccgcggaatctgtatgaagtaagcgtaagacctgtttcttcctttacctcacgcacaagacattcctcaggagtctcctgattctcagcatgtccgcctactccaatccatttaccttcattaatatcattatgctttttcaccctgtgaagcataagatacttcccgtccttctctatataacataaagttgtagttatcatcagctctgcctttcatgtccgattttttcaatctcgtatttcccgcatactatattaatttcatcagcattaccccagtcaagacttacatacactttcttcttatcaacatcccacttaagttcatcaatagttattccgcatcttgtacgaagtcccttaaccatgccgcttccaagcttgtctgaccatgccggaagcagttcaattgtgtgttcatccgaatatacaagcatttcattaataattccaaccagtccaaatgcagtatctgtacaatatacacctttgctcctgtcagtattgtggtctgtaaataatgttgtgtaaaatatgtcactgtgcacaagcagattaagcgtatcatatacagcatctgcatttttaagacgagcctctactaacgccttatgtatccagccatgtgaagcggtatcatcttttcctttattctcatggtttctgttaataactgcctgacgacacgcagctgctaacttactatcatgctgagtctgcaaagccggccatgccggataaagatggcttatatgcctgtgtgcattgttctcgccatactccttcatagaccattccttaactgcacctgactcatcatacataaaatcaggtaacaatcttaagagtgcttccgcctctgatacagcctgcattgctgcagtcctattctcttcagccatctctttattaatcatctcaatatacatattaattacatctttagccgcagagatatccattgctgcattggcagtaatcgcactatgatatccaagaggcttattctccggtgaaaatgatggaataataagataatgctcccccgcattaaggctgcattttcccttctcataccttgcattaccgtctgtatctgtataatactcaggatttcctatctgtttccagaaattataggctttttttagaagtggctcatatacatcttttcttacatcaaatgtatctttgccgtacatcttaatcagcgacgcatcaaaagttgttatcacagcgtcgccgtaagtctgtaagaattcataaataggaataagcatccagccagcaccggcattccagtactggaatggataattaatatcgtactctaccatcattgccctgtgtccatcagtattaaccggaataagcactgcatccttcattccatacaccattgctgcattgttaacccagtcaggtatctgccgcagaataaaccacatataaccaacacctgcttcatacaaccctgagccattcattcccgaaacctgaatattaacattggcatccattgtgtacgcacttctccacaacagattccactcaccaacccacaagccgctgagtcttggtgctgtcgttcctgcgcatgcctgcattccatacagaccgttataatataatttttccagcagatgaggcataatgtcatattcatttttctgcaagtcaagcagttcttcattagcagactcgcaaaaatatccgccgtcaagcttaagctctatattcttatgatctaagcttaccggttcttccgttatattgacactgttaactttgttaatacatttgtctaccagtgcaaatgtatccttgccattaactctgtccctgaactcacaatattcccccaaatcatctgtccagtctgtgtaagttataagtgttatactctctgcatgtgatatattaataaccggcgcagtctcatcaatacaagtgtacgcccggctgtctttaggctttgatgaaaccctcatatcaccatctgtcaatatccttgtaacacctgcaaatccaccctttgcaagctcacttccctcatattcaggataatgcacaaccgtacctattatgttatctcttacaaatcttgaatacagcatatttctttcaggcgcagggatattgttcttctgaactccgaatttcggcatagactcaaaatcatctgttgatatcgacatattcacagacttttcagatattattttagttataatcacattctgttttctcgatacatatgtactttttgaaacagaagctccgtctgatttaaatgtagtatttattgtaccagtcttataatctgtccatcttctgtaaccagaaatatccggctctccttcaagtgtcagtcttatcatatggcctggatgataacagtacatattcgttctttttctatcatgtatattccatgtatcatcaaaattaataactgactgtctggcttcatctaactgtgctgtaacatcgtaaggcacatgtcttggctcttccgatggcatgacaaattcaacattctgatatataagactgtcctctataggcgcacatgattcaagcacgccaagccttccattacctgccaccatagcctcatgccatggtacatctgtgacattataattatcgtaaggtttaatctgcctaaacttctttgaaaatgaactatacatttttagacttccttttctacttatcttgtttttcttctttctcttcagttccaaatgatttagcgtaaagaaacttatgtgttgcaaataatcccgcaattgcagccaccccagccagtacctcaaaacctgatacatgtcctactatcatctgtcttgaaatagcaaaaagcagaacttcaataaccgtacccggagtatgagtgcagagcatctttacaaactcaactccaattgcaaatgtcataactttttcaagaaaatactcaagcgtggcgttatcatatcctatcccaatcacgctttcgacaataaattcccctgcaagaaatattataaccatcagtaaaaatgcagataatacaatctcgatatatgatgcagcctgctgcattaattttcttaatttcattttcatagggtaaactatcctttcaattaattttatatatagtgccttatttaagcattaattatatcttattcttaataattaagcaattgtgcccctatcgctttcattaaataatttaacataattatatagtgaatatgcataattcaatttgactttcataatgttttttagtaaactttaacaagttggtgttttgaagtatgataataaatgacgccacatttattatctctacaggcacgcgtaacggacataattttttaacgaggagaaaaacatggaagctttattaattctagtcatcgttgcagccctgcttgcgctcggttatgcagcattcaacttcatcggtgttaagaaacttgatgaaggaactgaccgtatgaaagaaatcgcagcagccataagagttggtgctaacgcatttattacatacgagtacaaaatcattgcagtagtagttgttattattgcaatcgcatttgcagctatattcactgtccagtatggagaattcagctgggagccatctgtatgtttcatgattggtgttatcatgagtgcatcagcaggctgggtaggtatgaagattgctacttacgctaatgtaagagtttctaatacagcccgcaacactaagaacattggttcaacacttaaggtagctttaaaaggtggctcagttatgggtctctgcgttggcggtttcgcacttttaggacttttccttgtatacatcatatttggatttggtcttaacatgcttgacattgaggctctccgtggtgctcatgtattcacacagtgtctttcatgctacgcacttggctgctctattgttgctatgttcaaccgtgttggtggcggtatatatactaaggcagctgatatgggagctgaccttgttggtaagacagaagcacacattcctgaagatgatccaagaaatcctgccactatcgcagataacgttggtgataatgtaggtgatgttgccggacttggttctgaccttcttgaatcatttgttggagctatatcttcagcaattattcttgcagtaagtctttacctttcaaatgtagctaataaccttgaagtttcagacgaaatgctctctaagatgatgtatttcccacttgtattcgctgcaatcggacttatcgcatctattcttggtatcgcttatgttctcttaaagaatggttctgataatcctcacagagatcttaatatctcaacatggagtgctgccggaattacaattatcggcggattcgttgctacatatctgttattcaatggcgagaatgcagatattcttaaggttgcaggatttaacattggtttcatatcaccttggattgctgcttcacttggcgtagtgagtggtgttatcatcggtggtatcgcagaatactatacaagttatgattacaagccaacacagacaattgcacaggcttctaaggaaggtgcagctttaactattacacaggggctttcagttggtatgaagtcttgtatgtacccacttattgttttaggtattacaacttatgtttcatacgcagtttcaggcatgttcggtattgctatggctgccgtaggtatgctttcattcgtatcagcaactgtttctgttgatacttatggaccaatctctgataatgccggtggtattgcagagatgtcagagctcgaacctgaggtaagagaaattactgataagcttgattccgttggtaacacaactgctgccatcggtaaaggctttgctatcggttcagcttcacttgcagcactttcacttatggttagtttcctttatgcattccagccagagggaagcagcctcgaccttaacttcactaacccacttattcttgccggtgctttagttggtggtgctcttccatatctgttctcaggtatgcttattgaagccgttgccaatgctgcccgtaaaatggttgaagaagtaagaagacagttcagagacattcctggtatccttgaaggaaaggctaaaccagactataagacatgtattgagatatcttctcagggtgcattaaaagaaatgcgtatgccagctatcatctcaatcatcttccctgtaattgccggattccttttcggaccttacttcgtaggcggtcttcttataggtgctactctttcagctatcatgcttgctatctttacaggtaacgctggtggtgcatgggataacggtaaaaagtacattgaatcaggtgctatcgaaggacagggcaaaggctctccagcacatgatgcagccgttgttggtgatactgtaggtgatccattaaaggatactgtaggaccatctcttgatatccttatcaagattatgtctactgtttcactcgttgcagcagtaatgttctataactacaatttactgtaccttatctttggtataagataatattccgtataaaggagttggggcgacagaccataaaggtctgccgcccctgtttttatgtatatttattttatgaatttgacattaggatatattgccttcttggcttcttcttttctttcattgaatgtaaccttattctgttcaaataggttgtcaccattagcatctattgatactataagcggtccaaattccttaaccttacagcaccataatgtttctggcataccaagctcatcccagtgatgctcagcaattctttcaacctctgttgctgctactacagcacatccggcagggaatacgcagtggatagcaccaaattccttacatgctctctctgtattaggacccattccaccttttcctacaattactcttacacctgtctgcttagtaaattcgtattcgaatttctccatacgcattgatgttgttggtcctacagataccatctcataatcattctctgttccttcaatctttcttacgataggacctgcatggaatattgccttgtccttaatatcataaggaagctctcttccatattctacaagtcttctgtgtgcaacatcacggcatgtcattaaatctccgtcaagccatacaatgtcaccaatcttaatatcctttaagtcctctgcacttactggtgtaacaagaacctttttatcgcctctgatttctaccattttctaatcctcctatgcgttcaggtctattgttgaatgtgtatcacatactgcatttaagtctttatcaaatattacatgacctcttctgtgtgaccagcaacctacatttacagctacaccaattgttgatggatgtcttgctgtattttcaatattaactcccataacggagaatttaccgcccataccctgaggtccaagtccgatagcattgattccgtcttcaagtaacttctccatcttagctgcattttcattctcattatgtgaaccgattggtctcataagtgccttcttagaaagaagtgctgctgtctcaacagatgttgcaacgcctacgcctacgagaagtggaggacatgcattaagtccatagcttgtcatctggtcaagtacgaaatctgttattccttcataacctgcacctggcataagaaccattgccttacctggaagtgtacagccgccgcctgccatgtatgaatatatctcgcagtggtcgtcattaggaacgatatcccagaatactgttggagttcccttaccaacatttctcttagtgttgtactcgtcaaatgtttcaacagagttatgtcttaatggtgttgcaaatgttgcctgtacaacagcttcctttaacaatccctccagctcattaataagcgggaagttagttccacatttaacccagaactgtaatacacctgtatcctgacagctaggtctgtcgagtgatactgcaagtccctgattcttagtcattgtctcatataaaaccttaggaagtggtgctgtttcctgggctgcaagctcctcaagctttgcaattacatcatctggtaactttttaccgatatggccaacaaatttagccatcttgtctgtcatcagctttacgctctcttctttgttcatataaatacctgttcctttcttctacctgcatgctttataatgcagacatatatttacttttgctgacccattcttctcctatggatagaacggatataatattggtaacaaaatcatacacagcacaaacgatacgagtataagcggaagtcctgattttacataatccttgaacttatatccgccaacgccaactaccattgtgttagccggcattccgattggtgttgcgtatgcacatgatcctgcaataactgtagcaattactaccgctcttggatctgcgttaaggctctctgccagtgatacggcaattggaaccataagcgctgttgttgctgtattggacatgaagttcgtaagtacacatgtgactacgaatatcacaagcaaaagaactataggacttggattagaacccataattccaacaatcttatctgctataagtgttcctgctcctgttttttcaagagcacttgcaagtgcaagtgaaccaccgaataacagtacaacctttaaatcaattgacttcagcgcttccttctcagatataacacctgcaagaacaagtattactgctccgagacatgctgaaacctgtatcttaattcctatcttatcctcaaatatcatggcaagaataacaagaattaacacaataagtgacattgcctgtttccattttggaacattgctgaaatcttttgtatgctctggggcatcctctgtaataaccttcttatctggaagaagcctgcagcctattacaatgaaatagataattccacatataagcattggtattccaatcggtgcatacatgaagaagcttgttgaaagccctaattcttcaagagcatttacacccataagatttcccggtgctccaattattgaaaggtttcccccaagtgctgctgcgaataccagaggcattaacagacggcttcttgaatatcctgattcatctgctattccacagacaacagggataagtactgctgctgttcccgtattagaaaggaaccctgacataattcctacgattaacattatcgcaataataagtatcttttcagatttggcaaatttagtaacaatacctccgattttattagccatacctgtttcaaatagtgcctgtccgactacgaacattccgacacacagtattacattgctgtttacatatcctgcaaatgtttcctttaccgtaagtacgttggtaagattcagaccaagtgcaactattgtagctgtaagccccagcggaatcttttcaagtatgaaactgactacagcaaacaataaaaacagtaatgttattgtggtttgagacataacgttccccctttcacatattattaattaactttctgtccggactcatctttaatgtaactaaagtataattctgttctcgcaaaaaaacaatttaacgatttttatgtttcaataaaaaatttttatgctaaaatatatgtataaaatgcactgatttttgcaacatttaacaggaggaagcgcgctatgacacttaatcagttaaaatatttctgcactgcatgccgcacccgcagcataaccaaagcctcagaagagctttttgtgacgcagcctacaatctcgattgccattaaagacctcgaggctgaatttaatattattctttttgcaagaaatggtaatcatctggaactaacaagtgccggtgagacattttatgaaaaagctaaagacctgctaaaacacagtacagaaatgcagaatgaattcttagaattaggcaaccgtgttccagttcttaagataggaataccacctatgttcagtacaatctttttccctgaagtacttaatgcatttgaacagaatcatcctgatatccagacagagctcgatgaattcggctctgtgcgtgcatgtgatctcgtacaggatgaaaagcttgaccttgcaattgttaatatggagcaatttaatatagataaattcgaaagctgtattcttgctaaagaacagcttatgtacgttgtctctaagaaacatcctatggctaagaaaaaatgtatgacaattgaagacttcagagatgagaatctgcttatgtttaatgtggactctgtgcagaatgagcttttgaaaaacagatttgaccagctaaagcttaacccgagaattattatgcgaagcagccagttatatactacattgaaattcattgacaacggaagctgcggttgtttccttttctcagatatgctgcctcatttcaagcaatataaaggaattccccttgaaccaccgattgatgttaatatcggaatcgtatggaagaaggggaatttcttgagccacagtgcccagttatttatagattttgcgatgcagtactgctcagaaaacattactacttaacaagtgcttcccagcgctcctttggaattgaactgctcgtcacaatacattcagggtctggtgcaatgacatgccttacaacttcaaacaccgcctgtgcatcacacagcaggctctctgcgtcaccaaatgtcacttcacgcacagccttacagtcaagaaatgcctgattaagcttaacgaaatcctctgatatgtgaggctggtctgcgttgtaatgctttctcatatatgaatccttaatgctgccatcaggcattacaatctgtaacttcatcggcttatctgataatctgtgtggtacattaagtacctcttcaacactatggataaatgtattgcgctcatgtcctactccaacaagcaaaactttccctccacagcttcttaatctgtcataacagccgcctggtgtacatggtgtattgttgttttcctcgcctgcaagatatcctgccgctttctttccaatccctgccatgctgtgtgtaggatgaagcgaccttattactccatctcttttaagaaacatattagtaagcagtccgacacatgatggtgtttctttaggattatatacaggtgagtccgaatttatattcttccatgtatgtgtaggaagaagtaaaagtccatgtccgaaatattcaatccatgcatcaagcactgtatctgccccgcctgcaacttcgccgatagatttcatagatgaatgaataagaattgtctcatttcctgttaaccccatattctctaactgcttctttaactgttctttggtatacatattagtcctcgcttttcacatatcaatatagtaaacatattatcacatttatccttgaaatatccagtaaacaatgcaataattacttttgaataatttaattgaaaggaattaattcatcatgactaaaagacgattgactcgcagacagcgtcaggtaagaagaaaccgtattattctcgcctgtgcagcggctgctttacttatcattattattgtaataatatcagtttctatgaaaggctgttctaagtctaagaacgcagataagaatggaaaatctacaactgctaaggttgaagaatcaacaccgacaaaagaaaatgaaaatacaagtgaaggagctgattcaaccaacgccgataattcatctgccaccatgtcagacattacatctactactgcttcttctaacagttctgaatatcctgcgccagagataccatctggaaatgtggtttccaaaggcactacatctaaaggcttcaagattcaggaaatcaatggagcaacttatattgatggtgttcttattgccaataagacatatgcccttcctcaggattttattccaactaatcctgaccagccggtcaacgcagacaggagttcaacatgtcttgacaaaactcttatgagtgcatggaacactatgttaaaagatgccacagccaaggggctcaacatctacattgccagcggttaccgctcatataattatcaggtaaatgtgtacaacagatatgttaaaagtgatggtgctgccgtagctgacacatattcatcaagacctggcaactctgaacatcagactggtttatgctttgaccttaacactattgaggacagcttccagtacactaacgaaggcaagtgggttaatgataactgctacaaatacggcttctgtatccgcttccctaaaggcaaagattctgctaccggatatcagtatgaatcatggcatcttcgttatgtaggtgtcgacctcgctactaagttatataacaatggcgactggttatcacttgaagaatactttggaattaccagtgagtatcctaactaagattaaaaaaggagtgttacgctgattagttttaacactccttttttgcatatatttagtttattgcggatttgatacgattaaattatcagaaacctactaattcacaacatcccatttgtttcgtatgtcaattaaacaacatattttattaaattgatttccaaaacccactaactgaattaacagcatcaatttagtaggcatttcttcaacgaaatgcttccaagatagtgtgtaatatccaaaaacaacccactaaaacgcattgacttgctgttttagtgggttgttaatcaatttgcaattctacagaagttggaatatacctacacaattgaataaaagcaacacatttgtaggtttatgccttttcttatcaccatcttaattcatattaataaatcacatcctattaacaaaccttcttacaatcaccagacatatcagaagctctaatggcatcaacactataaaccacaatgattccctaatacattcatacatgcatatctttacaagctgctctttctctgcacctgtgtcagaaagcagtttcagcctgcttctgtacttttcaaggcggttctttacaattatcatgctgactatcatatatattataattgctgcaaatgctgttacaccatatgacataagactttctattgtacgctgtcttaacagattcttttcttcagaatatgatatggtatcaaagcccgctgttttcagatatgaacagaccacattatctgttgctgcaaatgaagacttaagattatatcttatgttaaactgattcggtcttaacttcaaagtaacataatctggaagttcatcaagaaacagatactttttaataacattattctgattatccaatgctttctgtaaaagctgtgtagaacctattatcgtatactgtccaaactccggtacataatacttaagtctatcctttatctcatcagttaacattataaccctggcaacattagtactggctgccggctctaataatgaataatatgcatactttctataccataaaccttgtactgcagctttccatgaaaggtcaccatcaaataattcttcttttgatacttcaccccttttatatgacatatataaattatatttggctttcatgtattcataaagctcttttctgtactcataatactccggatcagaagtatcttcataaagttccttttcgtaataatctcttggatcatcatatgtacattgaagatattcatcaactatttctataatctgctcccttgaaatattatcacttatgtattcatacatatctttactgtctattgtatatctatattctgatataaggtcagtgaaaaatttattacatgctacagtgtatttatccatgtagaaggattttatattataaaatggatttcccatataataattattaaggttaagtgtaacaccatctttcatagtatcatcatattcaccattattatctgcatcaagaaagacaacactctgtgttccttcttttaatgcattgaaatccagcttaccgccagcatactcattaagtatatcgaatatttctttatctatgtcaacatactcgcctgcaaacacatattttctgttttcactggagccgccttctgtctcccttccttcaccattcacggtaatattaatgttcatattatcccatgtaaatgatcttgtagtttcataatatccatatgagatattatctattccttcaatccgcttcaaattattaataatatcatcattagcagaattatataatccgctcctgcctgatttaactcctgaaaaataataaggacgtgcactatgaccatctgctatattaaattcattacaaccaggaattactctactgtcctcagtatatctcattccattttcaatctttattaatttatgtaaagaatcataatatatacacggaacagttgacacattatcaaccatgtaattaacactatccgatgtgctgcattgctctttataattaccatatgatgtaactattcctatgccacacaatactgttataaccgccatgacaaatgaaaatacccttaccagaatattaacaataattccatcagttctcattaatcttgttgctgtgctggttataaaattctttttcataagattactggtaaccttaattgtacggttactgccgtattttttcttatgacagccagacagcaatatgctgattatacttaccactactgagataaccagcattattattacttttatgtatatatctttatctattctgaaaaatgtaactccttttgtatgttcaagtacaagacatattacttttcctgctcccagcgcaatgcagcttcccgctattgctgatattccaagaatcactacattttcaagaaaagtaataattatcgtctgtacatttgacgcaccaagagatttttgaataaatcggacattgtttctagacctgttatatataataatctgatatgtaactgctacaattccaataatcataatgagcatatacatgtatctgtttactcgttcattatcccatgactgataatcatatacaccgctgttataagctatgttgttccttatgccactttcactggcaatagactgatacattgtattatagtcagtctcactaatgaaatcacgcagcctgtatgcatatatatatgttatctcatctgctattacatcagcctgcgtatctgtcactataacacctggtaagcggtaaccattctgccatacattagtatagctttttataattccgcaaagtgtatagtctgtatcattaatagtcagaatatcacctatatctgtcccctgtcccagctgtatcagcgaattctggtcaacagccacttcattgtcagcctcaggcatatgtccctgttccattataatactgcccatttttatgaattcatctgacattgtaccaaccataatcttatcagttgcagaaatagcttctattgcgttgtcagaatctacagaaagcggttctatacttctgacagttactgctgtcactgcctgttcaagatatgggtgattcttaatcacatcattctcactcttattggtgctattataaaacataacaaaccagttgccaaaatgctgtttattaatagctgtctgccacttcttcatattacccgaatataacagaactcctgtgacaaacataaatgatatcattaccacagcaataacacgcaccgcttctttccagcgtctgcgaagtcccttaaatgtcaatgcaatcaattcactgttcatacacccacaccccctgtcacacttccatctgtgattgtgagtatacggtctgcatattctgccatctgtctgtcatgtgtaaccataacaatagtctgctgatacttggatgccgcaaatgtaagcattttggcaactgtttctgcactcgccgcgtcaagatttcccgtcggctcatcagcgaatataactgacggatgtgtaattaatgcccttgcaattgcaactctctgctgctcaccgcctgacatctgtgcagggaatttatccttacagtagtctatgccaagtgattccaataattcagtcactgcttcctcgtcagcatcttccccatcaagaattaacggaagtattatgttctcatatgcagtgtattcaggaatcagcttataatcctgatatatgaacccaatatgcgtgcgtctgaattttgccatttctgaattcttaagattacttatatcttttcctgctatgtacacctttccttcgtctggcttgtccattgttccaagaattcttaacagagttgacttgcctgaaccacttttgccgacaatcgcggtaaattctccctttcttacctcaatatcacaccggttcaacgcattaatcttcacctgtcctgctgtgtaagttttagatataccttttgcgcttaatattatgtccatacgtctccccctctcatccccgatttctatctgggataattatatcttacaaaacttacatccaacttacatcggctgatatttcgtctttaatctgtacattgggagtgtcacaacgaattcagctccgccatacttttcactgtttcctgcctttatgcttccatgatgtgcctcaataacaagctttgacaggttaagtccgatacctgccttaaaatccgccgcactaccattagtctcaaatctattaaatatactgttaaactgctgtgtacttaatcctttaccattatctgcaatcgtaactacacagtcatcattctttcttgttacatcaacgtataccttagtattgtcatcagctaaatattccgcacaattatcgagaagattaatgaaacactcgacaatccagccttcatctgcatacatacacaatttttcgtcaccataatctgtggtaattctatttctgtctacaacactgctgttaatgctttcctgaagtattgccgcaacatcaacctcatcacttgtcatgacaacctttcctgcctcaaatcggcttatatcaagcagcttctttataaatgttttgattctgaacgcattacctgtgcaatcagctatttccttacgctgcgaactgtcatcacatttttcctcgagcatttccagcttcatagttataattgccagcggcgtcttaatctgatgtgctatattttcaataaaatcctgcatcttctgatgctgctctttattgtaaatgtgttcgttatctaactgcttagaaagcctctcgttatctgcatatacatcgcacactttctttacaaagcccttatgtccaagtctgtaacagttatataatcctgaaccgagtgcaattaaaagaaccactattattgcaattaaagcatacatttccccattaagtctgctcatatacgaaaagccatggctgccgtatccggcactttccatggctgtcctacccgctctgatattgttatctgttatccctgatgaaaacatttttcgtacaaatgcttcaccgtatgcattatcctgtaaatacaatgcacctgccagtgcctgttctttaagccggtaataagctataattccagctataacagccacattaatcaatccatatataataacgaaaacagtctgcctttttctgaatacagacagtttcttcttaaccgtgttatccatacatccccctgaaagttattagtcaatccacctatagcccacatttctaatagtctctatgtattgctgatgtttctctccatatgttccaagttttgcttttattctgctcattgcaacagtcagcgtgttatattccacaaaattaccgtgaatatcccatatcttctcgtatatgacttcacgccttacgacttttcctttattctctataagtattcttacaatatcgaattcgttagttgatacatttaattcttcaccacagcggctaatcttatatctatcaaaatcgacaacaatatcacccttcttatagatatttcctgcattgaacatgcttcttcttaagttggcacttattcttgaaagcagttccttcgtataaaacggctttgttatataatcatctgcacctatatcaagccccgtgactatctcatcctcattatcacatgaagttaagaaaataactggcacttcgcttgattttcttatcttcctgcatatatcaaatccacttccatcaggcagcttgacatctaacagaaacatatcaatctgtggattgccaatatatttatccgcttcatcgcagcttctggcagtaactatctcataccccttctcagtcagcagcattttaaggctttcacataattccttctcatcttcaacaacagctatcataacttccgttccttttcacatatcctgtcatactgcttatacattttctgcacctcgttttcaagcagatagtaatgcttgatgtatggaacaagaaggataagtattgcaattgcaaggacaagcagaggcatgcttaatgcagagtctatcgccccaactatcacatatgcgcacactgtcagcagctccaatattgcaaatgttatggttacaatcaaatgcacaagcctttcatgctgaaagaatgccacctgtgtaagatgctcctgtttgatgtatttccagtcgcagtcttcttctgactgtaataatgaatctatgtattttctgtatgttaaaatacggtttttcatggttagccttcttcctttaaaatgtctatcttatatttcatcatctacactatttagtaaacgatcaaaatcactctgatataaagaatcctgaataaccctgtatttctcaaattcactctctgcaaattcttttgctatcgcagctgtcacctttcctttatcttgcaacacatcggcatcattgaatctaagaaatgcatccagcttagttttccagtcttccatagtcattggaatatgtcttcgtgcctgtcttgtagcataatctaaatacattgttactatttcattcaattctgttatctcttcttttgccaaatagttcttggcaatcgtaacatccgtctttacaatctttccgtctggtgcgtttttccaagatgtaagccccatatgttctttattatgatcggcccttgcaactatcacttctgctgccgtatttccatgtacggcatagtgcatcttattctgaactgtcgcataaaactcctttgttactacagaatttttatcataatcaacagcagttgcatatatatctgtaatcttttgataaaacctccgttcacttgctctgatttcttgaatttcagctattaaatgttcaaaataatcttcatcaaaaatctgaccattaatcaacctgcttttgtctaacacatatccctgttttgtaaatgcttccaaaacctttgtcgcccaaactctaaactgtgtcgccctttcagaattagttcgatatccaacagctatgattgcagccaatgaataaaacttatacttgtattcttttccatcatctgcagtttgtgcaaattttgcacaaactgaattttcatcaagctctccatctttaaatatgttacttaaatgctttgaaacgacacttctatcaacatcaaaaagttgtgctatcgccttctgagtaagccatacatcattattctgcactcttacttcaattccatcatctcctgcatctcgggtaaataccagaaaatccactgtactatttcttatttgtattttttcgctcattcagacatacctttcttttctatattgcactaataagaagcatatttaaactaccttcccgatatcgcactcttaaaccatcttcccgtctcagacaaatcaccatcactccagccgctcttagcactgcagcctgatgaaataagtgctgaagtttctgctttattgctaagactccatgcaataaaactcagctggttactgttcataaagtcaagccactcgttggcagatgcataatctattccaccattgcctgatgcgtcacatatactacattcgctgataaacactggaactccagcattaagtgctgtgcttatcttatttcttatattttctttatgtgttcctgcataaaaatgtgccacatacataacatttccatcatcaagcgtattgccgacaacgctgtcaacatcctgtgaccatgtattagttcctacaagtataagtgaatgatcgtcgaattgtcttattgtgcctattacagtctctgcatacggcttaatgtctgaattccagtcagcaccaacaggttcgttacatatttcatatattacattgtcatggcctgaatacttagatgccatttctgcaaagaaatcgcacgcctcctgagtgtgtcttgatggtgcataattaagcacatgccagtctataattacatacattccaagctctgttgcataattaactccattatcaattatctgctttaatgaatctttgtccccacctgaaagatatccattatattcttcagggtacatagcaattctcactacatttgcaccccaatcgtcccttaacgttgcaaatgcatcataattaacatagtctggaaaccatgatattccgtgtgtacttacccctcttagctggataatgttacctgattcgtcagttaatttcgtgccagatacctgaagtcttcctgttggaactgttgtgactatgcctgcattgcttcctgtatcagagttatttcctgaatcatttccagaatcacttccacccggctgtgctgtatttccatctgacggcttcgtatcttctggctgtgctgctgttgactcttcacttgaatcagcaatttcttctcctgctttatatgcctttccatcattagcaagcacaatctccacacctgattcaagcttgaaatcaagtgtatatttcgtaagtccctccttagacgcagaacttataatgaatccgacactattcatctgagcctgactctcaattatcttattataatcgacaggcacaactctccactctgaatcagatgtatcaactgtacagttccagctctgctctaaagttataccacttattgtattaagcttaaatgtccagtccgatatctttgccgtctctttattatcaataacaaggtcgtactgtgcatagaatctgccattgccctcccacgaattagactgcttaaactgcattgttacagatgtctgtacctgttctcccgcatcttccttagctgtctctgtcacagaaccagtctgtttctcattattcaccgtactttttgcattaacattttccttatgtttccctgattttgataatactgcaaatgtaacagctaatcctgttacaattatagctataactattattatacataatttctttttattcatcatatgtttttccacccccatttttttattatagcaaaatatacaaaaatacaccatatcctgcattataatcagaatatggtgttaaaattatcttttttctctgtcaatatattcttttttagttacaagactcttatatgcaggacgtattatcttatctgtagttattaattcttccagtctgtgtgcactccagccaactattcgggctatagcaaataaaggtgtatataactctcttggtatattaagcatatcatatacaaatccactatagaaatctatattaggacttactcccttatatatttttctctgttctgcaataagccttggtgcaattttttcaatattattatataaaagcatatcttcattgcgtcccttatctgttgcaagctgctccacgaatcccttaaacactttctctcttggatctgagatagaatatactgcatgtcccataccatatataagaccttttttatcaaatgcctgcttgttaagcaatttatccagatatgcagctatttcttcttcatctgcataatctttaacatgctccttaatatcatccatcatattcataaccataagattagcgccaccatgtttctttccttttaacgatgacatagctgcagcaataacagaatatgtatcagaaccagaggatgttacaactcttgtagtaaatgtagagttattaccaccaccatgttccatatgcaacagtaatgcgatatcaagaacccttgcttccaaatccgtaaaacatgtatctggtctaagcattctgaggaaattctcagctatagataattccttttctggtctgtgaatatacatgctctgatccttctcataatgattataagcatgatatgcatatgctgcaatcatcggaaatgttgcaataagctgcatactctgtcttaacacattaggtatatccaagttatcttttttcttatcatatgaaccaagagtcagaatactcctagtcattgagcccattatatccgctgtaggagccttcattataacatctcttgtaaaattagttggcagcttcatacactctgacaactcgtcacggaattcctttaactggtcattgtcaggaagttctccaaacaagagcagatatgcaccttcttcaaaaacatattttttccccttgcttcctgcaacaaaatctcttatattgtatcctctgtatgacaattctccatcacatggacgcttttgaccatcacggtattcaaaagcctttatgtcagatatattagtaagccctgtcaatactccctgaccattttcatctcgtaatccacgctttacgccatactccgaatacaggttcttgttaatactatcattgttttcacaaagaaccgccatctgctccatgtaattatcaatactgttcattcccattacccctttcctgctactcattaaaactttttatattattcattttcagataatatattattaaacttaaacataaatactatcgttgttacaatagccgcaataatatcacttaccggctctgcaagaaatacagcaaatactttatcttgaaaaatcaatggtaatatgaatataagcggtatcaacaatataagtttccttaaacatgccagtataagactgacttttgcctgtcccaacgccataaaactctgctggcagcttacctgaaatcccatggcaaatattcctgccatatatattctcaatgcccatgctgtataattcacaagtactttgtcacttgtaaatataccggcaaacagctgtggtgtgagcatcataattgcccagcttatacatgtgaatattacacatgctttaaactgcgtaataaatgctttcttaaccctgtcattattctttgctccatagttgtaactgataaccggctgtccaccctgacatattccctgtaacggcataacaataagctgattagtgcttgttataattgtcattgctcctaccgcaaggtctccgccgtatctggaaagacttgatgtaaagctgattgacaaaatactctctgtagataacattacaaatgttgatattccgagtgcaagacacggtccgattatcttcgcatcaagtcttaggttagctttcttaagacgaaggattgtcttgttaccagtcaggaaatgcagaatccacacagctccgacagcttgactaagcactgttgccagtgctgctcctcttactcccatattaaatacaaatataaatataggatccagaacaatattaatcactgcaccaattactgtagtcagcatgctgatcttagcaaacccctgtgttgtgataaacatgttcattgccataacaatcaggacaaatacgcttccgagaatatatattcttgcatatgacagagcatatggaagcgttgcatcacttgcgccaaaccatcttaaaagctgtggtgctgatacataaaacaccgccgtcaatacaaccgcacatatcattataaatgtaaaacaatttcctataattctctcagctgtatcattgtccttctttcccataaatattgctgcccttggtgctcctcctgaaccggcaagcattgcgaaagcattaataagcataagtatgggagtgaaaagtccgacccctgtaagagcattagccccaatacccggaatatgtcctatatatacacggtcaactatgttatacaacagattaacaacctgtgctacaactgcgggaattgcaagcgaagcaagaagctttgttatatttccctctcccagatttcttgtcatattattattcttcataataaacctcttagttctgtttaattgccagatgtctttctcacatatactgaccattaatttatttaactataatatcattaatcatttacatagtatatagatttttatctgtttacgaaattttcataaatatacacattacaaaagctgccactcatttactataaagtggcagcttttgtatgacatttttattataataatttattttgtcttataaccaaattcaggaattgcactccatctgttacggaagtaatgagcaaccatctttggttttctgtctcttgtgaacagtcccttcttattaccttgtactcttaacaggctctggcttgttgcaaagtctgcgaagttccatgcctgttcacctacaacaaagtcgaattcatcaaatactttattattcatctcataatattctacctgatattcttctgtatacataacagatgttgtatcatgaagtccgctcactgtatcagctccatattctgtgaacataacaggctttccaagtttgccccagtctgagagttctttacgaagtccagtctctgacacctcaagatcaggaccaccaaaataccatccataatatctgttaagacagattacatcacttaattgagatgagcagtctgtatcagcagttgttccctgaacacttactaatgtacatggtcgtttctgaggatctaattctcttgcaagatcatataaaggcttaaagtagtcatatgcaccttctgctgctgaatcaggttcgttagctatgctccacataacaacacatgcatgattcttatctcttgatatcaaatcacggataacatccttatgatgttcctgtgtctgcactccatgctccttatcaaatgttcctattctctctccaccaaaattagctcctccgccgaactgaagattgactcctactgctgttgtttcatcaataacaacaataccttcttcatcacaaagtctcatcatctcctcgctataaggataatggcttgttctgaagctgttagcatgctgccacttcataattgatatatcctttgtattcataggaagatttattccacgtccattaggaaatgtatcttcgtgctttccgtaacctttaaagtaaaatggcttttcattaattaaaaactttgtgccatctactcttacacttcttacaccatatggaagtgtatacacatcctgtcctgctgtaacctttatcttataaagataagcatttaatggctgccataatcttacattacttatctcaaatgtgccttctgacccttctgtttctgaaagctttgtgccttcttcatcaaataattcaactttacatgttatgttgttgtaatcttttcctttaatttcaacattataattaagtactgccgatggttcttcttttgtgaaatcaatatcagctgtaactgtaatatcattgatatatgtctcaggtgttgtgtagatttttacaggtcttgtaattccacaataattaaagaagtcaaagttaggattgttctgtggtttgtcagatgcacctgcacccatgccccccatcattccactcatcatgttagccttaccaccaactggcagagttgtataatcaataacattattaaccgcaatggtaaggagattatctccatcctgtaaatgatcatttaattctacttcaaatggaagaaatcctcctttatgctcacatatcagtttgccattgagatagatcatggcataatgtgtaactgctgcacaacgcagtacaattctctggctctttacatattctggaactgatatatttctctgataaaatacccatccataatgatctctgaaatctgtcccctccttaagatcattataagaagctggcacaggcattgtatctgcatctttcaaaggtttctcataccatttttcttcaaaaccttttccgttatctaacttaaaattccaaaccccgcttaaatcgcttaataatcttgactgtgttaaaactggatataacataattaattcctcctgatttatatttataatatttttactgctgttccttagctgctctaatttctcttaacttagctgcatttgcttctactctctttttattcaaaggatataagaatattaatgcaagcaataataatgtcattccggctgccggcataagacatgtcacattgtagattccgtcaataaccttaggatcaaatgctgtagctgttgtataaccaacaatcgaaagaagtacgcccgctaaacctgatgaacatgcctgtcctaactttcttgcaaatgaatatactgagtaaattgtaccatcctgacgtacaccattctgaacttctgattcatcgataacatccgtaatcatcgcccatataaccatgttaaacattgaagtaccgattgttgctataattattaaagctatccagatccatacattatgagtgtgaattataaataatgttataaatgaagctgcactgataatacatcctataactgacaattctttctttccaatttttgatgcaagctttgtaataaatgttgaaagtaaaagtattactattgttcctgaaagacttgcaatcgacattgcttttatattgccaaaataatttggataaatatatgcgttcatgttacttaatgataactgtgcaagtaaaaataccagtgcacaaactataatgcctattaatgatctgttatgggcaagttcctttataagctctccaaacgaaaatttctgtgtattctgtccaaccttaactctttccgttgtcattttatagcaaagcatatagcagatcactgctcctattgaacataccaaagcaccaagcatcattttctgaccggataatactgaatttcctgcttcgtctgtataatatactacaagtggtaatacaacacctatcgctgtctgagcaagtgtagctcctattgttctccagttagaaagagaagttctgtctgtcggattgtctgaaatcgctgatgccattgaaccataaggaatattaattcctgtgtagcatatacttccccaaagaaggtaagtgaaaaacatccagaaaatcttaaatcccatcggcatatctttaaaccatgtcgcatacatcagaaatgatgctaatgcaacaggaccgcacattcgtctgagccatggtgcaaatttgcctttctttcccggcctgctcctgtcaactatctgtcccattgttacatcagttatagcatcaacaaatcttgccgccatcatcataagaccgaccagtgctgctgaaacccccataacatcagtgtaaaacttcaacaaaaacatagctgataacaaaaaagtaaaatcgttaccgaaatcaccaaacatataaccaagcttgtcttttataccaaatggcctcacctttccattgttatctgtcataataaaacctccatcactttattaaatattatagatattttttctttaaagaccgtccttaaatattatgtgcactattatgtgctctcttttctatgtctttatattaacctataaataacatacccgttattacagattttagtatatctagtattatttttacccatacattttttatagcaaaaattgtactataaaaaatcaaatcattactaacatgtcagtatcagttttataacatgttagtatcagccagtgtgacatgtcagtttatttttatgctttgaatttttgttttcttctgttattataatatagtaataaaaactgatagagattggaggtttatatggactataaagtatatctggactacaccatggaactattatctaagataaaaataccatcttatataattgacacaccatttctctgggatgacagatatgatggtgaattaagaaaaactatcctcagtgatgcatttttaattaatcataaagaaacatttcagaactttattaactgttctggcaaaaataatacaattcttctgattcatgacagttttgcctgtgattatatatatattaaattgcccgactcaaaaaaagctttctttgccggacctttttcatttgaaaagtttaccaatcaaagaattgatgatttatgttcatacaattcaataccaccaaaatttactgattttatgcagctttattatgccgcactcccggtatttgcagatgaacgatgtatagaagcaattataaactgtttatgtagtaaattatggagcagttacacacttgagaaaaaacattttcttaataaaaatgcttctgaatacatgtacaatgattattctcccgagccaacaaagcaatccattgaggttcttgaacaacgctataatgatgagtctcttctgatggaatatgttgctcatggtgattttgcatcaattgacaagcttgctcatcttaattcatctggaattaagccacgcctatcggattcaatacgcgatagaaagaatttcatgataattcttaataccatttgcaggaaagctgcccaatcagcatatgttcatcctattcatcttgatgaaatatcacgcaaatttgctatccgtatagaatcctgtaccacaattgcccagcttgaaaccctggaaaatgaaatcacgcgtaaatactgtctgcttgttcaatcttattctttaagaaaatatagcaaacctgttcaaaatattattaattatatctcatttaaccttactgacgatctcagccttaatgcaatttctgctaagtttgctttaaacagcagttatgtatcttctctatttaaacgtgaaaccggctcaacgctcactaattttgttaataataaacgtattgaacacgctatctatctgctcaatacaaccaagcttcctatacaggacattgctgtacaatgtggaattacagatgttaattatttcaccaagcttttcaaaaaaatcaaaaacatgactccttctcaatatagagaaatgattcaataaataaaaacaaccatctggatacctgttgattccggtatccagatggttgtttttaattgttttcaaaataatcaggataaattattcttaacttatcaatctcattaaaaattctgttaatatgtcctttaataacacgaagatacattcttttatcttttttccttattgcatctataagcatctcatgttcctcattagttttaacactgatagaactattaagttctgctaagaaacgtattctgttgtaatgactcatctgcattttaattatattagcagcgagctgttctccagagctttcatatataagttcatgaaaagcattatctatttcaatccttggaactttttcattagatttatcataattaatgaggcggctgtttaattcttccatcttatcaagcatctcattgctgacatgctcaaaaaccgggtctaccatccccacttcaagactttttctgacaaaccattcctgttcaaaacgcctgcaattaatacttgcaacgtatgtgcctgactgaggtattattttgagaagcccctccttttcaagattaacaattgcctctcttgccggtgttctcgaaacattataccttacagctatcttctgtgcacttattgaatctcctggtacaagcttgaaattcatgatatcgtattttaatttttcgtatgtgtcttcgtttaatgatttttccataaccctgcggcctttcttatattatgagcctgcttgttatatatattaaaggtattttttaagtgtatttcttacagcaccctttcctgctatctcttcaacaaacatctcttctattttatcgccaattcctgcttcatataaatttataccaaatatattagcatttgacaataaattcttaagctgtcctgtataagacgatatgtcgcctatttttatacctgataaatgcttctttaattcatctgccatcggatctggagacaattcgaagctttcgccattatcatcaattccaagaagatatctgcaccatcctgcaattgccaatggaatcgctattaattctttggcacttccgtcctttgctacatatgacttaattgtttcgccataccgtattcctaccttctgtgaagtatctgtcgctattctttgcggtgtatcaggcataaaaggattaggtattcttacattaaggacttcatccacaaacttctgtggtgaaattatctccggattaattaccacaggcattccctcagataacccaattcgtctgacaagctctgaaagttccttgtctttcatttcatcagcaatcagattatatcctaataagcagccatatactgctaaagctgtgtgtaatggattaagacaggttgttactttcatacgctcaaccttattaactgtctgtctgtcagtcatatacacacctgctttttcaagctgaggtctgccattagggaacctgtcttctattacaagatactgtggtccttcagcatttacaaatggagcaatatatgtcttcttagatgttatcaccggactcatatcctcaacacccgcttcctctaatgctttagcaacactatctgctggtcttggtgtaattttatcaatcatagaccatggaaatgatacaagctcttcattattcacataatcaacaaaatcattaccaacaaatccttttttattccactcagttaccatctcagttatcgaatttctaagtttttctccgttatgtgagcagttatccattgatacaactgcaatcggtgccttacaggctttaaaacgttcatacaaaagtgctgctgttactgccattgctgatgttgctttttctggtccattatcaatatcttccctgataaaagagaaaaactctcctttagaatccttcaacgcataacctttttctgtaatggtaaatgacaccatctgaagtcccgggtcaacaaatatctcctttaatcttgcccattccttctgcgaatatgattgtgccttaatagcttctgtaagtgaaccaagcacctttttttctgtatttccatcttccttcaatgtaacagccataacaagattatcaaatggcttatatattttatctactacatcaaagtcaaatgtttcaacacatgtaatgcctttatctaaaactccctgttccaataatgaatctgcaattccaccaatgaatatcctgaaaatattaccaataccaaaatgtacccatacaggtgacttttttgtatcctctgcaaccttttcaacatcatatgaaggcagctttatgccagccttttcccaatctgtcgtattcttaataccatttattgaaagtttcataatatcctccattatgccataaaaacccaatgttaataattactttgatgatttatcaatagcttcccataagccattaaggtatgttgctcctaaagccctgtcatataaaccataacctggcatagccacctcatcccatatcattcttccatggtcaggtcttataacgccgtcaaaacctgtatcatataatgttttcataatcttatacatatccatagaaccatcagatgataaatgtgctgcttcttcaaaatccctaggtgaattatatttaaggtttctcacatgtgcaaatggtattcttcctctgcatgccttaataatctcgcaaatatcattattctggttagagccaaatgaacccgtacaaagtgttattccgttatatggtttatctacagcatcaagaagtcttgtaacagaatccttacctgtcataattcttggaagtccaaatataggccacgcaggatcatccggatgaatacccatctttatatcatacttctcacataccggaccaattgcttccagaaaatataccagattattaaacagcttttctgcgtcaacatctttatacatttcaaaaagttcttttaatctgtcaagacgctctggttcccatcctggcattacgaatccattagacatctttgcaactgattccttcatatgctccggatcaatcatatcaactgtatcctgattatatgcaagcaccgttgaaccatcagctctttctcttgcaagttctgatcgtgtccagtcaaatacaggcataaaattgtaacataccacatgaatatccgcttctccaagagcctgcagagtctttatataattgtcaatgtgctcatctgccttagctgtgccaatcttaatatcatctgacacattaacagattcaataccagcgattcccaacccggcatcttcaacaatccttttaagctccgctatttcctctggaagccaccgctccccagcctgcttaccaaaaagcgttgtaataacattctttacgcctggaatctgtctgatctgcttaagtgttacgctgtcgtatcctggtccataccatctcaatgtcatatccataacaaaaatcctccttttacataacaacattattattctgtactatatttgcataattatttgctatgtgtatactaacatgtcagttctaacatgtcaatgtattttttgagtttattttgttatgtttttcaatctattttgatatcttttccttctgcttcaccatattgacatgagtaattcccatcaccctgtcatagaacatctgccgtgtactgctgaacagacataatatgaaatctatcgcaaaatatgccgtaaccataaggcacaatacacatactgctatactgacagagaatctccacccataagccttaagtgccacatgataaagattatatgcatatacaggagatggcaggcttaaaacatacagaataaaatatcttcccataagcctgaaaacattcactctcctgtgagtatcagcctcaatattctcagcttcgtaatctgcagccttattatctcttttcttgctctctgccctcactagtcttatattaacaagtgccttgcctatagatcttcccttagtaactgctgtaactattgtaaatgtaataactatatatacagctatgacaaccagatatcttacatcgtacacagcattcataaacttttctttatctattgcaaaaaatacggcaaccggagccattatcacaagcatatccaacgcccatgctattattcttctgaattccgacacaatctgtcctctgttgtaagcaacctcatccattctgtcacgctttggaagcatgaaaacaaccgccggcataacccagaagcccaccattcctccaagtgtgttacatatcaggtcgtccacttcaaagaatctgtatggataaggatatattccatacaagcctgacaactgcgtaagctcaaaaaacaggctgtagcagaatgacattataagcacctgccaccattttctcttaaaatagtatctcagatacacaccaaatggcactaacagcagaatattgaaagcaatctgccagaagtcaccacatttgaacagattaatatatgttgccggattcgataaagtaatattcacagtagcaacaactcttcttactgcgtcaaatggcaccaacagcatacatgccgaatccggtgtcactgaatcaatcgaaggcagcggaagcactgtcataaaatatgaggtaagcatgtagaatataaatgtgtacacaacccctgttcttattacaagtattgagccatatttatgatattcgtatattatatatggcagtgtgaaaagcacggcaagaaccgggaacacataacacgctgaaattatcggttttaagtatatttccatgaattatctccagtccacattcttggcattaatcgctttttctttaagtgttgccagtctctttattgcttcattaagtgtatcgtcctgctttgcaaaatgaaatctaacaagattatgcacatcttccctgaaaaagcttgaccccggaactgccgccacaccaacgaactgtgccatccattcgcagaacttcacatcatctttaactccgaattcactcacatcaacaagcacataatatgccccctgtgggtctgtgtattttaatcccagcttcttaagaccgcctacaaatacctctttcatatgtgcataatgtgcggcaagttcatcataatagccatcaccaaactctaatcccacaactgctgcctccatcaatggtgcggctgcaccaactgtaagaaaatcatgtaccttcttaactctgtcgattatctgtgggttagcaataacataacctaatctccagcctgttattgagtatgtcttagacagcgaattgcacacaatcgttctttctctcatgccctcaagcgactgcatataaatgtgcttattaggcgcatacacaatatgctcatacacttcatctgtaacaacatatgcgtcatatttctttgcaagttcagcaattgtctgcatttcctccattgtaaacaccttaccgcatgggttggaaggattacacagaattaatgccttagcgccctgtctgaatgcatcttctaacttttccttatcaaaatgaaattctggtggaactaatggaacatatatcggctctgcgcctgaaagaattgtatctgcaccgtaattctcataaaaaggcgagaatattacaaccttgtcacccggattagtaatactaagcattgtagccatcattgcctctgtacttccgcatgtgacaacaatctctgtctcagggtcaatcttaacaccagaaaaatgttcatatttcttagcaactgcatctctgaaattcttagctccccatgtcaatgcatactgatgaggtccttcgcctgcaactcttgcaagcctgtctgttatagcctttggtgggtcaaaatcaggaaatccctgtgataaattaactgcaccatatttattagcaactcttgtcattcttctgatgacagagtctgtaaaatttgctgatctgttacttaactctttcatgtaaatgtgtcctccattatttaagtattttcataatttcaatgccatttattatagcactgttcacaaaattctcacaaactttccaactcattttcacatttcccatttaatataaacaatgtcgaaagacaacagacaaactttttcataaaaaagatggctgtctaatctcccaatgcagcagccatcggatgtttgaaaaacatttttccccctcataaagagagccggtatatacgaacttcaaccccattgtcagtccgtatatcctggctctcttatttaatctgctatatattctttcagctttttctcgctgtctaatctgcatgcaacaatagtagacattatcatgtattttaccacgccttttgcaatatgctcctcgtaacggcatttcatatcgacaggatatcccgatacaagaaaatgaatctggtacttatcctgatttcttgatataaatgcacttacatacagcccattaagcactgccgtaactatttcatcatcagtaacaggaatgtttatcttataacctggtgatgaaaatgagacttcttcgtctctgttatggaatcttccgtccgcaatctctgctattgaatatccgccaacatgattcatcattgcaccaagcactggcatttcaaggtcattctcaattatataattgtaacaatctgttggagtattaaacattttccttctcctatatttcgtaatccatgcatgaccttactgctgtgtaaggtcttaccttgctgtctgcaactgctacatgcttaggatgtacggcataaccctttaaactttccacgctgtcaaatgttgtgtctaacattacatctgctgtagaacttggaagacactctgttcttacttttacctctataagtcctggaatctgtcctgcaagaccttctagtcctttcttaatacctgccttaacctgctctttttcttctcctgcaagctcatcctttaatttccataaaataacatgctttaccataataattgctccttatctaaataaatatttgtacttgttcatctgactgtatatgattaactccaccctttttctttcttccggtggatacatatctgcgttattaactatatcgcttacattctttttagtaaatagaaattgcagattctgtccgtataaattttcggccacatcaagctgctcatcaaaattctgacttacgctcttgctcttaacttctgatatcatctgatatatatcctgttccattggataatccattgttgtatctgacagaagccctgcaccattatcaaacaccggacaatatttataatcaccttttccattcatcaagacagcaatattatgcatatgcctgtcctcatttaggaaaaatgcgtctattgtaaatagtctgcatatatactcaccccaattattaagacctgttatattctttatagaatttacaagaaattcaagcctttccttcacatcactcatatgccacaaaacacttgtaagactttcattatatacatttttaaatagtctctccaatgtaattatctgccagtctccatctataaaagttctgctcctgacaccattatatatctgtcttttatatttaatctgttctggttcatataaaacatactcgtcttcattaagattagtatactttaataaatgtgatataacatattccgctaacccttcatatccggtataatcagctttataccatgtaccttcgttttcccattttaactgatttcccttagatgactgtcgggtattggttcttatattctgttcaaaaagttcgaccataaacattcctccaccatctacttctctattcttatccagaagtcatcctctgccatacgcccctgcgtcttttctattatcataaatgtgtcataaaacggaagtccgatatcctccagcacaagcttcatcttatctcttgttcttggaaaacatcttgactcaaggaattccttatagtcattgtaatcaggattttcattaacaccaaatgcacgaaacatcagcttgtctgtataattctttattctcacaagctgctttgcatcatcaacatctatcagtgtacagatgtcgtccttatacatataaaacattctgactggaaattctttttccggtattatcagtctgttcacataatcaggataatcattaatcatctttgacagtaaaacaattggaccggtaatcttagcattttctttttcccatcgttctattgtcggtttcgatgttccaacaagactggcaaattctttctgtgtcagtccaagattcttccttagattcttaacatcctccgatgtaatataatcttttaatgcaaacattgtgtcacttcctttcagtccttgataaataatgactttccataacccgagtgtaccatgtacacattttgttgtaaataaaaagtcgttaaaatgatgacttttattcataataattccatcattttaacgactttattcatataaaaatatttctcacttaaatcagatagcctccaaagcctgtgcaatatccgcaatcagatccttcttatcctcaagaccacatgagatacggataagtcctgctggaattccagcggctttaagctgctcatcattcatctgtctgtgtgttgatgttgcagggttaaggcagcatgttctcgcatctgctacatgagtttcgatagctgcaagctttaaattcttcataaacttctctgcagcctctcttccaccctttaactcgaatgaaactactccgcagccgccatctggcatgtacttcttagctgtctcatagtacttgttagaaggaagtcccggataattaacgaattcaaccttatcctgcttctcaagaaattctgcaacagcctgtccgttttcaacatgtcttggcatacgcacatgaagtgattcaagaccaagatttaatataaatgcattctgtggagactgtatacagcctaaatctctcataagctgcgaagtacattttgttataaatgcgccttctttaccgaacttctcggcatatgtaattccatgatatgattcatcaggtgtgcagagtccagggaacttgtctgcatgtgccatccagtcaaactttccgctgtctacaatagctccaccgactgctgctccatgtccgtccatatatttagttgttgaatgtgttacaatatctgctccccattcaattggtctgcaattaactggtgttgggaatgtattatcgacgataagtggtacaccgtgtgcatgtgctgcatttgcaaacttctcaatatctaatactgtaagtgcaggattggcaattgtctcaccaaatactgctcttgtgttgtccttgaacgctgcattaagttcttcctctgtgcagtcagggtcaacaaatgttgcttcaattcccatcttcttcaaagtaacatcaataaggttaaatgttcctccatatatagaagatgatgctactatatggcttccagcttcgcaaatattaaataaagcgaagaaattagctgcctgtcctgatgaagtaagcattgctgcacttccaccttcaagggctgcaatcttagctgccacataatcattagttggattctgaagtcttgtgtagaaatatccacttgcttcaaggtcaaaaagttttcccatatcctcacttgtatcatacttaaatgtagtagactggattataggaatctgtcttggttcaccatttccaggagtatagcctgcctggacgcattttgtgttaattgaataattatccatatttccctccggctttatatgtttacatgacatgaattatatcacaaatgcaaagcatataacagcacattttaataatctggctacacatttattaacataatatgttataatatcaattatgctattatcagtttttaataatattgtataataattaagaggttttattatgaataatcagtcagcgactatgaacacaaaagataatccgcttggatataaaaaagaatccactctgcttgttggttttgcaattccatgcattatttcaatgcttgtgacagcgctttacaatattgtcgaccagatatttatcggccagggaatcggcatgcttggaaatgctgcgactaatattgcatttccactttcaacaacatgtacagctatatcgcttcttctcggtataggaagtgcgactaatttctcgctgtatcttggtgccggtgaaaagaacgaatctgaaaaatatgccggcaatggtattgtgcttatggcattgtttggaatatttctgttccttgtaaccactatattcttaacacctatgcttaaattctttggtgcaactaaagatgtacttccttatgcaaaggcatatacaagaatcactgcgtttggcttcccattcttaattgcaaacactggtatgagcaagcttattctcgcagatggaagcccacgatattccatgatatctatgcttgctggtgccatagtaaatactattcttgacccattgtttatctttgtctttaacatgggaatgactggtgctgctcttgcaacaattacaggccagataatttcattttcaatcagtctgcgttatatgtttcattttaagacaattaaacttagcagggaaagttttattgtatctgctgcccactgtaagaaaatatttattcttggagcaagtgcctgctttaatcagattgcaatgaccgttgtacagattgttatgaacaatacgctgtcacactacggcgcacaatcaatatacggtggagacattcctcttgcctgcgccggaattataactaaagttaatatgattttcatgtcatttgttatcggaatatctcagggaacacagcctgttataggttttaactatggtgcaaagaagtacgcacgtgtaagaaaaacttatcttctttcacttggtgcagcttctgccctgtctttaatcgcatttgcatgcttccagatattcccaagacagattatcagcatatttggaaacggaagtgacctgtactttaaattctctgaaagatatttcagaatatatatgtttctgacaattgttaatggcatccagcctgtaacttccagtttctttaactcaattggcaaatcacagcttggtgtatttatgtcgcttacaaggcagattattttcctgctgccacttatcattatatttcctatattcatgggaattgacggtgttatgtatgccggacctatagcagacgctgccgctgctatcgtatgcggatactttactataagagaattaaaagaattaaaaaagctggaaatcgatttaactaaatgttaaaatataagttatgcgtgtattcgtatatttaacggattatttttaaaaggatttttaacatggataattttaatgctcgatatgagaaagaacttgcctatcaggaaattacctcgaataaatacactctttacggtattctgctatttataggagttgaattactgatatggattcttaatataattggattttttgaacttgataaccagataatgtctgctgttataggttcatctatttacagtatatagttaccgccagcctgcatgatgccgcaagaattgcccagcttacatatcttaaagaaactgattctttaaccaggcttttcaacaagaataaatacaacgaaatggtatcaatgtattatcctaatgtaaataatattactgttattttctgggatcttaacaacctgaaaattattaatgacacttatggacatgaatatggtgataaagcactttccgcactagcttctgtattatacgcccattcagatgaacaatgccgccgtgtttacagatttggtggtgatgaatttgtcatgataattgataacccacatgacggtgaagctgaccgaataatatctgctgttaaagatgaacttatgaaatgcagttatgatatttcaatagaaatatcaagtgctgtcggtattgcatccggcaacggaagtgatattattgaaatagtaaaaaatgctgactcagcaatgtacgctgacaaacagctctaccaccatcggtgattaggagatactatatatgcgttaatttatgccgccagcttaactgctggcggttttttctgattttttgattgtggattgctgttcatttctaattattgcaaacctcaccttatatgttaacttgatgaaagccgttggcttgaattgccagcggctttttgtattttctcttgaaatattgacttcttgaaagcgtttttcctataagaaaataagtatatctcatcttataggctgattttccctctttcaccgtctaaaatgtgattttggagttgaatttcctataagattcctgattatagttactttataggtgtattttgtggctaatatattagtcattattattttagacctataaggaatttaaatttgcgactactgataggtatcatgtgttttcaatcaacaggcttaatatatcttctctgcaatctgttccgtactatattcaacacctatatccatatttgttaaaatctgtttgtgtattgctgataaatctgatctattcatgttttttgaatctgctgattttctgctgattctgctgattttatacctctataatcatatcatggttatagacaagaaataaatttatctccataatcctccatgtcttaaattgttcttcgagtttctttcgagttttttcaaaaatcaactcgaaagaaaactcgaaacactaagtccgctaaaccattgtcatccatacgatgccctattgtctatttttatatgtccttctaaatatccgcatcaaaccgaaaaagggtgatgcccgaaagcaccaccctgtagactatatatctattctcctctacttgtaatcaattattatttctgccaagaatcttagacattcctgttgccacaaaaagatatacaaccatattaactactgatttaagaagaagtcctggtgccgaagctaatcctgctgcaaagctgcctgctattattgcaccaaatacaacatatcctaatgtcatgaaaagtaatgtaacaactgcaccaacaattccttttactgaaataaccttacatctgtcaaacttacttttcatattgccaaatattgcacatgctattattggcatgattgtctttattataagtgttggaactgcccatactgcaaatccagttaatatatctgccatcgcagaaccaattcctcctgcgagtgcaccaacaactggtccgaaaaaaaatgcacatataagtattacgctgtctcccaaatgtgcatatcccaaaggaataggaatctgtaccaccattgttgcaacacatgtaagtgccataaatactgctgttatacacatctgtgttacagtaatatgaaatccttctttcttaatcccctgctgtactaactgtgtctgttgtgcttccattttatctgcctcctatatcaacatactttaattgcacataagaataacagataaagtgacatgtgtacattgtcattttgagttaaatttatatggtcagattaagttattattacctttctttacataataacatctggttccatatattgtttttgttttattcaacccattatgtacaattgttttactaaaattatatcttgctatatttattatccctcagttaatcttattctcaaaatcctgtaactcatgaaaaatcccatctatataaacagttgtatcttccactctatacagcataaaatatctatggaatttaaaagctatccttctatatcctaaacttctcaatttttcgttatcacataattttaaacttcctgcgacctctgctaatatatctttagtatattcaaaatcatcaaggagacttcctgctgcctgctgattctttttttcatataagatgtattcaatatactcttgcatattttctttagcatcattagtaacaaccactttatatgccatactttgtcctcatatctgcaacaaaatcacctgcttctgaatattctccattctttgactgatctcttgactttgctaatctgtcaagaacttccttttccgaaatagcaatgtaaggattagctgccactttctttatctcaaatggaaatccattattagcaactgcctgtgttaaaaacattcttatagccgttgtagtatctgttcctaattctttaaataaattatctgatttaatcttcaaatcgtcatccactcttacttgaatcgtacttgacataaaaacacctccatattcatatagcatactgtcttaatgctacatcattacaaatgtaatatatcataatacattatgtttttcaaatatttatgctataataaacagacatattacacaccacaaacaaggagtcacattttatgaaacccaaatcagatttaagcagacaattatatgaattaatgctgcaaagaggttatgaggaaaatttctgtgatattgtcactaagaatctcaatactgatttcactgccagccgcatgattggttatctctatcattacgaccaccctcctgttgaggagatagctgatgaaatgatttccattctaagcgacagaaaccgtatcatgcagaaaaaagagcttgaagaaactaatgccaggtggaacgattttctgctccacggctttaacgacgaagaagaggaagaatagactgaatctattctccctcttctttcttaatcaattcatccataagctctttataagctgaggcttcaagcggaagttctacttttatgcctttgcatgctgaataataagcactggcacacaacatgagtgaattaatcccctcactacccttaactgtcagataagactcatcacctttaagcaccgcatttgcaaaattttcaaataactgtgcatatggctcagatgccttctcgaactgtatagtttcctctgcaaatgtcatattctgccttgagttgacttcttcgttcttgatatactcacatacatctctgtgttttgtaatagtgagcgtgtcgtcttccagaagaattcttgccttcgttcctataatctcaagtctctcttcgtggcaggcttcgcctgtggatagtataaatgtgcctgtctttccattgtcgtattccataacgatagtagcctcatcatctactataaagtcgttgtattttccaaatggaatcgctgcaaaaagtttctgtggcattccaaacaggtactgatacatatcaagaatatgctgtccctgattgataagtgctccaccgccttcacccgcaaagctgcttctccatgagccagatttatgatagtatgaggttcttaaatatcgtgaattaataagacatacccgctttatatctcctaattcaccattgtctatcatctgcttaatcctgatgtatttagggtaaagcctctggtgaaatatcattccatatattctgccactttcactggcagccttctgcattgcaagtgcctcgccaatatctgccgcagccggcttgtcacataacactgcttttccctttgcaaatgctttcaaagccagttctttatgagttttatgaggagttgctataataactgcatcataacatgattctcctgtctcaaataattcttctgcactcctgaatatccttgcattatcaccatcagtattaacaagtgattcgccccattcaataagttcatctcttcttataaccacagctgataatttcatatgcggaacttctcccgctgttatcattctagcatatttctttccaacacttcctacacctataagtgccacctttaacaattctttctgcataccatgtaccccgtttcattatattaactatgcaccacttctcctgtttccacagccttcttcagtaagatggcagcatacgcatctgcaagggcatcctccatactatatggtgcagacgcatttcctctgctatactctgccgtattcttcatcatcattgcgattgctgtttcatcttctgacagaccacacaatccaaattccggcttatatataattttattattaaatgaaattttcttaatttcacgaatcttctcaaaattaggattagagtttcctgtattaatcacatgggaatccgttatgattctgccagtctgaccttcattattctcatcaagataatatacacattcatcaataagttcgcctcttacaccctgaactttaagcgtattctttctgattggtgacctgtactgctccgaatcaaaatcataccatgccactttctcgctttcgaattcaaatgtggcaacgcatcttttctttcctgcaatcctgccatcagtgaacttatcatatcttgtaagggtctgtgttgtaggaaactcatatgtcttagctgaaactgtatacttctctcccggattaactccaagaaatgctcttataagacttattccatgatattcatgcgccagtgacacatttacacagctgacatcaccaataattccttcattaataagctttaatgatgctttaatattaggatactccctgtactgttcagcaaccacctgttttttaccacatttgtaataagaatacagtttattgagcgaatccgtatcaagtgccgctggagtctctgataaaacagttattccacggtcaagccattccattgaaacatcacatatggcgtccttcttaacagccacaactgcaaaatccggtttatatgccacgcattcttctatagatgtagttgtatgtatctgatactgaccggcaattaagtccgctttctcctgcgtcctgcaatacatcgcatcaatacagaatatttcaggcagagcctttgctacgcgtacataatataaggcccgccagcctgaaccgattataataaaatgatattttgccatgtgtgcctcccatttgttatatctattccccatattctgtcagaggccagcagcctccatcagtaatacgataatagctatctgtatcagtgtcaaccattaacactggtatagaattcttcacctgtgtccagacatattgccgcaagccttccacccggcagatatgcgccacagtcaatatcaatgtgattattctttctgtacacatagcctggtctgggattgtcctcaatatatcttgttggtgtatgccctgtgacagttattacatcatcaaaatatctgacatcataatccacccttgaccatacaagctcatcaagtgaataatcatcaatatccctcttaatatcgaaattgccaagccctccatgcacaagaagatacttctgcccattaaccgctaccttctcgtaccatgaaaaatccgacacatagtcaagcacatcttttcttgtctcattatccagcttactcagctcatcagtggttgcaatcccgccatttctctgccatgcataaagcttctggaacatatcatcactaaacttttctgcaaattctttgatagaattctcatcttttacttcattaataagaaccaacatacattccagcatcatctgttcatggttgcctgctataggtataacatttggcatctccatcatcttaaggatcgtctttaccgggttctttcctctgtcaacaacatctcccagcacatacaatatatcttcaaccgaaaaatgtattatatccagcagttccataaacttcccgtattcaccatgaatatccgatatcacatatgtcgccatatattccctccgtatgctatttattaagtatgttatttattaagtatttccttcagtgtgcgtggctcataattcatataaggcatcatacaacctacattgtaagcccttgatatatcataacacttctctgaccgcataagcatttccatattcagcttgcgtaaacattcctgatagaattcattttcataagtattatgagtatgtccatacaaatgtattgtccccctgtgctgtccattccacataagtataggataatggcttaatacaagcttgtatgcatcttggtctacatagtcagtaatttccttataatcatatatctcttcaaaaacattcttatacctcatatcagaaacatcatcatgatttcctttaataagaactttcctgccctttaactgtgcaactaaggctatcagctcctcgtttgtaccccgcatggcaatatctccaagaatataaactgtatcaccatttgtaatcttactgttccatttttccttcatatactcgtgcatttcagccaaggaattaaatggacggttatcaaaattattgccttcctttgtcacatttttatggaataaatgcatatcactaatatagtagttcattcgtgttcctccttttttatcaatcctgtacctgtcttaatatagactctgctgccttctttaattctttattcagttccttatccttattatcaacaattgaagctatatcataatgatgacacagccagtatgccattcccttgcatgacgcatttacacggatatcaactgttgtatccgtttctttcaaaacatttatctcatacgaaaaatcatctatcagtcttgaaaaatactccctgtctatcctgacaatataaggtcttaattcaccgcccatcatgtaagggtgattcagaatatatactgctctctccaatggtatatcaaggttatctaagcctattccatcactttttctctgttcctttactcttaatctggtcataaggtcaacactgtatgtatacactttcctgctgtccctgtatcttaccagacagaaatatcttccattattgagcataagtcttataggaatcactgttcttcttccctgaaaatgaagataaacatttttattcttaacatcatacacattccagtcaaattctatgtaattgtcatttttaatggcgtcaattataagctggcagtttgccaaaacatctgtattctgtgcatatctggtctgtccgaaagaagcatttgcataaggtgttatatccttcagattcttccctgataaagtctgaatacgcccggctaagtccattgctctttcattattaaaaatgttactgtacaacacagaatctataagaaatttaaactctacatcggttataatgttattataataataatctgtcttgcggcgctcattgtcatatatcctgtatctgattatcttctgttcatcaggcagattaagctctgagtccgtcaaatcctttaacgccttcctgacctgcttatctgtaatacttttatcatattccctatgcatataagtaacgatatcagtaaccttcagcgttattgctgcctctttggaactgtgttcctttaatatattaagcacattatactcaatactcataattcacctttaattattctttcttcttttgacatcttctttgtataattcctgtgcgtctttataaaaaagtgccgctgattcctgaaaatgttttaactcctcttgtgatttcatttctttatcatatctgtttatcgtatctgattgttttaattccatctgacgccctccattttcttataattacattttcattaataattcctgtatttccttttttgttctatctttttctaatgctgtatacacactcattctcatatccgaaatagcacatgcctgttctctgtcaaaataataatgttccatcagcatctcctgaaaacaagctttatcctttgaactatccaccagatacataatctggttatgatgttcctgcgcccacataacggcagacaaaatgtggattcgttgttttattttttctttgtgtgtagctgtattataatctgataaatactgtttatcgtatgtttccacaagatagtcgatgtaatgtttccttgcatcactttctggaagctggattctctcaatatatattggattaacatgcgagtgtgaaaattctccaagataatcatatcctctgaatatgacatcaacacatatctgtatatcactgtaatcaccctttttgactttaaatttatcatactcttcatctgtaagcccaagtattactccgatattcccttcatgtttcccatcaacaactcttactatatccccatgtctgaaattatgtggaatatcaaattttctataaaagcatttcatacccgattcgtaccagcaattctccgaatccggtatttcatcaattgccttatttaaatccgctatcaattctttatctgatatggtttctttcaactcttgcactgcctgttttttctctgaattttttaagcactcatgattaattattatttctgcctgttccacatccgaaaatgtaacactcttgtctttaagaaactctctttcatctttagatggtacaaatctgtctataaaattttctatcatcagacacctcccaatattatcctgctcaaatcttggcatattccttcatacaccgtttggctgtttcatcagtattgcgctctcctttgtaaaaacaataatcactaagcgcttccatggctctcctataagctgcatcttcctctttgttctccatatgtggcggcaattccatctgaagatgcaatggattacaatgcatatgatcccagtactccgactttattggatataaaaccacagcctgaatatctgaataatcaacttcccattttctgtctttaatctcttgaagataatcattccagtcatcttctccagatgaaagtattccatatgttccatctactatatccttcactggagtacctgctgacttataacaaaatgggatttcaaaaaatgcatcttcaaatctttccggtctgaacggatttactatgtctgcttcctcttttgacagtttattttcatattcaattctttcggtaagctgcttcttaagtacaatatctttagtagtgtctcttaataaagccaatgccgtgagcttctgctgtctgcttttcatggggtcattccagacaagagttgctgtctggaaatctgtgaatttataattaagttcttctaaaaaagccctgtagtcatctgacatagttatatcaatcatttacattcctccattgattaatgaaaagatacttttgacataaactccacttccttcctattaatctaacttcttttcacaatgaatacttttcattcaacgcctttatcttaatttttatatcttcccgcagactttccggctcaagaacttccacaagttcactgtattgcaatgcccagtgtgccataccataaggtgaacactccaccctgacgatatcgtcatatggtggctctttttctgttcttatgtatgtgaatgaatctccgaaccagtcatgcaaaaatgtatatccgggacggactctctttttcggattgccttcacatttttcactcttaattcttagtgttaccggaaccggcttatcaaacgacatattaagatgtttcaactgaaaatcttctgaccatttttctggaagattggcaacatttttctttggaatacgcggtattcccttaatatgaagcctgtcattccttcccggaatctctatatccgtcataaggtcaatccgccatatagacatatcaggcttgtaatcttcatactctttagccgccagcagatagtattttccaccactcgcaacaatatagtatgggctaagctcgtctgactcttcccttaccggctccagctttttctcataagaataaccattgaatctgaattgtattctcacattatcatcaattgctttctgtataatggcaagattgtccttcaacagttccctatctgcaagctccggctcctgaaccttacatatatgtctcggcgttctcttataaaataccgtagtcatattgtcctcaaccttcctgacaagctcctgcgccgacttggaatccagtgtccttgttgccataataccctcaataattgaatcaacctccttctcagaaaatgttctgttatagtaaaggttctttattcgcattacatttgcaatataagaatcatcttcatcagaatcatcccgttcatatctttccttatcaccgtaaaacttcttgaaatcatcaaaatacagcctccactcagcctctggcttataatcacttcctccatcttccagattcataatatttgccatatcttttaaaagcctgttaatagtctccttatcaccaatatacgtatttatatttttatctttcctcatcttagcaatactggtagggtgtcttctgtctgtattctttctcagataatcccacaccttatacatacgctcaaaacgggttggtttctgaatctttctctttgccatatatcacctcgtgttaatcataatctattgtattctctattataataacagtttggtcggttttttccaccatttatcaaaatttattaattaatataaaattctttcatgtcatttaaccttattgcacccagtgttccctctttaccataacatttataaccagcgccacaatctatgcgtatagtccgtcctgaaggagacacccatattctcctgttatcagttacagtatgccccacaaccgatataaactgctcatgttcctccatacctctgataaaatactcataatgcccatctcccatatatatctttcttttatcaaacatacgctcaggcgtcagaaatgtctgtgcatgtgctatctgatatttcatgccattaatggtcagattaatataatatggcttttcctgtatccattcagcaagtcttaacatatcaacaggtgtcagccgcttctccataatagccactgtattataagaaatatattctccagtttttctatgtccgaattgttcaataatctgccttgcaacccagacatcatgattgccctgtatcacctgtatattgggatattttaatatttcaaaatacagctcaactggcttatctccacggtcaaatatatctccatcaataatcagcaaatcattctcattaaactgtatcttctttaacagccttttaaatccatctgcataattatgaatatccgaaaccacatatacatttctattatcatttattgtaatatccataaatatgtgcctctccttacatttttaataaattcttcagtgtatcaaacccgctgaactttcctttaatttcaataattctctgtttgtcttctttgatatgtgcagcttttatatcatacatattcatcttttctatgtctgataaagttatgtctgcctctttttcacatttatctgctatcttcaaatgtattactcctgcttaaaaaactatcataaaactgttcaaattcgtcgattaattcatttattttttcacggtcataaaatccctgtactttccaaaacataagaatactattcaattcttcttttcttttatctataaatcccctgcacaactgcccgttaaatattgcactgtcatcttcagagcagctaaaacatgccatatcttcatgcaatctggaacaatcactacaagtaatttccttttttctggaataaaatgacagttatcttcgatatttacaggaaaccatgagcttggatatgagcatattgccgaacctgtttcactcgtatttgctatattggttttgtatttacaatttttacacttcaatttatccgacccttttttcatttagttctgtcttgggttgtccgaaagcaccagcactattcttttcttatggtcagagattctctccattccaatgccatacacatacatgttgtcatatttttctggaatgttttctctgcacttatatgattcatctgaccagtccagcttattaacaatattgaactcatcaataacctgtaaatacggttttaaatctttaaatgtcagattatcacaaatgtttctctcaatatcccgcggcttatcagataatactatctctaacgctggctgtattgtaagattgctcatagatatacttacctcaccatttggttcttctggttctgaatagatatccttcgaaaactccacatcagtcattcctatgccataaacatataattcatcatattctgaagccgaaatatcggatacaaacagataattatgataatgcccatctaaaaagcagattgataatcttatgtttcttgccagaaatcttcttatctctttaaatttaattgccattgtgattctccttatctatagacattatttcctacaaccagcaatattgcattatctcaataaatagtccgcctgccttaataaaattatccattatttgacactcattatcttcaagccattcatactcctgtaaatacattctgacagccggattaaatttactaatcatttttccaataagaggatatcttgttatgtaatcaaaatgtgtatccaaataataaccatacctgataaattccccggtattttcaataatccaatccaccgcctcttgtatggtgtattctttgccatcaaatattacagcagccatagtatcatcatgaacactattatctttatacattcgcatatgtgagtataaccattctgcaaatgacatatccatattaaaaatgtcgcgataatcaaatccatatcgatatctttgacgcattctgtacagctttttctctgtgacaaaattaccgccataaattcttctcggtactccgagctggcttatgtattgatttcttcttttcattaataagctcctttcgtctggctgttctcctctcttttatatggtgttttgtgttcagacaagatgacctctcgtctattatttattataatgtcggagaggtcggattttttcgcctttggggagtgttatttaattttttctaatattttttaataacgctatttctcttattatctctttaagtccagggtcttgacatttcgccttttctacatgtttttttattaatgaaacataataacttaaatagtggtctaattcattatagtaaaaatgtgttacatagttttgtactggtttttcttcttgcttaactggcatatatttcatccagtcttcacaattatactgtatatttgtataattccacccgtcaacatcataactcaaattatagtttactatttctttaccgtttcttacacttacacttttttttatatctatgttatatgtttcaggaaatttatctataaattgaggtgaacaattctgcatgcaatcaattatataatcataatgtttcttgcctcttattgatatatcacttattaaacttatgattggtgctaatccctcatctctcattcttttcctaataaagagcattaattccattgcacctatgctgcaaccataatcacctattattttgtcgtcttcttttgttatcttatcaaatttttcttcaaattttttataccattcactaccttcagtttcattaaatattacttttattatttctttaaattcctctggactaatatccatttttatataacccctttcaaaaccaataaatctcttatcctatttcttcaacatcaaaatcaaccacgagaacacaaacaacacaactcctatgcacgaaactccaagagctgctactatgtctgtcgaaccgctatttaccagatcaactattgataatacagacgcaacaatcgaaatcaagccaaatactgctatgacagttgccacataattctgcatgtcagaagatttcctctcctgttcgtcccttatgagttcaaccttctgctcgatttcttcaagtgcttcatcaattccattaacggctaacagacatctgtatgtttcgcagacattattccagcgtgatacctgcgatggtgcaagcgtacctgaagcacgaaattccaacgcttcttttttaagcattttcacttttctgaaatactcaagactctgacgtttattgtcaatcagagtattctgaattccttcattaaccagcatgcatgtacttttctggtgtaaaacaagcattgtaagaaaaacatcatctcttgactgctctgcaacatttgccgctgtcatatcatctgttgcgtacacatatgatattgactgtgatgtaatgcatgcaccccatctgtatgaacacatattagtatccttcgcgccgtatgtatatgctatatccttttctgaaggatccgaaaaatcacgcgaaatgtctattaatttatgctcgttaaatgtaattctttcaatagtctccaactcattaaaacgcctgcttacaagtgccacattaaaaagatatgtctctttcaccgccagtttcatatcatcaacatacaatctgaatatattactgaccccgcctattgaaatattacttacagctttaattacattttcttcaaaactgtggttgtaattctgtacatagcccggattaatcagcttatcaatgtaacccgcgtcagcattgtcatatgtaacaagcaccgtgaaaaatgctattctgttattaaatacatataactggctctcattaactgccaatattttaccatctgaaaaatgtacatcatcaatgcatgaatttaaaatgtatcttctgacaaaaccattttctttcctacatcttctggcaagaatatctgacatatcatatgatgaaaaatccgcattttctgccccatcaatagcaagctctgttaggttaagactgctttcatactttaaaggaaatattacatatgttccccttatcgaatcagaatacacctgtctgttgtcattaaattcgttcataatcccccttccctcaagtctttatctttagttttcacgacctgataatttaggttgattataccacaaattgtctttaaggagtatctctaaatgactttaatattgcaattatttcctccctgtctttatctgtataatcagtgcttaattgtgtcataaatactttcgaaccttggcattcaaacatacaacctacttcaaatccagaatcagaagagctaaatttatttccataatttacatattctgatattttttcacctgacattaaagcatagagttccgcaccattctcatctctaacttcctctcctgttaatttattctctctgcttataattttaattttaacaattccaaaatcattttctggactatatcgggaattagcaattttatacaacgatgatgttataatttcgaagccatataattgattatattcaggaactttatatgtccatgcttcataatacaactctgccccattttcattctgtaatctcactatctctccaccaccgctgataaccttttccttaataacagtccaattatccggatagtcaaaataaaatgttgtctgctctggaaaatattccgccattctcgtcttatatgtatgaagtgagcctgtctggtttgcattagtttcctgcgtcgtctgctcctgtgttggtgcttctgtacttgcctcactttcctttggcttgtcattttctgactgctcattatatgtacattcatccacaaactgtttcgttccatcagcaagtatttcataatgaagtgatttactttttgcaaatgatgcaaattcacaattcttacttatattcattgtgcaaagaagtgacttcttattcttatatttaacactctcattgccagctccaagcttaaaaataggacccttgatattaacatctgaacatatctgtccatttggtctgcctgttcgttttgcatccgcttctgcacccatatcaagttctgcgtctaacagcggtatggatttcattgtcacaagcattggcgctgtcctgaaatataagcccatttttccttctgcctcaattgatgtctgcatagaagagcgaagccccattgttccattcacgcctttgcctttttcatatgacactccggcatgaaacggtacttcgactttaagcgtaattgaaccatctattgttggaacaatatataatgctacatttactgcaacaagatgattaccaatcggtgcaggtgtctgacataaaaagattccgtctgaaaaatccccttcaactccgatttttcctgaaatctctgaatcaatatcaacaccgacagaagcatattttaatccgttcttaagtgtgtatttaacctgtgcgcctacatttatattattaacatcccattttatagagaaattctcacattttttattaagcttctgcttaacaggaagcttgtactttgtatgtgtgtcattatctgtcaatgtaacttcaagttcattatcatcatttacctctgcctctattgcaaatcccttggaatgaatattgccagacacatctgctgccatcgtagttactggatttcccgctgacacctccacattatcaagtccataataactaataatatcgtcaatacctatgcttgccgaatctgaaactatcagagtatcaaagacatcttcaatctctgggtcttccagtgaaaatgtgccattgcccatattctcaccgattttctttgaaaccttgtcgcccttataatcgaatacaaatgtgtcaccttttttgagatttctggctgcactgtcatctaaagatataatattgtcatcttccttataatctttaatgtcaaaatattcgagctgtgatacattttccttataagaaacattttcaatattatcaggccagaattctccataatacaaatcatcaaatttatcaagaatactatcagcctctttatctgaaaatcccttatcaagtgaatcttctgctatcaggtctttatcaattgcaagttctatgttggtattgtctgatatttcatcatcagtgccaagatatatctgcattttgccttcgcccattgcacgcattgaagtaagtgccataaatccaccagaagctatgtcgtcatcactaaattcatcactatctgtaatataaccattttcctttgccgcttttctgtaatcctctgcttcaatgcccgtcttgttgcataacttcttaagccagtcatagcatgttatatcatcatttttagtcaccactgccttacacgaaacatttatatcattactgcttttcttctttgatgaaacacccgttataacgcctgcagctattgccgcaataactattaccgccgctgatactccaattattattttcttcttcacaatgtatccccttatgttttatatattattttttatgaaaccagccaataaagtttcctgctctgtcaaatgcttcagtagctactgatgaatctgatccgccgtcagcaaatgaacatattatgagaagaattattcctattacaataattgtcacaagtccaattgccaatccaataatattttccaatatcagaattgcaagaggcatggctgcacatgtaattacggcactctttgcaaatgaaaagacagcatatcttccattgcttatcattagaactactataaacaatactattgcaacgcctgcaattatcaggaatatcttaagattatccctgatgctgtttacccagttatcaaccatcctgccggcataatcccagtcaatcagttcattgtctgcctgttcatagtacattttttctatcttcttatactgattatatttgacaagcagccatgttcctgaaacccccatcaatataaaatcaattatggcaagaatccatttccatatctttccttcaaacacaagcattaataatgctattacaatctgaactatcagtataattccaagtgccttatgcactccattattagcaattatatgtactgttcctttagaaaagcttgctccaactccatcaaaaaatccagtttctgaattctttattgctgctattgcctttggatatcctccctcagctataaacatgatatacgccacaattgacattacacctattacgataccaaacacccatgatattgttttcgacaatgtttctaatggtttctcaacaaatgcatttaaataatcatcaattaaatctgctatccaatttataaatcttcgcattttgttcctcctcatacttaacttataatttcatttaatctttagatgatgccttataaactatttcgccccctttcttgctaatctcataatttctatgacctatgctgtaattagcagacatctcatttatttctgataaatatctatcaacggtaacaagtttttcctccatctcaagcctgctcagatcagattctgaactgtctgatataatcgaatccaccttaactccaaacaattctgaaaatctgcataaagtatctactgacggcacactcctcccacactctatattagaaattgctgaagccgtaagcccaatatccctcccaagctgttcttgtgtaatacctcgttccgttcttaattttgaaatattaattcctatcttttctgtattcatgcctgttttttcctattatcgtatacttaaccattatataattatttatgctttcccgacattttcagatacttatagagcacaactgtcagtgtgattttcacaactctctcgctcattattaattataatattgaaaaagtaggctttttccaccttattcgagttataacaaaatttcatcagaaaaattccaatcaaaaagagccggtaaagtaacatgtacttataccggctcaaatatattcatattatacctgatggttctacctatttctgattagtgctgattcctacccctcaatatacacttcccctttaactctcctgtcatatatatccccaagccacctcataattatctccttcggtgtctcaaaaggtgtcctgtgactcaacatgaaatgctttgctttaacattttccaatacggcaatttcttcctttagcacacctgcattatacaggttatgtccgcatttctgcattgcatataatgcatctccaagaaagcaccactcttcgtttacttccaacgcaacacagccctttgcatggcttgacggcagtggaaatatgtgaagtgacacatctccgtcctgaatatatatgtcctcctgtacaatcacacctttttccgtatgtctataagtgtactttccctgatatatttcattgcaggctatatccggcaggctgcctgtatggtcttcgtgaaaatgtgacaatataacattaacatttcttccatcacggaattgttctattacctgtggaatatcagggtggttgccgacatcatacagccacaaagcttcttctccctgtatcattaccacattagcagataaaggattctccgtcggggatatatacgatattaaattattcagtctgataatgttacattcatccattctttactccaaaaattccacatgcccgtcttcaagatgatacacagccccgataacctcaagacctttctcctctagaagcttcatatctgtgttctcctctatcaccttaacactgtgctttacattgagacaggttgcaatatactcatctttctcttccttaatagcttccctgatatcgtcagttatatacttgatatgtccgtcagggtcatgctttattgccgcttcaactgcaccgcaatgattatgcccaagcacaaccaccagcttacagtcaagatggtctgctgcatattcaatacttccaagctgatgcgaatccactacatttcctgccacgcggataacgaaaagttcccctattcccgctgagaatattgcttccggtacctgtctggaatccgaacagcacagaacaatcgcatatggatgctgaccattctttaatgtatccacgcgcctttccagcgaaacatctcctggattgcttgtagcattaataaatcttttattaccctctattaatcttgactttgcttcatgtgctggtattgacatattattatcccgcctttcacaacatattttcctacagtttaacagaattttacccatattaaaaccccgtctgcaatataccacatatgatatataacaggcggggctgattattttattctaaatcatatcaagttttgtgttacttaaatgcttttagagaattttttgattttgcaacagtcattccaatcgctaatccggatactgccattaacataataagaattctcatatcagatgaatctcctgttggcactacattaactgaactatctggaacatcttctctgtcatctgtatctttattaatatcatcattgccattattaatgtcattatctggtacatcaataacttctcctgttacacccttgtaatctacgcttacagaatgaatagtgactctgttaccagactttcctgcaccagatgtacctgtatgctggaatcctattccactgtaactgtttacttcattctcaaatacatggcttaaatgtacctcgtgaggcatgatactgcttgctgagtcctgagatgatgttgttgtaacatctgctgtaaatgtattgccagtcacatcaagcttaattgtgcatcctggaagaaatgctgttgatatgactgaatcctcaagcggaattgcaactccattcttatattccatcaatgtaaatgtacatgacttagctgcaaagctactaagggccggatcacttatagatggtactctggcaattcttaagccataaccagtcattgtttttgcatcatatttgaaatagatatctatgaactgtttagcactaccgaagccctgtgctcctgttttatgaggagaaagagtcaatgtcattgacatatcttttcgtgcagtatcatcaacatatacaagtcttgcaccctgtgtagttgtctgaagtcccgtagttcctgatgcgcctgatgctccctgtgcatatgtatatggaagctcacctgaaacaggcttatatgctttgtcactccactctccaccttctctgtattcagcaggcagatagaatcctccataccaattaccagcttcaagtgtgtttttccattcataattattctcttctgtatcattctcagcttcaatatatgcaagatgctcaagatcaacattatatgactgtttctgttcatctgctacatatgctgacttgataagttcagaagctgcagtaaatactgaactgccttctactgaattcgaacgctttggtataacttcacagataatataatgattaacatcatctaagcggagtacatatgaagagtatggcttagcatcactatctacatatgttgtctgtgcaacgaggactttatctgttccttctttgtctgtagcacgataccagttaattatactttcgtctgctgcttcactattatctgtaaatgcatatgttacattaatcattccattctcaggtgctgataaaacaggtttttctgataatacaggtgcctcaaatatcttaggagtaactgtaaaatgtaataccttcttcattccgttggctactgttgcaacaagacagcctttcttattgtctaatgttgagttgtcaccctttactattacagtaccatcatcctgtggttcaataacaagcgtatcgtcttcagtactccatgttacagtcttgtcattgccaccaagaacaacaggcgtaacctgaagtgaatcagaaacatttccctgaagtaccggaacaacatccttagcaattcctggatagtcaaactggatattccatgtaccggttggcatataatccttctgatttaacggatcccattcatcataacccacaccatttaagagattatatatattatattccccattatacttaaatgctttcatctgctctccatcaggagttactgataaatctggataatcaggactgattgtcaatggctgtccattaagagtattattagaaacaatctgtcttatatcatcagaaaaattactctgtttccattccataccagtcatgtcgcccttaaaatcacagtcaataaaagcaaacggttttgtattcttacataatgtaattgttttattatctgataactgtgttgtaaattcacagcctaagaatgcctgcatatagaatgatgctccaccacaaggagtattagaaaacaggctaaacgtacaattttcaaatatcgttatataaccggttccaagcgaatcatctgtacactcaagatgacaatcttttataagagaacgcttaggtctgtcatctcttgagaaaagattaagtcttgatataatgttacaattttcaaagaaccattcatccatatctgtaatgctaggaactttagtaacagcctgtgcctgtgtaacagcttcctgtctcttagtatgattcttagtagtatctctttcatacactaaatctacattacaataatttccgattgtaaggtcttttgcatgaaatccgtcgcctacaccaattgtgttaaagttaccattagctcctgcattctgtcctctgtctgatgcaattactacatcatcacgattaccagtcattcctacaagtgttatataagcctgtggaattataagacctataagatcattcttatcacgatcttctgtcttagtataatcgtcagtccaatatacatccggctcaagataaataattgttggattatcctttgtgccaggaattgcattagctactgcttcctgaagtgtcttatatgaatatccgcttgaagaagctaaattctgatttacatataatgcatgctctgaaagagtaactgattcaccattatagtaaatcgtctgtgtatcatcggctttcgtaaatgtaagagagccaataccagaactagtgaagatgagtgcaaaagccatcaaaaatgcgataaaggccgatgcatgtttcttgtgtcttagcatattctattcctccgttcattgtgattatgaacccattatatccagattgtactaatataaatacaaaaaatcagttcaaaaattataataaaacgaaaaaacagcattttcacattatttctctaaaagccacgcaatctcttccttataaggaggctctttcttatcagttccttcaaccgcaacccatggggtctcaagaatcttaggaacatctaagaatctttcatcatggacaagtctgtgaagagtctcatatcctatatttcctttatcaatgttggcatgtctgtccttatgcgctccaagcggattcatactgtcattaatatgaaatactgctatctggtcaagaccaatcactttgtcaaattctgcaaatacttcatcataatgattaactaaatcataaccagcatcattaacatgacatgtatcaaagcacactctcaatctgtccttcttgtcaacgccatcatagattgccttaagctcttcaaatgtcctgcctatctcgcttcccttgccagccattgtctcaagtgcaatatatacatcatcattgttctggttaagcactgtattaagtcctttgataatctgtgcggttccggcttcaactccggcattgacatggcttcccggatgaagcaccattatatggcttcccatggccgcagtccttataatttctttttcaagaaattcaacagcaagctcataagtctctggcttaattgtatttgcaagatttattatataaggtgcatgtacaataatctcctcaattccatgttccttagcatacttccagccagcttctatattaagctcacttatttcttttcttcttgtattctgtggcgcacctgtgtataacataaatacattagccccataagaaactgcttccttcgcagatgcaagaaacatttccttacctgccattcccacatgacttccaagctttatatttgacatatatgattcctccaatatttaacctgtataatttattatctgtccggttagaaattccaaacgaattaattttaatattgcaatacttatgtgtcaatgcacaacatatgtatacttgcatactgataaatgtcattaccactttcattcattttcagtcggattcattcataatttacatttattgtattgacatttatacagcatattgatatagtactaaagtaccgattttatagtatttatgtaacaattattttataaggtgagatatgaaaatacacaaacacggaaaacatataaaaacaatcaatactgttattgaaagctgtcttatcgttattcttattgttcttgtagcaataatgatggttcttataggaaaattacagggaactgccagagttattaactataccggtcttgtcagaggtgctactcaaagagaagtcaagcttgaaatcactggtaatcctaatgatgagctcatcaattatcttgatggaattcttgaagatcttaaatataaagatggcgattataatcttatcaaacttgataacaatgattatgaaaaaaaacttgatacacagactgctttctggattttactaaaggacgaaatatataaagtccgtgaatatggttatgaaaacactgatattgtaaatctcagtgaagaatacttccagcttgctgaccagactgtttctgctgctgaaaagtattctgaaagaattgcatgtaatataagattatttgaaacttttacagcaatagatatgatcattataataatatttataattaatcatttcattaatgcaattgtaatcaccaaaaagaataaacagcttgaaaagcaggcatttcttgacctgcacacaggtcttcctaacaagagtaaatgtgaagaaatattcagaacttcgcaatttattactgattctactgcatgtattatgtttgacctcaataatcttaagaaggtcaatgatacacttggtcattccgttggtgaccagttgattcttaattttgcaaggcttttaagaaatgctgttccttctaacgattttgttgggcgatatggtggcgatgaatttattgccgtaatatataacactactaaggatgaagttactgatattctcagacagcttgacaaagaaatatccgaattcaatgagcttggaaaagcttttaagataagttatgctcatggttgtgcattctcttctgattatgagaattgcacattaaggacactctttgataaagcagataaaaatatgtacaataacaaacaggcagagaaagctggcagatagccgctttctctgccctttttaatattacatattcatcaatttatttattaatatttctcaagtgattttatggcaaatgtatgatagaatataaaaatgactttactatattaacccagacattgtatacatggagataaataaaatgaataattataaacgcggactaataaccggcataccaattgcactcggatatctgtcagtttcttttacctttggaattatggctgtatcctttggtcttagctggtggcaggccgttctcatatctatgacaacagtaacctctgccggacagtttgcaggaatcggcattatgattcatccaggacaatatattcagatgcttatatcacagattactattaatataaggtactctttcatgtctatatcaatcggacagaaagccgacagccgtttcagtggcatataccgctggcttctcggtttctttataactgatgaaatatttgcagtagcaactaaagaagacgaaatcaagcgcagctactttgcaggacttgctaccctgccttatctgggctgggcattaggcacatttattggtgctattcttggaaatattcttccagaccgccttatgagtgctttaagtgttgcaatctatggaatgttcgttgccgtggttgttccagagatgaagaaagctcgccccgtcctgattgtcgtaatcattgcaattatacttagctgcttattctactatataccgcttctttctaagatttccagcggtataacaataacaattgttgctatcacagctgccattatcggttcaatattctttccggtatctgatgaagctgataacagcaataattaatcttattggaggaacttatgaaaaacagtattttctttatatatctgcttatacttgcaggtacaacctaccttataagagttatacctttcactgcaattaaggaaaagattaacaaccgctttgtccgttcttttctttattacataccttatgcagttcttacagcaatgacaattcctgcaatattctatgcaaccagctggtgggttggtgcagctgcaggacttttgacagccgtaatatttgctttgaaaggcaaaggtcttacaactgttgctatagcgtcatgtgtagcagtatttcttattgaacttataagattctaataattcataatagaaatgaaatggattttaattcttctttccaatatatgattcatataaactgtaatcactattaacaataagttcttctgggaactgtgtatcttctataaccttataggctctgtcaaattcacatattccctcttttatatgtgcatcacttcctatagatatgcagactcctaattccctacatatgttaagcatcttaatatcattctcaaaagctccctgtcttgggccatccggattcaatgatgtattattaagttcaagaagcacatgcttttccttagcggcctttacaagcttttcataatcgacaggataccttgaatcatcagggtgtcctataatattaacatatggattatccattgctttaattaatgcattcgtattctgctctatacttccgggcttgatacatggaatatgaaggcttgctattacaacatcacagcccttaagtccatattctttaagatcaatatttccatcatagtccataatattagcttcacaacccatatatatcctgacaccacatttttctcttggaattatcttcatattagaaaaatataatatacctgcgcttcccggcatcttgggtgcatggtcagttatcgcaaggtgcgtaactcccatacctgctgcgtaagctgccatctcatcaattgtgttatatgcatgaccgcttacaagtgtatgagtatgtgtgtctattgtgtatttcataattaaagctcctgattacctgttctttctttcacataattctccagaacattaacagttttctctattcccagaggactactgttgatacacatatcataatatgttgcatctccccatttaccttctgagtatctgttatgatactgttttcttgttctgtcgtgtctacgcattttagtatatgcctctgattcggataagtcaaaatgctccataactctctgtatcttatgctccttatcacctgttacaaatacggatataaggcagtcataatccttaagtacattctctgaacatctaccgactactacaaatgattctccgctctcagctttcttacggatataatcaaactgaaactgggcaataatctcttcataagaattggtgtgattacctacacgcctcgacaggagacggtttcccggcttttcatcatatttgtgaaaatctgacacatcagcattcatctgttctgcaatctcgtccaacatgcatctgtcataaaatgcaagttctaatctgtcagccagcttccttgctatctcatgtcccccacttccatattcacgacttatagaaataatcaactgttctcccataaaacccccatttctgtacacattttgtgcacgaagaattaacaataccttacaaatatgcacaccatagatataagcacaactattatagttgccggaacagctgtgcgacaatacttaccccaaccaatcatataaccattcttagctgcaactgatgttccgacaacattagcagatgcacctataggtgttgcacttccacctacatcagttcccatagaaagtgcccacgcaagaacagaaaggtcaaccccttgtgtcgcagccagactcttaataactggtaccatagttgctgcaaaaggaatattatcaataagtgcacttgcacatgctgaaataataataataattgcaaccataagcttaagattacccttgctcacacgacctataaatgcagcaataatctctaatatgcccgtctgttcaagtccacctacaacaataaacagtcctaaaaagaacaaaagtgttttataatcaatagacttcaacatatgtaaagccttcctgcctgatacaataagtgaaaatattgctataacaagtcctataaatgcaaccgtaagtcctgtcagtgcatgcgttacaagcaatacaaccgcacacatgaatataacgcagcttaatgcaaaatcccttctgttcgtaatagtctctgccggacttggcatagattcagccagtttatcaatatccggtgacgattccagttcttttctatatgctataagaaaatataccacaataaataccagactgattactgcaatcagtcctgtatgggtaataaatgttgaaaatgaaaaattaagtgatgtaccaataattatattaggcggatccccgcacattgttgccgagccgcccagattagcacagaatatctctgataaaatcattggcaccgggttaaactttagcagcttggcaagctcaatagatacagctgtaagaaacaatataaccgttatactgtctataaacatagccagtccaaaagacattatcataaatgtaataaacaatgctcttgtacgatagtgtacagccttagccagaagcatacacagccatctgaaaaatccggcagcagccataacctcaaccataatcatcatacctgcaataaatataatggtagaccagttaatccctgttactgcctcttcagcagctgcggactgataccagaaacctgatgtaaaaatgcttcttaaattaagagtactaataaccgcctctggcgacttcatgataattccaaataccccaatcagcgtcaatgccccacatccaagcgtcacataatgcctctctatcttatcaagaactatcaatacaaacatagaaatgaaaataattaatgccaatacctgctctgctaacatattaaataacccccatcacatgttaaattaataacaaacttttaactgtattatacaaacatatataactaatagcaacatttttccatttattctgtcctttattaatacaaaaaacaccataagaatacattgcattcgcttcttatggtgcttctgttttaaatattatattgtatcagcaagtcaactattccaattacttaataagactttccttaatcttaacaactgccttatggatattaacaggctcatccattgtacaattagggcggtggatatcattagtaaagtatactgtaaattcaccaggatgtaatgtaacgaactgctcattctctactgtctcataaaagatattgtctttaccagctggctcttcacctgtaactcctggaagaagtggtgcatatccctgaacttcttttcctgtgaaaagatactggatatcaatataatttctgtgactttctgcacgcttattctcaactggagctgttgtctgatcctgaataagaacaaaaatgttatctccatcaagttcatatcttcctactggaagctcagctgtctctggctttgcaagaaattcaagtgcagtattaatagctgctgggtactggtagttacctttttttgcattaagtgatgcgtaaatcattattattttacctcgaatctgttaaaattttatacactaaatatatcattatcgataaaaagtttcaatatttttcttaatattcagcctttaatgttcagcttttaattaagccttttaattcatatctgattccacatatgccttgttcaaaatacattacaccatcttctcaacagcctttacccatgcgtggtcagggtcatcacaaggtgtaagctgtcttgtatcaacacctgccattacccagagatgaaatcttctcatgttcgtatctccttataaatagatttaatattattctattatctcattggtgttgtatcaacagttattttcaatttctatgcacttctggccagtcctcaaatcttccgttcacaactgcatgcataattctgtccttagttcccggattatctctattaatctgctccataagctgcttggcatattccctcttagtcgaaccatcaaccggacaggtgttcttaacaaccttgattccctgattaatcacaaaattagccacacccttttccggcacatacatcattggccgtataaccgtaacccctgcctctggcagatatgtaactggtggaaatgcgtaaaaccgcccttcatatataagagacattaatgctgtttctataaaatcgtccttattatgtgcatatgcaatcttattgattccaagctctccaagcctcttatacattgcgccttttctaagcttcgcacacagtgaacatggtctttcgtctttattatcctcaaagacaatcttcgcaatctctgtatcaacctgttcatatggcacatttatactctcacagaacttcctcactcctgtaaaatccattccctcaaatccaacattacaggtaattgcatacagttcaaaattcttcggataaaatctgttaagtatcttcattgcatgcagcaacgcaagcgaatccttgccacctgatactccaacggcaatcttatcgccttcctctatcatgttgtaatcttctattgcctgtcttataaggcttaataatttctgttgttgcataaaatatatcctctgttgtaaaaaaatatccaccatctcatcttcagtatcaactaaaatccattctccctcccccggttacactatcatatattaaattgtataatatccttatgtggattagtctgtgacaatccaagccttactattttcccttttattggaataaaatgtgtctgtaatactctcattgccattatcatctgttctttttcaagtttctttcccaatgttatgtgtggaaaccagttatatggtttgtaacaacgattaattgttacatcttctcttgcagaaaatatatcatacacctcattggaaagatgcattaaatattcgtccagaacaggtgtagcatacataacatacggcagaaactgcccgattgaaaatatatttatctctcctgcacctattttattaagcttcatgaattcttccttaagattatcaggttttcttgtttcgaagcttgaaattgtcagatgcggaggaacattattctcaatcatataagtattacctgtttcttttgcaatattatcaattaacctctgcaatccctttgttacatgttcatcaaaatatgctgatataagatacatatgccgcctcattattattaatcacctatgccaaactctctggcaattctacatctattactatttttctttatctatgtgtgaagcaataaatttcccaatgattgcaagtatcaaaatagagacataaaacctcggatcacgatgttctccatataaagcaaaccaaataacgattgaaaataccaatatagtgtatactggaaaaaagaattttttcataagtactgctcctttattcgtcaaatccgaagttagcgatttctttttccggtattctctgtcccacggatttcctcatgatagaaataatctacgatcaccggatgtccctgcgggactctgccataaggcatttcattatccacaaaggcacaatcatactttttagccattttctcagcttttacttcaagtgcttcaaagtagctgcggttatgcttgttatagatctcgtcgtaaagtggtacaagatcaggatattttccggcgatataatccataattgtctttttgaaaccgcctcgaagattgagattttcgagccagaacagatcgcactgatcctttacccgctcaaagattgcttcaaaatccgtgataccagggaataccggggatacgaaacagactgtacggatacctgcttcatatacctgcttcatagcagcgatacggcgctcaatgctcgaagcagagtccatatcgttcttgaaattttcatcttgtgtgttgatcgaccatgaaacggttacacgtccaagcttcttcaacagatcaatatcccgtaccacaagatccgactttgtgcagatcagaatatctgcgtcactgccgatcagctgctccagaagttttctggtattcccgaattgctcctcctgtggattgtagccatctgtcacagaaccgatgaccacccgctgtccggcatatttcttcggatttttaatttccggccaatgcttcacatcaaggaaagtgccccattcctccttgtgcccggtaaagcgcttcataaaagaagcatagcaatacttgcaggcatgtgtacagcccacatagggattgaccgagtaaccgcctaccggcagactagacttagtcatgatattctttgtttccacctcacgaatgaggattccatttattacttcttccatgatttctgtacctctaacactttattaaattcttccggcatttcctgaatcatattttcatcccctatgatagggacaaggtcttccttcataaacaccggaatgccaagcttatgtgcctggtccgtcagagaccatgcccattccggctccgtatgaatcttcctgctctgcgctccggtcatggtgccgacaacgatccaattgattccagaaaggtcaactgtgccgggatcatcaaataacggctcaaaggtaacatggtaatgttttgctctaacgtttttccgaagggcgtcgatacgccacagttctgctttcctcgtcaccgtaacgccaaaccatgcgttttccagatcggtatcaaaatccagcaaatcaggtcgcttggtaaggaacaggaactgatgctgtggattttcacggatctttgcaaatacctcgtctctccattccggcttccatccagagagatcgctcatgccggtaagaagaaagttctgcggacgtttcttttccatcatcttgagcttacccggaaagaattcagggtcagcgaaatcatcaatcatatgccagcgtttcacgttgttgcgggcatagcaatatgtacaccccactgtgcagccaatgacgatattcatgttctgaatctgatctttgatacaaatactcatgacttctgccactcctcaagattctttctgatgcggtcgaggcattcctcaaaccgggtaatttcttcctctgaaaaacctttgtagtaaatactgcccatctcatcagatacagaatcgtactcgccctttaaggcatgtgctttctcagtcagaaacaggagcgttttccttttgtccgtttcagactgaacacggcttatcagcccttgattttccattctttccagcatcgtagtaagagatgttatcgctaatccgcatttagtcgagagtgacctgattgaaataccatccttctgccacagcacataaagaatacgcccttgggctccattaaacgcatcaatattcttttcactgagaatcttctcgaaaatccggtctccaagctgttttattttggtgacaagaaatcctccattcatttccatacaaaagctcctatatagtagtttatcaaaaacatactatataggagctttattgtcaagagtttatatgtcttaataggtaaattccgtttttttcaattcttcaaacttgaatttatcgttcctgtatttccttaccgctgaggtgctccacttctatttcgaaaatttgcacagcctttcctgcgtgggcaatttcctcatcaactaactgttcgctgggatagtatttcattgcaaatcgttttaacagagttgttgctcttgcaccggattctacgaggtaacatcggccgaacaccacaacgctctgcacaaacggtacccaatcttcttctttaatggtttcatttccatataccgtgaagcatactttgtcacaggcacgcagtgcatctactttatgacctacgcgtgctccatgaaaataaattttctgcgcatcgtcatcgtagacatagttgataggaattgcatagggatatccgtcatctccatttacggcaagaacgccacgtcggctggactgcaaaagagtctttgccgtgtcgatgctgatttcatttttctttttacgaattgttctgaacatgatattattctccttcttatgctgatacaactcccgatttttcaaaatctttatattggtaatacagaaatcgcccatattatctaacctaacaatttctattttagcaaataaaatgttcaaaattcaaaccacttttgatatgattgttaatcatattcctttcgcattgaccaaataattcttttgccttatcaataacttccgtaacatcatcactttcaaatattacctctttttctttgtttaacaactgcgttgacatccacacatatggtggcaattttttcttaagcgcatcataaacaactaatgtcactttgacatcctataaactatcgtgagccaactcatcaaaattataaccataataacatgccgcatttgttagcttttgatatgtatggttaccataataattgttccattcttcatatatcttagcaaattctatcattggatcgtatattatagtaccatgtttaaacctaattcctgcattagctaaaaatgcatagtcaaaatcaacattataggctatcaactcgacacagccatcaaatacagcttatcttacagaaatattagttattactcttttgtaattttcttttattatatgcatcttcatcaatagctccagaagccaacattctttctgaccataactgaagtgtttcaacatttaccgatattttttctaattcctcctgaatatatatgaaatcatctaattcgtcgttatcaattataccatcagctgtaatctcaatgaggcgctcctgcttcttgttcatcttattaagagaagctaccgtttcaagtataatctgagggagctctttcatttgaatctctggaacatattgctgtccaattggacactgatttgagcaataataattacacaattccggtaatttatacttatcagccattatgagtacttcttacggatgtggcagcaccttctcactgtctattttttcaattctctctggaggcacgcactctaaaagttcacttgccttttctcggctaagtcctagctcctctctttttaactgatatacattcttattctctttaattgatgctcttcccattccttattccctcacttaaaatcttactgtatctttgctataattccttcttctgttatagtttgcagacattccataggcacatctgaatgcattatctgcctctacatgaccacctgggaaagtcgtaccagaataattcttgcccactttatccaaggccagtacatttcctttattatcactaatcatgcacatgttcatgaatactactttttctatcatctgttactccatttaatatagcttatcaacttctttttcatatgctacttctgtatctctgtcaaacagaacaaaatatatttcttctatttgctttggaaattcctgctcatatcttgccacaacatttacagcaatgtgtgctgccagtttaacaggaaaaccataaacacctgttgatatagatggaaacgctattctttttatacctttttccattgcaagtttaagcgaataataataacagctggcaagcaactgctcctcattatcctttccgcctctccatataggtccgactgtatgtataacataatcacatggcagattatagcctttggtaatctttgcttctcctgtttcacatccatgaagcgtcctacattcttttaaaagatcaggacctgctaccctgtgaattgctccatcaacaccgccaccacctaagagactgttatttgctgcatttactataacgtcaacataatctatttttgttatatcacctagaacagttttaatcatcgtaatttctcccaaatattttctttaaataatttcccattataccgtcaattgtaccaccgccaatatcgccttcaattactctttttcttccatccttataagtaatctgcaaggtatatccatatccgtcgcaaacttgtgcttccataatattcttatacaaacctttgcagagactccgtgggaagagtctctgtttttttgtgcatagctgtatacaatatacatgatgatacttttaaatcactttcccttttccaactctttgaaaaatgcctttgcattatccaaatcattcttatccggatgtccttttgatatgcctccaataagtttgaatggtccaaatgtgtcaaatcccttacaagaaaattctcccacaattcttccctgcttttcttttacaatttcctttatggaatcaaagaccggctttccgccataagtgcacataagaaaaacatccttattctctggaagatttacttctgcaaagttaattacggactgatgcatcttgccaaaataaataccagaagcaaaacctataagatcataccctgataagtccttttcattaatcttagttgcatcaactacatcaatatcattttcagctgctattgcacataccagctcttttgtattattgtgatgaaccgacgcgtatataataactgttttcatatctgcttcactccattatttcttagtttaaaatccaatctcatctggtgccacaggacatttccatgagtagatttatcagttataccctcatcaaacataagccagaaatgattcccaaaatattttattctttgctcaaattcttctttagttgctgcctctaagacaggaaaacatacagattcaaccgatgcaatatcgtctaaatcagccattgttgcatatcttatattcacaatcattccttctttactattgctttttacatttagttcttattcatatattacaatattttgcttaaatactctgccggaacagccttcgtaagccatactccatttacagataagaaaaactcatatccgtcatctgccatctttccggctgccaccctatacaccacaggctttccgtgcctgctgcctaccttaactgctgtatcagtatcctttgataaatgaacatataacctgctcttagaaagtaatccttctttatctatcgatgcaacagacttctctcccgttccatggtaaagaaactctggaggagttttcttttcaagttcaacatcaacagatattgaatgcccctggttcgctctgattaatgtcttatctttattaaatgaatatcgctgcttgctgtcagttcgcacaatctcttcaagcatcttcatatcaaatggtcttgttttacttatacctgatatcaactcagatacatctgcccagccatgctcatcaagcttgatttctattgtttccggcttgtgccgcaaaataagacttaaaaatttgcttgtgtccgttaatcccattgttatccccctttagttttcttttatagctgtaaggcagatactgcacattatatgcgtatttctaatactttctactctatcacatactcatacattctaaactgcctgtttccaactacctcataaaaaatgttttcagtacttacatatttaaagccagctctgatatataacttgtcagctagtgtgttcttatctattacatcaagatgaatggcttcaatgttttctaacttagcatatgatattaagttttttacaaattgagtagcaagacccataccgcggtactcatatcgcactgcaagagcatggattatccatacattattatccctttcatttactttccacgctacccttttatactctttattagaattactgttaactatggcacacgccttaataattccttcatctcttaatacgaacaactctttctgaacaataccagccattaaaaaatctgctgaaggatgtacacccttttcccagtcaggaaaagaaggttcttctttgcttttatctattaaatcccaatagagattttctatctcattaaaatcctccaggcatgctaattcaaaattcatatatctgtctcctaatttttatttaactccagttcttccagacatccggctggtatccgagtgttgatgcttttccatttcttacaacaggagtcttaataactgaaggattttccattaccttttcaagtttatcttcatcagctgtgtattttataagcgcaagcagatctttgtcttttccatcccagttaatcattccctgtaacccgccattaacctgagccacagaattaaactcccccttgctcattcctttttccttcatatctataaactggtactttatgcctctttccttaaagaaacgctctgccttctttgtatcattgcatttcttagttccaaatatctgtatattcacaatagtttcctccaaaatttattaatcttttcctgcattttcctgtagcagcttttccactagtctctcaaaagagacttcaaagttataatcatccttatcacttctttttcttggacctttcatgtggtttttactgcttgcccgccttgccttcttacttatatgtctctccattaacataagatcaatattttcatttgtataccatttcccggactgatgaatggcatatgcacccttacttaatgccatggcagctacaccatagtcctgcgtaactactaaatctcctttttcacaaaggcttattaacttaaaatcaactgcatcagctccggcacccacatataccacttctgaatagtctgatgtaagataatgattagtatcacacaaaagcgttacggcaatattatgactcttagctattctttcaactatcccaatcacagggcatgcgtcagcatctacatatatatgcatactcttatctctttcatttacaatcaattgttatatacatttaggaactgtctctatttcattcccacagataacttataccagcgttttatgtatgggtcatcaaaaagctcaaggtcgttttctgtaagtttcacaaaaagatcagtaagcccgtcatactcattaatatctcctgcaggatacagtttccagtttagctgctctaatgtccagttactcttaactgaattgtgaagcatagacgttgtcgcataattagacaggttatcctctcctccaatggcaataggaatgatgtggtcaattgttgggaccagctcccagtaggcactgtgacattcttccatcttccaatggctctgatatggaaatgcatccggaatgtatgaaaagcagactgctaagataattccattccgtagcattgatatttttgaaaatgccgtatcagccggaaccggtaacttccttgtagacggaccgaaagagactgtacgcatagatgaatctatcctgccggaagatactactttcggtgtccgcattagtggtgacagtatggaacctgaattccacgatggtcagattgcatgggtattacaacaggaatctgttgctaatggagaaatcggcatcttcgctctaaacggagaagcctacatcaagaaattacaaaacgataaagacggaattttccttatctcgcttaatgaaaagtatgcacctatcaaggttggagaaaacgaccgcttagacatatttggaaaagttcttgaaaaatctaatgcttctgctatcacaggacattgctgataaaattgcaagtcctttttattggacacattattttgcataattgaaaataagaaaatatctatagaactgaaagaagggatttttatggcggttactaataatatcagagaaatccgggaacagcgtggcatttaccaggatgaccttgccgctgctatcggatacagcaccaaaactgtcggcaggatagaacgtggggacagcacaccatctgccgaatttatgctgcggatatcaaagtactttaatatgctggtcgaagatgtattccatgtggaagattgagctgggtattttatccagctcaatcttccgctccctgtaaatgagaatttgtccgctcctttatataaaataattccatttttcagaactactaactatttttcttatctaaatgacattgattatctaattaactacattattttctgtctaaaatatccataaattcgtcacctgtaattgtttccttattcataaatttatcaggaagcataaaacgctctaccgctgactgtgatatcctcagtgtatcattcttcaaatctataatatacagataatcatccatacaaggtgcaattaagtcaatcacacttcctgcttcccgctcgtcaagtattttatatgcatcaaaagccatcatcaaaattcaccttccattatattactcttcaatgtctgagattttgaatttcgctatcatttcactcagattttctgattcactgctcatctgctggctcgcagccgcacactcctgtgatgttgctgaattggtctgtacaacatcattgatctgctcaattccttcgttaatctgcttgatctcactggtctgggtctcaagtgtatcagctatattaatcacctcttttgtaattaccttagagttctctgctacttcttcaagctgtgaggctgtctgctctgcaatattcatgcctttttcaacagcctgcacagatgcctctataagcgcagctgattcctttacagcctgtgcactttgatcggcaagaatatttacctgatttgccacaaccgcaaagccttttcctgcctcccctgcccttgccgcctcaatagaagcatttaatgcaagcaggttggtctgtgatgcaatatcattaatagttgatataatctgatctatctgtttagaggcttcgtttatttcatgcatagatgcaaccatctcctgcatctttccattgctttcccaaattgcacctccaagttcgtccacttttccactgatttcctttgcactctttgaattctgctccacctgttctgaaactcccgcaactgtcgctgtcagttcctctacaaccgcagcctgattggttgcaccgtctgcaaggtcatttgagcttgcagctacctgctctgccgcacttgaaacctcgcttgatacatgctggattccctttatggtgactgccatacttttttcaaattccataaatgaatttaaaatacctacaaaatcgcctttccactctacttccggctgtgcatcaaaatgtccgtccgcaaagagcttcatcgacctgtctatatcatccacatatgagccgagaatacggatagactttctcatgctgtgtgccaatctaccgatttcatcctctgaatggtactcaagtgtgctgtgaagatttccttctgtcagctcctttgccacatcctcgattgcatgtaacggctcaaggattgtatcaagcacgatctttcctgttctctttgtcaaccgccatgcacatgtcagacagataatgatgactatgagtccgactgcagcacatacgtatgtacttacaactgcctgaaggcttctttcgtcagtcagcttgtcgatttcctttgcaagctcaacagttttatttaactttggtgtacactcattgataatctgatcaacagccccatccttctgtccggctttaatcttatccatgattgagtatccggtattcgcccagtcagaaagagcctttgaatattcattatactgattctccggaacaacacctgatttttttattgtttttaactgcacatcaatatcctcgagcaaagtttttgcatcctgctcataatcttcatacgtagactggtcaggattaagtgccatctctcttacatttcttgccgctgcagttacatttattctacataccttaaccgcctgatcagaagcatttaccttgtttacatagtttaacatattgaaaaacaacacaccaatgaccgcaatcgaaagcagtcccgaaataagcatcatggtaataaccattttgtaaccatagttgattcttttacccaaatgcatgttttccaatttctttttcatcgcacctttttttgaagacataatttgttatttcctcctatcttatgataccttttgactctttaatcatattattatttatactcaagtccgaattcatcagactaatttaatatagtacttttttctaaggacacaatactgtattctcaataatctttatgtgaatctttctattaaatatgtggatttgcacaaaatggtataatttttcgtaatcccccttaaaatacatattttacgaactgtttgtatttttggtcagttttgcaaacttgaatttgtccgctcctttatataaaataattccatttttcagaactactaactatttttcttatctaaatgacattgattatctaattaactacattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactaactatttttcttatctaaatgacattgattatctaattaactacattattatctgtctaaaatatccataaattcgtcacctgtaattgtttccttctcatacaggtacatagccagttcgtccagtttttccctgttttcagcaaggatttttcttgctttttcatgctctgcttttacgagatgcacgactttttcatcaatttccttctgtgtatctgcagaacaggaaagagacgtatcgccgccaagatactggttggtcacgttttccattgccaccatgtcgaattcatctgtcatgccgtagcgggtgatcatcgctcttgcaatttttgttgcctgttcgatatcattggaggctccggtcgtgatctcaccaaatacgatctcctctgccgcacgtccgcctgtaaatgtagcaatcttattctcaagttcttttttcgtcatcagatatttatcaccctgctcaacctgcatagtgtagccgagtgcacctgaggtacgcgggatgattgtaatcttctggaccggtgctgaatgactctgtaatgcagctaccagagcgtgtccgatctcatgatatgcaacaaccttcttctcttgatctgaaagaaccgcattcttcttctgatatcctgcaataaccacttctatactttcttcgagatcagattcatttacaacggtccttccactacggacagcacgtaatgctgcttcatttataatattggcaagctccgcaccggatgcccccgatgccatacgtgcaatcgtatgcaggtcaacatcatcagatgcttttatcttctttgcatgaacctttaaaattgcttcacggcctgcaagatccggcagttcaaccggcacacgtctgtcaaaacgtcccggacgtgtaagtgccggatctaacgactccggacggttcgttgcagcaagaatgatgacaccattatttccttcaaatccatccatctctgtaagaagctgatttaaggtctgctccctctcatcatttccgcccatttgtccgtcacgctttttaccaatggcatcaatttcatcaataaacacgatacatggtgccttttcctttgcctgtctgaaaagatctcgaaccttggaagctcccataccgacaaacatctctacgaattctgatccggacattgagaaaaatggtacatttgattcacctgcaactgcttttgcaagcattgttttaccagttcccggaggtcctacaagaaggacaccttttggcatagacgcacctacatcggtatacttcttcggattgtgaagataatcaacgatctctgaaaggttttctttcgcctcatcttctcctgcaacgtctgaaaaacggattccctcactggattgcacataaatcttcgcattgctttttcccattccaaaagccatcgaattttttcctccggcatgctccatcagtttcttcgccatataatttcccagtgctataaaaaggatcaatggcaaaaccccggtcagcaggaagctgatgatcggtgacatctgcttatcgatatcttttgcgaatactgctccacattcatatagcctgtccgtcaggttcggatcgttcatcagacctgttttataaatatttttttgatctttatctgtaaagatgatctgattgtccttaacttctacttcaccgatattcttcttctcgatcatgctcataaaagttccataatccgtttcctttacctgatgctccataaggattggtgtgacaaccagattaaatacgatcagcactattaacacaatcccataataatatgccagtggttttttcggtgttttaacttctttcatggtctttcctcctgttgttctgcgttatgctttctccgtgcattttcgtattatttattctgccatctgacttcgcccttggacagaagcggataacagatcagctgatctgaatccagattttccgcatgcatgtcaaccgctgtgatctgatgattatcataagtcgtataataataaataccttttgctgtattacaacaggacgtgtatatcgtgatctcatatttgccttctgtcacctcacagcatccacgctgctgatctacggatcctaagatatggaagaactggcttacactctcatcctcttcttcaccggagatcgaatttaattttgtaaaggcaactttcacaaatcttgactggctggaaagatctccaggtattcccattccacccattcctctgctatatgcatcaagctgtaatactcctgcaaaagtactctccggctgttttctggatactccggcataattattcagtgcaaacatctgactcgggaatggtggattattggtaagcactcctaccggattatcatatacatgcagcccatccttcatagactcaacaacgatacaggagtctttgtctgcaatgatccagtgaagctgtgctgtcggcagctgttcactgaatgctgtacctgtcagtctcattgctgccagcttctctctcgcctctgctacagtagcacactgtgtaaggatccatgggatgaactcgaactgtgccacctggctgacttctgtttcatcttccggcaaagcctcttcatatgccgcattgccgacaaaattaagacctgccattccaaggcctttttcattaacagcatcataataaagcggataaccttctgcaacaaatgccattccgatcaaagcataatggctttttatcttcccggcaaaccggaaatcaaattcgtaatttcttggcgttatcgtgatctgttccccataggaaaattcataatcaagcgttctgcccatataaaaatcttttgttttgtaagttgctgctgtacacatatcgaacacctcttctttctgctataatagtcctgcaaacaatctcataaacaactgtccgatccgtaaatatgcactccgtcctgtgcggtacttttcggtcacttccctgcattcattcattgttgctccaagatcatctcttatatccaaaactgtctgactaccattatactgcattataaggcagataagcaatctgtctttttgtcataaaaaaccttatctaaatgacattgaatgatttattttctatctaaaattttattaaaccgactaaagactccatagtttgtgtgtttgacttactgtttatatctatcttctcctaaatatttttctagtcattgcaatataaaattgcttataccgtctctcccttaagagtcctggtattctggataatatacagagcgaccgatatgaccatcattatagcgcacaaaccaatcaacagatctgataccatcggtgtaatttggaaccatataatatgaaccgctgcagttccatataataaaaaggttactatctttccatgccagtctgcaccatgtacttttcctgtctttcgtatcataagacatccactgactaccatatacagttccttacctgccattattacgattaaaagaagcatatgcggaaaacgagtaaacagacagattaacatcgctgcctgtgtcagcttatcagccaccggatcaagtatttttcctaaattactaatcctatggaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacgatcacatcactttccttttttttagacataaaccaataaaatataacacaaaatgctaaagcaaacacaacaccaaaaacattttgaatcactctaagactaaccgctccttgtagtccataagtctctgcagcaatggctaaagcaccaaatgtgttaaatactgcctgccagccatattgtgctgaaaatcctacaccgattcctccaagaattcctatatatgcatagattgacgaaggaagcagaaaatataacactgtaaaacatataacacctgcaatatttccgacaatccttttatggactctgtagtgcatatcttccataaatggcaaaatcgcggacatggctgcaataccagcccacattgcacgtggcatattacaaagttctgcaatgcaaaggacaatcggcacgcataaaatctgacatatctgccattttgttctggaagaagtgatatcaaattcttgtatcagatctttcagatttcttttataagttctgtttttatgatttcgataaaatacgaagcaggtaagtgctgcacctaaagccattccgactaatcgcatctgatagctttttcccgtaacatcataaccatatagcagtagatacccaagaaccaatgtagattgattaaacatgaatggattatggcatccgaacagaatcaacacagccagtgccgcaatatttaacagcattcccaataccggtgaaaactgatttgctaaatgcggacatacagtcataattacaaagaacaaagccaaaagcatcgtagattgtccggtgtggatccccagatccgcattccgaaataccataaggcataataaaactactacacccacaatactattctcatttccaaataagatactgaaaatagtaacaaataaaaaacaaaatgccattgtaacagctatctttaccaaatataccagtatatgatatgatttttctttcactgtttcactctttttcaacagatttttagaacctgcctgatttaactgcaattcctgataaaatgtcatgtaattcctcctctatctgtttttcttaaacttatatggcctcatctttctgtattggaagctctacaacaaatctgcatccaccatattcacggttttccgctttgattgttcctccggcactatctacaatccgttttacaagtgcaagacctaggccatttccttctgctttatgagatccatctacctgatagaacttgtcaaatattctggattttacatcatcctctattcctggtccttcatcttccagaatgaacttaacagaatcctgttcttgtttcagaaacatcgtaattgtcccctttgaagggctgaacttaatcgcattatccaaaagatttatccagatatgcataaaaagtccttcattcccagtatatttaacttcctccaattctacctgaaaaccaatttctttttctgtccattttgtctccagggaaagaaatgcctgacggatctgttcatccagacgatattctgtttttttcattggtatgttctgattctctaacttggataacagcaaaatatttccaaccaatccggaaagcctttgggtgttaaataagattttttctacatattcctcttgctccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccccgagaaacttccttcattgctttactaagtctggtaattggttccagtaactttgcattaataaaggaagtgatcagccctgcaatcaatgtattgaaaatcaaaagccagccaagcacaggtatactgcccggcagattaaaaaaatgattcaaaatagcaaataataaagcagatataactgttgaaaatacaagtgccagccagattgcaccagtcagacaggatcggatccgcaatcctttttctttcttttgttccattattttttcaccaccttgtatccaattccacgcattgttacgatttcaaaatcagggttatctttaaaacgctctctgattcttcctatatgtacctctatcgtatgtgggtctgcctccgtctcgtatccccatacttcatccatcaactgttgttttgtaaatgttctgtctggcgaagctgcaagcttatataaaagcaggaattcttttttaggcaaaacaagactttccttatcagttgtaaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtgctccatccgatgcacttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgcttctttgtcaattcaattggctctacatgatacggatcacgataggttccatcttccaatacctgtcgggacactctttcatattccatcatgccctcttccaactgtttattaatatctttactgcgaattacaagcatcagttccgtatccagatatgcacttctcatgtccatattaaaggaaccgattacagacagatcatcgtcaatcagaatactttttccgtggtatgaataaccgccttcatattcccagatattaattcctgtacttaagattctatttctgtttttcgcataatcggcagccccaaatggattcccattattcgcaactgaatttgtcatgatagaaaaatctgaaacgttctctgcaatctcctcccatgtattatacatcatatcattacagataatatatggcgtgtggatcttcacacgattttttgcatttttcatcaattctcccaattgataccacactactggttctttggaacctgtgtgaataggatttgacactaatgcaatcttttctgtctcaaaagtttcgtccgtgtaatcggtatcgcagattctttccttattctcttcaaaatatttctgatagccgttctgcagctctaaaactgcgttctttacagattttctatttgccagttttttattgtcatgaaaataaccactgtcttcttgttcccatatcgtttcaaaatactctaacaactggttaactgaattttctttctcaggttcatcgcaaaccactaacacgtctctgtcatagttcttatgtcccggaaaatcacccaggaaataattgtatgtatttcttccgccaagaatatatgtcttaccatctgcaatcaaatatttatcatgcattctacccatcattttccatggtttcaacgggttggctttattatacagtttaatttcaacattctcatgggaagataatccatagaaatacggattcccttccatatcaatccagctctccattccatctactaacagacgaatatgcacacctctgtctgccgcatcatgcagtgctcctaagattaattttccactttcatcggatttaaatgcaaaagtagaaagaataatttccttttttgcattcttgatcaaacgcactctttgtaaaagcgcttctggattcttttctatgattactgcccgttctgtattttcactgcattcgttccatgacccattttttgtttcttttttggttgtattggacacttccggctgctttttatatgcaacgcagattccgatcaattcataaaaagccacacataaaaaaattgccagtataacaagaaggattttacatattttatactttttcattgtacatcacctgattcctttttatttcatacttatacaatacaaagtcaatctcaatttaacctcaacaaaatttatttttcataaaaaaatatgacaggcttctttttaaagaaacagtcatatttttattctaatatatgaatgagcttttcttactccgttttattaatcactattttatttcttccataagctgtcggatttttctcaatgtacatcgtgtaactgccaggtcatcttcttgtatattcgatatgattttttcataagcttctatcattttttctttctgacaattacttaattcaattgccttgttcgtcaaaacaaggtacgttctttcttttttctcatctaatttccagataatatatcctttattttcaagactttttaccatcttagatgtttctggaatcgataatttcatgtattctgccacttctgaaagatatactccttcatgacagtctgatttttcaacacattcctttatactataaaggaacaaataatctgttctttcgacaaattcaaatatgctttcaacattgatgctctttaaaaaaaactcctctgcactggttcctgctcccatattatcgttcctctctttctatatattcttttttgctgactagactcttatatgccgggcgaatgatcttatctgtagttatcaattcttccaggcgatgtgcactccaaccagcaattcttgctatcgcaaataatggcgtgtacaattctcttggaatattcaacatgtcatacacaaaaccactatagaaatctatattaggacttactcctttgaatatctgacgctgctttgcaatcaatttaggtgcaatcttctcaatattgttataaagggtcatatctttctcacgtcctttatcccttgcgagttgttctacaaagcctttgaacaccctttctctcggatcggaaatagaatatacagcatgtcccattccataaataagtcccttctgatcaaacgcctctttcttcaaaatcttactcagatatgatgcaatttcctcttcgtcttcataatctttcacatgacttttaatatcatccatcatattcattaccatcagatttgcaccgccatgtttttttccttttaaggatgacattgctgctgaaataacagaataagtatctgaacctgaagatgttactactcgtgtagtgaatgtagaattgttaccaccaccatgttccatatgtaacaataatgctatatccagtactcttgcttccagttctgtgaattttgtatctggtcttaataggcgcaggaaattttcagcaatagataaatctttttcaggtctatgaatatacatactttcgtttttttcataatgacaataagcatggtatgcatatactgctaacataggaaatactgcgatcaactgcatactctgccttagcacattcggaatttcaagactttctttctccttatcgtaagagcccaatgtaagaatacttcgagtcatagaacccataatatctgatgtaggtgctttcataatgacatctctggtaaagttagtcggtagttccatacaatcagatagtcttccctgaaattccattaactgtgtatcagttggcaattctccgaataaaagaagatatgctccttcttcaaagacaaacctttttcctttacttcctgttactaaatcttttatattataaccacgataagataactcgccatcacatggactctttactccatcatgatattcaaaagcttttatatcagaaatatttgtaagccccgtcaacacaccttggcctttttcatctcgtaagcctctttttacaccatactctgaatacagattcttactaatgctatcattttgttcacaaaaaattgcttgccgtttcatataattttccaaattgctcatttgaatcgctcctttcattctgttacgaacttacatactatactcagatattcttgtttccagagcattcagcattgtctgttcttattcttattcattagcaatacaatacaatggaaaactcaatttaacctcaataaggtttgttttttcatccatgcaaaatcttctttgtacaacagactgttagatatagcaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattctcccatcgttcttatcagatcattttttatatccacaactgcctgacaatctgccataaaacagccgttttcaaaatggtgatataaacttcgataatccaaattaattgttccacaagttgccatacagtcatctgccacactcattttcgcatgacagaaaccaggagtccactcataaacacgaacaccatgtttaactaatccatgataaaaagaacgagttatattataaatgaattttttatcagggataccaggtgtgataattcttacgtctacccctcgcttagcagccagacataacgcatgcgtcatttcatctgttatgattagatatggagtcataaaccaacaatatttttcagctttatttatcatactgatataaacttcttctcctacttgttcattatccatagggctgtctgcataaggttgaacaaacccagtttgctgtgccgcataatcatagtggaaaaggtatttactaaaatcaggatcattagcatccttagcacttactgcattccacatttccaaaaatgtcaccgtaagcgactgaacagcatctccttctaaacgaatacctgtatctttccactgtccatacgggtgtgtgtaattaaaatattcgtttgctagattatatccacctgtaaatccgacttttccatcaataactgttatttttctatgatcacgattgttcaaaaacagatttaaacctggcataaacggattgaatacacggcaatgaattcctattgcctccatctttttcacaaaatctgtgttaataaagcctatagaacccatatcatcgtagagtactctaacttccacacctgcttttactcgctcttccagaacatcttgaatcttatgccatgcttcagcgtcttctatcgcatgatattccataaagataaacttctgtgctttctccaaatccttaagctgtgcctctaatcctttcactgcttcatcaaaatacacaatatccgtattctgatagattggatactgcgaatttctttgtatgtaacttgctatatttcctgctttcggaattgtttcttttattctgctcaaacactcctgactgtccggaagcattggtaacaatttgctatcaatttctgcatatcgctcacgcattttatgtgtgccaccattcaaaccaatcagcaaatacaggcctacacccataattgggaaaattagaattaagatgacccaaggcattttcatagaggatgtcttatttgatgcgtacaatcccaaaaccaagatcccactcaaaatccttgtaaataaatttatgatttctgcatattcattcaagcgtgttacgatagtaataataaaaatcacttccagaagaatgcagattatggaaaaacacagccgttttaccccattttttgtttttgctttgccctctaaagtatcttgtttcatatatattccaccttcctacttgctcagttttctccctaaatttcgtagaacataccaattttgtcttttattctctgcatttcattatctgcttcaatgatagctcttgcagaatgaagtaattcttcacttatctcatcatagccaggcatttcttcaattccttttttatagcgaagttgatgttccaatgttgcccagaaatccataccattggttcgaatctgtaattctacacgcataggtgttttacccttagcaaaaaatactggtatttcaacaatcatatgatagcttcgataaccattcgattttggattttttatataatcttttatttcaataactttaatatcatcctgttgggtaatcaaatctgatatcatataaatatcgtcaataaacgcacaaactattctaacgcctgctacatcattgagatatgtctgtatattttctgttgtaaattcatatcccatcttctgcagtttatcgtaaatactattgggctgcttaattcttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgttcatcctgagtttttttacttcatcttttgtcatggaactttcctttctacctcatccctgatttcaaaacattatttattttgatagttgattcgttctccttgaattactggataacaaatcattttttctatattcatatctactgcactgatctgatgtttttcataagtattgtaataataccatccttatggcagacagtggttacgaaagttttaatacctttgcacacctgatccggaagggaatgtatttcgttatccgcatgaaggatatcaacagtaatggtatcctttcctcttatgatttgcctgacagcgaatttgatactcatataaggacaacacttaccagacgccatacgaaagaaacactggggaatcctaacacctataccatacttcagccttctaccgattttgattttcttgatgaaaactgcatgtattacgatattgaattccgtattgtacgtgttcgccttgataatggaacctatatctgtattgccaccaatctttcagaagaatttcctctggaagaaatcaataaactttacctgatgcgctggagcgaggaaacaagcttccgtgaactcaaatacaccatcggtctgatcaactggcacagcagcaaatatgatggaatccttcaggaaatcaatgcccatatgattctgtataatttctgtgaattagtgacttctcacgctatggtaaaaaaatctaaaaataccaaacacgtctataaaattaatttcgccatcgcagtaaacatatgcagggcgtatctcaaacacagtggtaacgaaacagagaccatgcttctcatacaaaagtatctgacacctgtcaggtacaatcgaaaatatcctatcccccctccgtccaaagagaaatagggatttcatgtatcgggttgcataaatttcgttaccattatactgcattatgaggcagatatgcaatctgtctttttgtcatacacaaaaaaatgatttgaactcatcatacacctgctttctacgcattagtgcaccaaaaaaatacagcatttcttaactgaacagtattttcaatgcatgaacgcatatgatatactgttttcatcataaaaaaccttatctaaatacagttcatcactctctgccttaactttcataagacagtagagaaccactgtactaataatgattacgaaccaaattaacactttgcccattcgaccactcctctcaaataaatagaggaccaaaccagctgatggaatattccatctcaagtgctaatttaatcctcactaaatgttttaatataaaattgtacctaatctaagcacacagattcactctcagactgattgcggacatctgtgatactgacttggattttcggttttgatataacagcgctgccttatctaccgctaaattggtataaaaataaggactaaattaggcataaccccttgattttactgtgtttcatctaacttggtcctattataactcaaacacctgtttcccatctagaaaccgttcggcctgaaacttttatcttttcggcaagctgttcctgtgtaatatccttttctttcctaagttcttttaagaaacgtccaatctttttctgatccatactgtttcctcctttcattgacagagtaatattattctactaaacataacacgacacaaagcgagaaaatgccgtatttacgctattggacaaacctgtctagtattatttatattggctttagccctaaaaacttcgagttgtctctatctttatcttttaattatacacaagatttgaatctttttctacttatctataatcaaaaaatcctctcgaaaaatcctcttccttgtattataaaaccactttcataaaatttttcttctttttcagaatacctgcgtatcactacgaatattccgactgtcaaaatcactccaaatacgattcctgccagaattccattcgtccccattccataactctcattcagataataagatggcaggaaagaaaggattgttcccacaaccgatggcggtataaatcttagaaaattcttatagcataggcactttaccatttcctcgtctatcattcccaacattcgcaaactacaaacgaccctgctattttcttccttctctgcctggatacgtgaatgaattaacagaaactcagccattatcataagccctatcacaaatgccatcaaaaataataaaaattgccctgatttctttgcatcctggtatttctccactttcgaagacaattcataatatgtctgctcatcttcattcaactgattgctttcctgcagatattcttttacttcacatactcccgcataagaatcttcccaattctgaaactgaaacaagtttgcgataccagcactacctgttatatctgcacttaatttttcgaaatcagaatcgtttatgatcagtgttttatctgcaaaggtcggattttgattaaacagtatctttacatctgttccaacagactgcagctttctgtccccggaaatcgttacagtagatactggctgtatgttatgttcatacccatcttccagattgtactgaaacaaattcaaaaactcgccttcctgaatctgataatcacatccaaaatcccggtttatttctgtcacaggaagataattaaaaacatcatctctgatatagggaatctgaatgacctgttctacagtaacaccatttttctccaatatatgaaggacatcctgtactgaaacctgattcattccatagatttctgagtacaccatgtcatagggagaataactttttgcatcctgtagaaaagccggatataaagtcacacatacccccgtaagcataacagataccgctattatgagagatgctaaaacatacctacatccccattctttcttgtgtctgcgaacaaatgaccattccaccagatgaaacctcatgtagttgggtgcaagtctgcataagaacgtaccgatctttcctgttttttctgcccgatattgtgcttttagcagggttccaattttatccagcataagtctcccggcattcaggataaaggcaactgccaccaccactgtatatagaactgctgtaagcttatatgcttccgggcaaaactgccattgcactccgtgaacatctattgcataaatgataacggaaaaaaataaaaatgacagcacagttcctgccgcaagtgctattgctaatgccagcacggatataatcacattttcaaaaagtaagtttctaaacgcttccttccggctcatgccaagagaaaacatcacgccgtattcctgttttcttgatgccagaaatgcctgacacgaaacaggaagaaaaaaaaacagaaacactgcagacagaaaaaatggaagataaatgttattggatattgatgaatttacaatcgacgcattcataaacgtcctgtttgtggaaataactgcaaaacaacagaataatgccgttgcagataaattgcatagaaagtacaatcgatatttgtaaaaaccagctttcagcatctttcgggaaatatcaaaaaaggtcatcttttccacctcccaaaccgcacagcgttttccatatatcttctctgaaattatcggcagtgttctctttctttacttcttttgccagattcccatcctgtagaaaaagtacccggtcacaaaaggatgccgtataagcatcatgtgttacaagcagaaagctgatgccagaccgttgattcatctgtttcatacatcgcatcacatccccggtggtctttcggtcaaggcttcctgttggctcatctccaaaaataatatccggttcattgatcagcgccctgccaatcgcaactctctgtttctgacctcccgatatttccgtaattcctttgtcagctaatttttcaatgccgagcacatacgctattcttgaaaaacgctcttgctggatgtctgcttcttttcgttcaagaatgagtggtaacaatatattttcttttaccgtcaaactctccaaaagctggaaatcctgaaaaatcattcccatatgctttctgcgaaaaaatgccttctcttcttccgtaagctgtgaaaacgtttctcctcctattacgatttctccatcgtccggtgtgtcaaccccggtcagcacatggagcagagtagtctttccactgccggatggtcccataatagcaaccatttctcctttcataacttgcagattcacattctgcaaaatccgcatagtttctcctgcagttttataactttttgaaatatgatttgcatttaatacatacatcgaagttcctcctgataataaattttaaatttgattatcagaagtatttaatcatccatccgaaccgatagactgcaaagggtaactcccggtctgaaagaaaactcaccttgtccgaggtctttaaagccatcatatacccagatcaccattatttctattccaccgaaacatatacactcatagaaatgcaaacatatactttcgcttatatcgttttcactatttgacttttccaagcattccatctgctgtatgactatactttccaaatccccttctgcataatatccactccagattcggaaatttatcgacaaaagtaaaatcagcatgatggaacttaaaaccataatagcagcaattctctgtttttttctgaaatcatatgaatcaaaccctatacttctgctttatcatctggaagttatcgcttaatctttcaaattagttaaatcctctaaatacatttctatattaccacactctggacagaccgcaacttttacatcatctataatttttgccttttgtttttcatctacatgaacaacaatcccatagcccccaccatttactttaagtcttaaatctgacatcataacttttccgcattttgcacattttctcattgtttaccacctacaaatgtataaattaaattccgatttgcagggaacaattccttgtcccctacaccataattactatgtatttgcatctacaaactagaatttggaacgtgctttataaattttttccgatcccctcaagttcgttcatggagtagataaaaccacataactgaaagatgaatttacacacaaatttggacttgactattggcaattctgattttggacttctttgcgtccccactccgcttcaacgtccaatccgccacactatgaccactccagctaacaaataaataagtccgtgatgcattttataataaaaaaaacacatcccggacatttattaacattttattcacttacaagctctgtattctgcgtttcaatgctcttgccagcaccgttaatcgtcagatataaaagccctattccaataaatataagcagcagaaccacaatcatatatacaacacctattcctagcgactctgaacccatctggcttaaatcccatccaaaccagcctgttggcacattataattaagaaagttgtatggtgccgtcattgtgtcataccacctaaccccaagtactgcaagtatgtatacaaaacccacatagcaaagcggtggtataaccgcgtatattgcatatatctttcttgctttaaatcctttatcaaatataagaaaatctgctattgcaaatactggtccaatcagatgtacgccaaggcttcctgcgtgattatgaagataagcaccaataagaccatcatctgacgtaggtccaagaataatcatatacaccagacatgtcagtgtaattgagagcgtcataagaaacttgagcatatataatctattattcttataatcttttcccgtaacaagcaatatcatgtccaacacaataaataccaccagcacaatatcaagtgccacattagaaagtgttgtaaaaaatgtgaatgacataatgctgtcaattgtaaacatgagtccatacaccgaagcaatcagtgatactgccttaaaaataatacttgtaatcaatcttttcctgtctaatatcttgttattcaatttgagcctccaattatttgattctcgaattataatatatattagtttgattatcaagttatttatacaaaatatctatgtattcaatcagcctgttatacgaatcttcgtctgtcttatattctgctccattccattctaccctgcctgcaagcacaatattattggctattccatctttataataagttattctataactccagccattagtacgtggaaacttttttgcggtaagattcatgtttttaaccagttcaataatctgtgtcctctgttcctcatctggtgttatctctttaccattacctccgcacattattgtcatcttatcatatccactaaggtcaatattgaccacctgttttgaagtactgattattacatatgcaccaattcccgcaaatgctaataataaaacaattcctgctattattttaatattttttcttttcatacgcccctccttttggactttttccatgtcactctccgcttttcctttctatttatatatacgaaacactttccagaatagtttgcacatttacatacatattttatatatcaatacttaattccactcacaaaaagaaaaaactcccgcagggacaagccctgcgggagcaatcatacactttattcaagctgtatattaaattacttgtaaagttctactaacttctggagatgctcatatctttccttagcaacttcctcagacttagtgaagagtctctcagctctttctgggaatggcttaacaagtcttgtataacgagcctcgttattaaggaattcctgatatgatccatcaccttccttagatgtaagtgtgaatggattctttccttcagccttaagtgctgggttgaatgagaagaggttccagtaaccagccttaacagccttcttcatctcatcctggcagtggttcataccacccttagcaataccgtgaagttcgcaaggagcgtaaccaatgataagtgatggtccgttgtaagcctctgcttccttgattaccttaagagcctgagccatgttagcaccaagagcaatctgagctacatatacataaccatactgcatagcgatttcagaaaggctcttctttccgatttccttacctgctgcagcgaactggcaaacctcaccgatgttagaagccttagaagcctgtccacctgtgttagaatacatttctgtatcgaataccataacgttaacgttctcaccagaagcaagtacgtggtctaatccgccgtaaccgatatcgtaagcccatccatcaccaccgaagatccatacagacttcttagcaaggtaatccttcttagctaatacctgtggagctgttggacaaccatctgcagctgccttctctaactctgcaacaagagcttctgtagctggtgtgttagccttagtatcatccttagtctcgatgtacttagctactgctgccttgaactcagcagatgccttatcagatgcagccatctcttcgatcatctcgatagcctgctctctgatgtacttctgaccaatatacatacctaaaccatgctcagcattatcctcgaataatgagttacaccaagctggacccttcttagaatccttgtttactgtatatggtgaagtagcagctgggttaccccagatagaagaacaacctgtagcattagaaatgtacatctgctcaccgaataactgtgtaattaatctagcatatgatgtctctgcgcatcctgcacatgaacctgagaattcaagtaatggctggttgtactgagaaccgattggagtttcaacaagcgctggcttgatttccttcttaccaacgttagcaacgaggtaatcaaatacaggctgctcagctgactgagattcctgtggaaccatcttaatagcttctcctgccttaggacatacagtaacacactcgccacatcccatacaatctaaaggagatacagacattgtatacttcatagttgtatctacagcatgcttagaatctgcaagcttgatgtttgctggagctgctgtaacttcatcagctgaaagaataaatggtctgattgttgcatgtgaacaaacaaatgcacagctgttacactgaacgcaggctgctggatcccactcaggaaccataactgctgttcctctcttctcgtatgcagaagcacctgtttcgaactgaccatcagcgcaatccttgaatgctgaaactggaaggctgtcaccatccatcttagagattggctcaagaagatcgttaactaacttaacaacttctggacgtcctgtcttagcttccttaggagcatcagcttctggattagcccaagaatctggaacttctaccttatgtatagcatctacaccggcatcaatagccttgtagttcatctctactacagcatcacccttcttagagtaagacttcttagcagcttccttcatgaacttaatagcatcatcgataggcattacatcagctaacttaaagaaagcagactgtaagattgtgttagttctcttacccataccgatttcgatagccttatcaatggcattgattgtgtaaagctgaatcttgttatcataaatgtacttcttagcttcagcgttaagatgatgtcctaattcttcatctgtccactgacagttaatcatgaatactccgcctggcttaacatcctgtaccatcttcataccctgtgtaacatatgctgggttatgacatgctacgaagtcagcctgattgatgtaatatggactcttaattgggttatcaccaaatcttaagtgagaaattgtgataccacctgtcttcttagaatcatactggaagtatgcctggatgtacttgtctgtgtggtcaccgataatcttagtagagttcttgttagcacctactgtaccatctccaccgagaccccagaacttacattccttagtaccagcagctgaagtaattggagctggcttaacttctggaagtgaaaggttagtaacatcatcaacgataccaattgtgaatctgctcttaggagcatcattctctaattccttatatacagcgaagatagatgaaggtggtgtatccttagaaccaagaccatatctgccaccaactaatgtgatgtcgttaagtcctgcttcacgaagtgttgtagcaacatcaaggaaaagaggctcaccaagagaacctggctcctttgttctgtcaagtacagcaatcttcttagctgtcttaggaataacctttaagatagcttctgatgaccatggtctgtaaagtcttaccttaataagaccaaccttttcacccttagctgtaagataatcaataacttcttctactacgtcgttaacagaacccatagcgatgattactcgctctgcatctggtgcaccatagtagttaaataatccataattagtaccgagcttctcgttaaccttgttcatgtacttctcaactactgctggaagagcatcataaactgagttacaagcctctctgtgctggaagaagatatcaccattctcatgtgaaccacgagctgatggatgattaggattaagagcgtgtgctctgaattcttcaactgcatccattgggcacatatccttaagatcttcgtaatcccactcttcaatcttctgaatctcgtgtgatgtacggaaaccatcaaagaagttaaggaaaggtgtctttccttcaagtgctgcacagtgagctactggtgaaagatccataacctcctgtgggttagtttcacaaagcattgcaaaacctgtctgacgacatgcatatacatctgaatgatcaccaaagatgttcaatgcatgtgatgatactgtacgggcagatacgtcgaatacgcatgggagctgctcaccagctatcttatacatattaggaatcataagtaaaaggccctgtgaagctgtaaatgttgttgttaatgcacctacacctaaagaaccatgaactgtacctgcagcaccagcctctgattccatctcaactaccttaacagtactgccgaaaatgttctttcttccggctgctgaccactggtcaacataatctgccatcgggcttgatggtgtgattggatagataccagcaacttctgtatatgcataagctacatgtgcagcggctgtattaccatccatagaatgtttctgtcttgccattataaatatttcctccttaagaaaatttaggcggcataaatgtaccagctataaataaccagatatacattatacgtccctacatattacttaatattttattatctttatctccaaaagtaaaggcataaatgtgagatttcatgcttatttcattattaaaatcaatacaatgccattaaaaactggacttttccaatgtccaagcatcggaaaagtccaattacacgatttacatattcttattattactacattttattaataaatcattatattaatcgtcttcaccctgaagtgcatcataacctgattctccggttcttacctttactacatcctcaacatcatatacaaaaatcttaccatcaccgatatgacctgtatagagagcctttcttgtagcattgataacatccattacaggaactgaagatattaccatctcaacctgtgtcttaggaagaagctggatatccattggaacacctctgtaatattcaggagcacccttctgtgtaccacatccaagaacctgtgtaactgtcatacctgtaactccgatatcgttcatggccttcttgaatctctcgaatctctcctgcttcataagaatctcaaccttggtaatcttcttgccatcacctgcatcagatgtcttaacaagagcaggtacagaagcttccattgattctgaaccgattacatcagcatcaccgtcaacaaagtccataccaccaaattcgaatcctgcataagcacttgaaagaccatgctccataatatcaaggcctctgatttcttcttccttagaagctctcagtccaatagtagccttaattactgtgaacacaatcaccatgcatacagctgcccatgctgcaactgatacaaatcctaataactgaagtccaagctgtgtgaatccaccgccatagaaaagaccttcgcccttaattgaaccaccttctaaagcaattgcatatcctggagctgagcttgttgcaaaaaggccaacagcaattgtaccccagataccattcatcatatgtactgctacagcacctacaggatcatcaacatgaagcttgtagtcaagaagccatacgccgaatactactaaaagaccagaaacaatacctatcattgttgcaccaaatgcatctgttacatcacaaggagctgttataccaacaagacctgcaagtgaagcatttaaacacattgaaacatcaggcttaccatatcttatccatgtgaatatcatacatgttactgtagctactgcaggagcaactgttgttgtaaggaaaatagagcctaaatcttcaattgttgttgctgctgcaccgttaaatccataccagccaaaccacagaataaatacaccaagtgcaccaagtggaatattgtgtcctgggaaagcatttacctttataaccttaccattagcatccttttcaaacttaccaatacgaggtccaagaatcttagcaccaataagagctgaaataccaccaaccatgtgaatacaacaagaacctgcaaaatcatggaagcctaactgtgcaagccagccaccgccccagatccagtgagcttctattggatagataagtgctgagataactgctgagtatacacaatatgataagaactttgttctctcagccatggcacctgaaacaatagtagctgttgtagcacagaatactaagttaaatacgaaactagaaaaattaaaatctttgtaagctgtgaagatatcaaaaccaggctttccaataaaaccaagtaaatcctcacctaataagaaactgaatccaataagaacgaacattactgtaccaatacagaagtccatcagattcttcataataatgttacctgaattctttgctcttgtgaatcctgtttctaccattgcaaaacctgcctgcatccagaaaacaagagctgcacctataaggaaccacacaccgaataattcggcatctaccgctgataaaatctcttgcataaccatttcctccctaatcagaaattctttttaatttaattgccggtaacagagttgatcaggttctgtacctgattaaacagaatgcaaaaaaggcgtgcaggcagttttcccaaactgcttacacgcctttgtgtacatcactgttcaatttatgttgttcattatactcgccattttcaataattattgaaaaaatcggacatttttattgactttttaattttttcttaataatattttaataaataaacttttagaggagacaatttatgaaacatatgatacagccatttggaattgacatgcataaaaatgttcttacagacacaaaagcagttaagcatatgcatttttacgaagcagataaaactaataccatccttaacatctcatttattccatcatccactacagaatggataatatgttacaacgataataatgacatatctgaattcatatgtatcggatgtcagaacatatttacaacactttctcttaaagaatttgaccattatttcgggataagattcgacaacactggctgctactttaataaaggctgtgatattaagacttatcccgtcaacattacagacaatatattccgttatgagccagcccctcaatcgtatgagatgcagctaataaaggattttcacaattcttcatcctttaaagacagaattacactttttaaagcatttgttacagattgcaagaccttctgccctgtttctgaaaatattgagaaacttaacagacttatatattcaggtaccagtactgttgcagaattatcagaagaatcagaatattctgtaagacatatatcaaggctttacaacgaagtctatggtattggtgcgaaggattttatcaaaatgtacagattccagaatgtccttgcagccataattgctgacccagaacgtgataacagcttctttattgaaggtgcaggttattcggatcaggcacatttccaaagagaattcaggacatttatgggaatgactcctaagaagtacataaaacttatcaagaatttctgatatacatgctaaaacaggtgacaatcttcacaatcagactgccacctgcttttcttaatctccatcagttaatataaaatcactcatcactgtattgcatatatcaatgccatattctgatagcttcaacatatctgcctgtcttgttaaaagtcccttattaatattgctctctatctctttttcatagactttttcaattggcattccgaatctgttctgaaaatccttcacatcaactcctgcaacctttcttagtccaagaaacatgaattcttccattgcatcttctttagtcagtatttcaatattttcatgaagttttcctatatcaccgttaagctctatatacttcttgacatctcttatgtcggaataccgcacattctctgtaaatcctgctgccgaacacccaaagccataatactctcctctgttccaatacagaagattatgcctgcattcaaagcccggtctgctataattggatatttcgtatctttcataccctgcatttccaagaatctgcttcgttatatggtacatgcacctgtcctcttcctcatcaggaaccggcggaaacttatcaatattatcagccagataagtgccttcctcaagaataaggctatacgccgatatatgctccggctgtaatgccgtcaccttgtcaaatgtattttcaagagttgcttcagtctgccccggaatagccgacataaggtcaacattaatattattaaagcctgcagcccttgccagtctgaagctttcctcaaactgttcaaatgtgtgtattcgcccaagcatttttaattcattattatcagcagactgtaagccaaagcttaacctgttcactcctgcggctctgtattctgaaagcctgctttcattaactgttcccggattacattccattgttatctcagcatcatccaaaacatcaaaacaatccctgacagcagctaatatgtcagctatacagccatcaggcagtactgacggagtacctccgccaaagaatatggatgttatcttatcttttacctgcccatctgctgtatttctgatttcattaataagtgccttagtgtaagcatattttacagcatcaccagccggagcagacaggaaatcacaatatatacatttgtgtacacaaaaagggatatgtatatatatccctttttcatatgttttattcatcatctaactttaatacgctcataaacgccttctgtggaatctctacattaccaatctggcgcatacgcttctttccttccttctgcttctcaagaagtttcttctttcttgagatatcaccaccgtaacattttgcaagtacatcttttctgagtgccttgacagtttctcttgcaattaccttgcttccgatagctgcctgaataggaatctcaaactgctgtcttggaatctcttccttgagcttctcacacattttacggcctctctcctcagcattgccggcaaatacaatgaatgaaagtgcatcaacttcttctttgttaataagaatatcaagcttgacaagcttagaacgctcataccccttcatctcataatcaaatgatgcataacctcttgagcgtgatttaagtgcatcaaagaaatcatatataatctcattaagaggaaggtcatacttaagcagtgcccttgtctgctcaatatattccattccattatatatgcctcgtctttcctgacaaagcttcataataggtccgacgaattctgttgtaaccataatctcagcacttaccataggctcttccatataatcaatctcagaagggtccggcatattagacggattagtaaggtcaattacatctccgttcgtcttgtgaaccttatatataacgcccggtgcggttgttacaaggtcaagattatattctctctcaagtcgttcctgtataatctctaaatgaagaagtcctaagaatccacatctgaagccaaatccaagtgcaatagatgtctccggctcaaactgcagggctgcgtcattaagctgcagcttttcaagtgcatctcgtaaatcctgatacttggcgccatctgccggatataatccgcagtaaaccataggattaaccttcttgtaaccaggaagcggctgctcacatggtctgtcattatcagtaactgtatcaccaactcttgtatctcttacattcttgatacttgctgtaatatagccaaccattcctgctgtaagctcatcgcatggaataaaacggcctgcaccgaaatatccaacctcaacgacctcttctacagctccggttgccatcattcttatcttagtacccttcttgacagtaccttctttaattcttacaaatatgataacacccttatatgcatcatataacgaatcaaatataagcgctgaaagtggtgcggaagcatctcctgatggtgccggaatcttagttacaatctgttcaagaacctcttcaatattaattccgttcttggctgatataagcggtgcatcctgtgcctctattcctataacatcctcaatctcttcaataactctttcgggttctgcacttggaaggtcaatcttattaattacaggaaatacatcaagatcatggtctaatgcaagatatacattagcaagtgtctgtgcttcaattccctgtgccgcatctactacaagtatagcaccatcacaggctgcaagtgctcttgatacctcataattaaagtcgacatgtcccggagtatcaataagattgaatatatattcctgtccatctgatgccttatatacagttcttactgtctgtgctttaattgtaattcctctttctctctcaagatccatgttatcaagaatctgctcctgcatctctcttgatgtgagaagtccggttttttcaattattctgtcagccagtgttgacttaccatgatcaatatgtgcaataatacaaaaatttcttatgttcttctgattaattcctgccattaatataaccccgcttgttttaaataatcttttatgccatctgctatggcttgtgctgtcttagttttatcagttgttactttctttaaatctgatacattagttataaaacccatgtctattactgtgcttgtacatttactatgagcgttaatataataattatcctttgcatctccaactgtaccggttttcactccacgattcttaattccagtacttttttccatgctcttaagaataatccttgaaagctctgctgcctcaacaggctttgtcgtgtgaatataactctccgcaccggaaactgatgtatctgcattatatgaattcattctaagtgacacacatatatatacttttgacgaattacatatctttacacgttcttcgtctgtaacatccctatctgatgttcttgtcatgacaacctctatcccatcggattcaagctttgacttaatatcaagagccatttcaagatttatatccttttccttcctgcctgatgacgacactccagtatcctttccaccttttgatggatcaagacagactacagcctttgaagacgcccctttagattcaacattcttattatcattaagatatccgcttgttctggtttcgctctcggtttctttgccaataacgttttcctcacttacagtatccttaaaaaagtcattatacaccattaaagtgataaccagcaagcagacaagtgtagccagtccgaataatttatctattctaaatgttttacgatgtttcattatagtaccccattaatatttcttgtactattgtccataaggaaggggtaaatgtcaacaacttttaaccatttcttttcttaactgacgcattattttcttttcaagccttgaaatatatgattgtgaaattcctaacatatcagcaacctctttctgtgtcttttcttctccatcctctgaactcaaaccaaatctcaaatcaactattattctttcacgctccggaagctggtttatagcctttttaagcattttgcattcaacctctgtttcaatatccctatatataatatcctcatctgttccaataatgtctgacaacagaagttcattaccatcccagtcaacattaagcggttcatcaattgacacttctgcttttatcttactgtttcttctaagatacataagaatttcattttctatacaccttgatgcatatgttgctagcttgatatttttatccttatcatatgaattaattgctttgataagccctattgttccaattgatattaagtcctctactccaacccctgtattgtcaaatttctttgcaatatacacaacaagccttaaattatgttctatcagagtgtgctttgcttcagcatcagaagcagtccccagcgcttctattgcgttctgttcctcacttgccccaagtggtgccggcaatatatctgtcccgcctatataatgtacgtcaccctgctttaataaacaaaaattctttatagaaggcattaccttaaactgaaaatgatccgccatcgcaacctttactaccatatttctatccatccttttattttcttcaaacttccgattcctctacataatcatgtccttccccaaaagggcatgataatccccattcttattaatctgcctaagagacatacctatagccgcatgctcccttttcacaacattttctccctcgtatatatgtatataatctgctgttatgatttccatcatcccacctgaattccccacactgttatatggaatcagatgatatccaagcttttgtaagttatctatgtcactgagaatatcgttgaaatacgttctttcaaccactgtaacaggtcttttcccaacataatcaataaggctgttgcctgtatcaattattgcgtccatttcaaattcccgttctgctacgccaatcacaatgtgtcttttcaaaccatctgttatcctgatagttttaagtgtcttaagcacaatgacaacaactataaccgtcacagtaagaaagattacaagctcactgtcagacagaattacatttccaataaaataccctgcaaatgtgtactttaaccaatgcattatcccacctgcaaaaagtgcaataagaatcattcctgcacctgctttcaacagattcctcatataaagctttaattgttttgatgttttctgcttaaagtctttagtaccggaaagcattatcatagccatgattaatgttaccggaacatatgtaataaacttttcaagcagtgcaaatcttagtggaatacacacacatatgacagcccatacagctcctaaagtggcagaaataatcattctggatattctggcagaaaatttaaatatccagtctgttataagcagcacgcacaggtttgccacaaggtttattccaaacagaacatctgcatatataaccgtttcgtacatcacctccttgttttgaatccgtttctttgttacaagtggaattatatacgacatatcatgcaaaatttgtcaaaacaacagagtgggcacaaaaaaacaccgccagcaaactgacggtgttaaatatacttatattaaattattacttcttattcttctgtaaaaatgttggaattgtaattcctctgtccttaacctgtggtgtaacaggtgatggctgcttaagtcctggaagcggagcatcatttgatgccgaagatgttcttgctgctggctgtgaatatgtatactgtggcttaacattaacagttggtcttgttgcctgtgccatacctgcaaatcctgccatagccttattaacattaccgtcctcaagacctgttgcgataacagtaattgtagcctgatctgtaacgctctcatcatacatagcaccaaagataatgttagcattatctcctgcaagttcctgaacgtagcttgcagcttcattagcttcgataagactgatatcacctgagatattgatgataacatgagatgcaccctcaatagttgtctcaagaagtgggcttgtaacagcctgcttaactgcttcgatagccttgtcatcgcctgtagctgtaccgataccgatatgtgcaacacccttgtccaccataacagtcttaacatcagcaaagtcaaggttaataagacctggtacattgataaggtctgtaattccctgaacagcctgctgtaacacttcatcagccttctttaatgcctctggcatagttgttcttctgtctactatctctaaaagcttgtcattaggaataacaataagtgtatctacgttctccttaagcttctcaattcctgattcagcattagccattcttgttctggcttcaaacttgaaaggcttagtaacaacacctactgtaagaattcccatatccttagaaatcttagctactacaggagctgcacctgtaccagttccgccacccataccacatgtaacgaataccatatcagcacctttaattgcctgtgtaagttcttcaacattctcctctgctgccttctcaccaatctcaggctgtgcgcctgctccaagtcccttagtgagcttctcacctatctggatagcagttggagccttacataaagtgagtgcctgactatcagtattaataccaataaattcaactcctccgatattctcatctatcattctgttaaccgcgttatttcccgctccacctacaccaacaactataatctttgctgatgactcctggtcattagtcattatctctaacaaggttgttgcctcctttaatatctaaaaattgcactacataatatattataatttttcatctaaaatatcaaccgtttttttacttttcacgtttaaaaattatagaactttcatcgccattataatcatcaagatacagtgttcctttaagtgttccgaatctggatgataactgctttaattcaaaaagcctgtctgtaaaatccttgctgcttccaaggcttaccttaacatcgcccatataaagcgtaatattataagaggcatcaaaatacactttgtccacatcaatatcatacttatcaaagctctgtataagatcaagaattgtattgtatatatctgcatttcccacatcaagcttcgtattgattactattgaatcaaacttaagtccgtcaatctgcggaacattttcatataaatccgttgagctttctactacaattccatctttatcaaaatacatattacagcccatgtacctgacataacctactattgccttttcatatactgttacataaagcctgtccggccagtccgtctcaacatcatatttctggataaatggtattttggtgtctttttgtccaaaaatcctgaaatatagcagattaacataatcaccaccaaatatatattttttaagttcttcatccgaataatgagttgaacccacaaattctattgtatcagcctcaaacaccttatatgtaacaccaaaaagcattccggcaacagctgcaataactgcaaatataataagggctttctttctttttctgccccgtctttttttctggtttacactgttactattcctactacccattatctttccaacttaatctgactgcttatattaaatacaaccccaagttcaagcagcaaaaatactgccgccgtacctccataacttatgaatggaagtgatactcccgtattaggtattgtattagttacaactgctatattaagaattacctgtatggcaatatgtgcaaatactcctgttgcaagcattgaaccaaacaaatcaggtgcattctgtgctatatgattaattctccataacattacaataaacagggcaatcaggcagaatgctccaaaaagtcccaactcctcacatataacagagaatatcatatcattctgtgattccgggatatatccaagcttctgaagactcttgccaagacctttgccaaaaagacctcctgagcctatggcatataacgcctgaactgtctggtatcccttgtcatcaatatatttctcaggattaagccatacaagtatacggtttaatctgaattttccagtcatatttcccgacactgccatcttctttatccatgagtaaaatgcgccaaaagccaccgctgccagccccgtcagtgcaacatatattttatatcccggatatgccacaaatgtcataacaactgagataagtgctacaataagtgcgctgctcatattagaagacagcacataaacaagcagtgccggtgcaaaaccggatattatacatatcactataacagtcctgaatttctttatgttctgccctgctttcactataagaagtgcagtcatggcaatcgttccaatctttacaagctccgcaggctgaaattgtcccaaacccggaatctttatccatctggtagctccatttcttgtaattccaagaggagtctttaaaaggaacatgcaaagaagtccgcctatatatattacaactgcaagcttcttaagataatgataatctaaaatcttagtttcaactatcattaaagcaaagcctattatagtaaatataagctgttttctgaaataaaattccggatcaccctcttcaatctgcgctgtatatgagcttgtgctgtaaatcattgtaagtccaaagccaactatgaatacaagcacaaaaagaagagtgtaatcaaagtaaaatccatattgttttctcttttttctgtttctgttatttcttctatttctattattccccggcataaagcaccgcctttttacagattattgacaagatccttgaatattcttcctctttgttcgtagttatcgaacattccccagcttgcacatgcaggagataaaagaaccgcatctccactcaccgcatttttagcacatatatctactacctgttccattgaatcagcatattcgatattatcaaagccatatttcttacatgtatcagcaatcttggcacttgtctgtcctataagcacaagaagcttaaccttatccttaaatgcctttacataaaggtcgaattctgagcctttatcataacctccgccgataagaattgtaggtttaaccatagcttcaatagccttaactgctgcctctgggttagttcccttggaatcattatagtaatcaacaccattcttagttgcaacatattcaattctgtgttcaacagccttaaatttcttaacctgttctattataatatcatcaggaattccggcagccttagtcattgcaattgctgcacatacattttcatagttatgctttcctaaaagattcatgtcatgaacattcaacatgtcataatcattagttccatctgtatacttaataatctcaccatctacatatgctccgactgatggctttctttcacttgaaaaccacacgacatcagccttacactcaggtgcaaagtctgtaagatacttatcctcaagattaagcacacatgtatctgccttagtctggttctcacttattctttccttggtccatgcatagcattccattgtatggtgtctgttaagatggtcaggtgtaatattaagaattgcagatacaatcggatggaattcatgtactgtctctaactggaagctgcttatctcagcaactgtatatgaatcctcacttgtctttaacacttcacctgtatatgaattgcctatattaccaacgacaaatgttttctcattatatgcagcaattatctgtccaacaagtgctgtagttgttgtctttccgttagttcctgtaattgcaataaccttacccttatcataattatatgcaagctcaatctcgccccatacagggataccggcattcttaaatgtaagcactatcggactgtcaataggaacacccggacttattacaagcagatcaatcttcggaagaagtgactcatcaaatgctccgatgataatctctgccttgttatctcctaacttctcctgcaccttctgtctgtcaagcttttcattgccatcatacagtatgcagtcagcaccaactttattcaaaaggtctacggctccaataccacttatacctgttcccacgaccattactgtcttattctttaaatccatcgtcgtttacttcctttcatacaaaatgtatacaaaaatatattactatcaatcatcgtttttttcaagttgaactgacctttctataccaatatacggcaatatattttcatacagtgtcttaacaacaggagcagcaattgttccaccataatatacacctgttggttcatcaattaagcacatcgctataacctgtggattatcagccggagcaaatcctatgaatgatgaaatatattttcctgaacctcttggcagcttctgtgatgttgccgtttttcctcctatcgaatagccgtcaatatatgctttcgttcctccgccttctgacactacaccctcaagaatctttttcatcgtttcactcgtttgggatgatattgcctcatcctgtgttgaatatgcaaattcatttaccactgaaccatctgatgaacctgtgtataagccaaaatgtggtgtaacaagtcttccaccatttacaatcgccgaaacagcccttaacatctgaacgggtgttatctggaaagactgtccgaatgacattgtggcaagctcaactgcacctacattttcctgcttatgaataatcgttcctgcctctcctgacagatctattcctgtctttgcaagaagtccaagcttacccatgtacagatacatattatcagtaccgactcttctgccccattcaacaaatgccggattacacgaattatacactgtatgtgtaaaatcctgtgttccatgtcctgttgttttgtgacatcttattcttctgtcagaaacaaccgttgcacctgaacatgtgaaagaatcatttaaacccaccacgcctgtctcaagtgctgctgttgcagtaactgtcttaaatattgagcccggctcgtatgtatcatttatgcagaaattccgccacatattattaagaagatccatcttatccttctgcgcctcttcctcatcaggctcataattaagctcatacggagaattaagattgtattccggaacatttgccatagcaagtatctcgccattatcaggacgcatcacaataatacttacctgttttgcctctttctttaccatagtctcccatgcaagctgggttgcatatttctgtatattaacatcaagcgttgtatacagatcctgtccgtcaactggcagaatacgatcttcccggctgccctttatctcaatcccccctgcatctgacagtgtaagaatctgaccgttagtacctgacagatatgtgtcatatttagcttccagtccaagtattccctgattatcagcaccagtaaagccaagcacttttgaagccagttcattatacggatatacccgcttataatcctcgtcaatcttaacacccggcaggtcatattcccttattgcatctccgatatcctttgccacatttgtcttaatatattccatagaggatactttcttaactttcttagtcacttcctctacgtccatatcaagttcacctgcaagcacttttataaccttatcttcgtcatctatctgactatgtattacagaaactgtacataccacttcattagctgcaagtatttcgccatttctgtcaagaatccttcctctctttgccttaattctcctctccctctgatgaagctcatcagccttttgcatataatactctgactttaccgtcataataacgccaagccttacgcattcaagaatacaaaccataaggattgcaactatcattaacacaagcttttttctatgactggtactgagccagccaaatgtgccattatccttcattgacaaataaccccgctttagtcttctacattttatgagaagcaaagcagggttattctacttattattacataattttagttactgcctgttgtagccggttccgaaacagggacatctgaaactcctgattcctccggtgcatttcccgaatcaacatatggctcgtctgtatccttatacacattcatataaggcagcagctccgtcataatatcttttgcaagtataagtgcatctgatgtacttcccgatgttccagtcgttccatccggttcatcaagaacaatgtatattgcaaatttaggatcatctgccggagcatgccctataaatgagataacccacttaaggtcagctcttgggattttctgtgcagtaccagtctttcctgcaatagaatacccctctatatacgccttatgtgctgttcctaattctactgtattttccagatattttctaagatactttgatgttgaagcagttactgtctgccttacaagaaccggtgaattttctttaacaacttccccattagctgattctattctcttaacaatatgtggctgataatacttgccatcattaataagagaactatacgctgacagcatctgtaccatattaacattaacattctgtccaaatgaattggttgcagcatctattgtagttatcttattctcatcatacataatacctgtagcttcaccaggaaggtctacaccagtctttgcaccaaatccaaacattttctcatactgtgcaaatctgacattgccaagttttattgcaatattaatcatgtaaggattacatgaattttccaatgcctgcgacaatgtaagcacaccatggcttcctattgttgaatatgagtggcacttaatcatatcaggaccaacatactcatatcccttacattcataagtatctccatcatgcacaacgccttcttcaagacctgctgcaatagtaaatggcttataagttgaacccggctcatatgactctgatacacaataattagtccataactgatacaatgcattggttacatctgtatctgacattgatgcaagctgttcctcagaatatacatttgcaagatttctgggattattaaggtcaaactgtggatagcttgccattccaagaatctcaccattcttaggattcataacaacaatagctgtattcttagatggtttttcctgattatatgcaaccatatatttctctattatggactgcacattataatcaattgttgtaataatattattaccgttaactgctgcctttgtcgtttctactgcattaagatcttcatcaacatagctgtatgaaactccgtctattcctgaaagctcatcgtcatactggctttcaagaccaagctcaccaccattgacattggatgcaaaacctatagcatcgcatgcaagagtactgaacggatattttctcacatagctttcctcaaaccatacaccatatatattgctgttcttctgtgccttaagctcattaaattcagctatctcatctgatgtcagttccttaagcagcttctgatactggcttgaaggattatcgttaattatttttttaatattatctttatcaagaccaaaacattttactaatgcatctattgtattattaagatattttccgtcctctgatgtcacactctttacatcaagtatcagattatacaccttctcactatatgccagaactgttccgtcacttgcagtaatattaccacgcatataaggaattgtagttgatgtatatgtctgatgattaagcaccgcctgggaatattcctccccatgtgtatagttaatcataaatatccttacaccaagtacaagtaataatacaaatactattataaatgtaacattaattcttctgtgtgtcctcttaagcattgcgcgtttcctgcgcattattttctttcttcttgcttcactggtattgtccataaatttatcaatcctttatatcgcactgccacacattttagttattttgagatatccttatactgctttacatattcactttcctttgaatcataaccgattacctggcttctgcttggatataccataccaagttcattgacagctgtatcatatattgcgttataatcaatgcctgcattaatctctgattcatggctgttattctctgccttaagtgaattaagctgattctgaagctcaactacagcagtactgttagtcttaatatctgactggagattaagatactggtagcatattgcaaatactgctgttgcacagatagcaagcactgtagtatacacaaggttaaccctgttatttcttcttatctctcttcttctttgtcttctctcctgctcctgctcctcaattcttctttcatgctcataagtatgtatttctggaacagactgcagctttcttactgcacttccatactgatattcagttgtcctgtgatttacaacatttcttctcttctccaaaactttcccctccataaatgttttatattctttcaaacaccctcagtttagagcttttagaccgctgattctcgttcagttcttcatctccgggaactataggttttcttgttataacctttccttttgatttctttccgcatacacatactgggaaatccggtggacatgtacatggattctcattgtttctaaatcttgccttaactattctgtcctctagtgaatggaatgttatgatacataaacgtccctgtggattaagcctgtctatcatcatatcaattgaattctctaagacatctaattccctgttaagttcaattcttatagcctggtatgttctcttggatggatgacctcctgtcgccctcacctttgccggaatagaagcctttataatctcatttagttcaaatgttgtttctatcggcttttcttttcttgccgcaactatatgtttagcaatattcttggcaaatctgtcctctccataatcccttatgattctgaaaagctccatctcactatatgtattaacaagatcctttgctgtcatctcctgtctctgatccattctcatatcaagagcagtatctacattataagtaaatcctctgcttgctgtatctaactgatacgatgaaactcctatgtcaagaagtatcccatctactttatcaattccaagttcatcaagaaccttgtccatattgcaataattatttcttactattgttacccgttcttcgaattctttaagtctttctgtcgctgccgcaattgcgtccgcgtcctgatctatacctataagtctgccaccacctgtaagtcttttcgctatctgatatgaatgtcctgcaccgccaagtgttccatctacatagattccatcaggtttaatattcagattgtcaattgtttcttccaaaagaactgatttgtgtttaaattccataataaacctcatgtctgcatattatatagaaaatccaagactctccatattcgctgctacttcatccatatcatcatcataggtactgatactctgcagccagcggtctttgctccagatttcaattctgcttgcaacgcccactaaaactacatctttttccaagcctgcaaactcgcgtaatactgatggaagaagtattctgccctgcttatccacttctacgcttgctgcacctgcaagaaagaatcttgtaaactgtcttgcattcttattggtaagtggtaatgtctgtaacttttcttcaaatttctgccattcatcattcgggtaaacaaacaggcagttatcaagacctttggtaaccacgaattcatctcccagaacctcacggaatttagccggtacgattagtctgcctttagcatctattgtatggttgtattcgcccatcaacataactatcgcaccccactttctaccattaagctccactttccaccactttagtgtcaattttatacttaaagtgtttaaaaaacaagtcctttttttagtttatttaatgtcagaaggcagttaataacagtctttttctccattttatgttttgattgcttatatagtgttttgtcatcattttcagcacaatatatagatatattcttatacttttatataaattattttaataggtaaattatatgttgtttttaaagaaaaatttttgtataatatgattttgtactggattcttttttacattttaagaactctggaacgaataatcataagaataattaatgaggagaatctattatgaagcttggtatcgtgggtctgcctaatgtcggcaaaagtaccctttttaattcacttactaaggcaggagcagagtcagctaactatcctttctgtacaattgaccctaatgtcggtgttgttgcagttccggatgacagacttgacaagcttgccgctttatataattcagcaaagataacacctgctgttattgaattcgtagatattgcaggtcttgttaaaggtgcatctaagggtgaaggtcttggaaaccagttccttgccaacatccgtgaggttgatgctatcgttcatgttgtaagatgttttgaagattctaacatcgttcatgttgatggttctattgacccaataagagatattgaaaccattaaccttgagcttatattctcagatattgaagtattagacagaagactcgctaagcagaagcgtgcttcttataacaataaagatattgctaaagaatgtgaccttctcgaaagacttaaggctttccttgaagaaggtaatttagctaagaattttgaatgtcaggacgaagatgaagaagcatttttaaaggaatacaaccttcttaccgctaaacctgtaatctttgcagctaacgtatcagaggacgaccttgccaatgatggtgctgacaatgaatatgttgcaagagtaagagaatactctaagaaggataactgtgaagtattcgttatctgcgcacagattgaacaggaaatctcagaattagatgatgatgagaagaagatgttccttgaagatcttggtataagttcatcaggtcttgataagcttattgcagcaagctaccgtattcttggtctcatcagctacttaacagcaggcgagaccgaaaccagagcatggacaatcactaagggaaccaaagctccacaggctgccggaaagattcacagcgatttcgaaagaggctttattaaagcagaagttgtttactatcaggatttacttgactgtggttcatataatggagccaaagagaaaggtcttgtaagaatggaaggaaaagaatatgtcgttaaagatggtgatgtaatccttttcagattcaatgtataatattaatgggcgtgtggttttaccacgcgcccattatttctttaaacttcttaacattatcagctacatctccagaaaagattgctgaacctgctactattacattagcacctgcctcaagaactgatgcaagatttccggcattcacgccaccatcaatctcaatatctgtatcaagtcctttagcatctaataaacttcttatttcttttactttatcaagtgattccggtatgaacttctgtcccccaaatcccggattaacgctcattacaagaaccatatctaccttatcaagataaggctcaattgctgataccggtgttggtggattaagtgttatagctgcttttacaccacattccttaatcttttctaatgtagcaacaacatccttacacgcttcaacatgtactgtaattatatcagctcctgccttaacaaaatcttctatatatcttataggctcttcaatcataagatgtacatcaaaaaccttgtcagtcgcacttcttgctgacttaataactggcattccgaatgaaatactctttacaaaaagtccatccataacatctacatgaacatattcagctcctgccttatcaatcgtttcaagctcttctcctaatttcttgaagtctgccgataatattgatggtgacaaaattttctttaaaccactcataattaacaacctttctgttttcaagtacatttagtacttcttcttgttctttatttcttcaaatatatctgtatatgacttatatctgtcataattgataattccgtcttcaactgcctgttttaccgcacatccaggttcgcttacatgcatgcagccattgaatctgcactttccttcgaatggtacaaactcttcaaagtaaaatcttaaatcttctttctcaacatccggaagattaagtgatgtaaatcccggagtatcacatatatatgtttgcttacatacattgtatatctcggaatgtcttgtagtatgccttcctcggcctatcctgcttacttctcctgtctggctgacttctccctgctcttccatgtccggtataagcagattggtaagtgttgatttgccaactcctgaagggcctgcaagtactgttgtctttcctttcagtacttccattatcctgtcaatgccaatattattctttgcacttataaatatgcattcacatccacacccctcatacttcttctttaattcattcttatattcatcatcagccagttcttctttattgaaacatacaactgtcggaacatcctgataattcatcataagaatgaatttatcaagcagattaaaattaggttctggcgtctttactgcaaatataaccattgcctggtcaatattagcagaagccggtcttataagttcgttctttcttggaaggatgtccaccacatttcctttgaaattatccttatcaataacttctatctccacattatcaccaaccagtggtttaatgtgtcggtttctgaatatcccttttgccttacattcataaataccgctggtttctacatgtatatagtagaaaccagcgatacccttaattatctttccctgcatataaataattatacctgattaattctgtgctgcatctgacttagcaccaactgtaattgtaatcgtagttccctcattcactgtacttccagagctcttatcacacgctgttaccagaccaactttatcctctgatacagttgtatcattcttagttgtataattaaggccattatcttttatccatttaatagcatcctgttcagtcttgccaaccaagttaatcattgttactgttttctttacttcttcctgcttatgacttaccgtaattgtaactgttgttccctctggaactgaagttccttctgagtaatcacttgaaactacatagccatatgttccacttgatgttgtataagaagcattaaccttaagtccgttattttcaagccactgtcttgcttctgactcagtctttcctacaagattagccattgtaacattcttaatctgctttccacggcttactgtaattgtaactgttgttccctgtgccacacttcctgatggagaagccttaattactttgccttcatcaacagtgctgctgtaatcataatcaaccgaaaccttaaatcctgctgattccagtttttctcttgcatcagattctgattcccctgtaacagatggaactgttgtattaacaacttcttccccaccacttatagtaagaataatctgtgtattctttgccaccttggcacctgccttagttccctgtgaaattacagtatccttagccactgtcttagagctctgtacaacctgcttatatccaagtccgacatcattaagtgccttaacagctttatccttagtcatgccctcaaccttaggaactgtaactgtatccttggaatttgctgttgataccgtctcttcagtagttgatacagtttctgtattttcattcttaggtgacttagtgcttccaacaagcttaacaataacaaatattgtaacaataagtataataacagctattcctattccaattattttcataattaaatccagcttgtcattatcctcatcatcaatatctacatcctcatcgtcttcctgtaattcattatctgaatcttcattttcatcatcttccagaaaaatatcatcatctgataatgcatcatcattctcaccagcattaacttcttctgtatcagatgaagctgtagctgccactcctgctgctgcataagccggagccatcttaacaaaatcttcatctggcattacaagagcttttttaagatctgttataagttctgctgctgtctgatatcttctgtcaggtttcttctgtgtacatttaataacaattctgtctatacttaatggtatatccgctacaaccgtagatggtgcaggtatctcatcctgaatatgttgtactgctactgcaactgtagagtcaccatcaaacggtactgtacctgtcagcatctcaaatattgttataccaagagagtatatatcacttctcgcatcagaatatccacctcttgcctgctcaggtgaaatataatgaaccgaacccattgttgatgacgaattaattgtacttgatgaagcaaccttggcaattccaaagtccgttaccttaaccttgccttccttagatataataatgttctgtggcttaatatccctgtggacaatattatgcttatgtgctgcatcaagtccgttagcaacctgaattgcaatgcttacagcttctttaaaaggtattttgccacgcttttctatgtatttcttaagagttataccctctacaagctccattacaatataatatactccgttctcatcaccgacatcatatacattaactacattaggatgtgtaaatcctgctacagactgtgcctccgccctgaacttagatacaaatgtcttgtcttcactaaactcagacttcattaccttaatagcaacatatctgttgagtttatggcactttgctttgtaaacatctgacattccgcctgtgccaatctgctcgattatctcgtatctgtcagctaaaaacattccttttcttaacataacctatccctttcacttacagttctacaattataactgaaatattatccttaccgccattctcattcgctctgtcaataagcattctcgctgcatcttctatatcggcattgttccttacaatgcttaatatctctgcatcttcaagcatattagtaagaccatcagaacacataagaaccttactgttttctttaagatcaattgaaaacatctctggttcgacttgttcctctactccgattgcccttgttatgacattctttctggcatgtgttcttgcctcgcttttacttaactgtcctgcaagaaccatctcttcaacaagtgaatgatctcttgttatctgagttatgtcattgtcatctattacatataatctgctgtctcctacattagcaactcttaatacattatcaaatatggttgcaataacaagcgttgttcccataccatagtaatcctctgattcagatgccttctgtaaaagcagaccattaaccatcttaaccgaatcattaataatggatatcgcatcttttccctgtgactgttcaataagagttttaatagtttcaactgtaaaacgtgaagctatatcaccagctttatgaccgcccattccatctgctacaataaacagattaggcaagcatccaaccctgtcaacagatgtatatatataatcctgattaacggcacgcgtcttgcctatatcagtaatcgccgttgctttcatcaacatcctccatatacttattccttaactgtccacaggcaccatcaatatctctgcccatttcccttctaattgtaacatttattccgttcttttcaagtttatttttaaatgcgtacacttcatccttaccagtctgcttataatcacgctccttgataggattaacaggtataagattaatatggcagttcatgtccttaacaagttcaatcaactgctttgcacattccattgaatcattgacacctttaacaagactgtattcaaatgagattcttctgcctgtacattctatgtaatacctgcatacatccattatctcctcaattgaatacttattagctataggcatcattgtttttcttagttcatcattaggcgcatgaagtgaaatagcaagtgtaatctgtaacttaaggtcagcaagttcctttaacttaggtactattccacatgatgatacagtaatatttcgctggcttatattaagccccctctcatcattgagaagttctataaacttaataagattatcatagttatccattggctctccagaacccataactacaacattgcttactcgctcccctgtaatcttctgtattctgtatatctggtcaagcatttcagatggtcttaaatccctgactttgccgttaagtgtagatgcacagaaacggcatcccatacggcatccaacctgtgaagatatacatactgaattaccatgatgatatttcatgagtacactttcaacataattaccatccgataatctgaacagatatttttctgttccgtcaagctttgaatgctgtaccctgacaggctctaagcatacatattctgatgtttcctttaacttctgtcttaatgcattagaaaggttggtacattcatcaaagctgtctgccagcttttcatgcatccactgatatagctgcgaagccctgaacttcttttcaccaagtccagccatatatgttacaagttcgtcataattaagtgacttaatatctgtcatgtctattctctcctaagttttgcaacaaagaacccatctgttccgccattctttcccggcagaatctgtctgtattctatcttcttaaagccatattctttacataaccagtcagcattggcttcattctcttctgaattaattgtacatgtactgtacatcattataccaccctgcttaacatatgcctgtacaacagaaagtatgctctgctgaagctcttttaatgaaacaagcttgtcctctgttatattatatctgatatcaggctttcttcccataacaccgagtcctgagcatggaaggtctgctataacaacatctgccttctctctcatagattcatccattacgagtgcatcttttacctgaacttctatattattaagtcctagccttgatatattttcttcaataagtcctgccttataatctgatacatcccttgaatatactttaccatcagtgccaacacttattgcagcattaacactcttgcctcctggtgctgcgcacacatcaattactgtgtccccagccttaaatccagtcatatatcctgctgtcatggagcttatatcctgtatctggtacagaccatccctgaaactcttaagtcctgctatataatcatagtccttaatctctaaagcatatggtataccttcaacatctgccacagatacattttcctgtgaaagaatcctctttatctcttcaactggtgcctttgctgtattacatcttacataagtctttttttcctgcttaaagcctgcaagaattttctcagtcttatcaatacctaactgactatgccacattttaactatccataatggcattgagtattttacagaaaggtactgttcaatatccttattcctgtcaggatatgtaatattgtctttatttcttgcaatgtttcttaagactccgttcacaaagcccttaagtcctgtgaatccacgttttgtagccagctttacagcctcattgcacactgctgaatccggaatattatccatatatattatctggtatacagacatttcacatatatttcttataagtggtttcatctttcttacaggagtctttgaaaactggtctattatatagtcaagttcaattctgttctcaatcgttcctagtgataatctgcttataaatgctctcttattcttatcaagatactggtactttgtcagtgcattattaatgagaaggtgtgaaaattcacccttctcattgatttccataagtatatccagtacaactgcccttaaattcaccgaatcagtcacggcgtcttcctccaaataaataaatcagtcttaaaagctgtaaaattgctgtggctgctgccgcaacatatgtcatggctgctgctgaaagcacttttcttgcctgtctgttctcatctccatataggaatccttctgattcaagaagctgtaatgctcttgccgaagcattaaactcaaccggtaatgttacaagctggaaaagtactgccagactgaacataagaataccaatatctataagtatattagttgagccaaatataagtccaagcacaataagtatccatgatacctgcgaaccgacactggctaacggaaaaagtgctgttctgaagcttaaaggaccatatccgtaagcatgctgtattgcatgtcctgtttcatgggctgcaactccgatagcagcaacagatgttgaattataaacagaatctgacaggttaagtgtcttatttcttggattataattatctgtcaggcttcctgatactctctgaatagatacatcgtatattccctggcttcttaaaagctgctctgcgaccattgcgcctgtcattccttttgaagatgacaccctggaatacttgttaaatgtgctttttacctttacctgtgctatcagtgcaataacgcatgatattattatcagaatgtacattggatcatagtaatatccatatccataataaccatataaagctaccataatacctcttttctgaaccatttaagattctgcttattctcctaacattacacctgcttctaactggttgcctcttaagaacgaaccgctgtccattctcttcttaccttctaactgaacctcattaacaactaaatacccctgtccacaggctattgtaaatgtgttctttcctaccgtaacaacctgtcccggcttaacttcttctgtctgtacttcactgatattatctgcaacatctgcatcccatatctttaacattttaccgtctatataagtaaatgcactaggccatggattaagtcctcttataagtctttcaagttcagctgcactcttattgaaatccatcttaccaaatgacttatgaagcatttttacataagtgctttctgaatcatcctgcttaacaggagtaatagttccagcttcaagtccttcaagtgtcttaaccaaaagatgcgcaccgacatcacttaatctgtcaaaaagacttccgcccgtctctttagcatcaagcttcaccttctcaaccatcaggatatctcctgtatcaaggccttcatccatcttcatggttgtaacacctgaatactcacagccatcaataactgcccactggattggcgatgcacctctgtacttaggaagaagtgatgcatgaacattgatacagccgtatcttggcatgttaataatacttgccggcagtaactgtccaaatgcaacgacaacaattacatctgcattatatgttcttaattcttctacaaatgcttcatctcttgctctctccggctgtaacactgtgattccatgcgccacagcttcctccttaactggagagaaaacaagtgatttgcttcttccccttggcttatcaggctgtgtaacaactgctgccacatcatgtcctgcttcgattattgctttaagtgtccctacagcaaaatcgggtgtacccataaatactactcgcattctgttccccttttcattaattattcttcttcaatgtcatctgtagatagaagttctccttctactttatcaacatacattataccatcaagatggtcaatctcatgaagaaggcatcttgcaagaagctcctctccttctactataatctcttccatattctcattaagagccttaaccttggcataattaggtcttgtaacctcacctgtctttccaggtacacttaggcatccttcaagccctgtctgacttcctcttgtctctaatacaacaggattgataagaacaataggatcatctccacagtcaataacaacaagtctctttctgattccaacctgaggtgctgcaagacctacaccgttagcttcatacattgtatcaaacatatcatcaataagctcttcaattcttggtgtcatctctgtaatctcttttgccttggctcttagtatatcatctccaagtgttctaatatttcttattgccatatattcctcctcgcaatcatccattaatatcgtattgtacattaatattcttaaaagcctgatttccaacaatattaacatcaagcttttcatgtatactgttaagaacttccctgtctttatgttttacatagattatcttactatacacatctttaatcttatatataggtgcatctgccggacctatacacataagtcctttatacttacagttgttatccacaaatgctttaacccacgctgcactctttgtcaataacatctcatctggtgaagataacataatcttcataagattatccgccggcggatatccacacagctttctgtaagcaatttcctgctcatagaaagcattataatcctgattagccgcactaacaatactaaaatgctccggcgtataagtctgtataactacattgccgcttttttctgctcttcctgcccttccagccgcctgtgtaagaagctggaaagttctctcagaagccctgtaatcactggaataaagtgacatatctgccgcaagcactcccataagcgttacatttggaaaatcatgtcctttaacaatcatctgagttccaataagaatatccgcattaccattggcgaattccgacagaatcttttcatgtccatccttgcctcttgtagtgtccatatccattcttagcactcttgcctgtggaaatgttttcttaacctgtgcttcaacaccttctgttcctgccctgaagcccgaaacatatcttgaaccgcatgaaggacatacagttatcttaggtgttgtatatccgcagtaatgacacatcagccttccatcagcatgctccgtaagtgaaacatcacagtgcgggcatttcataacctttccgcatgaacggcatgatataaagccagccacgcctctcttattaaggaaaagcattatctgctcatgctttgcaagtctgtcactcatcagttctcttaatctgttgctgaatatcgtcctgtttccaagccttaattcttctctcagatcaacaatatcaactgctggaagtcctccgcttcccgccctgctgtcaagtgtaataagctgtatatgtccattcattgccgcatagtagctttccattgaaggagtcgcagaaccaagtatcactgaagcgcctgcttcctttgcaatatggcatgcaacctctcttgcatgatatcttggaacagtctctgacttataagctccttcatgctcttcatctattactataaggcctatatttgaaaatggtgtgaacaacgccgaacgcggtccaatcattacacttatatcacctctctgtgcccgcagaaactggtcataccgctctccctttgacatacgggaattcataatagataccttatccccgaatctgtggtaaaacctctgcacagtctgaaatgtaagtgcaatctccggtataagcacaattgcctgtcttccatgattaaggacatgctcaattgtctcaagatacacctcagtctttccgctccctgtaacaccatgaagcagatatgtcttataatcaccattatcatagtcagctattattgtatccacagcgtttttttgctgcttgttaagttcgatacgctttctttctccggtaacatttcttacaggattcctatacatatcttctgacctgacttcggcaatccccatatcttcaaacgccttgaccgtctgtgccgtgatattaagcttggatttaataatactttcatctattacaggttccttaatcagtgcctctaacaatctgtatcttgcttttgcatttttctttgcaaatgtatcaagatacttctgcgcctgtgccgcgtcaataataagattaaccgagtgtttttccttctgtttaaccttatcctttacaggaataaccgtcttaattgcctgattcatggtacaaccataattgtgcttcagccacgccgcaagctttaacattctgcttactgcagtgacctttccctcagtaattcctgtaatatattttatcttttcaacaggatatgcagccttgtctcccaaacctacaacataccctgttatctgcctgtttcctgctccaaaaggaatatcaactgacattcccagttcaattacatccaccaattcatccggaactgcatactggaatgtcttatcaagctgttcatgtgaaatgtctattattacatctgcgtacattaattacccttcaattcttcaagcacttctttgataagcaccctctcatccataggatacttcacacccttaatctcctgataatcctcatgacctttacccgcaagaacaataatatcacccggttcgccatgttctatcgcatacttaatagcttcttttctgtctgtaatatcaacatgctttccggtagtcttagcaattccagtcttgatatcttctataattgcctccggctcttcaaatcttggattatctgatgtgataatagtaaggtcagcaagttttcctgaaacctcgcccatctcatatcttctttccttggagcggttaccaccacatccaaacaggcatacaagtctgtgagggtgatattccttaagagttgtaagtatactctctaaagccattgcattatgagcataatctatcattaatgtaaaatcatccgaaacctttacaagctcaattcttcccttaaccctaacatgcttaagagtttccttaagtgcctcttcgtcaacatcgaaatgccttgtaattgctattgcacataatgaattgtatacagaaaacttacccggaagattaagttcaaccttcatattaacaagtcctgtacagtcatatgtaagaccaattttacccggttcatgtaaaagttcaatattttcagccttaatatcagcattatctccgataccatagctttcaaccttacatatagctcccctaaggatatcctgggtatgcttatcatcagcattaacgataccaaccttgcactgcttgaataactttgccttacagttaaggtaatcctcaaatgactcatgctcattaggtccgatatggtcgggctcaagattagtaaacactcctatatcgaacataatacctgctgttctgtcaagcttaagtccctgcgaagacacctccataacaactgccttacagccagcgtctaccatctttgcaaatgactggtgaatctctattgattcaggtgttgtattatgtgccggaatcgcttcatccccgataatagtctcaattgttccaataagtccagtcttaatgccgcatgcctcaagcacatttttaaccatataagtggttgttgtctttcccttagttcctgttattcctattgtaaacagcttcttatcaggattgccatatattgctgccgacataagtgcaagcgcaagccttgtgttatccgtgctaacaactgctgccttgcaatccttagcttcgtactcgccatcaagaacaacaattacagatgccttatccttaatctggtcaatatatttatgtccatcactcacagcacccttaatgcatacaaatgcatatccatcctgcatttttcttgaatcagatgtaattcctgtcacttgcgactcagtactgccgcatacaacactgtacctgaaatctgcagtttcattttctgaacatatttttaatatctctgaaagcttcatacattagtctccttattttatagtatatattacttacattactgctgctttagaagtgtttcaaactcttccattgtcatctcaacctttcttggtttagttccaagctccggtcctactacctttgcaccagcaagctggtccataattcgtcctgccctgttaaagccaatcttaaaatgtctctgcagacttcctattgagcctttttcattctcaataacgaatcttcctgcatcagcaaaaagtgaatctctctcatcatcgcctttactgctgccaggcatgctctcctgacttacagtagcctgtgcaatactctcatcataagatacttcctctgcattctccttaaggaaagatacaacattttcaacctcttcatcagatacgaatgcgccctgaacacgcagcggctttggaagattagatgggaagtagagcatatctccctttccaagcagcttctcagcaccattcatatcaatgataactcttgaatcaattcccgaagatactgcaaatgctatcttagacggaatatttgccttgataagtcctgttactacattaacagaaggtctctgcgttgctataaccatatgtattccagccgctctagcaagctgagccagacggcatattgcatcttcgacctcacccggtgcaaccatcataaggtcagcaagctcatctatgataatgacaatctgtggaagcttctccattggagggtctatgccctccttattcttcttgacaacaacatcattatatccctttatattacgaacctgcattgccgcgaacttcttatatctgtctgtcatctcattaacagcccagttaagcgcccctgcagccttcttaggatccgttacaaccggtaataacagatgtggtattccattatatacacttagctcaacaaccttagggtcaaccattataagtcttacatcttctggctttgccttataaagaatactcataataattgtgttgatacatactgatttgcctgaacctgttgctccggcaataagcatatgcggcatcttcgcaatatccgcaataatagtctttcctgcaatatccttaccaactccgaacgatattgctgactggctttccttgaattccttagactcaaccagttccctgaaatatacacttccagcttccttattaggaacttcaatacctatagctgccttgcccggaattggtgcttcaattcttatgtcggcggctgccagattaagcttgatatcatctgataaagaaacaatcttgcttaccttgacaccctgttccggctgtaactcatatcttgtaactgtaggtccgcagcttatatcagttatagtaactttaacaccgaaagtaagcagtgtctcctgtaacctctgtgcagttactctgtattcagactttccaccagacgctgcacctggatttctctttaataagcttaccggtgggaacttgtatgctttcttaggtttattcacaggcttgacctgtacttcagtcttctgctcatcacttaactgttcactgccctgctgcccattattctggttcacactattttctctgtattcttcattagtcacatcattttcatatatattatcattatctgatacataatcattatcatatgatgcagtattatcctctggcatgtttccggccacttcatcatcaaccatataatcatctggctgtatctgctgcatatgagactcatagtcagcatacactggctcatcagccacatttcctgctgcacctgcattactatcgcaatcataagcaagctcaaatgcatcttcatcaggctcatagatatcctgtgtatactggtcattacgttcagtatcaacatgaatttcatgtatatcaatatcctgtgccagttcttcatccgttcctgttataagagtatcagatgttactccacggacaacattattcatacgtgcattggcaagatattcttctcttgccttcttttctgcaagctgcttttctttcttttcaatcttcttaagccttgccttggcacgctcttcttcccttaacctgcggtattcatcatcagacatgtcattctgtctgcctgctgaatgttctttgtatgctgaataatcctctcttgcttcctgcataatgcgctggctgccgtttccaaccttcttaagcccggatataaaagacctctccgtaattataaccagacatattattgcaagtatcataagtattacgaatgttccaattgaacctatagggctaagtaccttgcatagcaatccgccaaaaaatccacccccggctttataatcagcacaatatgtaaatatacttcctaatccattatctgcaatatccggtttattatataaacactgaatcattgcacataatacaacaaacaatccatatcctgctgccgtcttaattctcgcgacacgaagcagttctctgtttaccataagaaagattatgcttactgcaagaattacaggaaatatgtattccataactccaaataagccaaacataagccatttaattcctcttcccaatgttcctgcaatattaaaattacttaataccattattattgcacaggcaattgaaaaaagaataatacaatcattcttcaactggtcagcctgtgtctggacatttttcttagtctgtttctttctcccctgagcagtcgtctttttcccttgagtattagtttttctgctttgactggtattctttctaccattattgctggctgtttttgccataaaccttcactccttcatatattcatcacgcatcatgatattataccatttatctaatctcaaggcaaataaatgtgcattcttcaaaacacagaaaaagcggaatacacacataactgtgcatatcccgcctgtcatacatatgtatttaattactcatcaaatatacttacaatctcgccttccataatcttgttcatattctttactgcacagaaattaccacacatagaacatgtatcttccttctcaggcttagatgaagctctgtaagctcttgccttctcagggtcaatcgcaacgtcaaacattgcttcccagtcaagaacctttcttgccttgtccatcttataatcccagtccattgcacccggtacgccctttgcaatatcagccgcatgtgctgcaatcttagaagcaataattccttccttaacatcattaagatctggtaatcttaaatgttctgcaggtgttacatagcacaggaatgaagctccgtaagtagctgcgatagctccaccaattgctgctgtaatgtgatcatatcctggagctatatcagtaacaagaggtcctaatacatagaaaggtgctcccttgcatattgtctgctgaatctccatattagccttaatctggttaagaggcatatgtcctggtccttcaaccataacctggacatccttctcccatgctcttcttgtaagctcgccaagtgtaacaagttcttcaatctgtgagatatctgatgcatccataatacatcccggtctgcacgcatctccaagactcattgtaacatcatattctcggcatatctcaagcactctgtcataatattcaaagaatggattctcatttcctgtcatctccatccatgcatatatgatagaaccgcctcttgatacaatattcataagtctcttatctgctctgaacttcttagctgtagccttgttgataccacagtgtatagtcatgaaatcaacgccgtctttagcatgcatttctacaacatcaagccactcctgtgcagtgatatccttaagtgccttatgataatatacaactgcatcatatataggaactgttccaattgttgccggacattctgatgtcagctttcttctgaacttctgtgtatctccgaaagaagaaagatccatgatagcttccgcacccatctttacagcgttattaaccttgtcaagctccatatcaagatccacgcagtctcttgaagttccaagattaacattaatcttagttcttaacttatttccgataccattagggtcaagacatttatgattcttattggcaggaatgataacctgtcccttagctataagctgtcttaaactctcgacatctatattttctttctttgcaacaatttccatttctttagtaacaatgccttttcttgcagcatccatctgtgttgcgtattccatatgtattcctccattctgggtaattaacaggaaaaatcataagccttgtggaaattcgatattgaaacaatcaaatgaagagctaaaagccctctaaagaatccctacggtggcattatccacatcaggttatgggtcggaacttaatccctctcagcagccactgcttacacagcccttatgctcccctgcaaatataatatgtgataagtataacaaatgtgttgtatttgtcaatcattcttattctcatcttgactctgttcgcagctcatacgcacagacagccgcacataagtgcggctgtccattgctgtttattaatcttcatcatcagaagctgcttctgcaaagccctgacgctttcttgccatctcatcgcttgcaagatactcatcgtatgttgttatcttatcaataagctgtccgcttggaacaatttccataatacggttagcagttgtctggatgaactggtgatcgtgtgatgtaaataatgtaacaccagggaacttaataagtccattattaagagctgtgattgactccatatcaaggtggttagtaggatcatcaaatattaatacattagctccacatatcatcatcttagaaataagacatcttaccttctctcctcctgataacaccttaaccttcttaacaccgtcatctccggcaaaaagcattcttccaaggaatcctcttacataagtaggatccggatctggtgaatactgtgtaagccattcaacgatagtatcttctctgttaaactctgcagcactgtccttagggaaataagcctgtgaagttgtaacaccccatttgtagcttccctcatcaggttccatgttgcctgtaataatattgaaaagagtagttgttgcaagctcattagaaccaacaaatgctatcttatcatcatggtttacgataaatgatacattatcaagtaccttaacaccatcaatagtcttagaaattccttctactgtaagtacttcattaccaatctctcttgctggtctgaaatcaatatatggatactttctgcttgatggcttaatctcgtctaattcaatcttctcaagagctctctttcttgaagtagcctgcttagacttagaagcattggcagagaatctctggataaagtcctgtaattccttaatcttttcttccttcttcttattagcttccttcatctgcttgataatgagctgacttgactcataccagaaatcataattacctgcatagagctgaatcttcgcataatcaatatctgcaatctgtgtacatactttattaaggaaatatctgtcatgcgatacaacaataacagtattctcaaaattaataaggaattcttctaaccatgcaatcgcatcaagatcaaggtggttagtaggctcatctaaaagcagaatatcaggattaccaaataaagcctttgcaagaagaactttcaccttctcactaccgttaagctcagccattgtcttataatgaagatctgttccaattccaagtccgttaagaagctgtgcagcatctgattcagcctcccagccattcatatctgcaaactcagcctcaagctcacttgccttgttaccatcttcctctgtaaaatcttccttggcatatatagcttctttctctttcataatctggtaaagtctgtcattacccatgattactgtatcaagaacattatattcatcatacttgaagtgatcctgctctaagaaagataatctctgacccggtgtgattgaaacatcgcccttgctaggttctatctgtcctgtaagaatttttaaaaatgttgactttccggcaccattcgcaccaataagtccataacagttaccttctgtgaacttaatgttaacatcttcaaaaagagccttcttaccgattctaagtgttacgttgttagcactaatcattaataatctcctccaaaaaatacgcataacagataataatctattataaaaataatcatacaaagttgattatagagattctggcacataaatgcaagcaaatattaataaaaagctatcctgctgacctcaggaccagtaatccatctgtacctttccggtatgaccgtaccattctgaatcattgcgactatgtttatatatcccttttctttaaggctccgtaagatatccatataataaagtacattaatatccgtcatataactttctgacataacaataagcacattcttatattctcctataaaagcctcttcctcctctcttgaaaaaccgttcatatcctttcgcataatactccagaaatcttccagacagttacccattgacaagaaataacgttcaaatctgatacattctgtatctttcttgccaaacaaattaaatactaacattgtcccccaatcatgattattattccgactcgcttattatatcagattgccatatttctgtgttatatatgtcgtcttctgtcgttttttcgttataacctgtaacttttccgtcacatttagatttactttttacagtatatagtttagtcctatattgcatatatcatgaggctgtacaatacatttgttcttatatactttcaagatacatcaaaaaggagattcccgttttcacagaaatctccccatcttaatatataattattcagaattacttattagtctcttctataaatctttcaagctgcttcttagctaatccgctcttaataatttctcttgccttctcaacaccttccttcattgtaataccatctgaagcaagatatatagcagcacctgcattaagaagtacaacatctgtcttaggcccttctgcaccatcaagaatatctcttgcaatcttggcattaactgccggctcaccgcctacaagatcttccttcttgcatcttgtaaatccaaaatcctctggttttatagtatatgatttgaactcatcacctttgaactcgcagacctttgtatcagcacttaaagatatttcatctatactgtccattccatatattgtcatggctcttttgcagcctaaattatgtaatacatgagcaagtggctcaacaagctcctcactatacactccaaaaagctgcatagaagctcctgccggattagccagcggtccaagtatgttgaataatgtacggattcctatttcctttctcacacctccaacaaatctcatagccggatgatacttctgtgcaaacagaaaacatatattaatatccttaagaatctgtgccatccttgccggagctgcatctatcttaactccaagagcctctaaacagtctgctgtaccacatttgcttgaagctgctctgttaccatgctttgcaactggaattccagctgctgatactatgatagaagctaaagttgatatattaattgaattagaaccatctccgcctgttccaacgatttcaagaacatccatatcatttaagaacttctcacagtgtgctcttaaaactctggctgctgctgtaatctcgtcaatagtctctccctttgctgccagagctgtaagaaacgctgccttctgtgcatcagtggcttctcctgtcataatctcttccattacatcattcatctgcccagctgttaaatcttcctttttaacgagctttgcaatagcttctttaatcatattaccttagcctcctataaacatatctaaatgatagctttagtgtattactataacgccgtactgtcaatccataacagcttgcaaaggttatctgtctcaaacacatcatcaaaaagaaaagactcataaagtgcttccatattatcctctgagtactctacctgtcttgaaaaaatatgcactgtatctattctatcttcaaatgtaaacctcttatgctttctgtaccatacaagcatgtccatctgacggagtataagataattagtaacaaacattttagctttaccaaccacatcataatcatatacagccttggcaaaataccggaacacaagatatgttataaagttcctgtactcatactctctttcaagcattgctgtcatgaattcttctttggtctcctgatactgctcattatccatattctcatggaaagtctctgtcatctcagctaatatctgttcccagcgtgtattaagcacctccatatcctcatacggatacataatgtttcttatacattcccaaacatcaacatcatcaaattcatcgctttctgattcatcattcatttccataagaatatgttctatatcacttcttccaaatgtattgacatactccttaagtgcgtcatactcatcattattaatatattcctgtattgatgcacaatattttaatattacaaccagcttctcattaattgacatctccggcatatcaaggatcttaaatatttcatctcttgccttaaatatcctgacagcgtaagcactgtcgtactcatcatcctctgaatattcctcatcacacggctttaatacagttgtaaatgttttgttttcagaaaatataattctttccgcttcctcacatgcaagcccgataccgctttctttgatttctccataatattcagaatatcttgggaactggtcacacacaacagacaaatgctccgctccaagttctttatgaattgtacataatccacacttatctaacaaaccgcaatgtccatctacgagtttaaagcaattcgaaccatcttcacttttagtaattgattctcttatcctgtctccaagctcgccatcaagactcatataataattataagtatcatcatcaatatctatctcccagccgccaacacaacagttgtctttacattctgaagttatacagtggaactggtcataatagaatggaactctgagtttcataatccttatcttctccttagtctgtaacgatatcagcaatctgatatcttataactttatctacatcagacagcttaacttctacctgatgtccgattttaccggcactaaacattatagtttcaaaatcctcagcagtcttatgaaatgttgtcggaaagaacttcttcattcctataggcgaacagcccccatgcacatatcctgtaaggggcagtaattcttttgatttaatcatctctattgatttctctccaacagccttcgctgctttcttcaaatccagttccttattaacaggaacaacaaatacataattcttacctgtcttgccaactgtaacaagtgtcttgaaagcctgttccggattctcattaagaacagcagctatttcatctccgcttaacccttctgcatctggacacacatgtgtcttataagatacttttttctggtcaagcactctgcatacattagtcttatcatctgattttcccataattacattcctcttgcaattctatatctgtctcattctctcaagtcgttcatgaagcttttttatatgtttcatctcagcttcactctccatttttctatccgaataataatattctactgtgcctcttttccctttatcttcctctttaaatattccttttttcacaacagtattcttaagattattagatacacccgtatttccatcaaccatctctaaatcatccggaaacagctttgaaaatgaatccttaaaatagttaaaatgtgtacaccctagcacaagttcagaataatcattaagattgtatggagcaaattcagattttaaataatcagtaacatctgaagagtcaaaatcatcatcctgtgcaaatcttacaagcttaggaagtgccacaacgtcaacgatatgcttattatcatatttatctacaagtttctttaacttctcaccttttgccgtgacaggagttgatacaaccataactctttttcctgattcatgaatgtgctcaactgccggttttacagctggctctattccaattattggcagcttatacttttctcgtagatatgagattgctgcacttgttgcagtattgcaggcaagcacaattgcctgacatcccttatcaacaagaaatccaacagcatggtcgacaagctttcttacttcttcttttgttttctccccatatggaacattatccacatcagcataaaatatgtaatccgcctctggcatgataatcattgcctgatgaagcactgaaagaccacctatgcctgagtcaaatattcctatcttcatattaccataaacctctatattctaatcattatatactttacaataaacgatcattttatcctttaatatcttaaccctgctaggtcttatctctccagcaaatatcttatctgcgaaacctgtaaacagatacttctgtaacagcaccttaagctgcttgttaccagatcttcttatagctgataccatccatacagctacaaaacacaacggccatacccacacaggaatatactgcataattgtaagtgcatatcttcctgcaagcgcaaaccctattgcacagaatataacaacatataccacagcccatatataagcctttacccagccgacagcaccaagcaccttaagtctgttagttatctttctgtaattctctgattcctctgctgttattgacagttctattatctccataaacaagtcatacctttcttagcatttaataataattataagccctcatgtcaaagtattcaagatactttcacttctccattttcatcatatcttataaaagctttccccgcatacgctgaaaatcaattcaccgcatacggggaaagcccttttactgatttcttctaaacagactgattaatagtcactcagaacatcttccacatgcttaatagaaatctctaaaaaattggatatttcataatctggaacaccattatcatgaagtatgaatataagctcttccatactcgttcccttacggcgttccatcataataaaatgtttaacctgagtctcgtccataccacacctcacatatcacacattattaaattattccgtatcgaaacttttcaacattatatcagatacatttctgattagtcaatagaatagccttacttactgattgttctttccaataatcttctttaacatatgtaccctgttaaacggaaatgaaaaataatacccatcaacaaaatctgtagtctttgcaattatttcccttgctatctgaataccagtctcttctccctcttcttttgacatatcagctctgtatcttgaaagaatctcatccgtaacattaatacctgtcatctcatttttcatgaatgttgcatttcgaagacttacaaatggcattattccacaaagaatccttgcccctgtctgttctttaatctgtctgagtctgtctatatcttcatcagaaaatacaggctgcgtcataaaaaatgtggctcccgcctccatttttttcttaacacgctcaagttccactttaaaattaacccttccctgattaattgctccaccatatataaccggttccccggcaaactgttcctgattcatatcacttattatattcataagtccaactgaatcgaagttaaacacactctttacagacgctcttacaactgatggtatgggatcaccggtaataacgagaaaattattaatatcatttatatgtgctcccaaaagctgtgaacgcattgctatagcattcttgtcacgacagcatatgtgcggcataacacacattcccgtttctctcgaaaccttttctgccataagtattgaatctgcacgtgttcttcctgatggtgaatccggaaatgtaagcacatcaactccgctttccttcatcaaaaaagcagcatccataatcttctcatcatctattccaagcggaggcgcaagttctacagcaatcagttttcttccttcttttcctttatagaaagaaacatcatttgcagttttcttttctgttatctcttcttctatggaagcatttttcttatgaacaacatcagcagtttttaaaaccatctgtcttatatattcaggtgttgttccacaacagccgccaataatatcagctccatcctcagccagatcatgcataatctgtgaaaaatatgctgcattgttatcatcaaataccattcgaccgcttacaacctgtggatatcctgcatttggaagcaccgcaaaatacttgtcattcctgttaataaggctctgcacaagcttcttcatatgtcccggaccaactccgcagttaaatccacatgcatcaatatatgaatttttctcagcttcttcaatcagctttcttgcactaaagcctgcactgctatagccaaactgattgattgcaaactgagttataacaaatccgttttctcctgcattttcaattgctttatcaataaatcccagttctggaaatgtttcaaaaacaaatatatcaacgccacattccttaaaaacattaactatatcaacatactctttttcaatatgctctttttcaatcatattttcaccaggaataggaccaatatcagctgctacaagcacatctgtcccctttacggcttcccttgcaatgtcaacggcatttttaatattatttcttacctcatcaaatcccgctccaagacacacggtattacttgcaaatgtattagttctgataatcttagcaccagcttcaatatattctttatgaattgccagtactctgtctgaagcctgtaaatttgccagctcaggcaggctgcccgtatcatacttcttagcatagtatgttccaaacgcaccatctgccaccagtatttcactctttaatctgtcatataatattcctgctgttcctgtatacttcatgcctaatccccttatctttaacattcaacttaaaaaaggagccaccttaatataagtgactccaaaattgtatcattattaagtttaatttgcactaaaaattaaaggaaaatatacttcaatatgaacagcaatgcaagcacgtacataagtggagtaatcttcttagcctttccagcaacaagattaacaataacatacgaaataacaccaactgcaataccttctgaaatgctgtacataagcggcatacagataaggcagaggtaagctggtatactctctgttaaatcattaaaatcaatttctacaaccgcactaaccataaggaatcctacaaaaataagtgccggagctgttgcaaatccaggaattgtagtaaatacaggtgcaaatataattgcaataaggaataagaaacctgttacaactgaagaaagtcctgttcttccgccttctgcaacacctgatgaactctcaacaaatgttgttgttgtagaagtaccaaggatggctcctgcacttgttgcgatagcatcagctaaaagagcctgcttaattctaggaagtcttccgttctcatcaagcattttagccttattggcaacaccgataagtgttccaagcgtatcaaacatgtcaacaaaaaggaatgagcacataataacaataaaatctaatatattaatattaagacccttaaggttaaagcactgtccaaatgtctggctgatagctgtgatatcaaagcttctccatgaaggaataagtgaatagaatcctgctgccgcatcaaccttataaagtcctgtaagctggcagataataccaagcacccatgttgcaacgataccgataaggatagaacccttaacatgctttacataaagaatagctatgataaatgtaccgataactgcaagtaaagcacctattcctactgtgttaaaattagttctgaaattaacaacagtaacctttgttgactcacttgcaacaactaggttagcaccctgaagtccgataaatgccacaaaaagaccgatacctactgatacacccttctttaatgttgtaggaattgcgttaaatatagcttcacgaacattagtaagtgaaagcacaataaatacaagtccttcaacaaatacagcaaaaagtgctactttccagctatatcccatgcttccgcatactgtatacgcaaaatatgcgttaagtccaagtcctggagcaagcgcaaaaggataattagcaagaaaagccattgcaaaacaacctatagcagatgctattgcagtcgccataagaattgcattagaatccattcctgatgctgacaggatagatggattaacagccagaatataagccattgtcataaatgttgtaattccagctacaacctcagttcttacactggtgttgttttccttaagtttgaacaatttgtccatttcaacctccataattttataaatattaaaaatacttaataatattaacatattcttctcaattttacgacgacttttttattagacatatatcttttctaataaaatctcccactaaaagggggaagcacattcaatagcaaaatagtactatatcattgtactttagttacacacctgtgaattggacgtgaacacaggttttgggatacatccatttatgaaaaacatgaataaagccatatatgcagttgggagacctgcatatatggctttattttatttcttatctactaattctgttgtacagaaaggacatcttgttgccttaacagatatcttgctgaagcagtatggacaatcctttgtagttggagccggttcttctttcttcttacctaagctcatcatcttgttcattgctttaactaaaaggaacagaacaaatgccataataaggaagttaataactgctgttatgaatgaaccataatcaaacacaactcctcttattgtaaatgtaccaccaacagtaacgccttctccattagtgccacctgtaaccactgcaataagcggattaataaaactgcttgtaagtgctgttacaatgctctgaaatgcagcaccgataataacaccgactgccagattcataacatttcctttcaaagcaaattctttaaattcgtgaatgaattttttcattgtgttctcctcccgtatattattgattaatctttggaacaattataatgtctttaattttccccttatatcctctaccgtttcaacaatataatctgctcctgctatctcaagctcctgttcttctgcaaaaccgtatcttactcccatagaatcaattccagaagctttagcacctaatatatcgtcttttctgtcgccaatcataatagactgtgactttgtttctgacaaactgccagtgtccgcaagtccggcagcagcaagccttacaaacacttcatcaataacctggttcttatgtctgcgttctccaccttctaattcacttccaacagcaacatcaaaatacttatcaacattaaaatactctaatattctcggaacatatatttcaggcttacatgtagcaagtgcaattatatatccatcactctttaatccttcaagcatatctgctatcccgtcaaaaagaacattttcatatattcccttgtcagaatatctttcacggtaataatcaactgcctttagtgctttttctttgtcaaatccataaaatttttcaaagctttcatcaagaggaggacctatgaatcttcgaagcatcgcctggtcattttcttctattccaaatttcttaagtgcatgctgcacacttttggtaattccctcgcttgaatctgtaattgttccatcaaggtcaaataatatatatctcttagtcatattttctccattatcacattaattcactgtaacttctgatattgtaatcggctatccgacaaatatccggccagtcatcagctgaagcctcatcatatacagccacaacagtaaagccaccgctcttggctccctgtgcagccgataatacatcttcaaacacaatacattcattcacactgcaccctgctttgccggctgctttcatatatacatccgggaatttctttcctctcggcacttcatttgtctgtgtaaatgcatcaaagaaaccatatattccgttacgtcttaagcatggctcaaaaagtgccctgtctgatgatgttgccgaaacaatcttaaggccattattatgcatttgttctataaaagttttcgcatacggctttaacaccaccttgtcagtgtatgctttacatgctgcatcataccattctttcatgatttcttctgtagattccggcagattatacttttccttagtatataccgaaccggattcaaatgtatgtgtcttaatctcctgcatatattccttagatacaggaattcctcttctgcccagaaaatccatgtcgaccttagcccatacctgtgttgaatcaagtatagttccatcaaggtcgaatatgatacaccggcagttactaagatctaacatggataactctcctccagatttatgtactacttatatgaaaatctcttctttacattaacgctgtattcatcagtatatttcttgatatattcagaatatttctggttaagaagtgttgacttaattgcgtcatcatctgaaccatcatatgatctgcttatgtaatatacaatatagaaacatgtattatcatcatcttcaataactgtaaggtcgccctcttttctgtctgaagaagcaatccagtcagcacatgcttcctcaatattgctcttcttagtctctgtaactaaggaagctgcatcatccgcataagtatcatcgcctgcttctgcaaatttcctgcactggttaatgaaatcaagttcactgcttacgcctgacgcaaaagaattagctgtttctttagcatttgccatatctgacgaatctgaactttcagccttaactttaaacattctatattcaaacttatcatatgtatccttattgtcctcgtaatatgcactcacttctgaatctgatgccgcaagagtttctgttaacttctcctgatatgctgtactcttaagataatcttttaagaattccttaactctcttttctgtagctctcttaccaaacatctgcttaagataatctgaatatgatgtatcagctttattagccgcatccttaagcttacctataaactcatcataatctgcatcttcattatcatatgtaaatccgttagcatctgcatcctctaataaagctttagtctctttaatagttgatactgcagaattagcaaagaaatcataccatgtataatcagttgaatattcctggctcttatctgactggcttctcttatatcccatataagatgaataataatcaccatatgtcatagaaccatataaagttgtgttaagactgttagtcttagctatgccgtaataaaaatcaaactcaatctggcttatcttatcattatccacttcaatataatctttataaatactgttcagcttaatgccggttgctattccacttccaagtattatgcatgcaagaactgctatacacacccatttggtaatatatcttctcttagcttcttttctttcttcttcttttcttttctgcatcttacggtcgtatttagtaacaaccttctctgatgctgcatttttgtttgccataatgtcctccctattcatatccattaatttctttaattctgtctaactgcttcatccactcatgtgaacttgcatcacttggcattcttaaatcacctcttggtgatactgcaactgaaccaaccttaggcccgtcaggcaggcatgaacgcttaaactgctgtgcaaagaatctccatgtaaatgtcctcagccacttatagatagtcttatcatcatattctcctgcaaatgcgtactttgctattctgaatatcttctcaggctctgcaccgaatcttaacatatggtacataaagaaatcgtgcagctcatatggtccaacaagatcttctgtcttctgtgcaatagtaccatcttccttaggcggaagcagttccggacttaccggagtgtcaagtacatcattaagtactgctgacaaatcatcattgccacatgtatccgcataaaaccgtaccagatgtcttacaagtgtcttaggaactgatgcattaactccatacatggacatatggtcgccattgtatgttgcccatccaagtgccagttctgacatatcgcctgttccaatcaccatgccgttagtctggttggcaatatccataagtatctgtgttctctctcttgcctgaccattctcgtaagtcacattgtgattattctcatcatgtccgatatcttcaaaatgctgtctaacagccttcatgatattgatttcacggagtgaacatccaagctgcttagtaagcttcacagcattgttatatgttctgtctgttgtgccaaagcatggcattgttatacaatgtatgccgcttctgtcaatcccgcacaggtcaaatgcccttacagttacaagaagtgccagtgtcgaatcaagtccacccgatattccgattaccgcatttttacaattggtatgttcaagtctcttcttaagtccgtaagactgtatattaagaatctcctcacatcttgaatctctctccttcttgtcagaaggtacgaaaggtgccttgtcaaaatatcttataagctctaagtctttatcaataagttcctgagccttcacttcagtatatgaactgttttctacaactgcatatgtactcattcttcttcgctcagagcatattctctggacatcaatatcagcatataccgactcatccgcaaacttatgcgcctctgcaagaacagtaccattctcacatataagattatgtgcagagaatacgatatcctgcgtagattctccaccacctgcgcttgagtacacatatccgcatacaagtcttgcagactggcctgaaacaagctgctttctgtaagtgtctttaccgattgtctcattgcttgccgatgcatttacaataatagttgcaccattcatagcatgctttatgcttggcggctgtggtgtccacagatcctcacatatctcaacgccaatcttaacttttctgttattatcaaatgtaaataataattcacttccaaagggaacctcttcaccatcaacatccacatatacacattcattaaatcccggcgtgaactgtcgtctttcatagaattctccataattaggaagatacattttcggaaccataccaagtatctgtccgttcataactcctgcaacaacattgtaaagcttcccgttcatttcatatggaattcctacaaagcttatcattccttttacattttcagaaaaatgttttatcgtaacaagcccttccaatgctgaatctaacaacctgtcatgcaaaaataaatcattacatgtataacctgttatgcacatttccggaaaaacagctattgcagtatccttcttatgagcctcaatcataagagccttaatattttctatattatactcacagtcagccactttaatcttcggagtcatggccgctgctcttatatatccgtctttcaatttgccctctctttcaatatatgtctttttgtcaaacattaaaattatatcagactgggtatatatttacaataaaggtcacaaaaaagtcacttttgattatattgtccataaacaagtgtcacgccgctttcctgctctttcggctcattacaccctgttaaagcagttatcatacttataataaccaccagagccaatagtctcgctgtcagctttttctttattccatcttctaacataaaaagacctccacttattcataaatctattatgaaccagtggaggtcttattatactttaaatgtgcttattcaattacggctgcactaacctttattactctgtgtccagctaagagcttattctcaatcttatagaatgcaactaccttaagaggcttgccatctttagaaacaaactcctgtacatagcttacatatctcttatctatgaacttttctcttaactctgttattacttcctcatactcaacgcttggtacgaactgcttaaatacaattcccgcctcaaaatcatcttctgtgtatccaagaagctctgtaaatccatcatcaatatcaataatcttaccgcttctcatctccatagaaaactgtgtaaaaggaattgctttcattacttctgccataattattctccttatccgtgaaaactacttagaaagtgttgcaagacgctcagttacctgctcaagcatctgtgtatattttaccagctttgccttctcttcgtcaatctttgcctgaggagcttttgatgtaaacctctcattgttaagcattccgttacatctcttgatttctccctgtaatctgccttcctctttcttaagtctctctatttccttgtcgatatcaacaagctctgcgaaaggaatatagataacagcatccggtataactgttgaaacagcatcatctggaattccagccttgtcagcctgaaccttaacctcgcttgcatatgcaagtgttccaaagaagccaagtgaattgttaaatatgttcttaacatcttcacttgctgtaacaacatatacaagtgccttacggctaggagcaacattcatatctgcacgtaagtttcttatattacggacagcttccttgattgtctcaatagccttctcctctgctgcgaaattatcagtttcatcatatacaggccatgaagaaatcatgattgactcttcctcatcctgaatattgcagaatatttcttctgtaatgaatggcatatatggatgaagcagcttaagtgcatctataagaacagtttttaatgtccagatagctgctgtctttgtctcgtctgcatcattgtaaagtcttggcttaaccatctcaatataccagtcacagaattcttcccagatgaagtcattaagcttggcaacagcgataccaagttcgtatttttccatattatctgtaacttctttgataagtccattcatcttagaaagaatccacttatcagcatctgttaagttagcaggtcttgcatctgtagcttttatcttattgtcagggtcattcatcataatgaatcttgaagcattccataccttattagcaaagttacggctagcctcaactcttgaccagtagaaacgcatatcattaccaggtgcatttcctgtgataagagtgtatcttaatgcatctgcaccatatttatcaataacctcaagcggatcaataccatttcctaatgacttactcatctttcttccctggtcatctcttacaaggccgtggaataataccttgccaaatggcttcttgcccatatgctcatatcctgagaatatcattctgattacccagaagaatataatatcatatcctgttacaagcacatctgtaggatagaagtagtcaagttcaggtgtcttatctggccagccaagtgttgagaatggccataatgctgatgagaaccaggtatcaagtgtatccggatcctgttcaacattagcacttccacacttagggcatgtacatacagtctctcttgaaaccgtcatctcaccacaatccttgcagtagtatgcaggaattctgtgtccccaccagagctgtcttgaaatacaccagtctctgatattgtctgtccagttataatatgtcttatccatagaagctggaataagctcaatatcaccattcttaacgccttcaacagcaggcttgataagctcgtccatcttaacgaaccactgctgcttaatcattggttcaacagttgtcttacatctgtcatgagtaccaacgttatgtgtatggtcttcaactctcactaaaagtccaagtgcatcaaggtctgcaaccatagcctttcttgcctcatatctgtccataccggcgtactttccaccaagattattgattgtagcatcatcatttaaaatgttaatctctggtaagttatgtctcttaccaacctcgaaatcgttagggtcatgtgcaggtgtaatcttaactacacctgtaccgaattccttatcaacataagggtctgcaataataggtattgttctgtctgtaagtggaagttcaacttcctttccaacaaggtctgtgtatctttcatcatccggattaacagctaaagctgaatctccaagtaatgtttctggtcttgttgttgcaatctcaacaaatcttcccggctcaccagctacagggtagttaatatgccagaaatgtcctgcctgctcctcatgctcaacttctgcatctgatatagaagtgttgcagaccggacaccagttaacaattcttgagcccttgtatataagtcctttctcatagagctttataaatacttcctgaacagccttagaacagccttcatccatagtgaatctttctctgtcccagtcgcatgaagaaccaatcttctttaactggcttgtgatagttccaccatattctttcttccattcccatgttctctttaagaagccctctcttccaagctcatgcttgtcaattccttcgtccttaagagcattagtaaccttaacctctgttgagattgaagcatggtcagttccaggaatccagagagcttcatagccctgcattctcttgaatctgataataatatcctgcatagtattatcaagtgcatgtcccatatgcagcttacctgtaatattaggtggtggcattacaatagtaaatggtttcttatctctgtttacttctgcatgaaaatacttcttttcaagccacttgtgatataatctgtcttcgatttcagacggattataattcttttccaattccttgctcattattaatctcctttttaatattgcattccgggttctttcccaattatgcgctcgctgctcatatgccagaatttcattctggcattgtcgcggcgctcctcgagaacccatacaaagttctcagttcgtgcaagcacgactgcgaactttccatgacttctctcatcgctgctcgcgcaaaaaagccctttgcagggcatatactctgcaaagggcgtaaataaacttattaacgcggtaccacctttgtttaattatcttgtgataatcctcattactccttaacgcggaatacgtcacagcctacttaaatcaacagttcagccatgcggctccaaagctaccttccatatcattattacctgaaccatcttccagccagtgaatgcttctctctgtcggataatgatatgtactcctctttttcaatgcctttaaatataaaattcttttctatcttaatatctgacagaaaaaaatgcaagcattttattcaggaacttcaatctgcttaatattaaactcattgccctgaataagatatgtgtgcttactgccacaattcggacagactttggcgtatttcacagtctcataagtttccccgcagtcctcacagtaagttatacccggaattatctcaacttccatctcacagtcctttacaagttcttctttcttgcaagcccacttccagcagtctgtaagatattcttctacaactcctgatacttcaccaagctcaattgtaactttagatatgcttgaaacatcattatctgaagctactgctttgaggtcatctattatgtgaaatactacgcccaattcatgcatacattttagtcctttttctttttgaatttaatcttaattgcctgctttgcaccatatggaagaatgtacttaagcttatcctcacttcttctcattgtagaacactctggcaagtctctctgaagatgtatagcatcaaactcacactttgttgtacagataccacagcctacgcactggttctcatcaacgattgttgcaccacagcccaagcatcttgcagtttctttcttaacctgttcctctgtgaatacacctgcatcacttctgaatgacagcttatcaactcctgacttcttagctggtcgctgacggcctgtattgtcatacttctcaacgctgtaatcatccttatcaagttcaacataatagttagaatccctgcctattgtaagtgagctgtgtggctgtacatatcggtgaatggatatagccccctgcttacctgccgcaatagcatcaatagcgaatttaggacctgtatatacatcaccaccgacaaagatatctggctctgctgtctgatatgtaaccttgtcagcaacaggataattaccatgccagaattcaaccttagtaccctcaagaaggctgccccattcaattgcctgtccgacagacattatcacattgctgcattctattgtcatagtttcattctcatcgtactgtggattgaatcttccatcaccatccttaacagaagtacatttcttaaatacgatgcctgtaaccttgccatcttctgtaaggatttctttaggtccccagccaccaataatattgataccttctgattcagcagtctcaatctcttctggaagtgctggcataatgtctcttgtctcaagagatacctgtgaaaccttaggtgaaccacaacgtattgctgttctagatacatcaatggcaacattaccaccgccaatgactactgtgtcacctgtaagcttatagctttcatcatcagttgttatatggagaagctcaacgccagtcataactcccttagcatcttctccggcaacgccagtctttctaccgccctgacatccaactgcaatataaaatgctttatagccctgttcgcgaagctgtgcgattgtgatatccttacctacttcaacaccacatttaatctcaacacccatagcccgtaatacatctatctctgcctgtacgatattcttctccataacgaatgaaggaataccatatacaaccataccgccaggttctttattcttctcgaatacagtcacattagtatagcctttctctgcaaggtaatatgcacatgaaataccagccggacctgctcctataatcgcaaccttctcgtcaaaatatcccttagttgcaggaacaaccttttctggaacatatcttgtctctgcattgatatctaacattgctatatatttcttaacttcatcaatagcaattgactcatcaatagttccccttgtacatgcgtcttcacaacgcctgttacagacataaccacatattgcaggaagtggattgttcttcttgataagagcgagtgcatcctgatatcttccctgtgcagccatctttaaatagccctgtacagcaatgtgggctggacaggctgtcttacatggagcagttcctgactcatgtgtattgattctgttcttgtccctgtagtcctctgaccacatgtgtctgccccacttctgttctgaaggaagcggcatcttagaatatgtaacctctgagccgtcctttctgcaaagcttctgtccaagagacaatgcacctgcaggacagtattcaacacagcgtccacatgcaacacagttctgcttgttgacatgtgcaacatatgctgaacgtgacatattaggagtattgaaaagctgtgatgtcctgagcgcataacagacattaacattacagttacatatagcaaatatcttatcttcaccatcaatattagttatctggtgaacaaatccgttatcctctgccttcttgaaaatctcaagtgcttcttccttagtgatgtatcttccgcctttgccagtctcaacgacataatcagccatatcacctacagcaacacaccagtcagcaggatcatctgcacatccctcatcaaatgtctttcttgatttacggcatgaacatgggcttgctgcatatttgccctcgtatttatcaagccagtatgaaatcttctcaagcgagatggcttcattacacatatcaacttccttctgtacaggaatgacatgcatgccgattccggcacctcctggtggaaccatatgtgtaagtccctcaagaggaatacgactcatacgttcaaagaatcttcccatctcaggatgttcctctaagacagtatcattcatattggcaaattccgcacttccaggaacaaacataggaagcacatactgtttctcgtgctttggattctcccagttatactcgattacaccgttaaaagccatcttattaagaagctcctcaagatacttctcatccatacctgtaatcttaacaagttcaggaagtgtctttggcttacgcactcccatctttaatgcaacctcagccatctcatcagtacagattgctgcaagtccccagtactcagggtcatctgctgtgagcttctccaatccaagctttattgctgccctgtcagtaatcatctttccaagcttaagaatcggttctcttacaggaagctcaggatgtggattcttaaattcaacattcttagtattctctgccataaatcatcctccgttattctttcctctggcaaatgccggattctttattaactgcacaataagcggaataaccatcagaacccatactataggctctgaaacaataacaccccagtatcccataaacggaacaagtgtaaatgttataacaacctttcctgcaagctcaatcccacttgatatgataggagtaagcctgtcgcctattccctgcagtgagtttcttatgatagttatcatcgctgtcacaaaataaagcagcgaatccactcttaaatatagtgttgctgtatctattacttttctattatccgaacttataagcattttaacaaatgcaggaactaccgtataagatgtgattacacataacacacaccatacccatcccataagaatagatgttaatatgccctttcttattctttcatactttcctgctccaagattctgtccgcaaaaggttgccatagtagttccaagcacaccgaacatcatcataaaaagctctgaaattcttcttgccgttgtatgggcaagtattatatcctgtccaaatgaattgattgcactctgcaatgtaacagagccaattgatacaagactgctcataaagcccatggaacagcctgttgacataagttttccacacagactggcatcagtcttaaaatctttcttttcaatccacagtatgttgtatcttttaagtgaatatataagacacgcgataagtgctatgagctgtgaaagcactgttgccactgcagcacctcttacccccattggaataaccttaaggaaaaataagtctccaccaatgttaagcactactgatattcctaaaaaaataagcggagtaaatgaatctcctatcgaccttaacagggctgcacagacattgtaaagcataagtattgtcatgcctgcaaatattataaatatataatcataggcttcctttaacaaatcctctggtgtattaagtactttcagaagaggtcgtaaaaatatcagcacaaccactgtcagacctgctgatatcataattccatatttgaacgaacctgcaactgtcctcttaaaattagctgtatctcctgccccaaaaaactgtgcagcaataacagcaaatccattagtcagtccctgtaaaaagcctataacaagggtgttcactgagttagtagaacctacagccgccagtgaactttctcctaatacataccctataatcttggtatccacaagattataagtcatctgaagcagcgaacctataaacaccggcaatgcaaaccagaatataagtttcgttatacttcccttagttaaatctttcatacaaatattcctatataattcttaattcagtccagttaatctaccgataaatatgcatccatctcttcagcaacttcatcgaaagcctgattataggcagctgcaaattcaccatacagaagctttcttgctgcaagcagcatcctgctgtctgctgacttcatctttcttaaatccttagctctttcattcttaatgacatataaagcacgaatcagatgcataagctttaaagcatcctgagatttcatatgttcatcatactgcataggtgtaaccttttctgaaagttctccatctttcttacaatttctggctctttcctttaacttgtcacattccttaacagtcataatgcttcttatcataaccttgttgctgtcaacgggtgaatatataatccccttgctgtcaaataccggctgaagaaaataataatcccctgatatccccttaataggtggtgtatcaatattttcaacctcgcacactccaacaactccgtatactaccttatcaccaatctcaaacatgctctccgtacttccttccaattcttcgttaaatccgtatcaattattaatattatattacatttctaagattttttcaaagtatatttttactggaaattcgaaacaaaatctatctgtcatatgacataataaataaaaaacgtcgtttcaatgaatcactcatcaaaacgacgttctaatatcaatctggttattaattagaataaatctactcttcctgcaacctttccatcagcaacataatagcatgctccatcctgtggctttatgtataacttaatatctttagctgctaccttctgtgccttaagatcagcttcaactctctttaaaacagcatccatatctgtctgctcatcgttgtactggataaatgtctcagtcttagcttctttcttggcaacagccttcttagctgtagtcttaactgctgtcttctttgctgccactttctttgttgtagtcttagctgcttccttaacagtctctttagcatcttcaaccttaactgctgctgtctcaacagccttcttggttgtctctgtcttagctactgctttcttagctgctgtcttagtagttttcttgacagctgtcttagcttctgctggctttacctctgctgtctttacagcatcaccaaatacgatgttttccttcttctcaatgtttgccatgtttccatcctccttaataaaatactatttcccaataagaaacttcttgattgtttctacagctttatctgcgtcattgccttcagctgaaatagtaacagacattccgtcccttaatccaaatgccataatccccattaagcttttagcattaatattcttgccttctgatgaaatatcaatatggctttcaaactgacatgccgtctgtacaagctcagcaattggattcttatgtactttatcaatgttagcaacgttgattgtctcagtcattacaaattacaccttactttcgttaaatttcagttacttttataaatatactctaatagtaaatataagtcaacatctgcatttatattttatttaatattcctttattatcagaccatcagattaatgcttttgtctgcataaccatcgttatataattccatcatctgctcatcaaagatatcggaaggttcataatcacgcagtaaaagcaccagtttttttattttctcattatcagaagataatgctttatactgtggctcaattttgttctttaattccacaagattagtaacattttccgctttaggaattgccagtgcccctgacacaactccaagggcataggcacattcataattaccagtcatcttcgcattagagaattcacatttgcgcgcaagcgcctgcttagctaatatcggtaccattaggcattaagctccttcttaaatgttgcaacataatctgtggcagcttcctctgaataattattagcttcaagaagcttgataaaatgtgagccaacgattgcaccatcaataatatcttcaagtggggcaacatctgctgctgttcttattccaaatcccatcataacgggaatcttagattctttcttaacttctgtaagatattctcttatctgcgaatggaagttagcaccctttcctgtaacacccatctgtgaaacgcaatatacgaaacctcttgcattttctaaaagcattggaatcctgcccttagataccggagatacaagctgtataagaattggagaattctcattctttgcaaggattcccttaatctcgccctgctcctcaaatggaaggtcaggtatgataagtccgtctacaccattttcaatacatttgttcacgaagttctcaactccataatgatatacagtattatagtaaagcatgaatacaaccggacttttaagaccagcttttcttacctcacccatcattgtaaatgtaccttcaagtgaagcaccattttggatagccttgtatgaagcatcctgaatcactggaccatctgcaataggatctgagaaaggaacaccgatttccataatatcgattcctgccttctcctgtgcaaacataatcttcttagttgtatcgtaatctggaagtcctgctgttgtatatgtaataaatgctttctttccctcttctttaagtgctgcaagtctttcttctattctattcattacttgttagtctcctctccgttaagatatttctgaactgtattaacatccttatcaccacggcctgaaagacacatgataattgtcttacccttatattcaccctgtgccatcttgaacacatgtgcaagtgcatgtgcactttcaattgccggaataattccttccattctgcaaagttccataagtgcatccatacattctttatctgttacagaaacatattttgctcttccagaatctcttaagtaagcatgttccggaccaacacccggataatcaagtcctgctgatattgaatgtgcaagctggatattaccaatttcatcctgtaaaagatatgtcttcattccgtgaaggacgccaacctgtccaagtgccattgctgatgcatgctttcctgtctcaataccaaggcctcctgcctcaacaccaataaggtcaacgtctttatcattaatgaaatcagcaaacattccgattgaattagagccaccgccaacacaggcaacaactgcgtcaggaagctttcctgtcttctcaagaatctgctttcttgcctcagtactgataattctctggaattccttaaccatcttaggatatggatgtggtcctacagcagaaccaatgatgtaaaatgtatcctctgccttttcagcccatgttctgattgcttcattagtagcatcctttaatgttgcacttcctgttgttacaggctgaacctttgctccaagcatttccattctgaacacattaagtttctgtctctcgatatcctcagcacccataaaaactgtacactccatatcaaaaagtgctgcgcctgtagctgttgcaacgccatgctgtccggcacctgtctcagcgataaccttagtcttgcccattctctttgcaagaagaatctgaccgataacattattaatcttatgtgctcctgtatggttcaaatcttctctcttaaggaagatatctgctccgtacttcttacttattctctctgcataatacagtggagttgcccttccaacatattcctgcagataataaatataatccttagcgaactcagggtctcttatcgcctcatcaaatgctttctcaagctctgccagagtattcataagtgactctgaaacatactgtcctccaaactgtccataatacttgcttcctgccattttctctttacctctttttcttaatattttgcattctgtataaatgctttaactttactctcatcttttcctttaacggacacatcatcatattcaacgcccgaacttatatcaacaacatcaggccttactgcttctatcgcagcttttacattgtctggtgtaagtcctcctgcaaggaataatttcttattaccacagtccgcttttttaagactttcccagtcgaatgtcttaccgctccccggaactcccgcatcaaaaagcagtccatatattttatccagacttcgccatcgcttagtctccagatatatatcttcttctgactgatgcttaatgttaacggctcttataatcccgacactgcatgcattatacacatcatcacttaattcaccgtgaatctgtatataatcaaatcccgcattctgtattgcttcaagctgtgatacatctggggacacaacaacagcaacgctcttgatgtccgatttcttcaattgtgcaacaagcaccgctgccagattaatgtcaatattgcgtctgctttttggataatatagtaccatacctgcataatctgcaccatatttttctataatgtgtacatcatccatacttgtaagtccgcatatcttaacctgtactaaagaatcattttctttcagcattatatacctctttaaactctgatattaattcttccggctccggtgcttccataagcactgttcctataagaagtgcatctgctccactctttgccagcaccttaatatcgtctgtatccgcaacaccgctttctgatacaagcagttttccagcttttctcatctctggtgtaaccatatctgcaagttttttcgtagtatcaaggtcaacctcaaatgtcttaagattacggttgttaattcctataatcttcacatcaagattcagcattctctgcatttcctcttcgttatgaacctcgcataaaacatcaagtcctaaactgtaagcaaggtcatatagttctttaaatctactgtcatcaagaatcgcagcaatgagaagaactgcatccgctcctattacctttgcttcatacacctgatatggatcaattatgaaatcctttctgataatcggaaggtctgtcatctgtcttatctgcttaagatattctgtacttcccttaaaatgatcttcctctgtaagacatgaaatagcatctgcgctttcgccgtactgttttattctttcttccagagtaatcttattgttcatattaccatgacttggtgatgctttcttgaactcacttataattgaaagaccgccctttgcaagtgcatcatagaagctgtgtgacactctctggctctcaatcgcaagtcttgtcatctcttcttcgctgattcttttcttgtgttctggaagtctttttaacttatcctctacaataacatctaatatcattaaatcaccccattaacgaaattctcaatcattctcttgccatgctctgtatatattgactccgggtggaactgcaatccgaccaccggataatccttatgttttacagccattatttctccatcctgtgtcttggcaataacctccaagcagtctggcaaagtttcttcaattatagcgagtgaatgatatcttgcaacctttactggtgaatcaagtcctgtaaatattcctgttccatcatggtatatttcagactgtttaccatgcatgatacattttgcataagaaacagtcgcgccaaatgcttctcctatgcactgatgtcccaaacatataccaagtatcggcttctttcctgtaaaatgctttattacatcaacacatattccagcatctttagggctcttagggccaggagatacaactattgattcagggtcaagctcctctatctcctcaattgttatcttatcgtttcttacaaccttaatatcactgttaaatattccaataaactgatacaggttatatgtaaatgagtcataattatcaatcagcagaatcataaatgttcctccttaacaagtgtctttgcaagtgccattactttattgcagcactcctgatattccatctcaggctttgaatcagcaacaattcctgcacctgcctgaagatataccttatcgcctttcttaatcatagtcctgattgtaatgcagaagttcatattaccaccgaaatcaagatatcctgtagctcctccatacagacctcttcttactgtctcaagctcatctatgatttccattgctcttatcttaggtgcaccgcttaatgtgcccgccggaaggaatgatgatacgaggtcaagtggatgatattctccattctttctcccctcaacaagtgaaacaatatgcataacatgtgaatatctctggatattcatgaactggtcaaccttgactgttcctatctcacttatcttacccatatcgttacgtgcaaggtcaactaacattacatgctctgctctctccttctcatctgcaagaagttcttcctctaaagcaatatcctgttcctttgttgctcctctttttcttgtgcctgctataggacatgtatatactttattgtctgactgctttacaatcatttccggtgaacttccgattatctcaaaatctccgaaattaaagtaatacatatatggtgaaggattaagttctcttaatttttcatagagattaaaaccgctctgtcccgtctttattgtccatctctgcgaaagaacagtctggaatatatgaccttcttttatgtaattcttaatcttattaaccttcttgctatattcttcaagcgtgtccgattttttcaatatcacaccttcaagtgacatatcaggcttatcatccttaaacttatctacgccctctcttgcagcctttataagctcctccgcttcctttaaagccttaatcctgccttcctctgaatcctctccaagcactactgctgtgaatgtttctgctgtatgattgatagcaatgaacttgtctgcaagcataagctgtattgtctcaattcctatctcatcaggattatcatcaggaaggacttctgtgtatcttatataatcatatccaaggcttccaacaagacctccgaggaaatcaagttctcccggatcctttactatctcaaattcatcaaaatactctttaagtcttataagaggattaccctctcttacctctctgctgccatcttttcttgtaataacaaggctgttcttatctgactgaattatctcattcggttcaactcccataaaagtatactgtccgctttccttgtcagttccttcaagaagaaatcccttcttttcaattccaagtcctttgtatagttcaatagctttctcattaacaatacttaccgtcttcttataagctcttaatcttcgtttcatagttcctccctgtccttcgttgttcattactggcgtctgctgcttacaaaaaatgtccctgacagtaacctgtatattgcagattcctgtcagggacgaattaccgtggtgccacccttatttatgaacatacttgtaatattaataaaaaaggtggcactccttaccggatatgccacctgtatgctcaactcattatcagatacaattaatatatccttcccctgtaacgcgaggccgcgtcgtaaactactgctaattcatctacgcatctcacaaacccattccttacggctctccatgctgacattccaccaccgccagctctctgtgatgtaccttccgaaagtactcttttgatcatcgactttaaatatttaactgccacctataatagcactatgtttatctgccgtcaagcacaaaagcttaaaatttcctgatattaacaattgtctgaaccagatatactatgtataaaacagctgctacaaaaataagaaccgttgttgcatttgtaagtaccagtataatcacattcacagcaagaagaataactactcctaaaagtgtttttccgattgttcttttaaatactttaacgcttacaatatataccacaacaaggattatcagaataatcaaactcagaatcgaaagtgttctccaaaaaacatcaaattcttcctgtgtggtctgctgaatcctcgcaattccactctgaataaaaaacatatataggtttattaccagcaaaattaatgttactatttctaacaacacattctttataactttcatttcttaattcctccatattatttaattaagcccgtctaatgccaatattgttatgtataaaacatcaaatacaaaccacataatacccaaaatcatatatatagtctgttcatttcccataactccattatatggattatctttttttacacatatgttataaacagaacccctttcatgatacatcgaaaatatattcttttttacactgcaaacataattatgtcctttgtttccataaataaactcagaagagtattgatttccattgccattcgcaatgcccttggttttgtagaattgagtttttatatatataaatcgtgcaaaaaagaacacatctaacataatacctgcaattagttccatttcctacacctcatatttaatgttattcgacagtgttaaatgcaatgtgttcgcatgctttctaatatatttaatgctgttatttgtattttctctaacttcctcagagttgttaaataaattcactaatccactaaatattccatcatttttatagaaatcatactgttcttcttcacccagaattcttaattgtgctatattggtcaaataattctcggtcatctcggacatattataatatctattgttactgtctgatattttagaataaaacaaatctatgtatactaaggacatttcactgtagcaaagcatcctgtacatctgttttacatcttcttttacccccgttacaatcaagcttacatctcgtactgctgcaataagctttacataaggaaaattaaacgcaaaaatattccaaattacattatcagcaaattcaattccttctttaaaaagatcaattgcaatactttttattgcatctatatactcatcagccaaaattcttcttatctcaaaagcagcatttgataaatcattaatatttgaactctccaattttattagcaaatccatatttccagcaaagcacttttcattagcctttatttcaattaatccatttatattatcacataaatctaccgaactagttacatataccatagcatttgataaatcccctaatctttccgctaatattaaggcctgttcttctgttatatactttgccacatattttccattctgatttacttcaaatctaagttgtgttgcatcctcacttagcttattaagttcttttaaaaagctggcaacttttgagttaaaataatcatttattctgtctggagaattgcatccatttatataactagccattatattcatatcatttgccaatgcataattagttccaatatcagaaagtaattgtttgaatgtatcgtatattgtctttttccattccaacttcttatcactattcaccacatttgtagtcatataatttgagtagtaatcaactatcagatttctatataatccctgtttattccacactcctgaaattactgacgaatatcctatcatatatgaattaaacgttccatatctcatgtcattagcataactttcatatgcatatgctgatgaattcattaaactatctgctggagctttttcaagtgaataattcataggatctgagccatgtttcacctcatcataatcattcacttcgtcgaaatcagtgtattgcatgaaaggattagatttcatttctatgtatgttttaccaaactttgttacaatcgttaattcctcaccattcttcaagccgtctccatcccagtcgtcagatggttctccatcagcattaagattcaaatcaaatccctttaattctagggatccattgctcaaaactaatcttccctcttttatctcttctgtataataatcgcatattccatcattattagagtcggtcactaaatcttttgcttcatctcttacattatccactacgcccttcagatctgaaataacatttgcgtgaaagtaacttccacaagtattgtttgcaacatttgtcaatatgttctcatctattgttcctataccgatggtataaattgtcacgccatccttcttagctctttcaaccagttccctataattagcctcgtatgtggtagatggttcatcatatccatcagtgaacactaccatcatcttatatccattaatatcattggcttcaaattcatccaatgctctttctattcccgtatagatagctgtcagtccacctacagtcattctgttcactgcattttttataacatccttatcttctgtaaagccacaacgaagttcagcaaaacttgtaaatgatatcaacgcggaagaatctttttcttctaactcgtctacaaaagtatttatcactgtcttagctgtgtcaatcttataatttctcatacttccagacaaatccaccactaatgctacattcagagtgttttcccctgctgcagcctttatattgctttcccataccttgtcaaattcaactttgttaagaagcacatatgttgaaaaatgtgttgtaactgctgtaactttaccatcctctactgtctgattggcaagttcctcaaacatcttgttttcttcatcatagtaataaattcgtggctggaatccatctgatactttgcccaatgattcatcataactaaacaccagtgttgcctcatcaaatgaaccatccaaattgaaatcaaatccgtctcccaagtatcccgcaaccattggtgatatgtaataattatcgcttggcattactctgtcgattgtaagcgactctggatcagccttagcagaatcaatatatacacttgcgccaactggattatattcattaactccaccagttgttgctgaaatactaaagcctgaattctttactaatggatccgtattgttattaatttcccagttatcatcggccttgtctccatctgtatccttctttgtaggattggtaccatatatattaacttcatcataatcagttaagccatccatatccgtatctttatatgcaggattagttccaatagaaacttcatatccattacttaacccatctttatcaacatcgtcatcgtagtcatttattccattgccattagtatcctttttcaatggatgtgtaccaactatcataacctcgtcataatcagaaagcccatccccatctgaatctttattaaaaacattggtgccgtatatttcttcaataccatccgggatgccatcgccatcactgtccttgtattctatggtataatttccatttttattaatcaccttaaatccaattgacttgtatttatcagcttcaacataataatacatctctgttaaatcattattcagttcacatgtatactgattgtctttctccacatttgccaacaacttatatccagaataatcttctgtgtcagtctcagactcataaatatcaaattcatcgatatctatattagtgtaccacttgattgtgagcttagttccatcaatctttccttctgcaaatatatataacttattatcctcatatacagcatttttatctacaaatttgataagttctctattggaattaatgttaagattgtacttagctttaatattaatcttatctgctatgatacacacattgttcaagttgacattatccccctctattgtgagcgttccatatggaagataaattaatcctgaaaagctgatgttatcactctttaatgtaacatttcctgtttctgatacaattatcgcattgttagcattaaaagctggaccaccgataattaaatccccctctgtctgaagagccccattaagattaagtcccctgttaagctccagcttattgctaattttaactgctccattaacattgttgccaattttttcaagttcctcagccgaactaatactctcaaagtcagagaaatacttttcatcaattgcatcaaaaagaattggtgttttaatattagcattctctgtaacactaccattaacattcatattcgcagtagatatactacttccacctcttacattaccatttaggcagcctgcacctgtttcaatgataaatgaatctttatcacttgatatagctgttatagtactgttaaacggctcctccgtctcaccttgagatgcaaacgctacactcgtctgcatacacattgtcacaatcattgtggcaataagtaacattgataaaatctttttcttcaatttttctttccccctatggtatttttgaagcctgaatttaaaacaaaaaaggctgcactaagaaatttttttaagatttcttaatgcaaccgaactatcatagtattagagacttatgcttatgtgaatctctcaactgaaaatagtgtttttcagctttatacctctagacttctagttttgcgtccttatatttctataagtttgccatatttacttttttagtatatattaatttatatcatttgtaaacttaaattattaaaaatttctgattagcatcttgtaactatatctgacattctgattccaactcatattttattccatgtatctttcctctatagtattgcagacagctctgcaaagctctctattttagcaacatacctgtcatctgatacttttccaaatccatatgccgcatagataaaatctattcccacatctttggcagactttgcatcacctgctgtatcaccaacatacacagggttctttaagttgtttctttctataagtatcttattagactcgctctttggcagaaatgtccttccccaacattcagtatctttgaagaaatcggacataaggtgtgctgtaagaaaactttcaatataaccatcctgacaattgctcacaatatacaatggatatttcttgcttagtgtataaagagtttctgcaagctgtggataaagaattccacctctttctgcaagatatccattctcaaatgtacacagctcgtccataagtgcatttcttacctgctcctgttcttgtggaaacagctttgcagctatatcgtacatcggaagtcccatacagtcgttaaggtctgtctcgacaattggtgttctgtgaatctcttcatgacgagaaagtattatattccacgcctcacatattggctttcttgtatcccacatagtaccgtcaaggtcaaatattattccatcataagatttatcaagcattgttatcctccagatctttatctaattcatcaagcaatgtctttaactgtgcttcctgtgttatatcataaacaattgaaaagcagtctctagccagcttataatctttatcattcatcataagttcaccgactctgtatataattcctatcgtcttagagtcaggtcctggttccacctcattcttatcaagtatttcctgcatctgtttaacagaatattccggtgtcctgtcatttaatgcctgctcaagatacttaagttcattatcagcattatctgtctgataatatatattgctgtaggtgtagcacacccttgccgcctcagtattatacctggcaacataataaaatcccatatttctgtaatatcttgccatcgttgcgcggctgcagcagaatctgtatgcctgctttgtaacatcaagatatctcgacagcatattaagattcttataacattctgcaagaccaagatatgaatcaaggtcaacaggattccagcatatagccttcttaaatgcatcctcagctctgcgaaacttcgataacttcaggcacagactgccataagtcctgtagtactctccaactggcagctctgtacacagcacatccgtttccggttcgaaataacatgcgtacacataatattccataacatgattaaggcttatatatattggtctgccgtccatgtccgattttttcacaaatgtatcatccatagttccggctttacgctcgtccgtacactcttctattctttcaagtattgcagataatatatctgccgctttgtcataatcacctgaattaaatatcttctcgtaatctgcaaatctgtctttgacatctgcaagcttctttatgtccattacctctcctttttagcaggaatttcatatgttcctgtgagtattgcaacgctccgtggctcaacacatacacttctgttattatcttcaatcacagcacctgatacattagaactcatatcaaccttccatgtaccattaatcttaggaagtgcaaagctgtgattctcccagtgcatattatatgcagcatatatcagactgtggtcttcttcatccccatatacacatgaatacataattcctaaatgtctgtcatatgtattcatctgtgcataccacgcattagttccatgatatgatatatcagggtagccacatgatatcctgtcacttaaagtaagcgactgcggcatatgaagtatcttattattctgtctgaattgtataagagcctttgtccattcaagaatttcttttccctctttagtttccttccagttaacccatgaaagttcactgtcaacacaatacggattattgttaccgttctgtgaattgccaaactcgtctccggcaagtataagcggagtacctgccgacaagaaaacaaataccagtgcatttttaatctgacgcattcttagttctttaatctttctctttcttgtcgaaccttcctcgccacagttccagctgaaattaaaatcctcgccatccctgttattctcgccattaagatcattatgctttctgtcatagcttacaagatcattaagagtaaatccattgttgttggcaatataattaatacttgcactgtttgcctcattctttcttgatatagctgcaaattctccaagcatattctcgtcaccctttaacaggcggcgcgcaatattctggaaatcattattataattagccatatgcttcttcgttccggttttgccattccagtatacagttataatcttggtatccgctaaaagtgcatcctgtgaaagtgccttaagcgctgactcatcacagtacacatgaactccgtcaatgtgatattcagtaacccagtatcttacacactgcaggataaagcctgtactttcgtcagtaaaaaacatttccataacgacttcaatgccatttctgtgcagttctttaaccatattcttaaattcaactgtataatccctaaacacccccggatgctttgaagcaattgaagaatatgatgccttaggtgcgaaataaaatcctccgacatatccccagtaattaattttccgcgtattcttatccacgctgtaatgtgttccggctccgtattttgacattatagtatcattcagctgtggaaaacggcctatttcatcaaattcatatgcgggctgtaactcaatagttgtgattccaagttccttaagatatggaatcttgttaattattcctgaaaatgttcctttatctttaaccttagatgttctgcttttagtaaaacctcttacattcatcttatagaatatacagtcgctgtaatcataattaagcggtctgtcatcttcccagtcataatttgccacatcaatcgcagccagatacacatctttctcgtccgtctgtccaaatcttccgcaatccgttatcgccttcgcatatgggtcaagatacattaagccatctatctcatagcagtagaaacatgtatccagcctcctgccagacacatgaactgaaaatatatttccacatttcattgatgaatccagttctatccgttcttttggcttcatatgtgcatcaaaaatcagcagagctgcattttcgcattctgcctcatatgtaaaattatatccatccttatatctgctgcatcccataagcatgggatttcctttactaataagcatattaatctccactctattttttatacaagcccctcatagtattcttatccagcttatagaatctcattataaatattgtcacaatccagcctattatcggaattatgcaatagaaaaatattgtcagaaacttaagctgtggtgtcagttggtcctccacctgcggaaaaactttagaataccctgctatcgcaagtgctattcctacaaatcctgttccaagtgctgaaaatgatttgtcaataaatgaaaacagtgctcccattattcccggcacaaaatgtccactaagtgtatattcataatcagtacagtcagcaatcataggaacgactatattattagatattgattttactccgttaagcagcgtaaacactaacaaaaacgctaccgttataaagttaatatgtcttaatgatacatttgtaaggtctgaaaatatcatcataaacataagtatcgtctgaaaaataattgcaagatatgtcgaccttactaatgtcttcttctgtccgcatcgcttggcatgctctatcccaagatatattattcctaagttgggaataccaacaattattccaattataccagcaagcggataattctgcatcagtattccataaagcattacaagaactgttgaattaccatataccatctgtgcgaatttgttagatgccgccgcaataacaagcattctgattggcttattatgtttaattatagccgcataatccctgaaatgtatctgctgcttcttatcctcatcaagcttgaagtactttacattatccttactccatattcccacaacagccagtgctgagcatattccggctacaataaccactgtgattacgaactctgagaaaagtgcctgtgactggaatgtcttatatttctcaatcagatacactgacacatagaaagcaaccagaccatgtgcgaacattataaatgttgagtcaaaaaaagttatcattggcctctgcttcatgtcattagtaattaccgattgtccagactttacaactgctgtctgaaatgtgtatcctattatatatactgaatatacaattataaaatacaatggtcttaaaataactggaacaaggcttgtagtaaagaacagtacaagactgctgattgccattagtaagtatcctataacaatataaggcctgaatttaccatattttccattagtcttatctataaaataccctattaccggatctgttaccccatcaaatattctcattcccgtaagaataactgaaataagcacaactgaaagacctgctattccattagcataatatgagacatatcccatcatcgcaagaaacagatttgtagatgtattattaagagaaaacaagccaatctgccatattctggctctgttctgctctatatgcccatgcttattctccatatattaatcctgccaatacatttgtaataatctctgttacgattatataatcatatgccctcatagtcaaattcaggtatgaagctttcctctgcaacatcaccttcctgaataaatccattattaatcccgcagtctatcgcataatctaccacagaattatattcttttcttgtcactttacgcgacaggagtggatgtttttttagtctgtcaaatggcgtgtactggctcattatgcttatgtatatatcatctccatatgtatcaataagatactttataaccgctttggaatccttagttgttcccggaagtacaagatgtcttacaattacgccttttttcataatcccggcttcaactcttccgctcttcacgagttcatcatcttctataaagaattccggctttccggtctgtctgaccatctcatgtattgcagctttagccacataagcataatctggtgctttcgagtactctgccgaaagcctgctgtctatgtatttcatgtctggaagatacacatccacaagcccgtcaagcatattaagcgtgctgacattctcgtatgcacttgaattgtacacaacaggtatcacaagtcctttattctttgccttaataagtgcttctacaacctgcggtacaaaatgcgttgcagttacaagattgatattgttggcacatttgtcctgaagttcaagaaaaatgtctgaaagcctctccactgttatctttttcccaacatgtgctgccgcaatctcagaattctggcagaatatgcaccttaaagtacaccccgaaaaaaagactgccccgcttccacgctctcctgatatgcatggttcttcccacatatgtagtgcggcccgtgccgcatatatatcattagtcattccacaaaagcctttgttaacactcctgtcgacattgcaggctcttgggcatatattacatttcataatttccccttattgcgttattgtttatcaatcaatgaatccagctttgcaagtgcatcgctgattcctcctacttcacatattaaaccttcttcaacagcctgtctacccaccagcactgttcctaagtctttagagagttgtgtggtgtcaaccatcatttcctctactctttctttgcttacactgctgtgagccgcaataaatgatgttatcctgtcagatatccgttcaaaataatcatatgtctgctgaactccgataagtgttccgttcatcctcacaggatgtattatcatggtagctgtaggcacaataaatgaataatctgtactcacagcaagcggcacacctatactatgtgaatcgcctatgattagtgaaactgttggctttttcattgaagcaatcatctctgccagtgccagtcctgcactgacatccccaccaactgtattcataataaaaagtacacctttaatatctttatccatctcaatctccgccagcttaggcagcatatgttcatacttggttgctttgcttgttgcaggaagattatcatgtccttctatctctccaataattgttatcacctgaagagcatttttcgtgacagcaccatccttataatcatcatctgttttttcttcttcagatttacccatgtccgcctcctgataatattattctctattatggttggcggctggacgaaataatattcacatatttttatattatttttatatttaaagtatttatattcctctttatatatgttattcttttaatataaaataatcataaaaggagatattttatacttatgaggcaacagagttaaaaactttattaataaggggactcttataaaggcttgactttttcttttactaatgtatacttaaaaaagtaaaacatagactatattaaatgaaatctgaggacggaacgggcagccgtcacccttgttggagatgtgggaatgtcaccccacctatttcatttattagtaagatggtaactccggttaccatctttttcttttttgactaccacacccctaaaaaagccccttttgactaccattgactaccaaaactttagtgaattttagcatatcacgaaaatttaaaaagtccgcgaagccagtatttatctagcttcacggactttttaattcaagccacctgccggaatcgaaccggcgaccttttcattacgagtgaaacgctctaccgactgagccaaggtggcattataaccgccataatgcggaaactgtattacattatatatattatttgtttttttgtaaagccgttatttcactaacaccaaggcagaccctcgaatattctatattagaatattcaatgaaaggggctatgtaaatgaagaaaatcatcagaatatatattgcaattattgcatctgtatgcctgttcatgtcattaccggctgatatatatgccgttgttatagatgtgagcagctataatggattcatacagtgggataatatgaagaactatattgaaggtacaattatccgtataggatatggcaatgatatccaattacaggatgatgatgctgccataagaaatatggatgaatgtgaaaggcttggaattccttacggcgtctatctatatagttatgctttagattattacgatgcagcaagcgaaactgcccatgctctaagacttcttaaaggaaggtctcctgaacttggtgtgtggtttgacatggaagatgctgatggatataaagcaagaaacggtctggatgtatactccgaaggcgaactactgtctgatttctgcgaaatgtttgttaatgctatgcgtgtcagtggatataaaaccggtgtctatgccaattacaactattttacaaatgtgcttgaccttgacagactgaaatcaatcccagagatgaatatctggcttgcacactggggaattgattctccaagccttgactgtaccatgtggcagtttggcgcagtagaaattgaagatgaagaatatgacggcaatatatattactcagattattctgtaaaaaatgatgacaatactggtgaaactatccgtaccgatgatagttcatccaatagtataaatgtttactatcagacaaaacttgcagcgggtcgctggcttcctgttgttaagaataatgaagattatgccggaatacgtggtcagaatatcaccggtcttgctatcacaacagataccggctatataaaatacagagtccatgtggacagtggctggctggatttcatagacagccgcaacactgatattaacgattattataacggatatgccggcaatgacacacctgttgatgctgttgagatatattattacacgcctgatgacatcattaaatcatctggataccattacgcattctacagggtaagtcctgtgaacggtaactactatagttatcagaaagataataataaagataacggaatggatagctatgccggcatttggggacatttcatagacagattacagattgatataagataatatattcaataataaaactgccggaaagaatcaccttcatccggcagttaatatactaaaataaacactatttaattcctgcttcttttaagaatcttgccttaatctcatgttcaagccttacaatatcagcatccccaactttagacccggtttcttttccatatggtacataaccccccgccatattatcatggcctcctcccgtacctattcctctaagggcattgactgccagaactcctgacagatattttccaccacttcttattgacagtttaattccatccttctttggtgaatatacaattgacagattaattccatcaagcgtgagtgtaaaatcacatatagcagctataagtgattctttacattcatatccggcacatgcaaagcatacatcttcccttatatcaatagtactcagtgcatctttatatgccttaatatcatcaaaatgcagtacactactgtcaaggtttgtaagtatatccctgtctgccatcataaaaagcttataaaacatatcaagatcaagctgtgaaacacctctgcgcatatcagctgtgtccatcttgattccatataacagtgctgttgccacatcagctggcatatcaatatcattgtcaaaataataagatgctataatcgaagcacatgcaccaacatctggtcttatgtcgcaaaacctataatcaatatgctcatatacgggatggtggtcaatacatattatttcctgtccattcatatctataatattagaattacccttctgggcatcaacaagaataatctcatcttctttgttaaattcttcaaaacttatatattccttaacattaatattaagaagccttaccatcttggctgtcacagttctgtcgatgcttcccttatagcatatttctgcatctatcccctttgccttcaaaagctctgataatccatatgcacatgcaattgcatcaggatccggaaaattatgtgtctgtataaaaactctttctgtgcttatactggctattacttcctctaaacagttcataaagtacccctcatatgactttaatgtttttattatattctttatacgggttttattcaatcttgattatcactttttctgatatttttcataaattatattaaccatagtatgggagcaatctattggaatcaattctatctctggatcacatatattattcttatcacgataaaaatggagagactccggtaatcaatgatctttcttttgaaatagaacccggaagtttcacctcgattgtcggtccatccggttgtggtaaatccacactgctctctctgctatgcgatcttataaagcctgaagctggaaccatatatataagaccgccagagaacaatccggactcccggatgggatatatgctgcagaaggataatctgtttgaatggcgcagtatctataaaaatgttatgttaggtcttgaaataaataacaaaaaaacgcctgaaaacattgcatatgttaatcatctcttagagcaatatgaccttgcagaattcaaatcagcgaggccatcccagctatccggaggtatgagacagcgtgcagcacttatccgcacacttgctctgaaaccggatattttacttttagacgaaccattttctgcccttgattatcagacaagactcgaagtaagggaagatatatgtaatatattaaggagtgagaagaaaaccgtaatattagtaacacacgatatatccgaagcaattgcaatgaccgaccgtgtattaatactcacgagccgtcctgcaaagcttctgaaaactatcaatatagaatcaagagatactctttcttcccagaaatattttgatgaaataagggaggtgttaaaatgaatattagtcctttacagaaaaaattcataataaagcaacgtttgtatactatatcagtaacactctcccgcctgatattattcttaggattcgtcggtctgtgggaattctctgctgacaaaggtattatcaacgcatttatattcagttcaccggtaaggctgtatcagacatttatagacctcgccaaagacggagtaatattcatgcatatatgggtaactctctatgaaaccatagtcgcatttgcaataattacagttgtcgggattatatttgcaatattgttatggtgcttcaaaggactgtcagactgtcttgaaccttttatggtagtattaaacagtcttcctaagtcagctcttgcacctatgctcattgtatggcttggcactaataccaaagcaattatcataaccgctgtatccgtagccatatttggcatgataattaatctgtacacaggttttctcggaattgacaaagaaaaaattactctgatacggactcttggcggtaacaaatggcatattctgtgtaagcttatcatccccggttccaagaaaattattataagtaacatgaaagtcaatatcggtctgtgtcttgtaggtgtaattataggtgaattcttagctgctaaaaaaggtcttggttatctcataatatacggaagccaggtattcaagatgagttatgtagttctcggaattgttattctctgtattatatcaacaattctctttgctataataaatataattcaaaagctatttctaaaagactgattttatattataatcaatatacattttgcaaaacaaggaggctaaaatcctctgctcctgcatgggcagtcgcattttgcttcgcaaaacaaggaggatttatgctttctcttacaattaaggatttaaagcaatttatgaataaacttctgataagcgatacatttgatggtatgtgtctttcagaagcctatatatgcactggctgcagttatacaatagatggaaagctcaacacccacttttaccatgaagatgagcttaattccatgccttctgcaagatatacatcatggaaaaacattaagcctttcgcattcagcataattaagggcaggaaagttcctgaacttttaaagataacatttgtactgcctgaagcagttgttgcaaagctgatacttgatactgaccttaactttgaccccggctgtgtcaacgggttatttcttaatgtacgctatcaggatggttcagtaaccatgacaacagcatcttcgcttagtacatttacacttgaccgctcccttgatgaagcatttgaaaaatatattctcaacttcttatctgatgctgatatttcatatgaagaataatttagaattatttaataaatcccgcaaaaccgcctgtttacatgcacagacggttttttgttagcactctttacctttgagtgctagtttttgcttgacttctgtttattcgtgtattaaattaacacttagtttaatactatatagattggagagtgaaatattatgtcaaaagaacatggtaatttatctattaacagtcagaatattttccctataatcaagaaatggatgtattctgaccatgatatcttctatagagagttagtttctaatgcatgcgatgctatcactaaactcaagaagctttcaatgattggagaatatgaagctccagacgatattgattataaagttgagattaagctttctgctaacgataagacaatcaagatcattgataacggtatcggtatgactaaagaagaagttgatgagtatatcaaccagattgctttctctggtgctgaagcattccttgagaaatacaaggataaggctaatgacgaccagattatcggacattttggtttaggtttctactcagcatttatggttgctgaccaggttactattgatactctttcatttaaggacggagcagaatcagttcactggtcatgtgaaggaggaactgaatatgatataagtgagggaaccaaaacaaatcctggtactgagattactctttacctcaatgaggacagctatgaatttgccaacgaatataaggctaaagaagttcttgataaatactgctctttcatgccggttccaatctttgtaactaacgaagatgcgggtgaacagactgaggagattcctgaggaagaagttacagaaaaagatacagttcttgatacatttataaaggacgctgttacagaagaagttgagaaagaagatggaactaaggaaactgttgagaaagttccagccaaaaagatggctaagattgtaaaaagaccagttgcaatcaacgatatccatccactctggacaaagcatcctaatgaatgttcagatgaagattacaaggaattctaccgcaaggtattccacgattataaagaaccattattctggattcaccttaacatggattatccattcaatcttaagggtattctctacttccctaagattaatacagagtatgaatctattgaaggtactataaagctttataacaatcaggtattcgtagcagataacatcaaagaagttattccagagttcttactacttcttaaaggtgttattgactgcccagaccttccacttaatgtatcacgttcagcacttcagaacgatggatttgttaagaagatatctgattacatcactaaaaaggttgccgacaagctttcaggaatgtgtaaaacagataaagaaaactatgaaaaatactgggatgacatcaacccttttattaaattcggctgcttaaaggatgaaaaatttgctgagaagatgaatgattacatcatattcaagaaccttgacggcaaatatttaacacttaaggaatgtctcgaagagaataaagagaaacatgaaaacacagtattctatgtaacagatgaagttgaacagagtcagtatattaacatgtttaagaacgaaggaattgatgctgtaattcttactcataacattgaccagccattcatcactaacatggaatctaagaatgagaatctcaagttcaagcgtatcgatgcagatctttcagacagctttaaggaagagacttctaaagacgagttgaaggacatgactgaaaagctctctaagactttcaaggatgctcttggcaaagagaatttaactgttaatgttgagaaattaaaggatgcatctatatcttcaatgattactctttcagaagaaagcagacgtatgcaggatatgatgaagatgtatggtatggcaggcatggatcctaatatgtttggtgccgaaggtcagactcttgtacttaatgctaacaatgaccttgttaaatatgttgcagaacatacagacggcgaaaatactaagattatatgcgaacagctctatgaccttgctatgcttagtcatgcaccactctctcctgaacagatgactggatttattgcaagaagcaataaaatcatggaattacttgcaaaataacgccatttaaactatcattgtcttatataacaataaggaaatatataacatgactaattttaactatgacaattatgacgatgatactaaagcaaaatacgatgatggtatcgaatttttagatgatgatttttcttttgatgaagatgatgatgataacatttatgatattcctcgttacagcgatgagcctgttgctccacatcatcataaagaaaagcaggaaactattggacaggaaatattaagttatatcaaaatccttgccgttgctgttattgtagcatttctttttaccagatttataattgtaaacgctcaggttccgtctggttcaatggaaaacaccattcttaccggagacagactaataggtttcagacttgcttatctgtttcatgaaccagaacgtggtgatattgtaatcttcaaatatcctgatgatgaatcacagaattttgtaaaaagagttatcggtattcctggtgatgtcattcagatttccaacggacatgtatatgtcaatggtgaacagcttgaagagaattatcttcgggagccaatgaacaatgatggtgaagagttaacctatgttgtacctgctgattcatattttatgcttggcgataacagaaataattccaaggattcaagatactggaccaacacattcgtgtcaaaggataagattattgctaaggtttctttcagatatttcaatgtcagaacaaaacgttttacattttctttcattaaatagccctctgaataaagaataatattaagggtacaataatatggccgctatgtttcaaaaacaatagcggtcatatttgttttttgaaaggagaaatattatgggtaatcttaactgtaatgctgcatcttgcatgcataactgtgacaatcagtgctgtcttaattcaatctgtgtagaaggaagctcggcatgccaatgtggtgaaacatgctgcagcgactatgaacatcagaaaccaggtgcaactaatatgtgccatcttcctaaagattctttatccatctcatgtgaagcaaccaactgcatatataacactaataaaaaatgtgatgctgaccatgtagacatatcaggtataaaggctgtaacagaggacgatacagtctgtacaacattccaggcaaggggataattctagaactattctcatcgctactcgcgcgaatagcgcatatgccagactaaagtctggcattgtcgcggtgctcctcgaatatccgcccaatttataattcatgcaagcatgattataaattctgcagctattctcatcgctactcgcgcaaaaagggctgtcatgcatatgcatgacagcccttaataatacataaaaattatgctcttgatgtatactcacctgtacgagtatcaatcttaatcttatcgccctgattaacgaataatggaaccataatcttagctcctgtctctacgatagctggcttagtagcacctgttgctgtgttacctttgataccaggctctgtatctgttacttcaagctcaactgaaataggtggctcaatagcaaatacattaccatcatgtgaacaaagcttaaccatctcattctctttaacgaacttaagagaatcaccaacctgatcagcacttaatgcgatctggtcatatgtctctgtattcataaagttgtaaagatctccatcagcatataaatactgatattctgatctgtcgatgtgtgcaagatcaaacttctcagttggtctgaaagaattctctataacaccaccagaaataatattctttaacttagctctaacgaaaggtgatcccttaccaggcttaacatgctggaattcgattacctgccaaattccgttctcatactgaattgtaataccgttcttaaaactacctgcatctaccattctttggtatacctcctaaataatcaaatgacttctaatattgtataataaatataaacatttggcaactactttttcatagcaaggtcaacaactgcttccatggcatataaatatcccttaagtccaagtccaacaacctgtccgttgcacacaggaactgtcactgatgtgtgtctgaactcttctcttgtatgtacattagatatatgaacctctatcttaggaattgctgccacagatgcaagagcatctcttactgcatagctgtaatgagtaaacgctcccggattaataactattccatcaacatcattataatatgcttcctgaatcttatcaattatagcaccttcatgattgctctggaacacctcaacatcaactccaagctcctctgccttcttctcaatcattgaaacaagagcttcataattctgctctccatatatacctttctctcttattccaagaaaattaatgttaggtccgttcattacaagtatcttcatatcaatcctccattatgcctatattaacagctgaaactatatcagcatacatgtcttcaaatcttcttccatcagtcttaactataacatcagcagcgtccttataaagcgcctcccttgcggtcataagactttcaatcttttctcttaaattacctcctgcaagaagcggtctgcttgtgtccttagacagtctttttacaagttcatcaacctcggtcttaagatatacgacaattccaagctctttaagaagcctgcggttaatatctcttaccggcagccctcctccaacagatataacacagttatcacatgaatcagcaagttctctgactgcctgtgtctccatatttctgaaagcttcttctcccgactctctaaatatatccttaataagcttattgtattttttttctatgtactcatcagtatcaatgaacttcattgaatgggacgtagatatccatctgccaaatgtagtcttaccgcttcccataaaaccaataaggataatattattctttctattcattaatcccaagctccttctgaagacacttatacacctcatcagcctcttccttagtaatcttacagtcattccagagctcgtaagcacttactccctgatacagaagcatcttaagtccattataagcctttttcccctgtgccttaataagcttcataaacatagtctctcccggattatatatgatatcaacaccaactgccgcctttttataaaatgcttcatcatcaataacaactgcagtatcattcgggtgaagtccaacgcttgttgtctggataacaatataatcagttcctggaatatccgcataatcagcaatattcataggaattactttttcattgtgaaaatgtgtatttacagcatgtgctatatcctgtgccttatctacagatctgttcaacagataaattttctttgcccccttgcttgagcaaagaaaagtaatagctcttgctgcgcctcctgctcccagaataataaccttagaatcagccagttcaattccttcatcttcaagttctctcgcaagtccaagaatatcagtgttgtatcctttgaatcctccatcaacccttacaagagtattaacagctcctatagccttggcaagcggatctatatctacaagagaatcaataacctctgacttgtgtggaactgtgacattaagtcccagtatattgagactgtaagcacctcttacagcagatgccacatctcctttttccactttaaatgttgtataaaccatatcttttcctgtcagccgtgcaagattattatgaattgccggtgaaacagaatgtcctaccggattaccaataagtccgcatactcttgttgttcctttgatgtccataatctaagctcctttaagcaattaatgctttcttcttttatagaaaaataatacaatccattccagtcttctcttaagaattatctgaatttcttcatgcttatcaataggctttacaagcacagacataatacctgccctgttagcgccccacacatctgtaaaaagctggtcaccaacaaagaatgtgttattcctgtctgttcccataatatccattgccttaatataattgaccggcgatggttttgctgccttacttacatatcttgaaccacatgcatcagcaagcggctttacacgcggttctttgttattcgatataatgcatgtatcaaaccctatcgctcttaaactgtcaaataaatcactgcacttcttcgtaaccggtgcaccatgttccacaagagtattatcaatatcaaatataatacctctgtagcccttattatacagtccttcataatctatgtcgtaagctgaatcaatatatatatcaggataaaacctcttaaacataacaaaaatgctgcctttcttaattactgatatatattatttaaggattttcttaatctcttccataaatgaatcaacatccttaaattctctgtaaacagatgcaaatcttacataggcaacctcatcaactgccttaagcttgctcattacaatctcaccaatagttttagttgagatttctttctctccaatattaaatatctgcgtctcaatctcatcaaccatattattaatctgtgagatagatacaggccttttatggcacgatctgacaatacccgcagttatcttctctctgtcatatggttctctgttattatccttcttaatcacaataagaggcatagattcaatcttttcatatgtggtaaaacgcttaccacactcgtcacactgacgacgtcttcttattgagctgtcatcagtcggtcttgaatcaattaccttagtgttatctttaccacaaaatggacacttcacgctatctacctccaaattaaatatataaattaattatgaataagcccagccaaaatgtcaatccttttaatgttgataaattgaaaaaccaattattatttaaggagggattatggctggatacaaagttgaaatatgcggagtcaatacaagtgaccttcctcttcttaaacccgcccaggcaaaagaactgcttgtaaagataaaatcaggagatacgcaggcaagagaaacatttataaaaggaaacttaaggcttgtattaagcattgtacaacgcttcagccagagtggtgaaaatcttgatgacctgtttcagataggctgtataggaatgattaaagcgattgacaattttgatatatcgttaaatgtacagttttcaacatatgctgttccaatgataatcggagagataaagcgttttctgcgtgataacagcactataagagtcagccgttccttaaaagatacagcctataaagcaataactacccgtgaaacacttatgaagaaaaatcttaaagaaccatcaattacagaaatcgcagaagaaataggcatatcaaaagctgatatcgtaattgcccttgaagcagtcacaccttcaatatcattatatgaaccggtattcaatgatggtggtgacaccctgtatgttattgatcaggtaaaggacaagaaaaacactgaagaccgctgggtaagaaatattgcgcttcgagaagctattaatcggctttccccaagagaacgccagataataatactccgtttctttgattgtcttacacaaactgaagttgccaaagaccttgggatatcacaggcccaggtaagccgccttgaaaaatgtgccttgcgtgatatgaaaagacacctttgctgatatgcgtaatataataatataagcacttaatcaggtattataatgcgtctatgtgaacttaaaggaaaaaccgtaataaacgataccgactgctgcatattaggttttgtggttgatattgatttcgacccgtcatcaggctgcatactggcactcattgtccccggtcccgccagattatgcggactgcttggaagagattttgaatatgtaattcctttcaaatgcatccgcacaatcggacctgatattatacttgtaagtatttgtcctgaaaaggttaagcaaaaatgtatctgaccagtattgaaaatcctttacttatgctataaaatagtaatatatatgttttacggaggcggataatcatggataagaaatatgtagcttatgcaggcagctatacacacgaaagcagtaagggtatccatatatatgactgtgatgtagctaaaggaagaataacagaacgtgaagaggtggcaattgataacccttctttcattgcattttcacatgataagaatttcttatactctatatgtgaccagggtgtttcagcttatgctgtattagaagatggaagtcttgagcttatgaatgttgcgtccattaacggaatgcgtggctgtcatatatgcgtaacaagtgataacagattccttgttgtttccggatatcatgacggcaagattactgttttgcacatcaatgctgatggttcagcgggatttatagctgatgaaatatttcataaaggaatcggaagtgttgccgaaagaaacttccgtcctcatataagctggagcacattcacacctgacgaagaacttttatgtgtatgtgaccctggaattgaccagattaagctttatgaattcaatcatgtaaccggtaaattaaagttatacgatataatccgttcacagcaggaatctgcaccaagacagattgaattcagtcaggatggtaagtttgcttatgttgtctgcgaaatgaagaattatattaatgtatattcttatgataagaattcagacaaagaccgttttgatttagtacagaatatattcactgtaagaagagaccataaatctaacagtgccgctgctaacataacatttgacagcacaggaaagcatctgctctgctctaacgccggcgataatacagttacaatatacaaggttgattccaaaacaggaaagctctcaagccttaattctctccctatcagtggtgattatcctaagtacataaggctcttccctgacgacaagcatttaatgtcaatgaataatgaagggaattctattacaatatttactgtaaaatacgacaaagggcttataataatgaatggtccggagcttaagatttcaagacctaataatatgataattaaagaacttaagtaaatgtgtctttgacacatatattaaaatggctgccgtttagtaacgacagccattaatttttatgaatatttctcttcacagtacttacatctgtaaacctgcttttcctcatcagcaagtacgaacacctgctttaagccctgctcgatagatgtgatacatcttggattcttacatttgataatattagtaacctgctttggaagagatagtctcttcttctctactatttcaccattcttaataatatttacagtaatgttatggtcaacgaatcctaaaacatcaagatcaacaagatcaagaccaccttcaatcttaataatgtctttctttcccatcttaccacttcttgcattcttaataatagcaacctgacagtcaagcttatcaagtcctaagtaattgtatatcatcatggcctttcctgcttcaatatggtcaagaacaaagccttcattaagttcgcctacatttaacataaattttcctccttatgcatccagtgaatcaagtacatgcgctaatgatggattaaccactgtatcaagtccaagtaaagtaagtataagtgccattcttacatatacaccaaactgaacctgcttgaaataagcagctctgtcatcattgtcaacgtcaacagatatttcattaactcttggaagcggatgaagaacatacatatcaggctttccaagtgccatcttatcttcatcaagtatatagaaatctttcattcttaaatattcatcttcactgaagaatctttctctctgtactcttgtcatatagagaatatcaagctcaggcatagcctgttcaagattctcaacttctacgaaatcgcagttattagccttaagcacatcatccctgatataatcaggaattcttaactccttaggcgatataaggacaaactttacattcttgtatctaactaatgaacttataagtgagtgaactgttcttccgaacttaaggtcaccacataaaccgatagtaaagttatcgagtgaaccacgaagctcccttattgtcataagatcagtaagtgtctgtgtaggatgctgatgtccaccatcacctgcattaataatagggatgtgtgaatactcggaagctaccatcggagcaccttcctttggatgacgcattgcacatatatctgcataacaagagataactcttatagtatctgcaacactttcaccctttgacgctgagcttgaagaagcctcagaaaagcctaatacctgaccgccaaggttaatcatggcagcctcgaagcttaatcttgttctagtacttggctcatagaacaatgtggctatcttctttccatcacatacatgaccatactttgatggatcctttgaaatgtctcttgcaagatctaataatcttgccagttcatcaacgcttaaatcaagcggactaagtaaatgtctcataatagaaaagcctccgtgtgtatatttaattaaaataattactctgttctgctgtatttttctgactgaaccttaataagttctgcatcattaaaataatcaatcttcatagcagccttgacatcatcaagagtgtcctgtgcaacagcgtaagccgcttctgtacctctcttaaggatattatatacttctggaatatccttttcatattcatgtcttcttgctctgattggttcaagctccttgttgataacattaagaaggaacttcttaaccttaacatctccaagaccacctcttctgtaatgatcctttaattcatcaagattcttataatcaggaaggaattcagcaaaatcctcatcactgctgaaagcatcaaggtaagtaaatactgtgttaccctcaacctgtccaggatcagatacctgaatatggttagggtctgtgtacatactcataacctttttcttaacttcctctggagtgtcagataagtagatgcagtttcctaatgacttgctcatcttagccttaccatcagtaccaggaagtcttaaacatgccttattatccggaagaagaatttctggttcaaccaatgcttctccatatacagaattaaactttcttacaatctcacgacactgctcaatcataggctcctgatcttctcctacaggaacagtagtagccttaaatgcagtaatatctgctgcctggcttataggataacagaaaaatcctaccggaatactcgcctcaaaattacgcatctgaatctcagatttaactgtagggtttctctgaagtcttgaaactgtaacgaggttcatataataaaatgtaagctctgtaagctgtgaaatctgtgactggataaatatattagacttagctggatcaataccaactgaaagataatcgagtgcaacctcgataatgttctgtcttactttctctggattatcagcattatctgttaatgcctgtgcatccgcaatcataataaaaatcttctcatattcacctgaattctgtaattcaactcttcgctttaaagatccaacataatgacctaagtgaagtcttccggttggtctgtcacctgttaatataatcttagacataagcgccacctttcctcatcccaaaatcgtaaaaattatatcatacttttacgcaaatggcaaaatagtttaatataaattggcagaataactgcaattcctgcaaggaatgtaagtccctcattccagcacactgcatcaaagccaaaatgtggtatcagaagcacagcaacagccgcccttccagccatctcagcaagtcctgagagaatagaatatttgccatagcccataccctgaactgaataccttgcagtaaataaaagtgccagttctgcattaaacacacttatgtatcttataaacttcacagtgtaaccgacaacaactgtatcagctgcatcaacgaatataagtgccatatatctgccggtaaagaaacatactatcatagtgattacagaataaataagaccaatctctaaagttctcttaaatccttcactgatacggtcaaatctcttagctccgaaattctgtccgataaatgatgaaagagctgttcccaacgcatttaacggacacagaatcagattcttaatcttatatccggatgtaaatcctgcaatggcgtcttctccaagtgcatttacataaaattgcagaataattgcgccaattgcagtaatagaatactgcagtcccattggcatgcacattttaataatgttcttcatgtaatacggatggaactttctttcatctgcattaactggaaataacagtttgtacttcttaaagatgtatacagcactaagaacgcctgcaattccctgtgaaaatatagtagcaactgcagctccggcaacaccccatttcacaacaacaaccagaaacagatcaagaaatatattaataacagttgatactgccataaacattgttgactttttgctgtctccaaatgccatcagaatcccaaaacagaagttatacagaaccgtcaacggaagtcctaagaatataataacaagatacacatgtgcatccttaaatatattttcaggtgtctttaaccacgttaaaaagagtccactcatagacgctgtaactgctgtcataataaccgcgattgcaagcgcaaagtagactccattaacaaaatattttcttaaatcatcattctttcctgctccaaatgcctgtgacacaggaacacttattcctatacatgaacctatacagaaataacatacaatatacgtaagagaagaagttgcgccaactgctgccagtgccttagagcttaagaactgtccaacaattgctgcatctgcaatattataaagctgttgcagaagctgacccaaaagcaccggtcctgcaaatgataataaaatccttgttatcggtccattagtcatttttgtattatcaagtgtttctgtcctgctcatatatatctcccatattgaattaaatataaatcattcaatattatagacttacagacaaaaaaagcaagaaatattataagttagttttcttttttctgcacataactataattcttgatattaacagtataattaatgtaccagcaacagctccacacccatcaatcagcacatctgtaatccttccactccttcctgacacaaacagctggtgaatttcatctgttgctgcatatattaccgccgtacatattgcagttaatccattcttccacctgataaaacctggtgtcactgctcccagcacacatcctgcaagaattgcatattctgttgcatgagctgtttttcttactggataatcaatcttttttgccatatcaacctgctcatattcttgcagattatcaaaaccgggtacaaatatattacacactgtcattccaactttaatactctggttttctgattcatctcctggttttgccgaaaaagcaaatattactatcgcccagataagtgcaattatcaaaaaaatcatttttctaatattataattcatagtaacccttaatccttacctaaaaaaatccggcataagccggattgaatataataaaatgagcagcactataagccgggttatgtcagcataagctgtgatgatcatctatctagtcctgctgttgccagcaggctcaagcgacctacctaaagcttggcgggcagcctttatatcgcttttatttggtcttgcttcgaatggggtttacatgtgccactgctgttaccagcaatgcggtagtctcttacactgcctttccacccttaccatagctttcgccatggcggtatatttctgttgcactggccttggagttgcctccaccggacgttatccggcatcctgccctgtgaagcccggactttcctcacctgcacgaatgcagccgcgatcatctgtgctactcataatatttagttgtttttgctttcgtctactatctggtaaacttctatcttaaactgatcttctttactaataccaacaaatctacagccgtatgttgtctctgtatcccctgaattactcattcgtataatttctattacagttgcaagtcgttctttattggcaagtataacaattgtatcgtaataagtattaggtttaaacttataatcagacttaaatgccatgccatcttttgatatattaatgacattcacgtctacggtatcaccagcatacccagaaacatatttatcatcaagctgtcttaatgatatataaacattgacatcagttcttcttgattttctcttttcaatccccatgattccctctgtactgtacaggattatacctgttctctttcatttaatccatataatgatatcattaacttattggaagttcaaatatattttttatatacctttattactccattaattatattgtgttaaaatatttttaccatcacatcgtaacagagcagaaccccctcggcttaaacggcaccaagggggttcgtctgtgttcatgagtcattttactcatttaatatatcattttttatttttatgttcaagtcttttctataaatatatattatttgtaaattatcatttaataaacatagcatctccaaaactgaagaatctgtatttctcctgcaccgcaacttcatatgcatgaagcacatgttctcttcctgcaagtgctgataccagcataacaagtgttgattctggaagatggaaattagttataagacaatcgattgccttgaacttatatcccggatatatgaatatctctgtccatccactcttggctggaattgttccatcttcaagtgcgactgactcaagagttcttgtgcttgttgttccaacagcaattaccctgccgccattttttcttgtattattgatcatatctgcagcttcctgtgtaacaacataaaactccgaatgcatatgatggtcaagaatattctctaccttgacaggtctgaatgttccaagtcccacatgaagtgttactcttgcaatattaactcccatggccttgattttttcaagtagctctgttgtaaaatgtaatccggcagtaggcgctgctgcagagccttcatgctttgcatatactgtctgatatctgttcttatcttcaagtttatgtgttatatatggtggaagtggcatctgtccaagctcatcaagaatctcttcaaatattccatcatatgtgaactggataagtctgtttccttcttcaactatatcaataatctctcctataagcttgccttcgccaaaacttatcttagcaccaaccttagccttctttcccggcttaacaagaacttcccatgtatcctgtctgtcttcaagtctttttagaagaagcacttcaatagtagctcctgtatcagccttagtacctataagtctcgctggtattaccttagtgtcattaacaacaagacaatcacccggcctaagataatctacgatatctctgaatatcttatgttcaatctctcctgtttctttatcaagcaccataagtcttgaacttgatctgtcagacaaaggatcctgcgcaataagctcctctggcagatcataataaaaatcatgtaaatccatgtactactcctttcaaagcaaaggggcggcgccacacgccgcccctttaccgaccactgcaacagctgggtctgtattactttctaagttcgattccgtcagcctcaagatccttgaatatcttctccattactggtgtgatatccttatcctcaagtgtcctgtccttagctctgaatgcgattgagtaagcaactgacttgaagccttctttaatctggcttccttcgtagatatcgaagaggttgtagctttctaatatcttgccgccgcgcttttcaataatcttctcaacttcaccaactggaagttccttaggcattaccatactgatatctcttgttacagctgggaactttgcaattcctgtgaacttcttatcgaagcttgccatttctgtaactgttggaatatcaataacaacaatatatgttctctcaccgattgagtaagtatcggcaacatccggatgaagttctccgatgtaaccaatcttcttatcagcgtaatatacatcagcctgacggcctggatgtaaaaatggaataccagccttagcatcatatgttggcttcttcttcattccaatcttctcaaggaattcttcaataacacccttcattgagtagaagtcaacgctgccgaaagctccgagtgtgaattcaactctttcgtccggaagctcgttaacatcatctgctgcaaggtaaatcttagccaattcatataacttaacattcttgtttcttctgttatagttagtagataaagatgtaagcattccgtgaattggaagtgttctcataaccgagaaatcctctcctaatggattagagattacaactgtctttctgtatacagaatcagcaggaagttttaacttatcgaataccttagggctctcgaatgagtatgtcatagcctgtgagaatcctgtaaactgggcaacctcagaagctgcatcttcaatactctgctcaaatgaaatcttacccattgttgtctctcccttaggaagagttgtaggaatgttgtcatatccgaagaatcttgcaacttcctctgccatatccgcgtctctgttaagatcctgtctaaatgttgggataataagctcattagcatctttatcatattcaacttcaagtctttcaaagtaagaaagcatatcttcatctgatacattagtaccaagtaaagcattgtatttagccggctcaaatggaagtctcttcttagttacagggtcaggatatacatcaaccacgcctcctacaacatcacctgcatcaagctcttcaataagctggcatgctctgttgatagcctccattgcgttctctggatcaagtcccttctcaaatttaccagaagcgtctgttcttaaaccaatcttcttagttgtctttctgatgttagttccgtcaaatgtagctgcttcaaaaagcattgtctggacatcatcagtaatcattgaattctcgccacccatgatacctgcgataccaactggtttctcaccatcacagataagaagtgtctgtgcgtcaagagttctctcctgtccgtcaagtgttacgaacttttcgccatcagttgctgttcttacaacaatcttgtgacctgcaatagtatcatagtcatatgcatgcattggctgaccatattcttccataacatagttagtgatatcaacaatgttgttgattggtctgatacctgctgtcataagtctttgctgcatccactttggagatggagcaagtctgatattcttaacaactcttgcaacatatcttgagcaaagctccttagcttcaatatcaactgaaaccattgtgttaacatcctcatcgttacctgtcttagtaacaaccggtggattgaaaggctttctgaatgtagcagcagcctctcttgcgataccgataacgctgtagcagtctacacggttattagtaatctcatattcaaatactgtatcattaagtcctaagtactctaccgcacttgaaccaacaacagcatcatctccaaatatatatattccttcctctggtgcatccgggaagaattctcttgaagaaccaagttcctcgatagagcacatcataccgcatgactccacgcctcttaacttgcccttcttaatcttaattccgtcttctggaagtgcgccgccgtcatgtcctccagcaactttacctccgtctaatactacaggaaccttctgtccacttgaaccaacttcaatattaggtgcacctgttacaatctggacattctcgctgccaacattaacctgacatattacaagcttgtctgcatcaggatgtctctcaactgagagaatctgtccaactacgattttatcaaggttcttgtcaaatgcattaaaacactccaccttagttcctgaaagtgtcatagcatctctgaattcctgatctgtacactcaagacctggaaccattgcttttatccaatttaatgatgtattcatatcgtcattctccttaaatatactttatcttattccagtcgttagaccactatatgaatcgatttagaactgctttataaatctgatatcgttctcataaagaagtctcatgtcatcgatttcgtacttaagaagagcaactctctcaagtcctacaccaaaggcaaatcctgtatattcttccttatcaattccacaaagctcgaatacatgtgggtgaaccattccacagccgaggatttcaatccatccctcgcccttacagaaacggcatcctttaccaccacatttgaaacagcttacatccatctcggcactaggctcagtgaatgggaaatgatgtggtctgaatttaactttagtatcaggtccgaaaagctccttagcgaattctgctaaagttcccttaaggtctgcaaatgtgattcccttatcaattacaagaccttctacctgatggaagcatggtgaatgtgtagcatcaacttcatctgctctgtatacacgtcctggagaaatcattctgatagggagcttgcccttctccataactcttgcctgaacaggggaagtctgtgtacggagtactatcttatcattaatgtagaatgtatcctgttcatccttagccgggtggttagctggtatgttaagtgcctcaaagttgtagtaatcatactcaacttctggtccatcaactacttcataacccattccgatgaatatcttctggatttcttctaatgcaagtgtattaggatgcttatgtcctaactcatccctcttagatggaagagtaacatctattacttcactctttaactgaagttctctcttcttggcagctaattctgtcttagccttatctaatacttcttcaattgcctgtcttgtctcattaacaatctgaccaaccttaggtctgtcttctggtgcaacttccttcatacctttaagtacttctgtaagttcacccttctttccaaggaaagcgactctgatatcattcagtttatcaagcgaatcagtttcattaatctgtgctaaagctctttctctaattgcttcaagtctttctttcatccttatagcctccatacttctttcgctttttatcattcatatgcgtaaaaagccactgtttattgtaacatatcaattttattttgcaacccgtgaatgtcgcttctcatacatttcaattacgcgcattgcaccatcgctgtgtgccggatttgaaagcgttatctttttaatattttcctttgcttcatcaatacgtttttcattgtactctatctgctgccttaatttataacggcgagtatttatttcatgccgcacttcaaccatttccttaggattaatgattgccctcactcttccaagccatatatgtggactgtaaagtcctaaattcttaagcatattctcaagctcattttcagcagaattaagtgatgatgtcatatcaagcattctaatctgctcttttttcatctcctcgtacagtctgtatttcttatcaagttcatatgaacttttaactccgaactttgtatattcataatccagcgtatttgctgcattaatgaacttaatctttactttgttaagcagtgctgtagctttattaagttttatttcggttataatcacatttctttcagtaacctttaataaagcaaacattccaactgcaagaattgctgcaaataaagatattcctataaaaagtaccgtatcactgtcattttgaacaagtgtcatcgatataagaaatactgcaaacactgccgcaagcgcaaagattgctgttttcgcaagccttcttatcttaatctgtcttgtaacaagaacgtccgcatcagttctaagattaagctgttctgcctcaagtatccttaaatctctcttaacagtatcataataatcttcggatgctttcaaaagctttattccacctggcatttcattttccacagcttccatgcgcctgtatgccgcatttgacagcttatgttctgtacttttaagaatacgcctgtcaaccatcatgttgtctatggtctctgcacaactcaatattttatcacgtatctgtgtgggagcttcttccataatctgtatatcattatattcttcagtaacagcctcatactcagctttagcattttctacatgtgtcgctgcttcttccatgatatcacactgttctcttacataaacctcaatatcatgtgtactgaaatcctttatattgacactgtctatattcctgctcatcgcatattctgcaattttatcaaggtcggatttttcctttggaagctcaataggtatagcatctatctctttgcggtcttcctcatcctttccatatttctcaactgccttgataagcgtctgtgcctgcatactgtttaacagatgatcatatttttcttcttctatcttggcctgctgctgtttttcctttgttttctcatcaagttctccgctcttgcggtcttcatgttttttcttattcttcttatcaaacgtttcatatatattcaatatattaaacattttattggcagttttttccttctctgcctcttctagcagttcctcatctctgtacgattcatcatcataatcatcatatatcgtttctttttcagcttttttaaatattcccatatatccaccacaattctttaaaatgttttgctatatttaatgtatgccgttctccacctgtcaagtctttcatctaccgccctgttgtactgtgccagattgccatctgcttttaatctggcaatatcttcaagttccctatattcatcactatatctggcattatccattaaagtttccaattccttctggacaacatattcatcttcatccgcatcaacattaacaggttctttatccttctttgccataattaaagctgctatactgcatttttttgattcctcatgctgacccgtcctatatgcctcatcataatatatcaccgctttatcatacataaacattcttgcataggcagttcccagattatgataaacttttgcataatcagctgccaacaaatcttttcccttgtaatcttttataattgactcgtaacatctgaccgaggcaaaataatatccagcattgagatatccgtctcctcttgctttaagcctttcgcatacgctctgctttccaagagtattaagaatcccttttaactgctcaatctctgcaacagaataataatctattgtcttgagtattattacaaatatctgtgctaatgaacctcctgtttctttcagcttccttactctttctgccagctctttttctccggtttcatcaagaaaactgataagattatcatctataaaatcctgtccaatcagatatatattattataaatataataacagagttcttctgctgtatataacttcacacctgtctgtaaaacagtcagtggtgtatctgccttctttcctctgcacagtattattttccccattgtatttctccgtttcctgatgttttccacattctcagcttcttaatacaagttctttgcttataacttttcctgaacttttgacaaactcgccaaatccaagatcttttattgtaatattacacctgtcagaatccgtaaagcttacgctcacagatactcttgttgttttcccttccctgaatggaatttcacttatatcaacaacttcatcataatatttattctcaggtgttattattttaaatgtaatgcttctcatatcctcaagtatacattccacagtccgtccggcagtataccagttacttcccggtcttaccagcctgaatctcattggcttttcatatgacgaaatatctatttctataccacatttcacatgattatcaagaagcattatgacattcttaaacacttccggcttcaatatctccattgccgcaaagcatgcaccctttgcaaaaagattctgtccgacaaatgcttttcttctcgtaaccataagctttgcaaatctttcaggaagcttttcaacatcaaaaccttcacctgtaagatatgccgccgaaacatgtcttttagaaaaatactcttctgcaaatgtacacaactcattctcagccagtccaagttctttgcttatcacagctttttttaatatatcagatgtgtatcctgtatgttcctgaagcagatagttactattgtcattcttcctgactgcaagataatcacaccttattccttcacttgtgtagtcaaacagtgccacaccagcagcatgaagctcacttttctgtctgtacgcataatatgcaaagctttcaactctgcttaatacctgccctctgccatctgatacaccacattttttaagagtatccctgacagcagatatttcatcagaatgataatcgggaatggttacacatatgctttgaatctgtgatgtacctgttgcccgcatacattcagcgacaacatttgcaagactggtcttttcctttgaatcctctgtcagttttaccgtctgcacattccgtgaattatatgaatatacacttgcctgaattttactatatcctatatctattcctgctataagtcctttacactgctccatatctgctatcctcatttgacaattgtaaacatttctcttgtaacgtattcctcaacacagtaactatacatgagctttcttaatgttgtaaggtcatgctgctgtctgcttgcaagacaatcattaagcatgtcaatccttccatctgtgttctctgatggaatatccttatattcgcagactaccggctctgtagatgtctgttcattgctgtcattaactataaatgtatattctaatgaatccccataaaacagattaaacctgcatgtaaatattccccattcgttagacttcataacctgcaccagcctgtcatccccattaatactatatgtcaaagatactttatcatctggatctgctatgtattcaacaatagtaagtccctgcatattgtatggtaaatccagtattcctttgaattttttgaaaaatccatatattctgtcatgttcacataattcattaagaactgattgtgcaagttctttttcagatgtatcttctcttaacgcaacagggtttcttgacagattcttaagccatgctacataacaacactctggcaatccatatccatcccccatacactcctctataactctgaatactatatcattagccttcttctgcctgagaagatagaattgtgaattataagataaatatgcctttactataagcatatcaggaatcttactataataatcagcaaacacctctgtaaatcttccagtatgcacacctgtatacatcatctgggcaagaatcctttctgacatatgcaatacatttacattataattaactgctgacttccacacagcatacatttcatcattagtcccattatagtattcacacatataagaaagaacatgttcattataaatgttgtgtctgaatatatattgagtaatctcatcaataatctgactatgtccgtctgatacatttgtaagaatatagtcagtcattttaagaagttttgctgcttttgccatacagcaaccgtatatacctgctatctcatatgcctgtgaatacattgatgaatctataagtatctctatcagctttcccgcatccttcttcgtcagattatctgtatcaacataattgtattcatgccagaaatcatcttcttcataataatgatagtaataatcaatcatccaggcattaacctgctgtttatactgttcactgataccctgttccttttttattgttttgtacagcttaagtgtttcttgtgtattctgtgaattctttctcatttcacagattctgctcataattattctggaattgttctttccataatcacctgcagcctcaaacacctctgcatactgctgtatatcaaacactttttctatatcataatcaattgtatcttttctaatctgtccgtcaatacattcaaatgtaatctcgcagtcacttccatacatacatatatatgctgtttcccctgaaagctcatatactgtttcttctgtaaactgcggatatctgacatgtacatatcttaccacatcactaaagcactgcattctgtacatatatggcattttacttacaaatgtgcccgtgtcatcacacacaagctgtgtcttaagaagtgccttgtataatacaacaagattgtcactgatattgccggctttaagctgttcatacacatatatctctatatttctttcataaccttcatagatattcttatagtacgaatctctgcccgtcaccacatttgcatataaaaatgctttatcttcatctgcaagagtattgtcatatgcaaaatacatcaacactatctttggcagctgcctgtctgtctttttaggcatactggcaatataaaactcatataatcttgttattttcagacctcttaatacccctttttcatatatctcaaagcagttttctcctgtcatgcccattcttaccatttgggttacaagaactgtcagtatctcgtctttctcatatttatcatatatcttttttagtataataagagtattaatattaatattcttctcattagccacaacatctgcaatctgcattgcaagcttctcgctaataatgtcgttcctgcatccataattaataacctgcatttcaaactgattaagcacccgtagtaaaacaggctgtgcattaataatgttcatagcctcaatatacataacagggcttatgcatcctgaattaattacatcctttattcttacaagtcttatactcttattatctgaatctgtactcaagtaaaaaagtatccataatattctatatgtatcatagccattctcaaagaacttcttaacctgtgataaaacctgagccgtatactcctcttcacgcacaataagtgtcgaaacatacagaaaatagcagtaaagttctacattttcaccaattcttccgactatatctttcttgatattattatatatctgtgttgctgtttcctctcttccagacgccataagcagttgtatctgcacaatatcataaaatacatctgtgcccttaattccccttattctgtcaactgtctgcatagattcagcaatccatttttctttcttgattttcttcattctgaaatcaagataaagcttcgtaagcttatattgtgccagtttttcttctcttctgacttcaaaatcttccgattcgtcagctttcttacatataacactcacatttatctttaaatgctgcgtataacttactatatgtatatatccatagttgttgcctgcatgcattttctgtggattaactatatatttaattacagccctgtcacctgcaaaatcatcagttgataagctgcctttctctaattcaataaaatctgcatctgcatatatatcaatctctgtttcttctgtgccactctttataagcacacattcaaactgctctgcttcatctttgtgtataattgtattctcttcgttatcaatgtgtagaacaactgcttcagtcttaacatgatttcttatatcatcctgattctctttcatacatctgaatacaaatggtatctttttctcgccggcattacatactactgtaaatgttccctctatctcatcattttcttcaagtccggaagcgtccacctgatattcagttataatatgcgtaccaccaaattgttctgaaagaatctttaccctctcattgtcagcatagaccattccataaaccttatcggtggcatcacatatgaagctgcctgtagcaactgtattacacataatatccatggtaatctgttcctcactgcatgacagctttggtactttgataattgaactgcctcttgaaagtctgtttatgtaatccctcattggaaactatgcctccgacttaatcttatccaaatgtttcttaatatccctctcatatcccatatctcccggctcatagaatttctcattcacataagcatccggaagatactgctgtctgacgtaatgattaggataatcatgtgcatataagtatcctacaccgtgtcctaacttggaactacccttataatgggcatcctgcaaatgtacaggaaccggtgcagtctttgaattcttaacaacatccattgctttatcaatagccttgatacaggaattgctcttaggtgctgtcgcaatataaagtgcagcctgactaagtataattctcgcctccggcatgccgatacgctcaacagcctgtgccgcagctactgcaacctgcagtgcattaggatcagcattgccgacatcctcactggcacatatcattattcgtcttgcaatgaatttgatatcttcaccagcatacagcatcttggcaagataatagcttactgcatcaggatcagaccctctcatactcttaataaacgctgatattgtatcgtagtggttgtcgccctctttatcatatcttaccgaacgcttctgtatacattcctgtgctgttgcaatgtctatatgtataactccatcctctgatctgtctgttgtaagtattccaagttcaatggcgttaagcgcatttctcgcatctccattggatatatccgcaagaaattcaagtgcatcatcgtctattgctgcattgtagcttcccatgcccttcttctcatcatacacagcacgttttataattgtcttgatatcgtctttctcaagtggttttaattcaaatattattgaccttgatattaaagctccattcacttcaaagtacggattctctgtcgttgcaccaataagaattattgttccatcctcaacaaatggaagcagataatcctgctgtcccttattaaagcggtgaatctcgtctacgaaaagaatggtctttcttccatacattccaagattgtctttcgccttggcaacaacctcttccatatccttctttccggcaactgtggcattaacctgattaaactctgcacttgttgtattagcaattattctagctaaagttgtctttcctgttccaggtggaccatagaatattactgagctaagcttatctgccttaattgccctgtaaagcagtttgtcctttccgattatatgagactgtcctaccatttcatcgagtgtttccggtcttaatctcatagccaatggagattctgtattcttattgttttcacgcatatattcaaataaatccataacttatacctgtcttaatacatttgcaattatcttagttctgttccaagccacaatctttcaacgtagcctatattgctgatatcatttcccttcagtgtattagaataaagaatattatcagcatcatacgcatagattcggttcttgtaaaaatatgttccctctgtatctgtaactgcatctgattccagaattgcaacagctttgctcttaatgttatccatataaaactgcctgccgcctgaaacatatgttaaagccttacttttattatacactttagataatgaacctgcattaacatctgacgcaatgtctgtaatcttgttgttatcaactactcgaagctgtcctttcgcattaacatacactatctgactatctgatgaattatatatgtaattcttttccttagtcatagaatcaacatccacatactcactcactttagtttctctgataagtgctgatgtcattgatgtacctgaaattctgtatataagcgaattgtctctatcaaatacataatctgcatcattgtctgtcttcttgtctatcttatacgcagatgcatctttacatgagtaataatatactccatcactcttagaatacagcaatgtatccacatcttttcttgtgttaagactgtctgcattcgctgtatacacacctgtcatgttctctgacacaggccataactgcataactgcatctgcaactgaaaccggcttttcttttttctcataatcatatgtatacaatgagcctgcattagtaagacatactatcaagtgctttgactcatacacatatgccttattaagattaccctctataagagttgtctgtgcctcaggctgtttcttaacttctttgactctgctcatggcaaggcttgtaccattagtagaaccctcgtcattaataatattaatattcgtgtatataacaagaccgtcatcagagatatacacaatctctttctgcagattatcttctgacacaagaacacattcgtccttactccatatgtacattgaatatctgccagacgagttggactcatcatatgttaccgtaacgaaatactttccattgtcactcgcaacgcttaagatattcttacctgaatctatctgttccggccactgtgctgtatagaaggtcttactgtctgccgcaaatattgcatcactttcatcacacacataattgctgtccagccctgctatatcatatatctttccgttgtagcttacataaagagcataattcttcttagttgcaagcttgtatattccaaatgctgcgacaccaataagcactactgctatcagcgctgccgctatcattttcattcttttgtttactttatgtcgtgcaattcttatctgtggcttttcctgattaccattcctgttgccacctgtttttccgctactttgtccctgctttctgctgtccgctttgcttctgttctgactctgcttcttactttctgtcttgtttctgctctgattctttatcgcctgcacgcgttttgctaatgcctgtccatagtcactctgtgattcctcttttttatcagaagaagcagacctctctttcaaagcctgcttctcctcatatgcttttcttctggcaagataatcactgttgttaactaatataacaggtccatcacatcttgggcactgactgccctcatattcctgaccacatttagtacacagcataattctttccttttaattatcgatttaaattccgttcttttattaattaaaatctgaacttatcttcaaaatacgccttaagatctgctatctttattctttcctgctgcattgtatctctgtctcttacagttacagcaccatcttcttctgaatcgaaatcatatgtgatacagaatggagtaccaatctcatcctgtcttctgtatctctttccaatattacctctgtcatcaaactcacaattgtaatacttagaaagttctgcatacaccttttctgcaccttcatttaacttcttagaaagtggaagaatacctatcttaactggtgctaatgcagggtggaaatgaagaaccgttcttacatctccgccttcaagctcttcctcatcataagctgagcaaaggaatgctaatgttacacgatccgcaccaagtgaaggctcaataacatatggtatatacttctccttagcttcatcatcaaagtatgacatatcttcaccagatactgtctgatgctgagtaaggtcataatctgttctgtctgcaataccccagagctcgccccatccgaatgggaagaggaattcgatatctgttgttcccttagagtagaaacagagttcttctggcgaatgatctcttgctctcatctcatcttccttcattcctaatgccttaagccagtcaatgcaatactgtctccagtatgtgaaccactcaagatctgttccaggcttgcagaagaactctaattccatctgctcgaactctcttgttctgaatgtgaagttacctggtgtaatctcgttacggaatgacttaccaatctgtccaataccaaaaggtactttctttcttgatgttctctgaacattcttgaagttaacaaagataccctgagctgtctctggtcttaaatatactgtgttcttggcatcctcagttacaccctggaatgtcttaaacataaggttaaactgtcttatatctgtgaaattgtgctttccacatgaaggacagcagatattcttctcatcgatgaaattcttcatctgctcctgtgtccatccatcaactgaaccgccgagatcatatgaattctcgtctgcccagtcttctataagtttatctgctctgaatctctcatgacattccttgcagtccattaatggatcagaaaatccaccaagatgacctgatgctacccaagtctgagggttcataagaattgcacagtcaactcctacattgtatggactttcctgtacgaacttctgccaccatgccttcttaacattgttctttaactcaacaccaaggttgccataatcccatgtattagctaatccaccatagatttcagaacctgggtaaacaaatcctcttgccttagctaaagaaacaattttctccattgtcttttccataataatataatcctcctaaaggcaacagcctgactacatcgaactgcatcggctgctacataatcttaatcattttataacatttagtgctgattagcaagaggttgatgggaatcttgttttggacttcctccgtgcttcccaccgcttcaacgtccaatctgccgcttctgcaaatccattttggacttcctccgtgcttcccgatgcttcaacatccaatccgccgcttctgcaaatcccttttggacttcctccgtgcttcccgccgcttcaacgtccaatccaccgctctttctcattccttttggactttctcccgccttcccaccgcttcaacgtccaatccgccgctctctctcactccttttggactttctcccgccttcccgccacttcaacgtccaatctgccgcttccacgcatgcatttgttgcttgtgaatattttataaattatcgcttgactttaatatcagaatattttatattcttattataaccacgacgcattagaaggaggatatttcttgtttatcaattacaacatttcagagattatcagccagctttcatctgccatacattatgatgaaagcattgtaaagaatctacctgatggcaagctcaattgcacacataatggacgttatattaagtggtttctaagcgatgggaataatatatcttacatacacaagaaagacagacagcttgcttccaagcttgccttgaagaaatttttgttatcaagaattgaagataataaaaggcttctttccacatacaagcaatgtaacagcaccaatatccaatccgaattattattaaaagataacgattttaggaaactgcttacagactatccagagaattccaagcatatatattgcaaccgggatttattcagagatttccacaatgaacagtttcagcctgtcattgattcatggctgtctgaagaatataatcacaacgaatcatacccacaagcgcttaagcatccatgtacatccggcaatgtcgtcaggtcgaagtccgaagctgtgattgatttattacttaaccagtatggaattccatacaggtatgaatgtgaactaaagcttgacaacataagcttctatcctgactttacactgtttaaccctgtatctggacagcttgtttactgggaacattttggcatgatggatgacccgcaatactctcttaatgcttcaagaaaaatatccagatacatagctgggaatattattccgggaattaatttaataatgacatttgaaacatcttccaatccactatcaggagttattgcagagtcaaagatagaggagtacctgctgatatgcaacaatcagcaagccccctcttaacaccgtagcaattttattcaattacaaccatatttgccaccaggtttcccataatagcaattcaacataactatgcattaatcctcccatggacgaatcctgtaagcagcccctatctcatcacatagcttctggcactctgcctcttcctcgtgagatatggttgtgtcaactgttgtaagaacaacattagggatatacctggtacattcctttgcgaagcttatcatttcatcaaatgatttttcgccgaacttacttcttacaagtgcattgtattcatctttgtgtggattgttaagactgattgatattgtgtcaatcaagccttccatctctggcacaatgtctctgccattaacaagatttccaactccgttagtattgattcttgtctttttgccatatgttttcttgacatactcagcaaccttgataagaacatcaaatctttctgtcggttctccgaatccgcagaatacgacttcttcgtactcatccatattgaacttctcaaattcagcaataacctcatcatatgatggttctctctcaagccagagtctgcctgactctccgattctgtccattgtctgtcttaaacagaaagtacatgaatatggacatttgttagttaaattaacatataaattattatgaaccttatataatatctccattgtaattcttctcctttttacttcaacgtagtcagcagttcctcaaacggcacaccatctgtcagaggaatatccatctctatagccttgagtatgcatttttttataaatgtagatgcttttcttactgactcatggaaattcacaccatttacagcatctgcagctattatagatgcaaatatatctcctgttccggaacgctgtgttccaaccttcatagtcttaataagatagtcttccctgttcttttcgtaacagtaattaccaatataatggccccgctggattcctgtaataacaatcttagatggtcccattgcaacaagcttcattgcaatttttttaagctcatcattggaataatccggtctgtatggctcgtcagttataatacatgcttctgtgaggttcggagtaagaatatctgcatattttacaagcttcttcatctcctggcatgtctcatcagtatatgtcggatacagatttccgtaatcacccataaccgggtcgataacaacaatattatcttcggtcttgaaattcttgaaaaattcttcaacaattgcaatctgattatgtgaacctaagaaccctgttacaattccatcgaatttaaggtttaacttcttccactctgccatataaggcggcatattctctgtgaaatctttaaaataaaagctgtcaaaacctgtatgattagaaaatatcgatgtaggcattggacagcactgaatcttcattgctgatataacaggtagctcaactgcaatagaacatcttccaaaaccagaataatcattaattgctgctattttcttctggttattatgagacacatttttatccggcatattgtctctcctttcgtctgaatgttacataaaatctttaccccttaatatacaaaaaactggcatatgataacatagccagtttatgtaatatttatatggtcagattaagcatttccttcgacttaaattctttatcgaatacaatgctttccagcctgtttaccacaagccttaattcttcctggacttctttggtaacggtgaatgaatacagcctgttaagctgtgctgtgacaatatactggagtgtatataccgttgagcccgaaagtgtaattccatcatatacatttgtggcacaattcttacagcatagtccgtttcttgaatatgaatatacatacagattatcttctcttccgcattcgtgacatgtgaagaaatccggacattcaccgttgactgcaatcattcttatctcgtatatgaatcttataagttcatggcttacagcacctctgcccaatgcctttagagtgatataaagcagattaatcatttctgatgcatcaagattctccctgccataataatctgcaatctcagcaaaatagcaggcgtagcacacggcattaaggtcatttaccacattttcaaagtactccttagctgatgccttatacatcgtatatgaatcgcgtccacggtacacctcaaatgttccgaatataaagcttctcgtaacaccaatcaatgcgctgttaggctttctcgcacctttcgcaaataccgttatcttgccatactccttagtcagtataaccagtcttctgtcatattccccgacaggcatggcggaaagtatcatgcctgtaacagtagtaacctccgccatcgcaccctcctgtcatgtatattatttgtccttcttcttgtcatatccgaagttcttaagaagaatatcactgtcgcgccattccttcttaacttttacccagagcttaagattaaccttcatgtcaagctgcttctcaatctcgtatcttgcattagttccgattttcttaagcatttcaccacccttgccgataataattcctttatgggaatctctttcgcatatgatagtagcgtcgatatctgtaataggacctcttgcatttcttctttccttaaagctgtcaataacaaccgcaattccatgtggaatctcatcatttaatgcatgaagtgccttctctcttataagctctgcaacaatctgcttcattggctggtctgttactgtatcttcatcatagtacatcggaccataatcaagatgtgagaatataacatcaagcaggtcgtcaacattattgccgtttcttgcgcacacaggaacaatatcaacaaaatcaagttcctttctgtagcagtcaataactggaagaatctcctctttcttgattgtgtcagtcttattgataacaagaactataggagttttacattctttaagcttctcaacgatatgctcctcggcagctccaagatgtgttgtaggctcaacaagccagcatataaggtcaacctcactgattgtcttctctgccgcaccaaccatgtattcaccaagcttgttcttagccttgtggatacccggagtatcaacgaaaacaatctgtccacgctcatcagtgtatacagtctgtattctgtttcttgtagtctgaggcttgttagaagtaatcgcaatcttctgtccgattatctgattcataagtgttgacttaccaacattaggtcttcctataaatgttacaaagcctgtcttagttcttgtgttctctgccttagcgcccccggtaattccgctggctgcaagcatctcatctaaattcatacattcttcctttctgttatccctgtaccttgataagtggctgtatcttatcaaaaagctcactctctttattgatttccttgctgcttcccacaacgcagaaataattctcatccattgcacatcttacaagtggagcaagctctcttattctttctacattacagtcaagaacctgacctctttctttcttgagtgactcgtaatctgtattacagatgtatgcgccaaatgatcttgttccctttgctgctggattcataggtgtatccatatcacctattgttccgattatgaacttgaccatatccctgtcgcttacatcaaaatgttcaagatagtctgctgcattttcatatatatcgttagtctttcttaagttagggtctctgtaggaaaccatatacatgtcaccgtttctgtaagaaccgctcatgcagccgtatgcgccgcctttaactctaacattaatccagagataatcatacgagaatataaccttaagcactcttaatgctcctgtgtattcatatcctccatctctgaagttaccacatcttgcaacatactggacctgtgaagctgaagtatatcctgtcttgacatttgcaggtgtgtactttctttcgcatgctggcatgtccgattttttcaattcttccgcatactttccgaaagcaggtgcaaatgcatcatatcccttatcatcagcagtaaagctgacaataatattctctttgtggaatatacaatcgacaagtttgcttaacttatctgcgatatcttccttaagctcatcaaactgtgagtcaagcttctgtataagctcatagaacccatatcctctcatctcgttagaataatatgcatttcttgagaactgtgccatacctgcaagcattgctgttgaatgtcctgcacttgtcattgtgctttccattcttgacttaagcttcgcaattatctctttaagtctcttataatctgagaactttgtcttatatataatttcattcatcatatcaaggacgaactggatattgtcatagagaaccttacccttaacctcatacatgatagtacatttgtcaaaatccttattatctgtgtatatggcagcatcagttgagattccaccacagttaatattgatttcattagtcagctctgtatatgtgtacttttcagtatccataagtccaagaaccgagcttaaaagtccgatatatggaagcagttcatcaggcacattcttacagtcgtagcacatcattatatatgcaattccattagtgaacatattgtggtggattacatcaacaccaccaatcttcttagggtcaatatataacttagccggctctcttgtgatatcctttaactcaagctgtggaatcttctcaagatccttctggcttgaaggcgtatcctgatattcctttaatgcctttgtctgcttaacaagctcttccagttcttccttggaaagtgttgccttatactttgcaagctgctctgcttcctttgcttccttctcctctgcaagtccatgctttggaacaagacttaacactacctcatggttattacctataatattgtcttcaatgaatttctcaaagaagccattctctgaattcttcttgattatttcaaatgtctcacctgcctcaacatgaacaaatggcttgttctcatcataaagccagctgtccatcattgtgagataatacataagtccctttggatatggtccaaaatcagcttctctgtatttgaattcgtaatagttgattcctgccttaaccattctcttgctaagaccgttcttaacaatatcagaaagcgtgtcttcaacaacactcacaaatctgtctctgtcactttcattcgcattcttagtaataattgaatacaccggctgatacacagaagtctctaacacactatacacatctgttccaattccggcatcaataagtgcctgcttaagcggagcacccggtgccatgataagtgcataatcaagaatctgtaatgcaagatagcttactgggtctgttgatgttccgataacaacattgtaagaaagataagtgttatcctcctctggctcatcatcagtaattgcatactctcttgtctcatacttaggtgcgtcaaatgctttctggaaagttacctcggcatctatattgacatcattcttatcaaaagctgagaggtattcgttattaagatattcaagcctctcatcaacatcaatatctccgtacagatagatataactgttcacaggatgataatattccttgtgatacttaatgaaatcttcatacttaagctgtggtatagcctcagggtcaccaccggattcattcttgtattcagaatcagggaagagtgatacaaatgtatatcttgaaagcacatcatctgctgaagaatacacacccttcatctcattaaatacaactccgttataagcaagctctccatctacatcttcaagctcataatgccagccttcctgcttgaatatctcctcatgctcatacattgcaggatagaataccgcatccatatagacatccataatattcttgaaatctgccatattgcagcttgcaacaggatatactgtcttatccggataagtcattgcattaagaaatgtgttaagagaacccttgcatagttctacaaatgggtctttaaccggatattttcttgaaccacacaaggtagaatgttcaattatatgctgtattcccgtgtcattatccggtggtgtcttaaaacctatagaaaataccttgttatcatcatcattagaaataattgcaactctcgcacctgatttcttatgctttaataaaagtcctacagaattaaggtcattaagcttttcaatgttcacaagctcatatgcaccgtaatctttattaagttcgttatatcttgtctctaaattcatattactgctttaatctccaatctttacaataaggaattatacatataaatataataccccacaatgtaggattttaccacattgtggggtgagtgtaaacttacattacatatgtaagctatagtatttatttgccgaaaagacctttcttcttaccgtgtctttcattgcctgtaagcgccttttcatacgccataagtgcgtccttctgctcctgattaagctttgtaggaatatcaactattaaagtgatataatgatcgcctctctgtgctgcatttcttacacttggcatacctttgcctttaagtcttactcttgtacctgatgctgttcccggcttaacttcgtacaatacttctccatcaacagtcttaaccttgatttcaccgccaagtaccgctgttggatagcttattacaacattagagaatatattgtatccgtctctttcaaattctgtgcttgctgagataataacagcaactaagaggtcacctcttggtccgccattaactcccggctcacctttgccctgtatacgtacgcactgaccattatcgatacctgctgggatattgacttcgatagtcttcttgctgcttatatagcctgttccgtaacaatccggacacttctccttaattatcttaccagttccatgacagtcaggacatggctgctggcttcttaccattccaaggaatgactgctgtgtgaaagtcacctgtccacgaccaccacatttgctacaggtctctggtgatgtaccaggcttagctcctgtaccgtgacagcttgagcactcatcctttaatgtaacatctatcttcttggttgttccccttactgactcgtcaaatgtaattcttacattaactcttacatcagcacctcttcttggtccattgctgtttcgtctgcttccgccgcctccgaacataccgccaaagagatctccgaaaatatctcccatgtcaccaaaatcgaaatcgaagccacctgctccagctccacctgctccgccttcaaatgcggcatggccaaactggtcatactgtcttctcttttcagcatcgcttaacaccgcataagcttcagaagcctctttgaattttatttcagcttctttatcccctggattcatatcaggatgatatttctttgcaagttgtctgtatgctttcttaatagcagcgtcatcggcatccttaggcacgccaaggacttcataataatctctcttatctgccatgattgcttcctctttcttatttaatcaacagaaactgcacggagtttacaccccatgcagtccttattccagtcagttattgctgacaattaaacctctttgtaatctccgtcaactacatcatcaccgtatggagctgaaccattagaagcaccagcacccatatcaggacctgcacctgctcccatgtctgggcctgcaccaccagcagcctgctgtgactcatataacttagcgaaaagcttctgagcgctttccataagtttttccttggcagccttgatttcatcaacctgagcatctgtcatgttttctgggtcagaaccatcaacaagtgcctttaatgcgttaagatcagcctcaactgcagccttgtcagaagcatcaagcttgtcgcctgcctcatccatagccttctgtgtctggaataccattgaatcagcttcgttacgtgcatcaatagcatccttacgcttcttatcctgagcctcgaactcagcagcttccttaactgccttatcgatatcttcatcagacatgttagaaccagcagtaattgtgatgtgctgttccttacctgttccaaggtccttagcagatacatttacaataccattggcatcgatatcaaatgtaacttcaatctgtggaacacctcttcttgctggagggataccatcaagtctgaactgtccaagtgacttgttatctctggcaaactgtctttcaccctgtacaacgttgatatcaacggctgtctggttatcagcagctgtagagaaaatctgactcttctttgtaggaatagttgtatttctctcaataagtcttgtagcaataccacccattgtctcgattgaaagtgaaagtggtgttacatcaagaagaaggatatcaccagcaccagcatcaccagctaacttaccaccctggatagaagcacctatagctacgcactcatctgggttaagagtcttgcttggctcatgtcctgttaatgacttaaccttatcctgtacagcagggattcttgtagaaccaccaactaataatacctttgaaagctctgaagctgtaagacctgcatctgaaagtgcattcttaactggctctgcagtcttttctacaaggtcatgtgttaattcatcgaatttagctcttgtaagagtcatctcaaagtgctttggtccttcagctgtagctgtgatgtaaggaagattgatttctgtctgagttgtgcttgaaagttccttcttagccttctcagctgcttccttaagtctctgaagagccattgtatccttagaaaggtcaacgccttccttggccttgaaatcatttaacatatactgtgtaacagcattatcgaaatcatcaccaccaagcttgttattaccagctgtagcaagaacttcaattacaccatcaccgatttcgataatagacacatcgaatgtaccaccacctaaatcgtaaaccataatcttctgctcatgctcattatcaagaccataagctaaagctgctgctgtaggctcgttgataatacgctttacatcaagacctgcaatcttaccagcatccttagtagcctgacgctgtgcatcgttgaagtaagcaggaactgttataactgcctctgtaaccttctcaccaagataattctctgcatctgactttaacttctgtaaaatcatagctgagatttcctgtggagtatatttctttccatcaatctcaaccttgtaatctgtacccatatgtctcttgatagaagagattgtcttatcagcattagtaactgcctgacgctttgcaggatcacctacaagtctctctcctgtctttgaaaatgcaactactgaaggagtagttcttaaaccttctgcgttagcgataacaactggcttaccaccttccattacagctacgcaagaattagttgtacctaaatcaataccaataatctttcccataataaaatgtcctttctataattaaattgattaataccttgtgttacatatgctttctggcttatcgctagttagcaaccttgaccatgctgtgtcttataacctggtctctgtatgtgtagcccttctcaaactcttcaactacgatgttctctccaactgaatcatcctcaacatgcattactgcattgtgaaaatccggattgaactcaccgcctaaagcttcaataggcttaacatctgcatcctcaagcatctttaaaagctgcttgtgaaccatatccattccctttgcgaatggagtttcaagttcctcatctgtcacactcttaaatcctctgtcgaagttatcaacaataggtaaaagcttcttaatgatatctgaggctcccatctcgaacatagtagatttctctttctctgttctctttctgaaattatcaaactcagccatctgcctctttactctgtcctgaagttcttctataactgcatccttaggatccttcttcttagagctctcagtgctctcatcctgtgcctcggccttgtctgattcatcagcttcacatgtattctgactttcatcagccttacattctgattcgcagttgcaggcttcttctttcttagcatcagtctcctgattctttacttcatcctgaactgtctcttctgatttctttttctttacatcctttgacacttcaataccaacctttcctaagttttcttaaatacatcatccaaatgcgtctgcatctcttttaaggtatcaacaaccttttcataatccatacgcttcggtccaataataccaattgttcccttcattccatcctgcaattcatatgtggctgttaccacactacagtccttcatggactcaactggtgtttcatttcctatatatacctgaatgccgtggttatcatcttcagtcttatctgaatcatccttgtcattaacaagtccagacaagccctgtttttcctccaaggcatatataagctcacttgctttcccggaatcactaagctccggatacttgaatatgttagttgcgccgcttgtgtatatcttcaggtcgtcagccttacttatagtctcaacaatcgcgtctaacacttctttaacaatacccatatgctcacctgcctggctctccatcttggatataagtcccagatgcatctcctgcaatgtaagacctgtgagtgttgtattaagaagaagattaagcttcagaagattctctggtgaaatatcctcgctgatagttataaccttgttccttataagattgccttccataacaataactgcaagaagcttattcggttcaagctgtgacagctgaacaaatcttaacttattgccagttaccttaggagttgttatcatcgtggcatagttagtattattcgccagaacctttgctacattctgaagaagttcttccactctgtcaaccttctctgataaggcatccttcatagaatcaagttctttctctttatcaccaacctgctgttctcttaaggatatctcttcctctttctgagccattaaatcatcaacatataatctatagcccttatccgttggaattcttccagcagaggtgtgtggctgtacaatgtagccaagctcttctaagtctgccatctcattccttatagttgctgaacttagctgtaagtcagtcagcttggaaatcgttcttgagccaaccggttctccggtatcaagataattctgaataacagctttaagtatcttaaccttacggtcatccagtcgtccatccgtctccatggcatcctctcctttcatcttgttagcactcattaagttggagtgctaatatcgatacatttaagatatcactaccctaacatgatgtcaacaacaatatttcttttttctataaataatttataaatttattgaacagaatcttaacatactatataattcagctataaatatcattattatatatagagatatttaccaaggagttacaatgaaaaagcacagttcaaaaaaaacttttttaaagattctgcttatactttctcttatcgctgcatctgttacaatattatcattccttattgatatgaaaaattcttctcctgataatgtaagtattaacataacacaagttgggactatttcatcggatgatttatcgcgtggggaagttaataattctgacaattcacaggaagataataaaaataataattcagaggattcttataaagattttcacaatacaattcactctgaaaatgaactaaaagaactactggcatccggaagaaaagcatatatagataattttccgtgtctgaatcagttaccggagctacctaccggctgtgaagtcacttcactcactatggttcttaactatcttggatatgatgctgataaaactgatattgcagctaattatctagaaaaaggagactatcctgatgctaatcccaacaccacatttgtaggaacaccttttgataaagcttcttatggatgttttgctcctgtaatcactgattgtgccaatctgtatggcgcccatgccgttaatatatcaggtgcctcaattgatcagttctgccagtatgttgagaacgggcagcctgttattgtctgggcaactatgaatatggagtccactgattatggttcttctgtatggattgctaaggatggtcagcttgttatctggcccggtatggaacactgccttgttatgattggatttgattctgccaaaaatgaagtatatatggcggatccccttaacgaaaatataacaacctataatttttctgtattttatcaaagatggcttgaacttggctgtcagggagtaattgttgacagataagtaaaaaatctccggacctttattacatacggtccggagatttttattttcttataatattagattccaagaatcttcttaacttcatcacacatcttatcagaatcgcatacagtatcatgaagaactggtgctgttctgatttcttcaattgcgttaggaactttgacattgcttatcttgctaagctcatctacaagttcgaagtctcccattgaatcatatttggaatcaatagcattcataacgcttcttgtaaacttatatgggcttgctgttgaagcaataactgtcttagttgtatcgccagtttcttttctgtacttatcatatacagttgcagcaactgatgtatgtgtatcaattacatatccgcaatcttcatatatcttcttgattgtagctgcgtcctctgcctctgtagcataattgccatagaagtcagctaactgtgctttcatatcatctgtaatcttgtactttccttctgactttaatgatgccataagttctgcattcttagctgcattattaccggcaattctgtatataagtctctcaagattactagagataaggatatccatagatggtgaagttgtaagaacgaattctctgtttctgtcatactcacctgttgtgaagaaatcatataataccttattctcattagatgcacatataaacttattaataggaagtcccatattcttagcataaaatgcagctaaaatattaccaaagttacctgtaggaacaactacatttatcttctcgccatccttaatctctccattagctaataacttggcatacgcatatacataataaacaatctgaggaacaagtcttccgatattgattgaattagctgatgagaactggaatccggcatcattcataaccttctctaattccttatcagagaaaatattcttaacacctgtctgtgcatcatcaaagttaccctttataccaataacatatgtattatcacccttctgggtaaccatctgcttctcctgaattgggcttacaccattcttaggataaaagacgataatcttagtcccaggaacattagcaaatccagctaaagctgcctttcctgtatctcctgatgtagctgtaagaatgacaatttcattcttaacattgttcttctttgcagaagttgtaagaagatgtggaagtatagaaagtgccatatccttgaaagctattgtagctccatggaaaagttcaaggaaatattcattctcaactttaacaagtggagtcatctcctctgtatcaaacttagaatcataagctctgtctatacagctcttaagttcttcctctgtgaaatcatcaagcataagcttcataacttcataagcaacttccttataattcatcttagacaactcttctaagcttttatctaatgatggaatactctctggtacaaaaagtcctccgtctgctgccagcccttttaatatagcctgcgatgcagtaaccttaacattgtcgtctctagtacttctgtagaacatgctcatctttaatacacctcataattaatatagtgtgcctgcgttaacgtcgcaggcttttgatattatacaacagacttctgtacaaaaacaatacccttatgtacgaaatacattttaaaataatattactttgcagttacaggtacacacatcagcacatataacatctcttcttcatcttcatatgccttgcttataacaattcctgtcacgtctcctgctactttaaaattatgttctttcatatatgtaatatgctttcctatcataatctgacgaacctcatcatcagacttttcactcatcaggcttaattttgcaggaactcttgagattcccataacagatggcttggctgtataatgcccggcatagtcattggtcttaagactgtatttctcaacatgttcctcttttacagcgattccacagcatatagtaaatctgcccttttcaatctcttcctttggaatcatatatatgtgttgtaattcaggagaattatacagaaattctttcacctgcaataaccgttccggctcctgaagcagtttttcaccatatttgtacagaacatatctaaggtcaaggctgttcttctcatatatgtccgaattgactgcagccttattcatcagcacataatcatctttcagccggtgccttaaatatgtcatatacgcaatctgcctgtccatctcatccatgcgttctttgtatgcctcaatagactgttctaatgaaaaatgctgcatctttgctatctgttcatgtgaaaatccatacttcacatgcattttagcattaagtacgccgaatatcccatcatcatcataatacctgtatccactgttttcatcgcgcacagccgatatataccccatatcctcatatcgtctgacagtattagtagatacatctaataattttgccagatcactaatcttatatctcatattttttgcctcttaatataatattttagtaagccggaacaaatggcagctctatcggatctgtctttgtgttttctattttatcgttttctgaactggtactgtctgttcctgaagtattatcagttcctgaagtatccttatcagccgcatcgctactggcggcagcagtactttcgggtacgatacttactggctgcagctcagaattaatgttattatcctgcgcatcagaagcattttcctgtacattctttttttcgccggtcttctgtgattcaccagttgtctgtaactcaccatttgtctgtgattcaccagccggaatcatatgtgcatctctgtcatcatcatattcctgaccgctttcactttgcagcttctggctgttatcagttgaaatgttattcttattctttccacatgctgataacggcaatgtcataagtgtaattataataattataaatgttatatttcttttactcattcttttacctttcaatatgttctgccaatgtgttatcatttattatatataattatatctgtatacacaattaatatatgttataatctttatatcaatggtagtgtcaaatggcacattaaatcagagtataagtttggggaagcctactaatattgcaaaatgtgatgaaatagtaggtttaaaggacaagtttatagaacgattgggggattctcatgacaggagtttacgaagcaagaaagaaaagcggtgaaatatattaccgtgcgtcatttacatataagaataaacacatcagcctcggaagttcctctgacgaggcttcctgtcatgccatgtacaacgaagcctgtgagataataaacaattcttctgaccactggattgatactgaccacagaacaacttcatataatgaagcaatgacactttctcttggtaaatacatctcacttatcaatttcagggataacaacatttatataaagacacctatatatatgtgccataaatatttcctgtattttctcaaagaacatgaggttttacagttttctactgatgaccttttttactattccaaccacacaattatgagccgcggaggatattattttgtaaatgattatggaatgcagacaagcattctctcaagattcggagtaagaagccactctgtaaaaggcagggattatgtatttaaaaatggggatacgcatgattacagatacgaaaacattcttgttgtcaataaatacaatggtgtttcccagtttactaagaatggacgaattatgtacagaaccaggattcatattaacggcgactatatactcggtgaattctcatccgaagcggaagctgcaattgcatataacaaggccgttgacatgctttcaggccttgtaaatataacttatacccctaattacatagaaggcatatcctccgtagaatatgcctccctttatcacaatattatattgtctaagaatttcagaaattatgtaaagtctgtctgtttttaagcctccacaatctttccagcaatagcacttgctgctgctgtagctggagacgcaaggaatatcttaaccttgcttgttcccattcttccaaggaagtttctgttgttagttgcaacaactacctctccgtcagtaagaattccgcctgttcgtccacagcataatccgcatcctggatgtgtaacaattgctccggcttcaacaagtgtctcaagtgttccgtctgcaagagcttctttatatatcttgcggcttgcaggagtaactattaacttgacaaatggtgcaaccttcttacccttaagaatagctgctgcacactgaagatcctctaatcttccattagtacatgaaccgatgaatacctgatctactgctgttccggcaagctctgtaacaggcttgatgttatctacctgtgaaggacatgcaagaaccggaactaaatcctctgcattatatgtaatctctcttgcatatactgcatccgcatctccctttaaatcctttaattcatctgtaagttctacattacagtactctgctgtcttttcatctggtgtaaaaagagcacatttggcaccggcttcaatagccatgttagacatagtcatacggcttgcaacgctcatctcgtcaattgttgaacctgtgaattcaagtgcctgataagttgcgccatctgctccaaggtcaccgataagtcttaatatgatatcctttgaacgcacattttcaggaagctttccattaactgttaccttgatagtctgtggaactttaacccacattttgcctgttcctaatacacttgccatctctgtatatccgatacctgatgaaaatgcaccaacacagccgtatgttgttgtgtggctgtctgtaccaaatgcgatatctcccggctttacataacctgcctctgtcattaactgatggcagattccgtctgaacgatggatattcttcattccgtatttttccacaaattcattaccaatacggaaatgtcttgtatcatcaacctgacttgctggaacaaggtggtcatatataagaactgccttatcagggtcccatatcttagtgaatcccatttcctcgaatttctctttaacaaatggaatgaaaatatcatgaatcattactctgtcaacattaacagttacgatatctcccggctttacttccctgccaatattctttccaataatcttctcaataattgtatgtcccattattcttacctctccctgtcttagtcaagaccgttaagctttctcattgccttaacaagtccgcctgcattaagtatatccacaagattatcaggaagtgaagcaataggatatgcttttccattgtgtgtaatctttgcatttacttcaacatcaatagtatcgccttccgtaacttcgtcgtgaaggtctgcattctctataaggagaagtccgttattaatagaatttctgaagaatattcttgcatatgatttggcaataacacatttaatacctaatgccttaataacctcaggtgcctgctctcttgatgaaccacaaccaaagttctttcctgcaacaatgatgtcgcctggcttaatctgacctgcaagttctggtcttaatggcgaaaatgcatatggcttcatatcttctactgtctttaatgcgaggtactctgtaggaataatgatatctgtatcaatgtcatcaccaagcacccatactttaccgctaaatttctcgttcataattactcctttgaagttaaatccttatcttataccatgtctgctgttgctatctcgcccttgattgctgatgctgtaacagttgccgctgaagcaagatatacgaaagaatctttatgtcctgcacgacccttgaagtttcgtgtacctgtgctgataagagtctcgccctcaccgataacaccctgacagctgccccagcatacagagcagttaggattcataacaattgcacctgcgtccatgaatatatcaaggagtccctctttcatagcctgaagatataccgaacggcttgcaggaactacaaggaatcttaccttaggagcaacctttttccctttgatgatcgctgcaccaactcttaaatcctcgattcgtccattgttacatgagccaagaaatgcttcatcaatcttaacgccaagtgattccttagccggaactacattgtcaacaaaatgtggctttgcaacgattggctgtattgttgaaagatcaatatcataaacctgctcaaatactgcatcatcatctgatgtaaagcatgcctttggctctctgccatgctccttaagataatccattgcaacatcatcaacttccatgagtgcagtcttagcacctgcctctacgcaaaggttacagattgatattctgtctgccattgaaaggctgtgtaagccttctcctgcaaattccattgctttatagttagcaccgttagcaccaatctttccaataatagagagtattaaatctcttgcatatactccatcgctaagctttcccttaaggttgaatcttaatgttcccggaaccattacccatgatgttcctgtaaccattgcatacaaataatctgtacaaccaacacctgtaccaaatgcacctaacgcaccatatgcacaagtatggctgtctgctccaaatataagttcacccggcactacatgattttccatcataacctgatgacacacaccctcgccctcgtagaacttaatatcattagccttagcaaagtctctcatcttcttctgtgaggctgctgtcttaggactgtctgatggaatattgtggtctacaatccatacaagcttatccttgtcagcaatatgaggattctttaacttctcatacataccaatagtaagatgtgttgttccatcattactcataagtctgtcaagagtaacagttgcaatatcaccagccttaacctgtgaaagacctgctgcccttgcaataatcttctctgcaatagtcatgccatgctttgcctcgcccgctgttacagctgcactctcagactcttctgcctcatcattaagtgatgcaataagtccgccctgattaagaatagcctgcatcttggctggaagctttgtacatgtataagtctttccattaacagttataattccatcttctaatgaaagctcacattcatcccccgcattaacttcgtcatggagttctttacatacaataacaggaagtcctatattaatagcattacgatagaatattcttgcaaatgatttggcaatcactgccttgacacctaacgccttaagtacgcttggtgcctgctctcttgatgaaccacatccaaagttgtcatctgcaacaacgaaatctcccggctttacagcagaagcaaaatcagagtctaatgattcaaatgtatgactcttcatctcatcaattgtcggaaacaaaagatactgcgatgcaataatctgatctgtatcaacatctttatcaaacttaaatatcctacccattgttttctccttatcttatccctgatataacaggtattattaatagtcattttaacattttaccctattaaagtgtgtttttcaatcgttaatattaacagaaacggtaattaagtgaaaggtcgttatccttaaccttaacctgtgtatataccccacttactatcggcattgaaggtgaaagatgcccgaaatcacagtccattataaccggcacattatactttgccgcaatacctgtaactgctctgtactggtcaagccccatcatttcctgtccgtagcacagcggtcttcctatgagaaatcccttcacattcttaaaccacccggcattatccatctgccacatagcccttctgattgcaaatacattcagatcacagctctctaagaaccatataattccgtcaactgcgtatctttcattgaactctttaaccttgtcaaagcttgtacccgtaagattaactagacagtccatgcagccgccgacaagccttccttcaaatgcaatctccgtatcacattcgtccccaccaacatattttcttaaaatcttcttctcagtaagattgtattgtggtgcagggttctcctcattctttagagactctctctcccatgtgtcatatccatggacttgtttttccacaactccgttattgttcttgcagccttttccacgaagcacatcaaaagtatccacaagcgcctgatgccagtccttcattgcaaatgcgcctgcacacggtccgtatacacttgccgtatcggcaatcgtgttctgtaaaaatgtgaagttggtattatcagaatatccaagataccacttaggctttgccgccttaatcctgtcaaaatcaacatatggcagaatctcacacatcagttcaccaccgccacatgatataagcacatcattgacattactctcatacatctgtgtaagctccttaccgcattcctgcggtgtgttgcttatcccaattccattgtcctcataacaattaggaccaagctctactgtataaccttctttttcaaatcttttaattgtcattccgaatgctgttttataaggctccgtcgcacaaccaaaagatggtgcaacgaagcctatagttccgccttcggataagaattcaggatatctcatatactgcctccttacctcatcattcagattctgcctgaataattaatctacatatatttctttactacattaatagcattgctgcctattactacactataatgctcccttataaacgcaacacgttcttcttttgaagaatcaaacacactgtactccatcaaaagattcagaagacttctgtatttttcctctgagcatcttcctttctcaagtacaagataatatgtatcatcttctttattcttatacagtgcattagttattccccatgttcttgaacttacagtacacatttcctcaaaatcattaagactttccaacctgaatacgccgcatccggctttaataacattacttgctttcttcttctgtcctgtcttcttaagttcatctgtctgtgcatctggtaattcgaacttatctagactgtctccaaatgtttcaaaaggtgcatctttaaatgtaccttcaccattcttaatcacattactcttctctggttttgaaaatgccttagatatactttcccctgcttttcttaacatattacccagatcttctttaccagatgaaactgtaagaagtattgaatggtctggctgtggtgcaagctgtagtgacataacctccccacttaaagtaacacctatatttttttcagcctcctccataataacttcaagaaggctgtgtatcttgtctgtatcattcttaaagaaatcatctaaggaaatattattatcttccaggtcttcctcatcgagtctgcactggaatcttctatcattgattttcttaaattccatatatcctctttccaaactttaataatatatatcaatatattattattacatacttttactaattctgtctactatttttgtgataataaggttcttattaacaaatgtacccctttcattaactcttatgcgtcccctgttaccggtaacatctgcatatatctccagtctgtcagaactgattcttgcatacacatcacatgtcttaacatatacattctgcataaccctgctaattatatcatcttctatctcaaaacattctgctgtactcttatgtgacaattctcttgccgtgcggacagcctcttttttccctttagtaagcatcgcatacacaccctcaccatgcacaggaacacattctccataatccatgattgtatatctatacagaaaactattatgtagccttgctgccttaatatcttctaaaagtacaaatacagcatcacattctgacgcatccagcttttcaatacattttcttatatccgtctctactacacagcttattccatcatacatatgtttaatacgctccgtcttgctgtatgagtcagttgcaacaacagcattttcaataaggtcttttgcatgtctctttcttatcattacatatcttgaatcgccgcgttttaaaacacccgaaataacaaccccataaggaagattctcatcattcttttccatcctgataagctgtgccatgtcaacaactgccatatcaaccgaaccaagctcaagtgcctcacatgctgaatcaaaattatcatgtccgatatctacaatcttaacttgtgaagctgaagctttctgaattatctgaactgctttttttaatttaattctctctattccattgccgtacaaacccagtctgtacatttcatccaaatcttttctcatctatatctgtaaccttttaacagctttatttatttattttttattataacatatcattttaggttgttgaaagtacctgcatattatgtttataataataagaataaattttaataaggaatggtacagattaatgacttatatcaaatcaaaaagcagtattttaaaactgcttgcttcaattactattacactattctgcatagttcttttcccttccgccgttaaagcagaagacaatcaggctgcagaagtaaatgctgatataacactttctaaccagggaagcatcagcaggatgaccgatggttcttacaacacaaaaaccacattttcatcaggagacacaatcacaataacttcctctgaaaaaatgtactcactttatatcaaatgggatttaattccttcagaatggactctttcttataatggaaagactgaaactaacggaactaatggttttcttcacgaatatgtccagattcccgatggtacaactgagatgacaattacatttgcatctaaagaatcaatctgtgatatgcatgtatattccaagggttctgtgcctgaagatgttcagacatggaagactccatgcgataatgctgacattcttgttttcgcaacgcatgcagatgacgagatacttttccttggaggagtacttgccacttacggtggtgaacaaaatctttccgttcaggttgcctatatgtgcgaattcactacatcagccaagattagagaacacgaaaagcttgacggattgtgggaatcaggcataaagcattacccagtatgtggagattttcccgacctttacagtcagacattagaagctgcaaagaagcagtatgtatatgatgatgtcaaagcctatactacatcatgtataagacgatttaaacctcttgttgtagtaacacaggatcttaatggagaatatggtcacggcggtcatatgctattctctcatgctgttgcagaatcagtagagacaagcaatgattcctctgtatttccagagtcagcatccaattatggtacatgggatgttcctaaaacttatcttcatctgtacacagagaataaaattaccatgaacttaaggcttcctctttcccgtatgggaaaccgcacttcaattgaagtacagacagcagcttataaaaagcatgtatcacagcagtggtgctggttctatgtatcagatgattatgaatacagctgtgctgattttggattatacaggactaccgttggtaatgataccggcaatgatatgttagaaaatattactacatatgaagagcaggaaaaactcgctaaagaagctgccgaaaaggaatctatagaaagttccaaagctgctgaagaagcgagcattgctaaagaacagcaggaaataaaagcagcacacaaagaaacttctaaaagaaaagtatcagtggcagtgattgttataattgttgtaattattattggtgctgccgcattcggatatgtcagattacagcagtcaagaagaaagcattcccgcaggagaagataaataaggaggttttgccatgaaactgcttattaacataatagcaattattgtagttgctgttgtaattggatttcagttcaacagaacaaagaatctttataataaaaaatacgatgagaacaaagacgaattcagaaaagatcaggaacaataaaacaaaatcaatcttatcaaaaagggctgccataatggcagcccttaaatattatcaattactgattattagttattgataagcatatcgctttcattgttccagctgtaaagctttctgatttctgctccaaccttctctgatggatgctcagaagcaagctttctcatagccttgaagtgaacctgtccaccagcatcactcatgtcaagtaagaattccttagcaaatgaaccatcctgaatatcagaaaggatcttcttcatagccttcttagtatcctctgtgataatcttaggacctgttatgtaatcaccatactcagctgtattagagattgagtatctcattccagcgaatcctgactggtaaataaggtcaacgataagcttcatctcatgaatacactcgaagtaagcgttacgtggatcatatccagcttcgcaaagagtttcgaaaccagcctgcataagtgcacaaacaccaccacaaagaactgcctgctcaccaaagaggtctgtctctgtctctgttctgaatgttgtctcaagaagaccagctcttgctccaccgataccaagaccataagcaagtgccatgtcaagagcctttcctgtctcatcctgctctacagctacaagacaaggagttccctttccagcctgatattctgaacgtactgtatgtccaggtgccttaggcgcaatcattgttacatcaacgcccttaggtgccttaattaaaccaaaatgaatgttgaaaccatgagcgaacataagcatgttacctggctcaagatttggctcgatatcatccttataaagcttagcctgcttctcatcattgataagaatcatgatgatgtcagctctcttagcagcctctgctgcagtaaatacttcaaatccctgctcctcagctctcttccatgacttagaaccctcataaagtccgataataacatgacaacctgaatccttaagatttaatgcatgtgcatgtccctggctaccataaccgataatagcgattgtcttaccgtcaagtaatgataaattacaatctgactgataatagatcttagcttctgccattttaaactacctccatataaatgtgttttatattgtaaaagttctccggatacaccaaagaattattacatcttattcaaatctgcgcttcctcttgcaagtcctgtaattcctgttcttgcaatctccgtaatgttgaaatcttccagaagttccacaaacgcattcatcttgcttaaacttcctgtaagtgcaattatcatggactccttagatacatctacaatattggctctgaatatatctgcaatagaagatacctgctgtctcttctctggtccacattcaactttaatcataacaagttctctgcatactgattcatgtgcaggaagctccacaatttccttaacatctataagcttattaagctgtttctcaatctgttcaagtacatcatcttcacctgttacagctattgtcatacgtgacaattcaggattgagagtttcaccaaccgtaaggctgtctatattatatcctctacggctgaacattccagcgacacggctaagtacaccagatgaattacccacgagaatagaaaaaactgctcgtctcataacctaatctcctaaattctgatattaaaatgcataaaaatgcatttattgtcaattattataacacagaacatcaatctgtcaattgcccacttatagcatttactactccaagaactaccattctgagcatgataacatctgtatcactccactttcttctgttagtgccaaatatatcaaattctaccatatattctttaccatcagcaccatcagccttcatctgaagaaacgagcatatattgttgtctctgagttttctaaaaacttccgggaattctatagtaagtgatgctatattattcaccatgttaacgccatattcatcaaaatgattcacaaatttatcatcattaacatatgctgcctcaattacattattcttatagtgacctgtactgtatatgcattccatatcattaccactgtaaatacttattccatgaatattaagcttatcggtaagctctgaaagcacttcttttactgtcatcattccaagcgatactttcattacaatattggttgcaagctcatatttagccataggcttcataaagccacttccaaatgcaatgtcatgcttcatgtcagccagaatatctccatgcttattataatcatatataatatatctgtccttgcctttttccttggctatataaagtgctgcatcagctatcttaaacaatgtctcaaaatcactgccatccttgccaaactgtgcgataccaattgatgttgaaaacatatactctggctgcttctgtgcaagcgataccttaagtccctttctcattgccttaagcataatgcgaagttcttcaatcgtaacatcttttataagtactataaattcatctccgcctatgcgtccaactattccacgtccgccaactgataattttaatgaatctgcaaatgctttaataacctcatcaccaaaataatgtccataactgtcattaacactcttgaagttatcaatatcaagaatcatcaggaacatctggcggtttctgtctgaaaccgctgttttattgatatcatcggttatcatatctgttacagtcttcttgttatatatgcctgtcgctaaatcaagttttgcctcatctactccgacatactcctgaacagttctggttcttctatctggttcagatattacgcctactgtaattctgttttctccatcagccagaagtgactgtcctctgaagataagattgtcaactctttctcctttagacataacagatgacgacagcttaacaataaagttattcattccacttgcaattgctgtacataatgcttcaaactgaacagcatcatcacctgttacaaagcccttagtgatacacgcttctttccattccttaagactggttctctcaaatatctcagatttattattacgataacaatatattgtaatcattccagaaacaggatcatattcaaatatcttctcatcaataacattaattattgccctgtattttcttacacggtgataatacatgtcaaaatcattcgaaataacaattatatcctgtgccacaagctcaaccatacggtctgtaccaacttcatatatacgcttctttaccagaagcatccatctgtatgaagcattctttataaggcatctgactatacaatatctcacagacatatctgaattaataaactgctcaaaacccatgacatcatccggatgcaccagtccgttaaatgcagaaagcatagtctcgcccatgagattgtaaaatctttcatcacctattttaactacatatctgttatcaagcgtaaattctacttcattaggcatgttgccttgatatgaagtatccaattcgtatcttcgcataaaaagtcccccattctaaggaacaggacaattattctctaagcatgctgtccctgactggttttctcaaccttaactttgagtatcattcttcctcgtacatcaagagttctgaatatatatcctttgtattctacctcaaagttctccccgtcatcaggtatcttcccaagcttataaatcataaagccgctcaaagtatcaatatcttcgcattcaaactctattcctaacttagcttctacatcctcaagatctgcctgaccttctattatatatgaaccgtctgcgtcggttacaatctgttcttcttcttcatcatattcatcaagaatattaccaacgatttcttcaagtatatcttccatcgtgacaattcctgctgtctgtccatattcatcaacaacaatagccatatgaatcttttctgactgcatctgtctgaataacggacttatatttcttgtttcaggtatacaatatggcttaaaaagtactgtatcttctacatctctaagcttcctatcctgattatccttatcaacatatattttaagaagatcccggatatgtaaaatacctgtaatattatcaatgtctccatcatacacaggatatcttgaataattctctttcattatcctgtcaaatgcttctctgacagtaatatcatcatcaagtgccacgatattgtttctgtgcgtcattacatcagacgcctgtttctcgccgaattcaaagatattacctatcatctcagcttcattttcttcaagaacaccctgttcatggctctcattaaccatatccattatctcttctgttacatcttcatctcgttttcccctgccaaataacttaagcagagatgaaaacctcttttctttcccatccgcgggatggccgtcattcatagctttcctccatatttataagttgttctttaataagtaattatcatttcaataataacacattattatgctgatagtcaattcatctcaaggcttacagacaatgctttattcacctgtcctattatatcattatcaagatgacatactttatctttaagtcttcttttatctattgttctcaactgttctaacagaataaccgaatcctttaccatatcgtatctggcagaatcgagttcaacatgcgtcggcagtttgcttttatgcatctggcttgttattgctgcacagataactgtcggactatgtttattccccgtatcattctgaattataagtaccggtcttattcccccctgttctgaaccaaccaccggtcttaaatctgcataaaaaatatctcctctttttattaccacaactgtcacactcctaaagctatatttcttaccttggctttagtattgcctgattttaagtgtgtattcagttatcatttatcttttcaggacatatgcaattgcttctgatatatctgctgccgtcattccggccctgcctttgcctgatgccgcataatcccctgctttgccatgaacatatacagaaagacatgctgcttcaaatgcatctaaccccatggctgtcattcctgcaataagtccagtaagcacatcaccgcagcctcctgtggacattccgtcatttccagtacagttaatatatactttctgtccgtcagtaactactgttcttgcatcctttaatatgcatatacatgaatgttgtattgcatattccttagcagactcaatcatatgctctttaatatcagcaactgtctttcctgtaagccttgacatttccataatatgaggtgtgattataatctgcccttctctgcttcctttataatcaatatgttcgccagcaataatgttaagtgcatctgcatcaagtattcttactttatcatctctttcaagaacacatctggtaatctctgctgctgccacgttcatagataatcccggtcccacagctatactttttgcccattcaaaatctgctttaagttctgctgccagcggcatattatcctgatatgttgatatcagacattctggcattctgcataacagtgctgtcttattaatctcatgtgtaagtacctttacaagccctgttccacttctgtatgcggctgatgcactaagaattgcggctcctcccatattcttagagcctgctataataagtgttctgccatatgttcctttattagaatcaggttttcttacaagaagtctgcccacatcttcatcgtcatatgtaaaaatactgccgaaacatttgacttttttatgtaatatatcctctgttacaaatccggcattaatgacttttacactaccactgtatgaagctcccgggtaaaacatgatacctgtcttattatatccaaatgtgattgtgtaatctgctttgacagcaattcccataatctgtccattatctgcacttatgcctgacgcaatatcaacggcaattatcttcgtatcaggattctcccgggctttattaattgcttctataacctgcgcatatcttccctcaactgctcttgataagccaatgccaaatattgcatctattatataatcatattcagaaaaatcaatattgccatcatattcaacacagtcaattccaagattaccgacaattgatttctgaagcctgtattcatcagttccctccgatgtaccagcaaacacaacatgtacatcaattccatcttcattaagctgtcttgctgctgcaagaccatctgcaccattattcccgcttccgcatacacacacaacttttattcctgttttcttattgttatgctctgcatgctttcttaaaaaagctgaaacccccagtgctgctctttccataagcaccactgagggaatcccaaattcatgtattgaacagttatcaactgctttcattgtatgtgaatcagttaaatatctcatacctcttcctcatttaccttatcaagttccttcataacgtcagggcctaatatgtcatgcattgcagaatacatacggttattaacctcttccttatcttgcttgataagtatattcttctttaactttactcttgttgcattaatccacttatccagaacctcaaggtcttccttattactgttaatcttgttataacacacctttactgtttcaatcataagacgctcattggcattaacaagatctcttggaatatcgagtgcttcatcttcaagagaattaatcttatccttagcttcctgaataagtctctgattcttctccatcacttttgctctcttaggatcattatcatcatcctgcatattatcaacaacatcctgaataagctgattctttattttttttacttccttaatatcattattaacctgtccctgcttcttaagaagctcattaacctgtttttcccaataacagatttcatcagtctttaatttatccgttataagatgataccatctctcatcgagagtaagtatcggtatctgttttatggctgtacaacttttcagcttttcaatatcaagttctgccatattatcctcccaaacagttacttcctgttagcaatagtgtatgaaagtctcataagactttctgacaaatgtacattttcaacaataacgtcatccggaagattaagatctgtatgtgcaaagttccatatagccttaactcctgcatcagcaacaaccttcgctatctgtctggcggcttccttcggaatagtgagtgcaacaatctcgatttcattatctttaataaaatcagtaagctcattcatcattcttacttctattccacgaatcttagttcctttaatcttaggattattatcaaatattcccttaataacaaaacctctcttctcgaaatcactatagttaacaatagcctttcctaaattaccggctccgattataaccatattgtgattacggtctataccaagaatcttaccaatctcttcatagagatactgcacattatatccatatccctgctgaccaaagccaccaaaattattaagatcctgccttatctgtgaagcagttactttcattctggtgctcagttctttagacgatattctctgcacaccagactctataagttctcccagatatctgtaatatctgggcagtcttcttattaccgccgacgaaatctttttctcttccattaaaccaaacctccagaccacgattgctcattttaccaagatataaacgagtatataaatatactataataaactatacatagtataaccatttttttctcatatgtcaaaattttaaccaagaactcttttagcaatatcaacagattcttttgcatcctttgcatagaaatctgcatctatctctttagcatattccggtgtaagtaccgcacctccaaccatgaccttgcagtcaagattattttctcttataagtgcaattgtttccttcatagatacaagtgttgttgtcataagagctgataatccgcacagtttaacatcattatctcttattgcatcaacaactgcctggtactcaacatcctttccaaggtcaataacatcatacccataattctctaggagaaccttaacaatattctttcctatatcatgaacatcacccttgactgtagctataactatcttccctttgcttacaggggcattatcagacataaccatatgctttcttataacttcaaatgctgcctgtgcaacacctgctgacataataagctgtggaagaaacaatgtacccttctcgaattcagcacctatcttatcaagtgcaggaataagcacctgattaacaatctccattgaatccataatcttaagaagagcctctgttatctcagcaccttcattcttaagtcctttttcaacagcatagaaaagatcatctcctgtatagtttccatctttcttttccttcttgacaggatcaatcttagaaacatttggcatagcgccatagttttttatgtaatcaactgaattcttatcaatattagcaagaagcttatacgcccttaccgcacctgtcatctccgggatgttaggattgataattgcaaggtcaagtccgttagtaagtgccattgtaaggaaaatgtggtttacaagcactctgtttggaagtccgaatgaaatattagaaacaccaagcactgtctttaagccaagcttattcttaactgtatgaagcgcattcagagtttccattactccctcctgctcagcagaagctgtaagtgtaagacagtcaatataaatatcttctttagggattcccattgcaacagccctatccataatcttctttgctatcgcaactctgtcctctgccttcttaggaataccatctttatcaagtgcgagtcctataactcctgcaccatatttcttaacaagaggaagaacattgttaagagactcctcctcaccattaactgaattgacaagcggcttaccattgtatacacggagtgctgcctcaagtacttctggtattgtagaatcaatctgcagcggaacatccacaactgcctgtaatgactttattgtatcaatcatcatttcacgttcatcaattcccggaaggcctacattgacatcaagaatatctgcgccacctgatatctgctctaaagcctgtccaagaatataatccatatcgtgtcttaacaaagcttccttaaaaagcttcttacctgtaggattgattctttcaccgataattcttggttcatcaacaacaacagtgcttgtagctgaacacactgcacccggaatatatttgtgtggtgctgccggattgccttctctttttaacatctctgataattctttaatgaactcaggattagttccacagcagccgccgaatatcttaatgccatattttcttaaatccttcatgaaatctgcaaactgggttgcagtaacattgtaaagattagtttcagggtcaggaagtcctgcattaggctttactactatcggaagattagtccattttacaagttcttcaataaccggctctaattctttaggtcctaatgagcagttaacgccaagtgcatcaacaccaagtcctgtaagtgtaagagccattgccgatatagagcagcctgtaaaggttctcatattctgttcaaatgtcatcgtggcaacaataggaaggtcgctgttttccttagctgcaagtacagcagccttgacatctaaaaggtcagtcattgtctcaaatacaacaaggtctgctcccgcagctgctcctgcctttactatctcggcatacatatcatatgcttcttcaaagcttaatacacctgttggctcaagaagctgtccgattggtcctacatcgagtgcaacaaggccgtccggctttactgtatctcttgccttctttgcattgacaatcccggcagttacaagctcctcaacactttttccgcattcttcaagcttatatctgtttgcaccaaatgtattggcatataccacatctgatcctgcattgtaatactgctctgcaattgaaacaagaagctccggtcttgttatattaagcacttccggtgtctctcccatcttcatacccgctgcctgaagcattgtacccatagcaccatcaaatattatataatccctagtttttaagagctctctgaatctgtcagccactacaatgtcctcccattcctctgtatgcacaggttttattaagattgcatgttgcacaacctctgttcttagtacttacaggctccttagtaagtccgataaccgctgttaccgactttaccggagccagcatatatgatttgttaagattaagtcctatctttttaccggcatctaataccttcaggaaaggctcctgcatacttatcggcaaatcaccgtagccaatcccgaacctgaatgtctggtaataatcaggatattcctctcttaaaagttcttcaaccttatcgcatgcctgttcaacagctacacttgccaggctgtcaaacaccagtgccttagccatatccgtaagctgcaacactcttagctgtctgtcaataccttccgatatcgttacagccatgcatattgcactgtcacatttatacagatgcttcttaatggactcgcccggaagcaccatgcttgtattcttaaatgccacaccgtcttcattaactgtaaaatcaagcttcttataaataaatcttggaactgcggtctttaatacaagctcctcacattcatccataagctcttccacccgttcatcaggtgcatttttcttataacccagatatcttaacgcttcttttctgttaagactggtaagcttaatacttttctccatttcttcttaccttgccgcttttacttctgcgttctttaagtttgtcatgttttccacgggactcgtcttttcttcttcttgtatctggctttgacttggattttcttgccggcttggcagatacatttgctttctctacattaacctttctgcccttgataagtacattgtcattcattgctgcaagtactgcttccgcatgctttgcaggaacatcaacaaatgtataattatccatcatatcaattgcaccgacaagtcttcccggcattccggattctcctgcaatcgctccaagaatattggctggtgtaatcttgtccttcttaccaacattaataaagagtcttaccattcttgatgtatctgcattttcatcaaaatgaaaattctctacctcatcgattctgtccaatgtatctccaactatcatcttaagaagagctgctgccatatccattgatgtataatcttcctgattaacatgctcctcaaccatatcaagcatggctctgtgctcatcagcttcaatcatctctttaatcttgtcaaatataccatccatcttggtgttcttgacatcatcaagtgatgggattggctttgcaagaatcttggtcttgcaatatctctcgatatcctttaacttatatacttctcttccagatatgaatgaaagtgcaagtcctgattttccagcccttcctgttcttcctattctgtgtacataatattcttcgtcctgtggaaggtcatagttaaatactatatcaactccgtcaacatcaattcctcttgccgcaacatcagttgcaataagaatttctgtctttccacttctgaaatcgtccattacacggtctctctgttgctgtttcatatctccgtgtataccgtcagcaaaatatcctctgcccttaagctctgatataagctcgtctacctgtctcttagtgttacagaacacaactgacagcttaggattgtatatatcaataagacggcttaagatttctgttttattcttaggtcttacttcataataaaactgatcaatattagaaactgtaagttcttttcttacaaccttgataatcttagcgtctttctggaattttcttgcaatctccattataggcttaggcattgtagctgagaaaagaactgtctgtctttcctctggtgtctctgtaagaattgtttccatatcctcacggaatcccatatcaagcatctcatcagcttcatctaatataaccatagataccgaatcaaacttaacagtctttcttctcatatgatccataactcgtcccggagttccaacaataatctgtacaccggcttttaacgacttaatctgtcttacaatctcctgtcctccatacaccggtaacaccttaatgtcactcatgtacttggcaagctttcttatctcttctgcaacctgtactgcaagctctcttgtagggcagagtacaattgcctgtggtttcttaacatctggattaatcttctgtaacatagggatagagtacgcagcagtcttacctgttccggtctgtgcctgtccgataacgtcaattccttccaatactgcaggaatggcctgtgtctgtataggagatgtctcctcaaagcccatatcctctaccgctcttaaaattctttcatcaatatttaattcatcaaatttcattctttaatctccatttctataacttgttaattttacattacagaaagccataagtcaaagtaataattgcattttatttcttgtacatatataatcgattgtgaatattaattcaggctttgccaattttgctatatacttatatatctgctcatgtggcggtgtgcgtttgctgctgtgtctgtgtgtgccatatgaccgatatattgcgaactgtgtgggagttaatgccgctatatacataagggcggtgtgctaaagctcgttcaagcgaagcgcgtttgctttcgcacaccgtaataagctttgtagatagcggcatttactcccactaagtgtagcaatccttgagggcatatggtatacacagacacagaagtgaatgcacacagcctcataagcggctgaatatatgatatggcaaaattggcaaagtctgaatttcaaaaggagtttttatgattttatcttgcaataacattagtaaatctttcggaacggacattattattaagtcttgttcttttaatatagaagaccatgagaaggctgccattgttggaatcaatggtgccggtaaatctactctgttaaagattatcaccggtgaagaacctgctgatacaggcattgtcactcttgctaaggataagactcttggttatcttgctcagcagcaggaccttcagtctgacagaagcatttatgatgagcttctttctgtaaagcagtatatccttgatatggagagtgaattaagaagaattgaggctgccatgaacagtgcttcaggtgatgagcttgaggctcttatgaacagatacaccaatcttaatcatgaatttgagatgaataacggttacgcatataaaagcgagattacaggcgtacttaaaggtcttggttttgctgaagaggatttctctttacatgtaaataccttatccggtggccagaaaacccgtgtatctctaggtaagctattactttccaagcctgatattattatgcttgatgagcctaccaaccaccttgatatggaatctataagctggttagagaattaccttcttaattacaatggtgcggttcttatcgttgcacacgacagatatttccttgataagattgtaagcaaaattatcgagattgataacggtgactgtactgtattttctggtaattacacagattatgcctcaaagaaggcaattcttcgtaatatgaagttaaaggaatacttaaatcagcagcgtgatattaaacatcaggaagaggttattgccaagttaaagcagtttaaccgtgagaaatccatcaaacgtgcggagagccgtgaaaaaatgcttgataagattgaggttgttgacaaaccagttgagcttaatgccaggatgaacattaaacttgagccatctgttataagtggtaatgatgtccttactgttactgaccttaccaaatcgtttgacggcaatactctttttaataatattaattttgagattaagcgtggtgaacgtgttgctttaataggtaataacggaactggtaagactactatattaaagcttattaacggcattatcccgccagacagcggaagcatttatcttggtgctaaagtttccatcggttattatgatcaggaacaccatgttcttgaccctgacaagactctttttcaggagattcaggacgcatatcctgacctcaacaatacacagataagaaatactcttgcagcatttctttttactgatgatgatgtattcaaatatatccgcgatttaagtggtggtgaacgcggacgtgtttcactggcaaagcttatgctttccaatgccaacctgcttattctcgatgagcctactaaccaccttgatattgtatccaaggaaattcttgagaatgcccttaacagctacactggcacaattctttatgtctcacacgacagatactttattaatgcaacagcaacaagaataattgaactcactaaccagaatattgttaattatattggtaattatgattattatctggaaaaaagggatatacttacagcaaaggcttcccctgatgcacaattgagttcttctgataacactactaaaaaagattcaaaactctcatggcagcagtcgcgtgaagaacaaaataagcttaagaaaaagcagaatgaaattaagaaaaccgaaataagaattgctgaaattgaagacagattatccgctattgatacagaatattcagatccttcaataggcagtaatacagcccgtttaatggaacttcataatgaatccactcaactaaagaaagaattagacgaactgtatgaacactgggaagaattaatggatgaaatataagtatttacattcagcaaaaagtgccaaaaatccccattttgagccactttttattgacaaatcatgaatctaggagtataaataatctatacttattattacttaattttttaaggaggacaattaaatcatgaataagacagaattagttgctgctatcgcagaaaaggctggactttctaagaaggacgctgaaggtgctgttaaggctttcacagatactgttgcagagcagttaaaggctggcgagaagattcagttagtaggtttcggtacatttgaagttgctgaaagagctgctagaacaggaaagaatcctcagacaggcgaagctattaagattcctgcttctaaggctccaaagttcaaggctggtaaggctttaaaggatgttgttaacacacctgcagctccagctaagaagtctaagaagaagtaattaattatgacttttaaaggctgtcacttatgtggcagccttttttctctttatttaattaagttcatgaaattgaggtttattaattatggaaatcgaacgcaagtatcttgtgtcaggcatccctgacaatatagattcttatccctgccgctttattgaacagggctatcttaacactgctcctgttgtccgtgtaagacgcgacaatgataattactatctcacttataagggtggcggaatgatggccagggaagaatataatcttccacttaacaaagaagcctatgaacatctgattaagaaagctgatggcaatatcatcaccaagaagcgttatgaaatccctgatggcaatggatatactattgaacttgacatatttgaggggctctttactggcactatccttgcagaagttgaatttccaactatcgaagctgctaattcatatactgccccttcatggtttattgatgatgttactaatgatcctgcttatcataacagtaatatgagcagaaaagttttctaataatatagaggtctggaatatggataaagaaactatgtttgaatatattcaacggcttaagcttgcagtaataactcttttcaaatggttattctgctcggttgtatgtggctgttttattggttctgtcggtgctgtatttcacctgatgcttggttatgtaggcagcctgcgcgttgaatacccatttttactattcggactgcctgttgccggtatcatcattgtattcatgtacaatatagtccatgaagctggaaaccgtggaactaaccttgtcataaccgcaatacagtcgaatgatgaagtcccgggaagagttgctccccttataattgtatcaacactgcttacccatctgtgtggtggttctgccggacgagaaggtgctgcacttcaggtaggaggtgcattaggcaatacatttgcaaagctgtttaaattcgatgagaaagatacacgaattatgattatgtgcggcatgagtgcctgtttctcggcacttttcggaacacctattgcgtcagctgttttctccatggaagtaatcagcgtcggtgttatgtattatgctgctttagtgccatgcgtactcgctgcatttatagcacagggcatagcctctgcactgggacttgaatctacacattttgtagttgatgaaattacttctttttcttttattaatggcagtaaattcatcatcatgtccgtactttttgctcttgcaagcattctgctgtgtgttgttttacacggtacttcaaagctctacactgattacataaacaacccatacataagaataattattgccggtactcttgttattgccatgcgttacatatttggcacaactgattatctcggtgcaggctcagatattattgcaagaagctttgtaacaagttgtgcatggtatgtattccttttaaaaatgctgtttacagccgtaactttgggcggtggattcaaaggtggcgaaattgttcctactcttttcgtgggtgcaacgcttggaagcttcttagcacctatattcggactccctgtcggattatgtgcagcatgtggtatggtaagtgtgttctgcggagtaactaactgccccctcacatcatttattctatctatcgaaatgtttggtgcatcaactatgaaattcacgattctgtgtattgcattaagttatctgttatccggatattacagcctgtataacagccagaaaatcgtctattctaagtataagacagaatatataaaccgccggtcccattgacctgtacaggtcaaagaaccgacggttcttttattggagggctgctacttacacatatctccagtcttctattcgaaactgtattgaaacaatcccattatattcattaatatcagggtaatacaccatagatatcttccttcctacctctggtatctcctgaccgtctaatttgaacctgattgctgtcaccagcttgccatgctcactttctaactgacatcttaatacatttttattttttccaatcacagctgactgtctgacagtaagatttctgtctgcaaacaccggtttttcattacctttcccgaaaggctgcagcttctcaaactgttttataagttttatatcaacataatcaaccggcataggcacatcaatccacactgtcggcgttagtacattttctgtcattgtctgattctcattcagcgctttcctgaattcatcaattttatcaatatcaagcgatattccggcagccattggatgtccgccatatttgttaaggagcttaccacatttgcttatctcctcaaacatgttatagccttctattgaacgccctgaaccctttgcaccatcttctgctttagttattactattgaaggcctgtagaatttttctcttactcttccggcaattattcccgcaacactttcatggcagtcaggaagatacacaactaacaccttgtcgtcttttagttcagtgttctcaacctgttcaattgcaatagcggcatattcttctgttatatcttttctttcaacattaagtgtgcgaagctctaaagccttatttctcgcatcttccatatctgtagtaagaagcagttcaatggctcttcttgctgaatcaagtcttcctgttgcattaagacatggacctataacaaatcctatgtgatatgagcttatcttgtctatctcaagctcacacgcctctacaagtgctcttataccaatattagtagttactgccagatgctttaaaccatatttaacaattaccctgttctcatctgataaatcaactacatcccctattgttgcaattgccataagctctgcatattcttcaagttcgattggattaagtccaagtctctcatatataatcttaataaccttgaaggctactcccgctccacacagcttatcaaatggatacggacagtcttcctgcttaggattaacaattgcatctgcctgtggtactttatgtatcttttctccatcaacgaaatcaaacggaatatcatgatgatcagtaacaattactgtcatgcccttttctttagcatatttaatctgctcaatcgcagcaattccattatcgcatgtaatgattgtatctgtgccattattatatgcttcatctattaagtgctcattaataccgtatccgtcaataattctgtctggtactgcaaatgttacatctgctcctgcagcctttagccctttgtagagaattgttgttgaacatattccatctatatcataatcaccgataatatgtattttctttcctgcttgtatcttgtctgtgaggatatcaacacatttgtctgcatcctttaataaatgtggtgaatgcatatcatccacggtcccattaagatacatatttatctgctcgtccgtttctaaccctctgttacggataattcttgccataacctggtcaatgccaaatctttccccaattgctttgaaatcagctttcttagtgtatactctccagttgcttttcactcttttctccctgtttcactattaaaccaattatggcgggaactgatatacaatccccgccatgtcataaacttattgtatctgttaattaaacctgagaaccatcttcaaaaacctctttcttagaagctgcttttttattattctcttctacaacgcctctcttcttaccacccattacataccacatagcacttgttaagcatactgatgagtaagcaccaacaacaatacctacgataagtggaagtgtgaactccttaacagaagttacgcccataatgaaaagaacaataagcattataagtgttgttatagatgtatatactgttcttgacattgtacttgtaattgatgagttaacaagctctgtaatgttagtctttgaattagctgtctttaactgctctcttattctgtcaaagataataattgtaccgttgatagagtaacctactattgtaagcatacatgcaataaatgttgttccaaccggaattcttgcaaatgcatagaatgcaagaacaacaagtacatcatgaagaagtgctaatacagcagctaatgcgaatctgatatcacggaatcttacaaagatgtatataagcatacagattgtagcaagtataaccgaaagaatagcatctctcttaactgttgcagaaaccgatgaactgattgtatctgtctcaacaattgttccatccttgattgggtacttagcagtaaccgcattttcaatagcttctctctggtcaagtgaaagatcagatgtcttgaaagaaacctgtgttgaatctgcaaccttctgctgctgaacctctgtaatacctgcagcatctctgattacaggaatgatgttatcctcaatctcttctgctgtatactctttatcaaatgtaaatattgttgttgaaccaccaacaaactcaagactgaaattcaatgctctgtttccaagagcagcctgaactgccatagttatgattccagcagcaataactactgctgaaccaattgcagcccatttcttaatactaagaacattaagagtctttctgtatacattcttaccataccacttagcatcccttataccaaagttatataagagcttcataataaccttagtaataacaagtgatgtaaagattgatacgatattaccaactgcaagagttgtagcaaagcccttaactggacctgtaccgaatatgtacaatactaaagctgcaataagtgttgttacgttaccatctacgatagatgatgttgccttgttatatcctgaaagaatagcattctctacagactttccggcaccaatctcttcccttattcttgtgtagataataacattaccatctaccgccataccaataccaagaataatacctgcaatacctggaagtgtaagagtaagatcatatacacttacaaggaataaaacaagtgctgtatagataataagtgataatgttgcaacaagtccaggaattctgaacataacaatcatgaataagcaaagtaatgcaagacctatagcagctgcaattaaacttgtcttgattgctgcatgtccaagctgtgcaccaacaatgttagagcttacttcctcaagtgtaagaggaatagaaccaactcttatgtatgttgcaaggttatctgcctcatcgaatgattccatacctgtgatagttgctgtaccacctgatatagctgtcttaacgttaggtgcacttacaacttctccatcatatacaatatatattcttttaccgatattagctgatgttgcatcgtagaacttagttgatccctcatctgtaaatgtaagctgcactccataaggagtatcttcctgactattagtatctgtgtaagcctgtgcagcttttacatcagaacctgtaagtagtggtgtgtagtcatttccctgtgaaaatgctgtatatcctgtggaatcaaggaattccaatgaacctggtgtaccaagttccttaagaatctcattagcatctgttactccaggaatctcaactgtgattctgttgtcaccttccttataaacctgtgactctgtactctttccttctactcgcttctgaagcttatagattgtatcctctacatcctgtgatgtaaagttatcttccttaatctggtatgtgatacttacaccaccggcaagatcaagaccaagatctatatcatatgtgcttccgtatccctttccattaagtccgaaaaatgctgttaatacaagtccaaccagtaaaacagcaacgattattgaataaataatcttcttaggtaaactgtacttcatgttaaaaactctcccttttacttattcttcctcagccatagctgcacgaatcattattgcacattctatacgctttttctgaagttcacatccaacatcatacgcatcattgatattaccatggaagttatatgagttagctgcacaaccaccactgcaatagaattttgcaaaacaattcttacatttttcctttgaatagacgttactattcttaaacatgtctctgatgtccggtcttactattccatcatcaacattacccataaggaaatcttcattaccaacaaactgatgacatgggtagaaatctccccaaggtgtaactgcaagatactcacagcctgaaccacatcctgacaatctcttggcaacacatggaccaccattaatatctatcataaagtggaagaaattaaagcctttaccagctttctttcgcttaatgatttctttcgcaaggatatcatactgttcacaaaggaacggaatatcctcttctcttatggcataggaatctgttggctgagcaacaacaggttcaacagaaatctgctcaaatccttcatcagcaagatgaagaacatcttctgaaaaatccagattattatgtgtaaatgtacctcttacataataattcatctgatttctgctctctgccactttcttgaacttaggcattataatgtcatatgaacttccatgattgtttcttgtaggacgcataaggtcgttaatctccttacgtccatcaatactaagaacaatattgctcatttccttattggcgaaatcaagaatctcgtcattaagaagaataccattagtcgtaagtgtgaatctgaacttcttattattagcctcttctatgcttcttccgtattcaacaagctgtttaacaacttcaaaattcatagttggctctccgccaaagaaatcaacctcaagattctttcttgaacctgaattggcaacaaggaaatcaagtgccttctttcctacctcatagctcataagagctcttcttccatgatattcaccttcttcagcaaaacaatatttacatgcaaggttacaatcatgtgctatgtgaagacataacgctttaacaactgtaggtctgtccttaaagttatcaatatatggttcatatatatcttctgtaaagagctggcctgcttccttaagttcgccaatctcttcatatgcctctttaatatcctgaacagaatatctgtctctaagtgcatctgtaatctgctcaagagtattattctcataaagtcctataatatcgtataccatgtcatcaacaacatgcacagaaccgctgttgacatctaatacgatgttataaccattattcttatactgatgtatcattaaaaagcctccaaaccgtaaatgttctctatacatttacgaaaaataagagagtgcagaatagttcgacactctcttactaaaaatactagttattcttattctcacagctctggttaccaactgtgcaagatgtcttacatgctgactggcatgatgtctggcactcgccacatccgccgtgcttcattgtatcctttaatacgcggttgctgattgtcttaatatgtttcacgacaatacctccttcatatattcaaattatatcgtattatatcatgtacaagtcttattttcaatcatttattctaaagatttgttcagataattattcttctttcaaaagtcttttcgcaatttttatgtattttgcattaaatacagctacttttcttatgtttttacataaattattgttttatattattaagatatgctatgtattaatataggagattattatgtttacatctaaagatttaaagaagcttattattcctctgatatttgaacagctgctggctgtcagcgtaggctttgttgatacattcatggtatcaatagcaggagaggcggcagtttcaggtgtcgcacttgttgataatataagtaacctgcttattcagatattatcagctctcgcaaccggaggtgctgttgtatgcagccagtatcttggcagcaggaatattaatatgtccaagaaatctgccggacagcttatatttattatgagtacactatcatcattactgatggttatctctctcataggcaatcacggtatcatcaatttcatatttggcaagattgaaaaagatgtatttgaaagtgcaagtatatatttctatataacagcaatctcatacccgttccttggtgtttataatgcaggtgctgcacttttcagaagtattggaaacagtaagataagcatgaacacaagccttatcatgaacataatcaacatttgtgggaatgctttatttatatttgtatttgatatgggggttgccggtgtagctttagccactcttatttcgcgaatcatatcagccataattattattggacttatgttcagaacagaatcagcaataagaataaagacctgcaaagattttcttccatcaccttctatcattaagaagattctgtctattggtcttccgagcggattggaaaacggcatgttccagataggtaagctttctgtttcaagccttgtttcaacatttggtactgctgccatcgctgccaactctgttgccaattctgttacaatgtttgccaatattccgggtaacgcaattggcatggcaatgattactgttattggccagtgtataggtgcaaagaagcctgatgaagccaaaagatatggaaaaaaacttatgtttattgcatatgcaggtattcttgcaaccaacattgtaatgacaatagttgccgttcctgtggtaggacttttccatctgtcaccggaagcaacaaaaaccggtttaagccttatccattgcttctcaattgtagcaatattcatatggccacttagctttactatgcctaatgctctccgtgctgccggtgatgccaaatacacaatgatggtaagcatcttctctatgtgggcattccgtgtgggaagcagttaccttcttggtggtacattaggacttggggtactaggcgtatggtttggtatgttcatcgactggggattccgttcacttgcattccttataagattcatccgtggaaaatggacacagaaggcggttatatgatgataattatatgacagtctgatgtctgtgaactgcctcttaacaccggatatctactgtcagatagacgacaagtcgtctaattctggatatacaatgtcatttgtgtgctgaatatacttataaactgtgttaaccaggttattttacatatattattatgccctacctataataacaattaaaatgtatgattaataggtaatatttctacttaatttctttttaatccagcttgaataacgaaaaagcctataagatgtatgcatcttttacatcttataggcttttttaacgtttatcttagtagttatttatcaaaattacctatcaagcaccccataatgcgactacctataggtatcacatcaataaaaaagttcctgccaatcaggcgctttgagcccgccggtacttaatgagcgtgtaacgcgaatttagtaccgctgcgaggcgagagcagcgaaagcgtgcctgattggcaggaacttattttatttcttaccaacttattacttcatgtccgtcctctgttacaagaacctgaatttcccactgtgctgaaggaagtccatcagctgtagatacttcccagccgttcttttcatctgtaacgacatttaccttacccatattaaccataggctctattgtaaacatcattcccggagccataaccatatctgttccttttctggtgttgtacccaacccatgggtcttcatgaaattcaagtccgactccatggccgccgatttctcttacaacagtatatccattagcatatgcatggtcatgtactgcctgtcccatatcgcctaagaagccccaaggcttaacctgctcaagtcctaattcaacacattccttagtaacatcaacaagcttctttacctcaggcttaacatcacctatacagaacattcttgatgaatctgaaaaatatccatgaagaattgtagaacagtcaacatttacaatatcacctgacttaaggataacatccttagatggaaatccgtggcatacctgctcattaacagatgtacacacactgtaaggatatccttcataattaagtggtgctggaattcctcccatatcagtagttacatcatatacaatcttatcaatctcagcagtgttcatgccttcatgtattgctgctgcaaccgcatcaaggcatgctacatttatcctggcactctctttaatcttctcaatctgttcaggtgtcttgattaacttgtgtgatggaacaatatgtccaatatcctcaagatatcttaacttatcgtcaaatgcttcatgacacgctttgtatttcttaccactgccacaccagcaatggtcgtttcttcctaatttcttaatcattgttctgccttcctgttacatatattataatcatacacaactataaggctttcttaatattttttcaatatctgtttcaaatgattaatcattattaacattaaaagccctgattcccggatatactgcactagtgccaagctgttcctcaattcttaaaagctggttatacttagcaactctttctgatcttgaaggagcacctgtcttaatctggcaagtgttaagagcaacagcgaggtctgctattgttgtatctgctgtctcacctgatctgtgtgagctgattgctgtatatcctgctttatgagccatcttgatagcttcaagtgtctctgaaactgaaccaatctgattaagcttgataagaattgcattacctgctccaagttcaattcccttagagagtctctctgtattagtaacaaaaagatcatcacctacaagctgaaccttatctccaagtctgtctgtaagcttcttccagccttcccagtcctcttcatcaagaccatcttcaatagatataataggatacttctcacataatttagcccagtgctcaataagctcctctgctgtatactctgttccagccttaggaagcttgtaataaccctttcctttctcactcttccactctgaagaagctgcatccattgcaatcctaaaatccctgcccggcttatatccagccttttctactgcctgtaatattgtctcaattgcttcctcatctgacttaagtgccggagcaaagccaccctcatcgcctacagaggttgcaagtcctctttctttaagtatagctgcaagtgcatgaaatacctctgcacaccatcttaagcattccttaaagcttggtgccccaacaggcataatcatgaattcctgaacatcaagcccacttgataatgcatggcagcctccattaataatattcatcattggaacaggaagcctgtttcctgatactccgcctaggaatctgtaaagaggaatatcaagagagacagatgctgctcttgctgctgcaatagataccgcaagaatagcatttgcaccaagattagacttatccttagttccatcagctttaatcatcgctgcatcaactgcatatatatcagatgcatctattccaaagaggcagtcattaataacagtgtttatgttctctactgccttagtaacaccctttcccaaatatcttgacttatccttatctcttaactcaagcgcctcaaattcacctgtagatgctcctgaaggtgctgcgcctcttccaacagttccatccgcaagataaacctctgcctcaactgtaggattgcctcttgaatcaagaatttctctgcctataaccttttcaatctctaaatatgctgccatataatcctcctaaacaaatgctttgtaatctttcaagttagtttcttctaactttagcaatacaattctagcattatacaaccaaatccacaatgcaagaaaatgggaagttttctcattaaaaaacttcccattcataattatatccagctatttagtttgtatacacataaataattatttttccatcttctgtaaaaatgctttggttctttcattacttggattgtcaataacatcctccggctttccctgctcaacaataactccgccatccatgaatattaccctgtctgcaacttttcttgcaaactcaatctcatgtgtaacgataatcattgtcatcttttcatcagcaagctgtcttaaaaccttaagaattcctgcagtaatctcagggtcaagtgctgatgtaggctcatcaaagaaaagcatttcaggattcattgcaagtgctcttgctatcgcaactcgctgctgctgtcctcctgacaactggcatggataactgttctccttgccatcaagtccaactttctttaaaagctctttggcttctttctctacttcattcttgtcccttttctggacacaaacaggtgcatcagtaacatttttcataactgtataatgcggaaaaagattaaagttctggaacacaagtccatatgtattcttgatttctcttaattctttctttccaacatacactgaaactccgtccttgtcctcacatgcagtttcaccacctaacttaagagttcctgcatccattgtctcaagaagtgttgcacaacgaagcagtgttgatttaccagagccggaaggtccaagaattgcaacaacctcaccctcgttaacttccattgatatatccttaagcacctcagtatcgccgaaggatttctttaaatgtgatatttctaataatttcttcatattaaaatcctccttaatcaaaatactgcatacgcttttctaacttttccataaccatagcaacaaggaaattgaaaatgtaatagaacaatcctgctatgaataatggcatgatacttgctgttgaagccgctacctgcttggcaagtgtaaacatttctgtgtaagcaagtgcaaatgcaagtgatgtatccttaacaagtgttataacctcgttagtaaccggaggaagtactctcttaaccatctgaggaaatataatcttccagaatgtctgtaccttggaatatccgagtacctctgctgcctcgtactgtcccttaggtatactctcaattccacctctgtatatttctgcaaaatatgctgcataattaagtgcaaatccaataattacagcatagaatctgtatgttgccgtaaccttcattccaaacagataatatggtccgaagaacacaacaagaagctgtaacataagaggagttcctctcattatagatatgtatattctcgcaatccatcttacaatgcctattcttgactttcttatttcacatacaagaagtcctagcggcattgagaatataagtgttaagaagaatattgcaagagttgctaacattcctgatgaaagctgcttaactatatccacaagcctttcaccaaaagaagccttagcagtactggtgctgtcaaggagataggcactgtctgttccttcttctccaagacatacgctgtctgtaagtccccatttttcagcaatcttgtcaaatgtgccatcagcaagcatatcattaaggcttgtctgaacttcatctcttaatgctgtattacctaacttaaaaccaataccatactgttccgatgaaacagtctcatcaagcattgtgaacttgttacctctctgctcaagctggtactttgcaacacccatatccatacatacagcatctgccgaacctgattcaaggttcataaatgctgagttataatcagatacctgctgaagtgtcttaaactgtgccgcaagtgcaagattttcttctgtcgcatcctctcctgtaaatgctgcaagagctgatgaatcagcctgtacaataacaaccttacccttaaggtcttctaacttctttattcctgaaccagatttaactataacaacctgtgaattatcaatatatgccttagaccatgtatactcacgttctcttccattaagcgtgaaaccgttccatatacagtcaatagagcctgaactaagctccatatctttagaatcccagtcaataggctgcttaaccagattccagccatttctttcacatacttcctgtgcaagatcaaggtcaaaacctacatactctccactatcatccttgtaaccataaggtgggaattccgcatcaaatcctactgtaaatgtagttcgtccatcatcgctctttttattactgcatgctgtgaacattcccacaatcacagacaacattgccagtaacaggacggcttttctgatattcttagccatataaaaatccatgcctttctcgctttaatatgctttcactttaccacagtaaatcaagcttgtctattataacatgaatcacctgataaaaacactataaatattctaaataaatccaaaatttctcaatataaatatccacgctgtaagagtcacacttgaaagtaatgttgtaagcacaactatgcttgatgacagcacctcgtcattatccatacctttagccataacaaagcaggtaactgtagatggtgaagcaagcataataagaattgccataagttcctgattacgaaatcccatttttactgctataggaagaaatattgctgctagacccacgagttttaaaaatgtagcaataaccgtaggtttaatcttcttaattgcctttttcccttcaaatgacgcaccaatacatataagtgcaacaggtgtagctgtctgcgcaatattattaattgtcttattgataattaccggatatcttaatcctgcaagagaagataataaccccagcacaattcctataattatcggattagttacaatattaaagcacgcttttttaatgttttctttcttatccgtagattgttcttctgtgctgccatgacactcaggatgtgccttaaaggtaagcactattaccgaaaatatattaaacaacggaactgcagcaactatcataagtggtgccattcctgtactctggtacatattctgtataaatgccatcccaagtatcgccgcactgcttctgaatgatgcctgcacaaatgcacccttctgcgtatcatccttcatgaatatctctgtgcatatccatattccgctaaacattatagtagtaacaatcatgcagtacagtacaaacttaacatcaaactgcgatttaaaatctgctgctaaatccctgaataacagtactggaagtgccaccttaaatacatatttattagccacatttgcaaaatggtcatctataacgccaagctgctttattacccagccaactatcataactaaaaatattggtaccgttgcatttatactatataagaagctgtccatctgtctctccttctactacttattaatatcaagccagtatgtatggtcaagcgggccgctgccgcttccaagattaagccctgctttcaacgcacctgtcaggtactccttagctgccttcacactttcttctattgataatccctgtgcaagattagctgcaatggctgatgacaatgtacagccagttccatgtgtgttaggattatcaatcctttctccattaagccacactatactgccatctacgcacagacagtcattagctgtatgaactgcatgtccaccttttactaagacagccgcattaccgccttttgtcttcagatgttcatatatctttatcgctgctttctccattgaatctgcactgtcaacagtcattcctgtaagaacctctgtctccggaatattaggagttataacatcagcaagcaccatcaggcgttctttaagaacctctgctgcatcttctttaataagtctgcttccacttgttgataccataaccgggtcaagaacaatattttttgccttatatgtaattaacgcatctgctattgtttcaataagttcctttgacgcaaccattcctatcttaactgcatcaggatatatatctgtaaatattgcatcaagctgtgccttaaaaaattcaggtgaagattccgatattcctgtaactcctaaagtattctgtgctgtaagggcagtaattgctgacattccatataccttatgtgctgcaaatgtttttaaatccgcctgtattcctgctcctccgctgcaatcacttcctgctattgttaatgctgtattcatataatttcctttctacatctattctcatcgctgcatgcacaaaaaaagcaccgaggttacctcggtgcttttagtgcagtcggcgggacttgaacccgcacccaagcaatatggactagatccttagtctagcgcgtatgccaattccgccacgactgcttgttttgttttcgtgtcgctcgctgtttgctgacgacttgattataatatcaccacatcaatataatgtcaacagcttttttaaacttttttgaaattttttgaattttctgttttttcatgcttcgacttcctttttggactttttcgtgcctttcctctgcataaacgtccaatccaaccagctttgacttcttttttggacttcatcgtgccttccctctgcttcaacgtccaatccaaccagctttggcttcttttttggacttcatcgtgccttccctctgcttcaacgtccaatccgaacagctttgacttcttttttggacttcatcgtgccttccctccacttcaacgtccaatccaaccagcctcgattccctttcagataagaaattttaaaaatgacagctattcatattgacacattttcaaatctcctataaaatatcaatgttgtgtaacttattaagtttgttatacatcatatatgcagaagtgtcggaatggcagacgagcaagattcagattcttgtgcgggttaccgcgtgtgggttcaagtcccatcttctgcactgattaaaagaaccgtgtgattttatgtcatcacacggttctttttgaatcatattcaatctgttttcaatgtaaatgctatctctgttcttccagcagttcatcattctgctccttcaaatccactatctcatccttcattctgtcgaccatcaactctgccatattcctgtccaatattctcaacgcttctgaaaacatactgagcacctcttcctgctttacaatattttcttgcttttccttttatctgcatacatagctttatctgcttcagcaattgaatcatttaattcttcttcgttattcgctatggatatgccataagaagttcccactgtaacgttctgtaactttatattaccttcagaattttttatctgatttataattttatcactatcctttttatcacattcctgtaatagaataagaaattcatctccccctaatcttattaatacatctacaggtctaatataacgctgcatattattaacaatggtcctaattaagatatcgccttctttatgcccataattatcattataatatttcaaattatttatatcagccataacaacacctactggatatttaagtttatttttatattcacctgattcgtaaaaagacctgttatatgtttgtgtcatcatatctgttatactataattttttaacttttcttgtaatttaatcagattagaaatatcttatacaatcccaactatacccattacatttccatcagcatctaatacaggatttttatttatctgataataaaacacctcttctccgaactgcattttctcaatataattcacgttatttttcgtctttattatattcatatcttcttcataaaacttttttccaagtgttttatctggctgaatatccaaatccgtttttccatatattgaaaaactagaatcaccgttgctgtttaacatattacatacatgtgtcgataaaacatatctgccattagtgtctttaaagaaaatattctcattaattgcattcagaatgcactgtaattctcttctatccaaatccataagctatctcctttgtatatctccactgctttacaaagtgcatttattaaccatatccccaatatcattttcgtaattatatcatcttttagcaaacaatacaatgctatgagcatttttatattagcctacggatataatatagaatgtaaaatcatagaaaaatagtggaggtaatctatgattaatggtttaggagaacgtttacaggaacaacggacaacacataaactatcccaacgagaagttgcattggctctaaatgtatcaccaactgttatctcgaactatgaaaagggagagcgcacaccaagtttggaaatgcttattgcactcgcgcgtttctaccattgttctactgattatctagtcggttttgaaaagccaaacgccaatacaataaatgtttctatgcttacagataaacaaaaaaatttattgaagctctttttagaagaactataaaaacattttatgatatataaaaaggatactgtcatgagtcaactcacaaacagtatcctttaataaccaattatataactttccttttcaatatctcctgcataacaaaagccttgcgcatctcattcttatcaaacttaaggtcatcaagaataactttacctcccgtctgactctgtggaacaatctcatcattatattcatgtccgcagtcatactgtgtaaatgtatgtccgcctgtcatatcagaatatgttccagtgcttcccgcctgcataaccggtgaatgaaattctgctttatcaagtgtcttcattgcaggtgctgcattatctgctgctggcggtggagtaacatattgcggaaccggtgcctctgctctatgcgaagtaacattcttgccattaaagtcatttcttgaacgaatctcctgcttaagcttttcagtttctgcacttgtcatcttctgagaacctgaatatgtctgtacagacggatcaatgtactgcttttcaccataagaattcaccatgtatggtgcagactgtgcatggctgtcatccttcttattcagattagcaccgtggcttaatgagccattcccagaactgttattctgcatccgatgcatattactaccatattccggcacattctggttatgttcctgcatattacgctggtgttcctgcatgcgctcctgctgcatcttcttggctttattcatattcattataactataataatgaatattgcccatataattattatttccatacaaatccgctttccttttaattcacaagttcattaaatagttgccggcttctctgtttctcctgctatcgactgtctcatcttagtatcagccttcagattctgaaggtcataataatccttaaagcccattctgcctgttcttaaagcttcagccaaagccttaggtacttctgcctcagcagctacaacgcttgctttcatctcctgctcaagagcaacagcggctgctcttctttcctctgccttagcctgtgcaatattcttatcagcctcagcctgaaggctctgaagatgagcgcctatatttcttccgatatcaacatccgcaatatcaatagaaagaatctggaaagctgttccaatatcaagacccttctgtaatatagccttggagatagaatcaggattctcaagcacgctcttgtgcgaatctgctgaacctactgttgttacaataccctcaccaactctggcaattacggtagcctcacctgcaccaccaaccaactggttaatattagttcttacagtaactcttgccttaactaacagttcaataccatccttggcaactgctgaaatattaggtgtctcaataaccttagggttaacactcattctgacagcctctaaaacatcacggcctgcaaggtcgatagctgctgccatctcaaatggtatgttcataccggctctgcttgatgcaataagtgcattaacaacagcgtctacatgaccacctgccatataatgtgactcaagctgattagtgttaagctgtaatccggcttttcttgcctgaataagtggaagcacaattcttgctggtggaacctttctcaatctcataccgataagagttcctataccgacatggcttcctgatgctaatgcagtaatccataatctcattggtacaaatgcgaataacaatataagcagtaccacaataatgattggaataattggaatgtaaggcataattaatccccctttatatattttgattttcaaaaatattattacatataatgagaaaaaataccacatttatatagaatcattttaaaaaatctgctatagtaattagtaatcgataattttttgtcaattattacaaaggaggtttcattatgttatctaatgatgctactattcagaatatcaagcatgaaatcctgtatgaagttgccaagctcgcatatgcaggaaggtttgaagaagaaaaggacgaactggcatacaagatgtttcctggtcctaaagcaagattccgctgttgtgtatataaagaaagagaaattgcaagacaacgaatccgcctggcagaaggcaaatgtccaacagaaagtgaccatccgggtgccaataacataatccaggtaattgaagccgcatgtgccgactgtccactttctcactatatcgtaactgataattgcagaaaatgtatgatgaaagcctgccagcaggcatgtaagttcggtgctgtaagcatgacaagagacagagcctacatagaccctgacaaatgcaaggaatgcggcatgtgtgccaaagcctgtccatacaatgcaatcgcagacctcataaggccatgtaagaaaatctgtccagccaatgctattacaatggatgagaatggcatctgtgaaatagatgaaaacaaatgtatccagtgcggacagtgtatccacgcctgtccattcggtgctatcggttctaaaactgatatagttgatgtaataaaggcaatcgtagacggaaagaaagtcgttgccatggtagcacctgctgttgaaggacagtttggagacacaataacaatgagcagcatccgcacagcatgcaagaagctgggctttaatgatatgtatgaggtaggtcttggcggagaccttactgcacaggccgaggcagaagaatggcttgaagcagctaaagaaggaaagaagcttacaacctcatgctgtcctgcatttgttaatctgattaagaaacagtatcctgagcttgcagaacatatatcaacaactatatcccctatgtttgcactttcaagacttcttaagtcagaagatcctgatacaataaccgtatttatcggaccatgtatagccaagaagaatgaaaagcaggaatataagggtcagggaaatgctgatttcgtacttacactcggtgaattcagagcaatgatgcgggctaaagaagtagttcttgagcctgaggaaaacagcgaccagcaggcaagcatatatggtaaaagattcggtaacggaggcggtgtttccgctgctgttgcacaatgtatgcgtgaagcaggtgctgaccctgataaattcaatatagaaaaatgctcaggtgctgccgaatgtaagaaagcacttacacttcttaaagtaggaaaactccccgcagatttcattgagggaatggtatgtgaaggcggctgtgttggtggaccaagccgtcacagaagcggaaagaatcctgttcttgctgccaaagaccgtgacaagctgctcgccgaagcagacaaccgtaatgtttcagacaacttaagtaaatatgacttaacagcattttcaatgcacaaataaaattaacgcaaaatagcgttggcaatattcacattgtcaacgctatttttttagtgctgcttttaaagtaagcacaacaagtttttcaaatatcacactcaatacaacaattataaccgtccacgccagcaaatcatccgtatcaagatatattttcgacatataaagcatttgtccaacagaacctttgggcattccgataatctctgctgccactcctgctttccaagccataccagcagtaactcttcctgctgatataagataaggtgaaagctgtggcatgataatataacgtattctgcgaatccaaggaatatgaaatacatctgccatttccctaatgcctttatcagtacttctaagaccggtcagtgtattctggtatataacaggcacaactattaaaaatgcaatgaacaccgacaggttctttgccgtaaaccatataagacatataaccacaaaagacgcaacaggtactgccttaattgtaaccatccacggccacagaatatattcaacaggcttacatatatatgcaagcactgcacatataattccacacaataatcctgcgagaaatccaccgacaatatgatacattgtaaaccacacagttcctgcaaaatccggttcatgccatatagtaaataatctgccaagcacctgtaccggtgtcactaataatatcggtgaatcaatctttagcgcagctatttcccataaaataagtgccagcataactgccagcactttatatattacattcaatatcttcttattaatattcataatagaaatcatctttcggcatactgccacctaccgacttaggattctggtcatataacacctgtaagaacccttctagtgcacttctcatgttattattaatatagcatacaatatggcacttaggaagagccttcttagctattgcttctgatgcaacaattccatactcagcaataagctgtgctgtctcatcaatattgcttgaagtatatgcaacactttcgttatattcatcaatgaacttcttaagctgttctggatatttttcagcaaattcttttcttacaacaattacacctgtaacaatcttagaattattattaatcttctcccatgcttcattaagatccataacaactcttaaaccactaatctgggcacttgctgctgtaacaaaaggctgtggaagaacagcaattgcaccatcttctgactttaacttagaaagtgcttctgttgtatctgaacaccacgcaatattaacatctttgtcggcatcaagtccgttacctgaaagaatatatcttatggtatattccggcacagcccccattcctgtagcatatatagtcttacccttaaggtcactgatactgttaacagtgttgcctctttctacaagattaagaacgccaagtgtattaacagcaacaacctggaccttgccttgcgtcttattatatatattagctgcaagattagatggtacagctgctatatcaatctccccggttgcaagtggtgttacaaatgcagatgcatctgtagcaaaatcttcaaatgcatatgtgttcttagtattgccattctctgaatctttacgcagcttaaccattcccattgctgtaggtcctgccatagctccgattcttattgttgttgtctcttctgtctgactctcgccttcgttattagctgattttcctgcacatgccgcaaatgaaaataccataataaccgaaagtataactgctagtaatttcttcaacttattattctcctgatatatttaattagtattccatgaactcctgtatatcccttaatacatcctcaatctcgccttctccgtcattaattgtaagctgtaatggtttactgatatccagactgaacaaaccaactaatgatttgccatcaacacagctatatcctgattcaacatcaaacccacatgagtacttactaattgtacttacaaacctttgaaccttctccacagaatccaaaagaatcatcactgtcagcatattatctcctccgcttcctcatattgtaattcccatatcagagactaatatacaccataaaacttataaaaacaaccattaactaagactaaaatatggcacggatgccacagaaaacgcttatctaagccgttttcatatcatccatgccatattctgataatcataaattagagattagtatatcccataaggtagtaatcaactgctcttgcacagtctcttccctgtcttatagctttcacaacaagtgactgtcctgtatgcatatctcctgctgtaaatacacccggtacacttgtttcaaatccgtctgctgctgtctttacattagttctttctgtaagttcaactccaaatgcgtctgtaacatatttctgtgaacccaggaaacctgctgctatcagtacaagctcacatggaagctctgcttctgttccctccacagggaccatcattcttcttcctgtcttttcatcagtcttagactcaagctttactgtaacaacacttgtaagattacccttcttatccttcttgaattccttaactgtagttgtatatattcttggatcatgtccgaatactgcaattgcttcttcctgaccgtaatctgtcttgcagactaaaggccactgtggccaaggattgttctccgcacgctcatctggtgcttttggcatcatctcaagctgtgttaccgacttacagccgtgtcttatacatgttccgacacagtcattacctgtatcaccaccaccgataacgataacatttttatcctttgcagaaatgtatctgccatccttaagtcctgaatcaagaagactctttgtagttgctgtaaggaaatctactgcaaagtatattccattggcatctcttccaggagcattgatatctcttggattagcagcaccacacgcaagtactacagcatcataatctgccataagcttcttagccttaatgttctcaccaacatttgcattagttacgaactcaatgccttcttccttcataatatcaagctttctgtcaattatatgcttttcaagcttcatattaggaatgccatatcttaaaagtccaccgatacggtcagctctttcatatacagcaacactgtgtcctctctgatttaactggtctgctacagcaagtccggcagggcctgaacctactacagcaattctcttcttagttcttaccttaggaggatttgctttcgcataacctttggcatatgcatgttcaatgattgccatttcattctctttggtacatactgccttgccattaagtccgcatgtacatgctttctcacagagtgcaggacacacacggcttgtaaattcagggaagttacttgtcttatgtaacctgtgatatgcctgttcccagtttcctgtgtaaagaagatcattccattccggaataagattattaagcggacatccgctagtcattccctttattgtcataccagactggcagaatggcacgccacagtccatgcagcgtgaactctgctttctctgctcatcttctgacagaggtgtatgaaattcattataattctttattctttccttaggtgaaaccgctgtagcttcaactctttcatagtctaaaaatcctgttggctttcccatggttagctcctttcatgtatgttataaacttgcactgtccctacgggtgcacttccaaaagcttcgcttttgtcagtcgcgactgcgtcgcctatgcaagatacagaacaagtacagctgcaggtaaacctgcactgtcctttttctacatcttgcgcaccctacttggtagccgcatagaatgcttctatctgagcctgttcgctgctaagtcctttttcttccatctgtactatcatgttaagcatcttcttataatcatgtggcatgattttcttgaactttggaagatattctccgaagttatcaagtatttccttgcccttcttagaattagtataagcaacatgttctgttataagctgctttaactcaaggacatcatatttgttagaaactgcttccattgaaacgagctgcttattaactctcttgtaaagacttgtgtcttcatcaagaacataagcaattccaccgctcataccagcagcaaagttcttgccagtcttgcctaatactactactgtaccacctgtcatatattcacagccgtggtcaccagttccctcaacaactgctgttgcacctgaatttcttacacagaatctttctccggcaacaccattgatgaacgccttaccacttgtagcaccatataatgcaacattaccgatgatgatattctcgtcttccttataagtacttcctgttggtggatatacaataagctttccacctgaaagtcccttaccaaagtaatcgttactatcaccgacaagctcaagtgtaagtcccttaggaataaatgcaccaaagctctgtccgcctgcgccattacattttactgtatatgtatcatcatcaagcttatcatcaaatcttcttgtaatctcagcgccaagaagtgttcctaatgtacgatctgtattggcaacatcaatttcaagacttctcttgcttcctgtctccatggcagattcgaacttcttaagtaaaatcttttcatcaactgtcttctcaagttcgaaatcaaatacatttttcttatcataatgtatctttgtctgcttaacatatggattatcaagaatctgtgataaatcaatctctgctgaacgtccgctcttggcaacattcttctgctcaagcagatctgttcttcctaccagctcatcaagtgtcttaattcctaagtcagccattatctcacggagttcctgtgcaatgaatctcatgaaattaacaacatattcaggcttacctgtaaatctcttacgaagctcaggattctgtgttgcaacaccaacagggcatgtatcaaggttacatactctcatcattacgcatcccatagttacaagtggagctgttgcaaatccgaattcctctgcaccaagcattgctgcgatagcaacgtctcttccgctcattaacttaccatctgtctcaataataaccttattacgcagtccgttcattgtaagtgtctgatgagcctctgcaagacctaattcccaaggaagtccggcattatgtatagagcttcttggagctgcaccagtacctccgtcataaccagaaataagaattacctgtgcgcccgccttggcaacacctgatgcaactgtaccaacaccagcttctgaaacaagcttgactgatattcttgcattcttgttagcattcttaaggtcgtatataagctgtgccagatcctcaattgaatatatatcatgatgtggtggtggtgaaataagcgcaacacccggagttgaaagacgagtctttgcaatccaaggatacaccttctttcctggaagatgtccaccttcacccggcttagcgccctgtgccatcttaatctgaatctcctgtgcgcttacaaggtatcttgaagtaacgccgaatcttcctgatgcaacctgcttgattgcagagcatctgttaagaccatccggaccaacctttaatctgtcaatgtcctctccaccttcacctgagttagacttaccatgaagcatgttcatggcaatagccatagtttcatgtgcctctcttgatattgaaccatatgacatagcaccagtcttgaatcttcttacgatagaatcaacactttcaacctcatcaatgctgattcccttcttagggaacttaatgttcataagacctcttaagttcttaacaccctcttccttattaacaagagctgtatattccttaaatgtcttgtaatctcctgttcttgtagcaagctgtaacaaatgtattgtctgtgggttatacagatgttcttccttgccgcttctcatcttatgagcgcctgagctgtcaagagtagtatctgtagaaagtccaagtggatcaaatgccttagagtgaagtgtctcaacatcttcctgaatatcatttagtgacacgccttcaattcttgaaactgtacccttaaagtatttatctataacatctgaattaattccaattgcctcaaatatcttagcaccctgatatgactggattgttgaaatacccatcttggcagcaatcttaacaatacctgtgataattgccttattgtaatcatcaactgctgcataataatccttgtcaagcatattaaggtcgataagctcctgaatactctcctgtgcaagatatgggttaattgcagaagcaccatatccaagaagagttgcaaaatgatggacatctcttggctcaccactctctaagattacagccatgcttgttctcttcttagtctgtacaagatactgctgtaatgcagcaaccgcaagtaatgaaggaatagcaacatggttctcatcaacacctctgtctgaaagaataataatattagcaccttctctgtgtgctctgtcaacctcaacaaataagtgatcgatagctctttcaagtgaagtgttcttataatatataataggaatagtctctaccttaaatccttcaacattcatattcttaatcttaagaaggtctgtgttagtaaggattggatcattaattcttaactgtttgcagttctcagccttttcctcaagaatattaccctctgttccaagataaacagttgttgatgtaacaaccttctctcttattgaatcaattggtgggttagtaacctgtgcaaataactgtttgaaataattaaacagcggctgatgcttgttagaaagtactgcaagtggtgtatcaatacccattgctcctgtctgctctgttccattaagcgccataggaagtattgaagtcttgaagtcctcgtatgtataaccaaatgctttctggagtcttgctctttcttccttagtatgaacaggaaccttcttgttaggaatctttaaatccttaagctgtataagattgctgtcaagccactcaccatatgggttcttagttgcatattcttccttaagcttatcatcctctataagttcacccttaactgtatctataagaagcatttttccaggtcttaatctgtcctttaacttaattctgctctctgggattggaagtgcaccaacctctgaagaaagaataagataaccatcgttagtgatataatatcttgaaggacgaagaccattacggtcaagcactgctccaaagtaatctccatctgtaaatgcgatagaagccggaccatcccaaggctccatcattgttgcataatactggtagaaatccttcttctcctgtgccattgcgccattgttaatccaaggctcaggaattgtaatcataacagcaagtggaagcggcatgccgttcataacaaagaactcaagtgtgttatctaacattgctgaatctgaaccgttagtattaacaaccggagtaatctttgacatctcatcttcaagatatggagatgtcattgtctcttctcttgctaacattctgtcggcattacccttgatagtattaatctcaccattatgtaccatgaatctgttaggatgagctctctcccagcttgggttagtgttagttgagaatcttgaatgaacaagtgcaatagctgactcataatcaggattttcaaggtcgccaaagaactgacgaagctgtcctacaaggaacatacctttgtatacaatcgttctgcttgataatgaacatacgtaagttgtatcttctgctgtctgctcaaatactcgtcttgcaacataaagtcttctgtcgaattcaattcctttagctgcattggcaggtctttttacaaatccctgcatgatatatggcatacagtcaactgcctttttaccaaggacattaggaaatgttggaacatctctccaacctaagaactcaagtccttccttctcaacaatgatttcgaacatcttcttggctctgtttcttgccagttcatcctgtggaaagaaaaacattccaacgccataatcacgctcatctccaagctcaattcctaatggctttacggctttcttaaagaatttgtgtgatatctgaagaaggataccaacaccatcaccagtctttccttctgcatctttaccagctctatgctcaagattttctacaatgcttaaagcatcagatactgtctgatgtgtcttaattccattaatacttacaatagctccgataccacaggcatcatgctcaagttcagatctgtaaagaccaggctgtttgatttcattttccataagtctaatcatcctttcgtatattctaaagctttgcttgcacataatatactcctgttttataggttttgtaaatatttttttgctctaattgtctgataatataactattactattgtttattataattatcagacaattacacaatttgtcacaatattatctcttaaaatgtaatattatctttatttatcattatatgtttcacacttaatccctgcctgtttttaagcatagaagttgaattgtttctaaattgtgtatgatttttacctgtcggcgtaaaattagtaaaaaaataaagtgacaaaacccaacgtactaatttacaaggttttatcactttatattattaatgattatcaattaattattaacaggtactcctcctatcaggaaatcaactgctttctccttaacagaaaactgtatttctgtatgttctcctccatattcaccatcaagtgtccatgatacaggctgtggtgattcaaaccttacagactcggtcttccatgtacatacccagtcacatttgcttaggtctttagttataaaagcattaataagcgattggactgctataggattgttaagctctcttatcagtgtaacttcaaataatccatcctgaagattaacatcattgccggtaagattctttattccaccaactgaatctgtattgcttatcattccatatacaaaattgccctcaacattcatctcctcagaatacacacgcatatactgtggtttaatagttgataagcttctgactgcttcaattacataagcctgatgtccaagtatattcttaagattctgtggagttccataagaaacccttgtaaacgccccaaatgcagcaacataattaaatgagcgttctccatttacaattcctacatcacaaggaaaacgtttaccctttgctatattaacagcggccttcgtcatatttcttgggattcccagactcgcagcaaaatcattcgttgttccactaggaatataccctatcggcggcttctctcctttatacttaagaacagccgcaaccgtttcattaagagtaccatctccaccactacatgttatgacatcatacctgccttcattatctaaaatgtgctgataaccatcaagcggtgccttagtcggatatacagtaatctcatatccagccttagaaaacacctgtattatcttcatcagctgattcttaatctgagcttttcctgagtttggattaaaaacaaacagcattttcatcataatcacctgtcccatttatcacataatgcattaatctgatctgtaaacttagccagatctttattcgtaccaccctcattgtgtgtaataactgtcatgaggcgctttccagcagcaacaagtctgtcaaatacagttttaccacgctgtgtactcgtcgttcttctagtctttctttccttaacaccttcagagataactctgtctgcaataaggtcataacttccgcctgtatatggtgccatggcatcataaccatattcttctttaagacactccgtaaactcgtcacatacactgtcttcaccatgcacaacaaacacttttttaggctttctgtcaaatgcattaatccaacaaagaagcccatctttatcagcatgaccacttgaacccttaagctgtacaatctctgcctttatctgtatcggttcgccaaaaagtttaatctcctctgcaccatcaactattatacggcctgttgttccaacagcctgataaccgacaaatacaattgtacactctggtctccacaaattatgcttcaggtgatgtcttattcttcccgcttcacacatacctgatgaagaaataataaccttaggattaggatcaaagttaatctgctttgattcatcacccgtagttgcatacttaagtcctggaaatgaaagcggattaatcccctttcttacaagctcgactgcttcatcatcaaagcagctctcaacattcttaataaatatgttagttgcctcaattgcaagcggactgtccatatatacatcaaagtccctgccaacaagattatcttctttaatctttcttataatatagagaagctcctgtgtccttccgacagcgaatgaaggaataacaacattacctcctctttcaaatgttctcttgaatatattcgttaaatcttcaacatagttaggagttccaccgtggcttctgttaccataggttgattccatgactacataatcagcgtctgtaacatgcttcgggtctttaattataggcttgttgatattaccaatatcacctgagaacacaatcttctctgttacatcaccattctcagtcttttctgtagcccatacctcaatacttgctgaaccaagcagatgtcctacatctgtgaatcttatcttaattccgtcagcaatattgtatatcttatcatactcacagccaacaaactgcttgcagacattaactgctgcatccatatcatacaatggaacgaattccttaagctttccacctgatcttgcagcctttctgtttctccattcagcttcaaacatctggatatgtgcgctgtctcttaacattatctcacataactgtgctgtagccgatgttgaatacacctgccccctgaatccattcacatacataagtggaataagacctgaatggtcaatgtgtgcgtgtgtcagcaatatgcaatccacatcagatgccacaaccggaagctcctgattctcatatacatcattaccctgttccataccgcagtctacaagaatattaagacctgccgcctgtaagaaatgacagcttcctgttacctcatgatccgcgcctaaaaatgttagtttcataatatgcctcatttccgcgtcaacgctattttttcacgatatttctgatgtaattgtaacattttcctatgtaaaattaaatacaatcatatataaaaattgtattaattctctgtatattctatatccgtaaatgtaacatccgcatttctcgaaacgaagaatcctgcgtatacatgcttagggtctacggctgtcagcttaaaatcaaatccgcctgttaagaactctccatcgcctaattttactgcatagccgtccggattagactttatacatacttctacggtatcacccggcttaagctctcttcctgtcacgcttccctgcataagctcgctgttctttcttgcaaaacaactccatgcctggtctttataagtaaggttaagcggtgctgccgctacataatcgccaagtacatcgggcattttcttatcaatatacatgtcatctcttaccataagcccaaatgacacctgattgttatagaaataatcattaattgtcatcttagccttaagggtaaagttcacatttacaggaatcttcttatagtacattgcaattccgtctgtaacagcagatatcttgccatcattattcttaaccgcgatgtgtattccccctggaacttcttcaagtatataattatcagattccgttggcagagttgtaacatccccgaatactgtgcctttgaatccatatgcatctttaaagttcttgctgtcagcaagctcatcgctaaactctaccggcttgtatgaagcatttttttcaagatatctgttcttgtctggaagcggttcatctgcccttatattaactatattctctgaaagtcctgatattccagccttttcaagctcctgcataacaaggaacgcattaaccctgccgccccatatattagtgtgtgtattgtcaacacttacttctttattagatggccatgcgtgaagataaattgtctcttctggtcctaactcatcatataaagtctttgttttttcagtcatatcaacacagacgattccaaggtctcttgcaaggtcacggactgcctttgaataatcccctcccttaaactgcgctgcgtcatcagttatgtgaagctcctgccttgtccactctcctgttgcagttcttcttacaataggcgtacacagtattggtgtacatgaaacatcaagtgccggctttatataattatcatataatgatgctgcaaatgtgcctttcttatccctgccgcctatcgggcttgtatatcttcctgtctcagttttctcatcattatgtccaaatccgattataagaaaatctcctgctttcatacctgcaagaagctccttataattctcttccttagtaaagcttaagctgcttcttcctgaaagtgcaagattattaacctgcacattgctgttaagataacagccaagcttggttccgtatccatatcttggataatagtatttgtcatcaaaagaacttaatgttgaatcaccaacaacccataatgtactcatcgtatgtcacctcgttttaaatatatgtgttatcatcaatatgttttattaaggtagttttcgcggaggtgttcttccatcgcagctatctctttctcgaactctctggcagatataagcaggcatccctgtcctcttataattacctgttctacgccatctgatgttgccaccgttacattatatttctttccattctcatgtgcaaatttttctatataatggtcagcagtttccgctgtcttcgtaaatacaacatgaatattatgaaaatctataaactcctcatcatgtcccggaactctgtatgcgtcaaataccgcaatcagttcacaacccttcattgcctgataattacacaatatatcaagcagcctgcctcttgcactgtcaagattgacctgtgcaagctctgatagctccttaaatgcatgtattatattatatccgtcaacaagaagaaaactcttcttatctggattatattcaggtgctttaggagggtttttaacattggcattaccgcctgtaacatatcttccaactgctgtgtcagcttttcttttcgataactttcttctttcattatcgcctctgctgttagaaaaatatgtttcattcaagattctgtctacctcgtctgttccaatccactcgtcagacactgttcttgaagcctgctttgccgtaagcttgacctccctgtcagactgtccaccggcaaccccggaatccgtcacggctatctcgacatgtgcatgctctcttacttcattccacggcacaacatatcccgaaccgcctgcacagaatactgaatctaccgggtttcttgtatcacgctcaggctcatagccgaatcgttcaataacctcttctgtattatggcatggtctgtagcctgccatcttaagagcaagtctgcctgttcccttggtataggcattaacctctgcctgatagttgccaatcactgaaaccggaccttcacctgtgataacaacattatcaccatcagcctcctgcatgttaaatgctgcacccattctctcgaagtcggtcattgccctgccaacataatctctctttacctcaagtgaaaatgcgtagaatggctctaacaatactgattctgcttgcataagcccctgccttacagctctgtaggttgcctgcctgaaatctccgccttccgtatgctttggatgcgcccttcctgcaaccagcgtaatcttcatgtccgtgagttcagaacctgtaagcactcctctatgcattttttcacacaaatgtgtatacacaagcctctgccagttcttatcaagtatatcctcactgcaatggcattcgtatctcatgccgcttcccggctcacccggttcaagcagcagatgaacctccgcataatgtcttaaaggctcgaaatgtccgataccatacgccttattcttaattgtctctttatatacaatgcttccttcaccaaatgttacatctacaccaaatcttgtcctgataatattggtcagcacctcaataagcaccggacccattacgcttacatgtatttctttgaagttctcatcccattcaacatgaagttcaggttcttcctcctctagtgtacgaagctttgaaagaagtgccaccggatctgtccctgccggaagattaagcttataattaagtaccggctcaagcacaggtatattatcctctccgcctgctccaataaactgacctgccttagtctctgaaagtcctgtcacagcacagacagttccggcaaatgcttcattaatgcttgtaaacttatctcctgcatagactcttatctggttgaccttctcattgccaataagcatttttgattttaaagaacctccacatactttaagatgtgtaagtctttctcctctgtcatctcttgtaatcttatacacctttgccgagaactcttcgccgtaatcaggacagcttacatatgtatcaattccatttataagttcctcaactccgttcattctgagtgccgaaccaaaatatacaggaaacatttttcgttccataatcatgcggctcataagggcatcatcaacatgtgcagattcaagaaactgctcaagtgcctcttcatggcacattgcaacttcttcgtaatctatattattaaaatccacacatgactctgacagcctgttctttagctgctccataattcttgccctgttcgttccctgctggtccatcttattgacaaatataaataccggaattccaagtcttttaagcagactccacagcgtctcggtatgtccctgtactccgtccattccgcttattacaagaaccgctgcgtcaagcacccacaacgttctctctgtctcagccgagaaatcaacgtgtcccggtgtatcaagcagcgtgtatgaacttccgttgtaattataagccgcctgctttgagaatatggtgattcctcttgctctctccatatcccctgtatcaagaaatgtatcctgattatcaactcgtcctaattttcttatgcttcccgcactatatagtatcgcctctgacagcgtcgtctttcctgcatcaacatgtgccaacatgccgattgttatcggattactatgtgccatatcatttcctttctccaagttttattccataccttctttaagccatctcgcaatattggtaaaatcaatcttaagttctccattatatatattcaccggaaccagcttatcaaatccatatatcaccggatacacatcactctcaaagaaatacacaagaaccttctcctgcgcaaagtccagtatccagtattcacgcactccagcctccatatacttggaaagcttcaatgcataatccttcttcttggtagacgaagaaacgacctccacaacaaaatccggtgcaccatatataccaaatctcttaatcttagatgtatcgcacactattcctacgtccggctgaaccatagtcctctcatcacaatcaagctgtacatctacaggtgctataaatggacgacagtttccaccatattccataatataattagcaatctgcctgtgaatctctccaccaattgactgatgtccgaaagtcggcgaagccatatcataaaagcatccgtcaatcagctccactctctgttcatcaggcagtgccctgtaatcatcaatagtgtattcaccattctttcttgtcttatataatccacctggctcccttacttctaactgttcattaaaaacctgttccagtgctgtaagagtatcatatcgcggactctctgtttccccagaaaaaatcttctgcactgttcccagaggcaccccagacaattcagctatcttggcatatgaatatcctttttccttcttcttctctttcatctcattaattgtcatataaccctctccaatcaaaacatgagtatccgtacatgattaaatataatttctatactcattataagagttgtatatccattagtcaaccaaaatatagtaaataaatatccgttttgtaaccgttttatttccgagcttactggttgtaacttaaataatgttaaatatcgcacttgagcttagctcactcaccacatgattattcaataacctactagattgccttatcatcataatttcgtaggtcatttttgcactaaaaaagagttttatattctaaaaaacatactaaataactcaggtttcattaaatagtaggttatttcttggttttttcgttgcgaattgcttgaaaagcagaaaaaacacctactaatcatgcgtaaaacgcagttatagtaggtgttggtataaaaattttttgaaaagaatatcttaggcagcattttattaggtccaggaaacagattgtataccattttcttataatcagtataactccttctctccccactgccctgaattatctttttatcaggcttatttttgcgttaaaaactgcaagaaaacacttgtcatctacaaagtagaaattatttaaggttattcaaacatctgtaggttcgctaaaaatattattatctacaaagtagaaattatttaaggttattcaaacttccaatgttcgtttttgacggtggtgatctacaaagtagaaattatttaaggttattcaaacattatatatatatgtgttataagtataaatctacaaagtagaaattatttaaggttattcaaaccttaattcgtcaaatcaaacaaattattaaacatataaccttataaaaagcaatttatttgtgtattatttcatattttattgaataacctttaaataatgctttattaaagcccatgtttgcatcatgtaataataataaaatctttttcatcattttttgcatatccaaaccttagtacctcacaacttgaagataatttaaagatcataacactgtcttcctgactaaatttcttttcatacttattcttcaaatcactgattatattatctaatattctaatgctattgtcaatttcaaaaaccgaatactgtatcctgtgaccgaatttagacaaatattttgcaaaatttgttcttaatttatcatccgaaatatcgtaacttactattatcattttcacctctaatgaattataaacacaggtatctcacttacactttttcttttcataaaaaatctataatattgttgaatgtataaaaatatatcatctttatattccaatattgcattcattaagaactgtatatattgcggattagacttatattttaagcaccatctattattaataacttcgaaatcattttctttacattgtccaagatttattgattttcttacctgataatcaacaaccggtcttattggttccatcaagtcacaaaccaatgattttctcatgtaaaagcatttatgaaataccccgtaatatgtgtcaaatccataaacctgcaatatggcatccacaatattaaacagcatggtatgtaagattgtcctgacttccatataacttatgaaaatatatagaagccggacaaaatataaaatcatttaagttagaaataattatgatatcatccattattcataccttttattctgtataaaatcaaaccattcagcatgaggtaatttcaggcagttcctgtcaaaaccatcttctgtccactcagactttatctttaacacctcatataatcccttaagtgctatacaatatgcaccatttgcatctgcatcttttggcatcttgcattctttatcatctgattctttataattatctgagtcaaaaaaatctccttcatcattgattacaggtgatattattttatcgtaacttattcccttctcctgttcctctgcttcagtataactatttctcatctgaactgtaagtttatataaatataacagttgtgcaaagaattcagattttttatcttcatccatcttctccatatctatccttatatcatgtccatcagcataattaatttcattatcttttaataataactttattgtttctgtaagatttattgattttgttttgcctgttctccttgcattgttgaattcactctgcagtctctcaccattggtatatactgtccattgtgtcttacccatggtaatgttgtaggtatcaaaattattataatcaaatccaaaactgaacatgtctttttcggcacaatatcttatttcatcaaattgcataaagaactgttttctcgaagcatttgttgaaatgctcttaaaattaaatgcactgataaatccggttgacggatctatttttgatgtaaatgcagcaggtacataaaatattacaccacattgtttcccaagattcttcatattatctggtacatatgtcaattgatatccttttaacagtccccctggttcatctacagatttttctttagaagcaaaataattcagcttattaataagcatactctcgaacttctggtatacctgtcgttcaactttaaaacgacctcgcttaaatccataattcaaatcttccatagcaattattgcattatactcaaccataagcattgctatctcatgaactacccctgaaatatatccttctttcaactctttaatatttcctatagatttccagttctttctcgcatattctctggtcttttccttctcaaccagcttcttcttataatcataattattcaatatattataacttttctgtttaacgatatttccatgagaatctataacagaaatatatataagattacgctcacccctgtcaattccaataacatgtatatcatcattttgtgctatatattttacagccatgtcatttacattatttcgtgctgtcactttatagttaatagtaattggcgtatgtataaaatatttgtcaactgtatatctgtaatctttaacaatatccttttgggcagtcctgacctctactttatcaagatattcctttgcagcttctgacaagtcactttctttaatatatccgttatacattttataaatttcattatatatatcatctggaatcggtattcttacaacatcaccattatcaagctgatttttatatgtcttattaactaatacagaatcttttttatgcttaactggattttttacgcttgcctttctataaaataattccgcctgtccatttaacttaataacaatattcttaagattttcttcactaaaaatgttcttgaaatacatagtgtgaagattttcttttcctgtactgttctctgcgaagtccttattataaatctgaaataaatatatcttgccttcctcatcaagcttattaatatcagcttcacttatataagtccagtcaattctatacccctgcatttcaacttcacggtagaattcacttatatcgttataactatcagttgcagagaatttaaattcatattttctccattccgcatgtttctctatgctgttcttaaaataatcaattaaatccctacaaaaactgatatcaaaattctcacttgtcttaatatgtttgtgtgcattataaccggaaattatataatcagatggcttaaatgtttctattcctttctttgataagaacactttaggaagcattttattcgcccccggcaacagattatataccatcttcttataatcattatcgttctttttatcagaatttccctgtataatctttttatctggtttatttttagcattaaaaattgccagataatacttattatctcttattaaaattattgcattattatcaaactctttactctgcgaccaaccattagcaagtgtaggactttgaaaattaagttttattttcttagaagtgtatggtttctgtgtaacgtaatttctcaccctgttatataatggcactatattttctaatatattatagatatcgtctatatctgaataaaacatttcatctctatccagtacttcatcaacaataaatgcctttacccaatgatacatgttcatatacatatcaagccttttcttaatttcatcagctttttcttcgctctcaatcagacttatatgctcatcgtattccaaatgtgctgtttctgtatcagttattatattactaatttcccttatatattgcttagcattagaatttttaaattcatttcgttctttttcatctatatatttctcaactaaatcattaacatcattaatactcttatatttatcttcttttacagcttttttaactttttcttctttagacttaccttttgcatgtatattttcatcataaaaattttcaacgcaacctgtaattaaattccagttaccactcataaaacatgataatgtctcataaaaatcttttgatatatatattcttttctcatctaattcatcatatttattaacgatatctttcagttttccaattatattgcctttttctgtttcatcaataaacgcattaacagcattatatacgctcatatcatcttcaaacattttaggtacttcaaatgaagttgatgtatacgcaaggatttgcttatgcagcttacgcattttgaataaattataattattctttgtctgctggcaataaagattcatatgtgcattaaccacaccacatatttcattgtaaaagtctattcctgactgaattaataccatgttataaaaatccggattaaatatctgattcaattcccaatcacccattttatcctgattatttttttcaattacttctatttcatccaatgccttttctgagattttcttatatgatgtcatattagcaagaaaaatcaaagaattttcatgcacaattctataagctatagatgtagaaacagcctctttagtaaatacattttttctcttttcaaaaaaatccgtaaaatatgtgctaaaaccattaaacaatgctaatgtttccagtttgccagctttgtctttaacatcatattgattataatttttaataaaatctggcagtatctctttaaaaagctttgcattaaacatatttttataatcagaatctgattgcagatgtgtgcatatctgttccctcattttgttatgctctttttctaatgctttcttattgtcttttgatagacttgactgaaccgaattcattaattcaaaaagcagagtaaaatctagatcagttaaacctgataatgatttatctatatattctctataataatcatccattatattttttaactctgtgcttttctcttgtcttaactcatcttcctggataagtccattctgtattatatgctcctgtgtatgcccaacaggtcttaattcattccttaatgtctttgctactggtgtaacccccacaaactctctgtaaactatgctgcgatttccgttcatataaatatcctcctttactatgttcaatttttataaagtgatgtaatatatactcgattatatttaaaaaaataacgcttcctatgcgttaccttttaacaaatcactttaatctacctaaaagtagaaattaattttattatattaacttcttatatatccgtcaatattattctttaaatatattttatagattatattgacatattctctctgtattgttattatatattacacattggtgcatcattttatattttaactatatctcacatatgaaacatttaagaaaggcgacatatgaataatagcaaccgcactactcaccagaaagatgtctcccttaagactttctggcgtgataatgaacattttgcagatcttttcaatgctactgtctttaatggtaaacaggtgcttaaacctgacaaacttacagaaatggacactgatgtctctgctacaattcattccaaaagttacaatgaatctattaccagaaacagagatgtagtaaagaagatgtctgatggcgttgagttcaatattcttggtcttgagattcaagacaagacccattatgccatgcctctaagaactatgacttatgatgcactcggctacataaaagaatataatgatatcaaaaaacatcataagctgaataaagattctttcagttctcatgaagaatttctttctggaattaacaagtctgaccgtttccaccctataataacgctcgttctttactatggtgagtcgttatgggatggtcctacctgcctgtctgacatgatgatttccatgcctgataatatcaaggcttacttctccgactataagttaaatctggttcagatacttgattctgataaatatacattttataatgaagatgtaagagatgtgtttaatattataaggaacatatataatgatgatttcgattcaatatatcgtgaatatgaatcccgcaatgtagatattgatgtaatggaactgatatgtaacataacctcagttccaaagcttatggacttatgtacagatactgaacaaggagggactgtcaatatgtgtgaagcaatgaaacgatttcaggctgaatgtgaaagcaaaggtatgaaagaaggtatcgattccgaaaaagtcaactctatcatctccatgctagaattcggcataaccaaagaacagatattaaccaggtacactaaagaggatttagaaagagcagaagctgctatcgctaatgagaactaacaccatactaataatattaaagccagttaatctagcaattaagattaactggcttattttatctgatacttttatagatttccggtcttctgtccctgaacaatccccagctcacgcgaaggtcggcatctgcgtcaaggtcggattccccatagacaatttcttccttgtctcttgatgcctgtgttactatctcgcctgttgcatccgttacaaatgaagaaccatagaataaaagtgatgattcctgataaccattagcttcagatggtgtaaccttctcctcaccaatacggttggcagctactacaggaactatattgcacgctgaatgtccctgcatacatcttctccagtgcggcatgctgtcaacctcaagaatcggctctgagccaatcgctgtcggatagaaaaggatttctgctccctgtaccgccattcctctggctgtctctggaaaccactgatcccagcatattcctactccaattctcgcatatcttgtatcccacaccttaaaacctgtatctcccggtgtgaaatagaacttttcctgataataatggtcatcaggaatatgtgtttttctgtatattccaagaacacttccatctgcgtcaataactgcaacagtgttatagaacacatttatatctctttcataaaagcttattggaagcacaactttaagttcggctgccagcttctgaaaatgcttcacagccggattctcatcaacaggtgttgcaaatgcgtaataatcataatttctctcctgacagaaatactgtctttcaaaaagctcaggaagcagtattatctgtgcaccgttagctgccgcttcacgaaccatcttatcagcctttgcaatgttctcttctaccgaccgtgaacactgcatctgtatgcctgcatactttacatttctcacactattttacctccggaatctgttgtgtaatacagtggatattgcctccaccgactattatatctcttgcatatatcccgactatctttctgtctggaaatgcttctttaagcacatttattgcaagactgtccgcctcatcatcaaactgcggcactatgactgagtcattggcaatatagaaattaacataagacgcagcaagacgctcgcctgcttctctcatgtcctcgccttcctcaaattcaaagccattaagttcttcctcagttatgcacacaggtttcttaggaataagcatttttcttactttaatgtgtcttcctttggcatcagttacattttcaagaacagaaagacaagccttgctcatctcatactgcgggtcgttctcatcatctgtccatgcaagtacaacctctgcgggtgctgtaaatgcgcatacattatccacatgttcgttagtctcatcattatatattccacagggaagccagattatcctgctcacattgcagtactgctttaatttattctcaatctgttccctgctaagctgtggatttcttcccttactcaacagacagctttcagtaacaagcattgttccttcgccatctgtatgtattgaaccaccttcaagaacaaatggtgctgcattatatccctgacagccaagataagacataaactttccggctacaaggttgtcattgtcccagtccgcgtacagtccgtcatatgttccgccccacgcattaaattcccagttaattccacgcaaatcacgcgcttcatatggtgtatccacatttccactcacaacgaatgtaggacctgtatctcttgcccatgcatcgtctgtatccatgactacaagcctgaccgtttccgggagcatctttgctgcttcctcttttctaccttctgatacaatcatgtatacctgctcgctttcactgattacagacgctatctgtgcaaatgctttcttagccgcctttgctccataagcccaagaccccggtctttctggccatatcataatgcagccctgatgtctttcaaattcagcaggcatgcgaaaaccgtctgctgccggagtactgtttatataatccatatctataatctccctttgaaatcttcatagccaaaatgcttccacaccttacattccccatcactatccataattacaatatccggcagtgggattccgttaaatgtgttgttcttaaccattgaatatatagccatatcttcaaatacgagtctgtccccgacattgatttccctgccgaattgataatcacctatgatatctcctgcaaggcatgtataagatgacagtctgtatctgtatcttccattcttcgccggtttccatatgccttcttttacatccatatcaaaatcaatctctatgtccttatcaattccatactcatcttccatgtccgatattttcaatccaccacgaagaggcggtgtgtatggcatttccagtacatctggcatatgacacgctgcagatgcatcaagtataagagttgttattccattttcaaccttatcaagcactgtagtcacaagatatcctgcattaagtgcaacagcttcccccggttcaacatacacctgtacatcatatttccttcttacatgactgatacatttttcaagagtttcaatgtcgtaatcttcacgggttatatgatgtccgccgccaaaattaacccacttcatatctttcatgagaaatccgaatttctcttcaacagcctttaatgttgcctctaagtcatctgaattctgctcacataatgtatgaaaatgtattccttccatgccagataacacatccggttcttccttaagagcggctttcaggttcttaagtgtaactccaagtctgctgcccggcgcgcatgggtcatatattgcatggtcaccctgtgtagaaaactctggattaactcgaagtccaaagcttactccagcctcaatacatctggctttatgcttctttaactgtgaaactgagttaaacacaacatggtcacatatatttacaagctcatccatatcctcatcagtaaatgccggtgcaaatacatgattttcttttcccatacactcagcaccaagtctggcttcatatattccacttgccgtagttccgcttatatattttccaatcagcggatattctgcatatgctgaaaatgctttctgcgccagcagtatgtggcagccggtatcttcttctactttatgaagtatctcaagattatgaataagcattttttcatctattacatatgccggtgtctttaactcatcaaatctcataattaacctctctttttagtctactaaaacaggattttcatcgacaacccatgggagaccgtacttattaagcgcatccatgtatggatccggatcaaattcatctgttgtgaatactcccggcttgttccagagtccctttgcaacaagcattgtaccaatcatagcaggtacgcctgttgtatatgaaatagcctgcgaacctacctcacggtaacattcctgatggtcgcacacattgtaaatatataccttcttctccttgccgtctttgatacctgtgaagatacagccaatattagtcttacctactgttcttggtccaagtgaagcagggtctggaagaagtgcctttaagaactggattggaacaatctcctgtccgttgaattcaaccgggtcagttcttaacattccgacattctcaaggcatttcatatgtgtaagatagctctgtccaaatgtcatgaagaaacgtattctcttaacatgcggaatattagcagcaagtgcctctatttcctcatgatgaagcaggtacatatccttcattcctactccctcaaaattgtactctctctttattgacatagcaggaatctcaacccagtgaccatcctcccagtatgagccgggtgctgatacctcacgaagattaatctccgggttaaagttagttgcaaacggatatccatggtctccgccgttgcagtctaatatatcaattgtatgtatctcatcaaaatagtgtttctgtgcataagctgtgaatacgcttgttacacccggatcaaaaccagttcctaaaagtgctgtaattccggcttctttatatttttctctgtaagcccactgccatgagtagtcaaaatatgctgtaaatccaagacgcttgcatctctcctcatatacctttctccactcaggattgtctgtatcctcacactcgtaattagcagtatcaacataaggaactttacatgcaaggcaggcatccataatcgtaaggtcctgatatggaagtgccacattaagaactacatctggcttgaattcattgataagcgcaataacctcatctgtgttgtcagcatcaacctttgctgttgtgatgttagtgcttgtcttgtccttcaattcgtctgctaatttgtcacatttgctcactgttctgctcgctatgcacaggtctgaaaacacctcgctcacctgacatatcttgtggattgctactgaagcaactcctccgcaaccaattactaatactctgctcatctttcttcctcctgttctaataattcttcaacatactttggcagcatgaatgcacctgtatgaagattagttgtgtaatattctgtatgtatatttcttctcttccactctgccggcttgaaatccttaagcggatgatatttctttgacgcaaatccaaacagccagtatcctgacggacttgttggtatatgtgcctgatacacgcggcttattggaaatgtgtggaacaccttcctgtgcatgcttctgcatgcatcctcatcctcatcatagaaaggacttccatgctggtacacaagtattccgtcctccttaagtgccttataacagtttccataaaattcccttgtaaacagtccctcactcgcaccaaacgggtctgttgcgtcattaattataaggtcatacatatcctgcttggagcgtaagaaccttaatgcatctgaattataaatgtgtactctctcatcttctaatcctactgccgtctctggaaaatactccctgcacacatcaacaaacatgttgtcctgttcaactatgtcaatattttcgatattgtcatactgcaacagttcctttgatacacctccgtcaccgccaccgattatcaatacatttttaacatctggatggactgacattggcacatgcaccaccatctcgttatagatgaaacaatcctgttctgaaaatataacacttccattaagtgtcaggaattttccgaactctggcgactgaaatacatctattctctgatagtcgctctcgccagaaaacagttgtttttcaaccctgatatcaaacttcacatgtggtgaatgaagttctgaaaaccaaaattccatagaaactttctcccttctatatttgaccgattgaacaaatcggacatttacattcttaatacattcagtgtctgcaatgttgaatcttccattccctgcattgaacagcccttctctactgaatactgaatatagtctattatctcgtctgtgatttcttcacccggcgcaagtataggaattcctggcggatatgccattacgaactcccctgatatatgtcctgctgcctcacggattggaactttaatcttatcggcatagaaggcttcctgtggtgaagcaagtacccttggaagcagcatttgtctgtctacttcaaagcgtttttcttcttttgaatacagacggctgatttcagccaatgctccgacaagtctttctatatcctgtattctgtcaccaattgatatgtacgccattatatttccaatgtcgccgaattctatctggatatcatactcatctcttaagatatcatacacctcaattccatcaagtccgatatcccttgtataaacacaaagcttggtaacatcataatcatagactgttccaccattaatcagttcttttccgtatgcataataaccgcctaccatattaatctcatctcttgcatactgtgcccactcgctcacctttgcaaatgactgtctgccgcgcagggcaagatttcttcttgatatatcaaggcttgtcataagaagatatgacgcgctcgttgtctgcgtaatattaataattgtctgtacataatcagcattcataccattattggtaagaaggattgaactctgcgtaagcgaaccgcctgacttatgcattgatattgctgcaaggtctgctcctgctttcattgaattcataggaaggttgtcaccaaaatacagatgcgttccatgtgcctcatcggcaagcaccttaagtccatatgaatgtgctatatcacatattcctttaatgtctgaacagattccataatatgtaggattgttcaccaaaaccgccaccgcattcggatgctcctgtattgtcttttcaacctgctgcacagttactccaagcactattccaagctttgcattaatttctgtattaagataaacaggaatcgcaccacacagaatcaatgcattaattacgcttttatgcacatttcttggaacgataatctcatctccagccttacatacagataacaccatgttctgtactgcctgcgtagttcctcctaccatgaaaaatgcgtgttctgccccaaatgcctctgctgtgagctcctctgcctccttaataacagaaacagggtggcacaggttatcaagtggcttcattgaattaacatctattccaacacatctttctccaagtaaatctaccagttctgggttgcctcttcctctcttatgtcccggaacatcaaacggaacaattcttttctttctgaatttctcaattgcttcgtaaagcggcgcactcgcctgtctttttaagtccataatatccccctgttctcattgctgcctatgcttctattctcatcgctgctcgcgctcgcagctttattccagagctgcgctctgtcattgtcgcggcgctcctcgaatatccgtgaagaaatcccaattcatgcaagcatgattgtgatttttcacttctattctcatcgctgctcgcgcaaaaaggcgtgattgatttaaaatcaatcacgcctgtataatcatattctatcttctttttgattactgtattgccaaatacagaaaatctgacctttcagagtttatccaagtaagtcactgttaccgctcttattgaccgtttcacaagatgatatgctctctcgcatgataattttaaaatcaacttataaaatttgagcttctaactcaatcaataatgtgtgccctcgtcacactcggcaaccgacccgcccgtccgcaaggcttaacatgtaaacatgtggtctgtatttgcgatatctttttatatccaaaatacctttaaaatataatataactatctgctggtgtcaataacattttttatatttactccatattttacctgaacttttcggatatattacaattattacccctgaaacctaaagacattatttcctttttatttgttaccatacaacttccgtgctaccgcaaatgcttcctcaggaatccccatttctctatacatttccttccagtcttctgtaagttgtccttttaattcaagctgtgttttcctgtttatacctgaaaataccccaaaccatttacggacatccggattgcttttgtaaaaactgccaccctcacgctttatctgcatgtccataactgctgttatctgtaacataagatgcaattcaccggttacatcagacgcctccatgagaacatcaggtcttttgttgtaaaagtccataaagtactgcatagcaccctttgtatcctcttttgcaagaaaagacgacaaaactgctttcagctcccttgtttcggctttttcgccaaccattccaaccttgcattcctttacattgatattgtttactctcacccacacaagcaataagaattcagatataaagccaaacacacgcctgtggtatgaatccttatcagtctccatatcaatgcgtttctgaacctcaaagaatatcgtaaacagccactcagcatatttatcaaaaagctctttagaagtgactatcatatttccaaaatatgtctcattgccattaacaagctgtataaatgtatcataatactcgggatataattccttaataacttcacctgtcatgtcaagcgcagttacattatgattagcagaaaatccgtaatgatatgaattattaagaacgactctcttggttgtaacaagttcgtactccttaaaaatctgctcatactgcttttcattcataatatgctcgttctcatcaataagatatcttctgtaatggcatgttccaacataattaatatcatgcacatttttccatatccagtataatcctgtaagttcactgtaataaccgttaagagccgatatattatctcctgtatcgtcccgaagataccccagtggtgaattaatggctgtacctacctgaagcggcacatacatattatcatcaggctttgtaaaatgtttatgtgtaagtgtgtaaattgttaagtccatattcaccctttatgccagaaatccactggctcatactcctgcaattttgcaagaaatccaagttttccaagctcctcctgaattaaatccagtgtctgttcgtcatccgcaacaattgtatgataatgatatcctgatgtcacattcatcaataggctgctctttccatttgcaatttcctcaagatatttcctgatatcacgccttgagtgaatattcatatctgctcttataacaccatataccttgtgatatacgaaaacatctcttatccagccacccatgtcaactattgctccgagttctgcttccacctcatcatctccatgtttaaccttaagtatacggctgtattcctgcttatcattaagcacatagcctctgttagttgagaaaacatctatattcttcgcgcggataagcgctatatcctgcactataacctgcctgcttacatctaatatctgtgcaagctgtgtacccggcacaggacttgacgaatgttttaatatatctactatctgatttcttctctcttctccattcattgctacaactccccagttcaccccgacaatgattactcctgtacaggatgaagattttttaatgaaatgtccataattggtgcagaatgtgtaagtgcaccacttgatacaaagtctacaccaaggtcagtaatttttgcaatgttttctttagttacatttccagaaacttcaactaaagcttttccaccaattatattcatagcctctcgcatatcctcatgactcatattatcaagcataataatatctgcgcctgcctcaacagcttcacgcaccattgaaaggttctcaacttcaacttctatctttcttacaaatggtgcatattccttagccattgtaactgcctgcttaactccgcctgcagcacctatatggttatccttaaggagtactccgtctgtaagattatatctgtggttattaccacctccgattctgacagcatacttctcaaatatacggttattaggtgatgtctttcttgtatcaagaagctttgtcttagttcctgcaagcagcttcgcaacaccattagtatatgtcgcaattccactcattctctggagataattaagtgctgttctttctccacacagaagaactcttatatctcctcttacaactgccatcttctgacctttcttaacctcatccccgtcttttgcaaaaaatgtaatctctacatcttcatcaagcagttcaaatgttcttgcaaatacctgcagaccacatattattccgtcctgcttgcatataagctcgacttctccaagttttggttctggcataacactgttagttgacacatcctcacttgtaatatcttctttaagtgctccaagaatgagcggatccacatttaactttaaagtaactttatcaaacatatcatttctccatttctatatattatgcgtaattcttcttctggctttcttcataggctttatctgcctcttcaatctttttattgactaattctgcatattctccgtcaattttcgactcatctgcatatttttctgcatcaaatgtatcaaaatatgtaatctcatcctgtgtcggttttacaactgcattttcagtaatatcaagcgctgccctctttgcaaacacaagactttcaagaagtgaattgcttgcaagcctgtttcttccatgaactccgttgcaggctgtctcgcctattgcatacaggttatccattgttgttctgctctcatggtctaccttaattcctcccatgaaatagtgctgtgcaggaacaaccggaatacactcttttgacgggtcatatcccttatcaatacaatactgcactatattaggaaaatgcgtttttaattcttcttcaggtattgtccttaaatcttcccatacaaagtctgtattgtcctttgccatctgttttctaatctcttctgtaagcaggtctcttggtagcagctcattaacaaatctttttccattcttatcataaagctttgcgccttcgcctcttactgattcagatataagaaagctcctgtcttcctctttgtcagaataaaatgttgtcggatgaatctggacataattaatatcctttaattctactccatgctttatagcaattgcaattgcatctcctgtaagatgtctgaaattcgttgaatgtctgtataaaccaccaattccacctgtagcaagtacaacatctgaagcttctaccttaataagctctccattttctgtccttataaccgcaccaaggcatctgttatctctgcttattatatcaagcagtcttgtgtattccataattgtcacatttggaagagttctcaccttctctaacagatggcttgttatctctttacctgtaatatcttcatggaatattatcctgttagatgaatgagctccttctcttgtgtatgcaagacttccgtcagcctctcttgcaaatcttgctccacaatcgacaagatcttttactacatctgctgatgaacggatcattatttcaacagatttcttatcattttcataatggccggctttcattgtatcttcaaaataactgtcgtaatcttcttcacattttagcatacacataccgccctgtgccagaaatgaatcactgctctcacaatcagactttgttatcataagaatcttcttatcagcaggcagattcattgccatatacagaccagaacagccacatccggctatcagcacatctgttttaattgtattattcataggatacctccattctttctgcgcatactacaatcttactttgcaagctcaagcattcttgtaagtggcttcattgctttctttgcaacttcttcatctacaaacacttcattattttcctgttcaagaacatcaagcaccttatctaaggttaccatcttcatgttgacacatacctggtcaggctttaatgtatacagtttcttgccaggtgccttttttcttatctcaccaaatacaccatcaactgttgcaattatgaattcctcacaatctgtatctacaacataatcaataattcctgatgtactgcctatgtaatcagcatattttaatactttctctgtacattcagggtgtgctgcaagctttgcctgtggatatttcttcttagtttcaacgaccatatcctctgttatcgcgacatgtcttggacagaagcctttattaagaatcacatttttctctggcacctgctttgcaacgaatcttccaagattctgatcaggaataaagaagatgtttttattaggaaggttctttactatctttactgcatttgatgatgtcacacagacgtctgaataagtctttagctctgccgttgaattgatgtaacagacaactgcaaggtcatcatactgttcacgcatcttaagaatttcttccttagttgccatatgtgccattggacaatcagcccccggctctggcataagcaccttctttttcggattaagaatcttagcactctcacccatgaactcaacacccgcaaatactataatatcctgttctaccttagtagctaccttgctaagatagaatgaatccccaacataatcagcaacttcctgaacatcttcatctacataataatgtgcaagaataactgcattcttctcttttttcaactttaaaatatcacttgtaactgacatattgcttctccaatcgttaaggtttacatatgcttgacttgcgttttacatacattgtgctagagtataccacgaatgtttacatgtgacaagacagttgtaaaattttctgtatagttaatgtaaaagccattcctgatgcaatatttagattaaatgcaaaaagccccggggaaatcatttcttaattgatttctccggggactttttcctaatccattacctattcattatgaattttcaatcatatcaaaacttataaatcttcctcaatatgttctcttccctgtgcgattatgcttcttacatgatcgtctgccagtgaatagaatattgatttaccttctcttctgttcttaaccaacttgttctgtttcaatattcttaactgatgagatattgcagactgtgtcatattgagagcctgtgctaaatcacatacgcacacttctgcctcaaataatacatacagtattctaattctcgttgaatcaccgaataccttgaacaattctgcaaggtcgtataattcattctcatctggcattgtttcattaactatctttaataagtcctcatgtatttctattgactcacagcattcacaatctgccattatattacctctttctttataagttctttacgaataatgctcttattgcattgattacagcaataaccattacacctacatctgcaaatattgctacccacatgtttgctatacctattgcaccaagcaccagacatataagctttatgcctattgcaaaataaatattttcataaacaatacgtaagcattttcttgatatcttaattgccttggatatctttaacgggtcatcgtccatcaatactatgtcagctgcttctatagcggcgtcacttcctaatgcgcccattgctattccgatatctgctcttgaaagtaccggtgcatcattgataccatcacctacaaatgcaagctttttctttgatttcttatgttctaacagctcctcaaccttagaaaccttatctgccggaagcagttcactgtacactgcatctatatttaattctttagctacagcatctgctacattctttgcatcaccggtaagcattactgtcttacgtactccagctttcttaagttcttctatagcctgctttgcatgaggctttaacaaatctgatattagtataagtcctgcatatgccccgtcaactgccacatgaacctgagttccggcctcgttgcactctgcatattcaagaccgagtcttctcataagctttctgttacctgcagctacttctcttcctgatacattagccttaacaccttcaccactgatttcctcaacatctgtaactaatgtcttgtcaatctcttttccataagctttctgtaaactcttgcttatagggtgtgttgaatagctttctgcaaatgcagcatattttataagttcatctttgtcaatagtgttattatatacaccactgacctcaaatactccctgtgtcatagttcctgtcttatcaaagacaacaatgtctgtctctgcaagtgcttcaagataacttgaaccttttacaagaacaccctgattacttgctccaccgattcctgcaaagaagctgagcggaatacttatgacaagtgcacaaggacagcttattactaaaaatgtaagcgctctgtatatccacattccccactgaggagatactcctaagaatatcatgcttacaagtggtggaattatagcaagtgccagcgcaccgtaacagactgcaggtgtatatatctttgcaaatttactgataaagttctctgaacgcgatttcttggaacttgcattctctacaagatcaagtatcttagatactgtggattcaccaaattccttagttgtgcggatcttaagcacacctgacatattaatgcagccgcttattacttcatcaccagcctttgcctgtcttggaaggctttcacctgtaagtgcacttgtattaagagttgtattaccttcttcaataataccatcaataggaactttctctcccggctggacaacaataactgtaccaacctctacttcatcaggatctacctgctcaagctttccatcaacttcaatattggcataatcaggtctgatgtccataagctcacttatgttcttacggctctttccaactgcaatattctgaaacagctcaccaatctgataaaagagcataaccgcaattgcttctgtaaaatcaccatcatctacaagtgcaattataattgcacctacagttgcaactgccataaggaaattctcatcaaatacctgtctgttaagaattcccttaattgctttccttaaaatatcatatccaataacaagataaggaaccatgtacattataaaaagaacaaccgtaggaatatcaacaaatgtgcttatcaccttaaaagcaatcataaggactgctgcgataatgattcttgtaagcatctttttctgctttttattcatattctactccaatctgccagaacaactctcacggctttctattacagatatatctcacaatcatcttctactttcttgcagttcttaagaacatcctgcataacagccttaggatcctgtccttcttcaaattcaacaatcatcttaagtgccataaaattaactgtagcatccttaacacctgctgtattcttagctgcatcttccatcttattagcacagtttgcacaatcaacatcaatcttataagtcttcttcataatattctctccttaaaaacattaaataatcaaaattctttcatatgaacattcattcatatgttcattttcattataacacctataaaacttctgtcaacaagaattcactatatttttccgcaaacattttatgtcctttctcatctaaatgctgtctgtcaacttcacttggttcagcagcaccagcggcatcaaaataataaaatccattttcatttgctattttttcatattcccatgcaagctgccttgaaacattttcagaactttcattaaattcaggatcaaagccttcttcacctacaccttttccaagatgaatcggagaaattataactatctttgcatgttctcctgctgtcttgttagcctttcttgcaactgcctccattccttttgcaattgtctttgcatcagcatgaaattcagtcttgcagtcattcgtaccaagcattatagctataacatctaccggcttatgtgattcaacaactactccaataagatcaatgccctttcttgcatctcttacagcatctggaaatatagttgttcttccgcacagtccctcttcaataatattatattcatttccaagaagattagctattctgcctgtccatcttacatcataatcatatcttcctgatttatcaggcttatatccataagtattagaatccccaaaaaacaaaatatttttcattgccacatcctcccatgtaatatctatcattgttcattccatacttgtttagtatgtttatatgttattacctgcatagtgatttgtcaacaaaaaattattataaaaaaatataattactcaccccgccagtaggttgtgtcagtctatatttccaagtggcggtctgtcagaatataagcttgattttttatgagctgtgtgggagttagggctgctatatacaaaaaatcagtgccaaaaaacacgttcaagcgtagcgcgttgttttttagcactgtaatagattctgtatatagcagctcttactcccactaagcgaataaatcatgaaagcttgtgttctgacagaccaccacttggaaatgtccgaacctaacacaaccctactgctctctttgcaagcctgtcagcctcttcatttccttccacccctgaatgtcccctgaccttcacgaatctgatattaattgaatccctgacagatgtaatataattataatattctattgttccttttttgtttcgtttccattctcccacagcccatgccttgatacctgcataatcatagaatatagaaatatctttaagtccaagctctattgctttttttacagcggccatgcttccaagaatctctcctgcaacattacgcattgaagccatctctttatcactgccattgcctgacaattcatatcttacgccatcatgcataagaaaaccgccatatccatacactccggttgcaatattaaaagaaccatcaacaaatgcataatcattgtcaggcattacatcttccatattgccacttccggtctttccattaatctcctgtacagcttcccttcccatataagccttcgcctcttccatagacatgaagctcttatattcggcagctggaaaaccatgtacattcttcttacattcgtcccatgtctgatatattccgggaactttacctacacgcacagcataatatttcttagccatatatatttccctattctgattaataaactcggattactccggcaatctcttttaccactgaaagtccattaaatactgtcattgcatcattaaaattcttctctgcaacaacatctgtaataataaccagttcagcaacaccgtccttacggctcttctggaccacctgcgcaatacttacatcattgtttccaagaacacttgcaatgttagcaagaaccccctgcttgtctaatgcttctattcttaagaagaatttgctcttagtttcagatatatccttaacaggaagctctttgtagcatgagcagccaatcttgccacatgagccatgaactatgttacggcatacatctataatgtcccccataacagcagaagctgttggcatctgacctgcgcccctgcccataaacatagtatcatcacttgcctcaccatgaacaaatactgcattaaatgaatctcttactgtagccagagggtgattctcgtcaataagcataggatgaaccttaacttctattccatccggtgtatttctggcaagtccaagaagcttgataacatatccgaattccttagcatacttaatatcttctgctgtaatcttagtaataccctctgtatatacctgattaaatgttacccttgaattaaatgcgattgatgacataatagccatctttcttcctgcatcatatccttcaacatctgctgtagggtctgcctctgcatatcctaattctgtagcctttgcaagagcgtccttgtaattcattcctgattcagtcatctttgtaaggatataattagttgttccgttaacaataccaataatctctgtgatattgttgccagccatgctctgctttaatggtctgattattggaattgctcccgcaacagccgcctcaaactgaaggtcagcatgcattttgtctgccattcccataacctcttcaccatgctcagcaagaagatccttattggcagtaacaacctgctttccagcctcaagtgcctcaagaatatactgctttgcaggagtagttccacccataagctctattacaatctcaatatccttatcttcaataatatccttccagttgtcagtcagtaattctctgtcaattggatcacggtctttatcaagatttcttacaagaaccttcttaactacaagttctgcacccgtcttactaatcacatcatctttcatactctgacataacttgtatacacctgttccaactgttcctgctcctaatatagccgcataaatctttctgctcattactttgtacgccctcattcctgtttattatgttaagtttattatattaatctgtgatacatttatttcatatctacagcatcaacctgatccttaaagttctttatagccttcccagccttctttgttacagatacaattctcataagagatataaaatcccataacccctctatcatcagagcaattccaataaatactataagtgctgatgatgttgaaaatggattcaataatgcaatgatgccaataacaaccattacaactgcacctataagctcaatccaccatttgtctgactcaagatggtagaaatccacagcatactgaagtttaaggattccatcaacaataataataattgcaagtgctgttcctaaaaaaaccgcaataaaacctggtttaatcacgaaaaacataccaaatgcaagaagcgtaactccctgtacaagaccatatgatccaagaatctcacttcccgcaatcctgaaataattgataagtcttaatactccccagacacataaggcaactccaattcctttacatatgatttcctgggatgctgttggaaatattaccagcagtaagccaagaacaaacaatgcaattgaaacaataataatctcaaacttaattgtctttaacttcttataaatactgttcatatgctccatctccttttcactcatttcaaagttccgtagttcttttgtcttttgattatacacaaaaaagaacatcacttcaagacatgcatttttctgcactttaatctgtctgtgatgttctttattattatttaatattaagttaacatatacagattactctgctcttgacatagcctgctcgtagtctcttgttccaacccagatttccttagtatatggacacttcttctgttcaatagagcgcttgataataaccgaaatacataccacattcgctattattgcaagcattgcaacaactccctgtgctgtcgggttagctgttataccaaagtttgcaattgcatctcctgcacttgcacctgtagtatgacatgtaattgctgcattataaagatcaagtgccctaacaccagccttagttgctccaccatataatgatggcaatacactgaatgtattgcttaactggaataatggtaatacctgtgcaaacatacaccatgttgcaagtgtcatggctctgttctgaatccatccgcccttgttccataatgcattcgcaaatgtaggagcaagaagaagagctacaccacagtaccatgtatgtgttggaagattacagtatgtatactcaaaattccatatatcataagcaacgataaaccatattgtcatatccggccagagcatatcatccttcttcttagatgagtaaattccccaccagcctgtcatacagaagatattaataagtcctgcaataccattaacaatattccaccagccgccataaaggaatacaccttcattagatgcccaccacgcaccagaaaaatctccagtaatctgataagctcttatagctgattcaaaatcagatgctactgcaataagaatattaatagcaacgattataaatggccatggcttaaaccattctttctttccaattccccacttatacttaatcatgaggaaaccgacaactccgatatctgctgcataaagcttagcataatggaaccatccgttcatatactcatatgtctgattgctgtggccaccaaacagacctgcctgaattgctatgaaatagattgtgagtatagccggtatgataacgaataacacgataccgccaatcttagtacgacgacctatctcattaagaattactaatcctgcaaacacaagcacccaacccagtaactgagtcatggctgtgctgccataaagttgaaataacattgttcacgcctccaatcgcttgattgattttataagtattttacacttttttaataaatatttcaagtaaaaatgatagtctatatgggctatcctaaacattttaatatctgcgatttcttgttgttgacaactgcaaggttttgcaaggccgaacgaatatttttctgaatcactgccgcccttattccttcgaatggtttaagaaagctgttaattccaagttctttagcattctgttccagtcttgtaattgaagtaaacgctgcagaccactgtgtattattaagtgtctgttctagtcttatgaagtcataacacgccatatattcccttacatcctttatatatacggtcataacaacttcattctctatatctttatccttgaattttgaattagaaatatctattccgagtcttctaagattcgcgattattttcatcaatacctgttcgcggactgacatactaacacttcccctcacactcagctttcttatatattcttggcagtacattattatgctttagttttactttttccttcaggaataacatatatccatataagtgaacttacaaacaaaaacattggataaaacagctttggtagaatctgaaatgctgtaatgctatatccaagctctgaaaccgctgatatggcaaccagcatctgagcaccatatggtattattccttgaaatatacatgaaaatgtatcaagaagcgaagccgcttttcttggagtaatatcataatcatcagccatctcttttgcaatagggttagccattacaatagcaactgtattattagctgtagcaatatccattgttccaactaaaagtcccattccaagctgtccgccttttttccctttaaataatcttcttattccattaagtaaagcatcaaatccaccatattctttaataagtgaacacattacagatacaagaactgcaaccatacatgtctcaaacattcctgacgcaccacttcccatattaagaagcagagtctccaatgtaacctctcccataacaagcataataactattcccgaaataatacctgttataagtacaacaaaaacatttacaccaataattccacccgcaagtacaagcacatatggaataatctgaaaaagattatatgaatgtgcaatctcaccatgaatatctgtactaaaagaaagcacaagaattataacaagggtcacaattgctgccggaagtgctatccagaaattctccctgaacttgtctttcatggcacagccctgaccattacaagctgcaatagtagtatctgatataaaagaaagattgtctccaaacattgcaccacccatgacagatgcaacacataatgccatactaaatcctgatgcttctgataccgcaaccgctattggtgtaataagtgttattgttccaacagatgtacccattgcagtagatacaaagcaggcaacaataaaaagtaccgctactgcaaactttgcaggaataatgcttaacataaaataagctacactctctgcactgcttcttcctacaactccgacaaatattccggctgtaatgaatatcagaagcattgtaacaatgttcctgtcagccaacccttttgccattacatcaagcttttcatcaaacttaagctgtgaattctgcatgcacgctactaatattgcagccataaatgcaacaataattggtacattataaaatcccattggaatcttcatgacatattcaaatataattccggttccaagatacaacacaagaaaaacaagtataggtaccagcgcaaccggattagaattcctatcctttttcataataccaattaatcctcgcccatcttagcaagcttggcagcctggtcggcagcgatacatgcatcaataatatcctggatgtctccatccataatcttgtcaagcttatataatgtaagaccaattctgtggtctgttactcttccctgtgggaaattataagttcttatcttctcagctctgtcacctgtaccaatctggcttcttcttgcatctgcctctgcgtcatgtgctttctgagtctcaatgtcatataacttggctcttaaaagcgcaaatgctttctccttattctgtatctgtgacttctctgtctgtgaataaataactattcctgttggataatgagtaagtcgtacagcagaatcagttgtattgacacactgtccaccattacctgacgctcgcataacatcaatacggatgtccttctcatcaatgtggatatcaacctcttctgcctctggcataacagctacagaagcagtagaagtctgtattcgtccgttagattcagttaccgggattctctgtactctgtgtacaccagattcatacttcataatagagtaagctccctgtcccttaaccatgaattctacttccttcattccaccaataccggtttcatcgccacttaatacttcaaccttccagcctcttgcctgtgcatagtgtacatacattctgaaaagctctgctgcaaaaagtgccgcctcttctccacctgcacccgctctgatttcaacaacaatatccttatcatcattagggtctttaggtaaaagaagaatctttaattcatgctctaattcttctactcttgccttagattcattaagttcttccttcgccatctctttaagttcttcatctgtctcttcatcaagaatagcaagactgtcctcaatattcttcttacagttcttatactcagtataagtttctataagtggtgcaagactgctctgttctttcataagctttctgaacttttcctgatcattaaccacatcaggattaccaagttcagccgttatatcttcatatctgttgactgtatcttcaagtctgtcaaacatacgtgtcacttttcctttctctctctaactatataattactttctgcccataacaacacggtcaaggccagcaaggtcttttacaaccgttatatctcttaaaccagcctgcttcattatttcagaaacatctgctgcctgttcggctcctatctcataacacaggtatccgtctgtcttaagatattctcgtgctttctcagtgattttcctataaaacataagtccgtcctctgttccgtcaagtgcaagcagaggatcatgtaaacggacttcatcctgcagagtttctataaccttagttggtatatatggtggattggatactattgtattaaatgtaatatcattacccaattcgccaaataaatcactaagcataaaatcaatattatcagcctcgagattatgcttattcttctgtgcaactttaagtgccttttcagaaacatctactccaagcaccctgctttctggaaacttcttagcaagagtaatcccaatgcagcctgagcctgtacacatatcaagaatattatcaccatttcttgtaaccttgattacctcaccaacaagcacttctgtatcaggtcttggtataagcacatcttcattcacttcgaattcatatccatagaaatatgcttttcccagaatatgctgtagtggaacatgcgcagcccttttatcaatatattcttcatacagcagaaaattctcttctgacaacatgctgtcaccattcacaagataaaaagttcttgtcataccattaatggcagataataattcaaaactatcatggtctgcattatcgacgttattatctctaagtcgctttgccccccattttactgcttctcgaattgtcatcataattatctgtcttccagccttttctgtttaaacataggaacatcctcaggatactgctcttcttccggctcttttccagtttcaaactcaaagcccgcaactacctcttcctctgtaagttcctctgctttatcatcagcattataatcatttgaattatcatatacagtactttctgattcatcacttgcttcatatacaaaagcaaatgactccctgtctgtatcgtccataccaaattccatctccctgcccatctgtaaatacttttgttcaggggtaagttctgtttcctgattatcttctgacttctgttcctctatatcaatagttcttgtctcttcattcccatgaataagacttcctgatattgcaagttctgcctcagatgccacaagtgcttcaaccggattatcggcttctgaataatattcagcaataaactgtctccagtcaaatacttcctcaactgcccttatggcaacttcaatcatatccatatccggctctcttgtagtaagcttctgaaaccacattcccggtttactcaaaactcttacaaatgcattatcattctttcctgcccatcttattacctcataagaaactcctgcaattacaggaataagcagaattcttataagtatctgcagtgccgtattatcaactcttataaatataaaaaacacaatacttataaacattacaaagaataagaagcttgttccacatctcttatgatatcttgaactgttctttacattctctggtgtaagtcttgcaccattctcaatgcagttgatacatttgtgttcagcaccatgatacatgaaagtccttttaatatctttcatcatggatataagtaaaatgtatataacaaatattaataatctcacaacgccttctatgaaattaagaagtgtcttggaaattatgtattttgataccagtctggctgcaagatatggaagaaccataaacaatccaattgcaaagaatattgacaaaataaccgttactgccattaaaaccgattcaaatttatccttaagaatattcttgccaacctcatcaatcttagtcttctcctgttctgccggatcatcataaaaagatgctgaataattaattgttgatatacctgtaacaagtgaatcaacaaaactgacaattcctcttattatagggaaattgagccactgatgcttttctgttaaatctctgctttctttgacaacaacttcaatttcattatcaggttttctgactgcaatagaatatttattcttattacgcatcataataccctcaattacagcctgtcccccaattcctgatggcttcatattacaccatacctttcttaaatgttttgtatacattcaaaaaaagttgaggtcccgaaaaacctcaaccttaatttcaaaattaattgtttgatactccgtacttcttgttgaacttatcaatacgtccgcgagtagatgatgccttctgctgtcctgtgtagaatggatggcactttgaacagatttctacgtggatttcttccttagttgaacctgttacgaactcgttaccgcagttgcaaacaacctttgcctgatagtaatctggatggattccttctctcatgatttcacctctttacaaattattaagtattacaattgtgaattccgccttagattccctttctgtcccgatgggatctatgcgcattagacacaatgacctctttatctgtcataaacagctttcatattgtatcacgatacgacatgttatgcaagcattttttcaaaagagttataaaaagaaaatatattttaaatataatggttcttaactactgttcttacaagttcctgattattcttagtcttaacaaaaagatccagtattctctctgccgcctcatctgtttttaatccattaagagcttttctcattatatcaacagcttcctgctcttcactattaagaagaagatcttctcttcttgtacttgattttgctatatcaattgcagggaacactctcttttctgatagctttctgtcaagaacaagttccatgttacctgttcccttaaattcctcgaatacaacgtcatccatcttgcttcctgtctcaacaagagcagttgcaagaatcgtaagacttccaccctcgcgcatatttcttgctgcaccaaagaatctcttaggcatatgaagtgctgcagggtcaagaccacctgaaagtgtacgtccacttgcctgaaccgtaagattatatgctcttgcaagtcttgttatactgtcaagaagaattattacatctgtcttctgttcaacaagtctcttggctctttcaataaccatctctgacactctcttatgtctctctggaagttcatcaaatgttgaatatataacctcaacattatcacccacgattgattccttgatatcagttacttcctcaggtctttcatcaataagaagaattataatatgcatctcagggttattcttagttacagcattggcaatctgcttaagaagtgttgtcttaccagactttggctgtgaaacaatcattcctcgctgacctttacctattggtgatataagatcaaccattctcattgccactgtacttgaattcttttcaagatgaattctttcattaggaaaaattggtgtaagactttcaaatgcaggtcttctctgtgcaactgacggatcttttccattgaccgtctcaagatacataagagccgaaaatttttcaccagatgttttcattctctttggtccatgaataatatcacctgtctttagattaaactttcttatctgtgatggagaaacatatacatcgttctctcccggaagaaagttctcacatcttataaatccataaccgtccgataaaacctcaagtattccatctgccaatggagcatcatgctcttgtcttggctgtgcatgataattatctttcttatcttctttaacatactgctcactcttatggtgtgactcatccgatattcctgctacatcatgttctgctccggcatcttcaaaaacaacatcttcaacttctgccggctctttcttttcttctctttctgctgcagcaataattgcatcaataagttcactctttctcattgttgatatattttttatattcttgtctttcgaaaattcgcgtaatacactgactgacaatgtttctaactttgccttcatataatccacctctgttattaatcatagtttaatgggaaatgatgcagaaatcgcatcaaagataaactgattatacaacgtattattctaaaagaaaagactaaaaatgctttttttagtcagatgaaaattgcaagctttttttacaactttttctaaaatatttttatacttacactatacataaaaatcagtctatagaggcttatttcctctgtttttaagatttaatggcacgacaaaaagactggctgaaagtcagtcaaaaaaagtttattaagttacacggctttaaatcaggtgtttcatttcttctttatataagtccttggagcttctatatccgaacattctccttggatattcattcacccagtcctctatctgctgtatttcctcttctgaatagccattgatacttgttcctttagggattttccttcgtatcattctgtttccgttttcatttgagccacgctcacatgaagcataaggatgacagtaatatacctttgtacgcttctttccgggatatacgcagcttctctctatcccttcacagtctgcaaattcagtaccattatccactgttatggtcttaaacagcttatagaagacatctcccagctctctttcaagctcatccagagtttcaacaacggattttgatgtcttatccggctgcttctttacaataatgtttctcgtctttctctctattattgtaagaagagtactgcccttttccctctttcctatcacagaatccatctccatatgtccgaactcctctctttcgagtatgtcttccggtctgtcttctatgcttgttcctgcacaagctttcttaattctgtgaatcttcttgtaatctttcttattcttattcctttttacaggaaggtctttgttggtaatcttcgtaaagaatcctttgtcaatactgttgtacaccgtcttgacgcatacggattcttcatatttatccatttccccactgcggaccattgtttcaattgctgcttccgggctgtagcccttattaacaatcttttcctcgattgcctttgcaagcttcttatcttttagtactttgggtattgttccccttgcggaaacattgtaatctcttttctcctgcgctatctgtgctgaatacctcgtctgtgttgttaagtcggattttgtatgtgtatattttcccctgtgcagttcattatacactgtcttttcgcatacatttaacattctggctgcctcaattactgaatagccagcctttaatagtgtctccagctcaatacgctttgtgtaggtcatttctttataacctttacgcatataaataacacctcgcctgttattgtttttagctgtcttatatctcaatcatataataatatttattcaaatatatttcaataaacctgtagttcaattgtgaaatgcaaatgtgacggaatccgtcacattcacatatcattttgtttattgtatgaatcgaagaactccttcatatcatcataattcattgtaaacatctgtcgtatgaatatatcaggcatcctatttactatagccttattgataaggtctttctgttgttcgctaaacgaattgaaatacataacaactccgtcctctattgttgccggaacactcgcagatgtgacggaatccatcacattttccgttgccttcttcttggttgtttttcttgtagtttttttcatcggttgcctgctctgacggtctaactcatacagtcgcttaatttcttcgcttactgcagcggttatatcatcctctgcattattatttccaagcttttgatataagaactcttctgatgtcatatctattacaagtgcatcatcaggaagttcagatgtttcttcaataggagaattaatattgatagttacatatattccggtgtgagggtctatcattgattttggagctggaacatagcctttatctttacttgctttatttaattccatagctatctgatattttgactttctgcttgggatttgtatattaggattttttctatgtagacgcttgcatcttcttatttcttttcgacttgctcccttatcctcccacggcagcgcttttctatcgtatattggatattcatcttccatgaaaattatacaatgttttttatccatccttttaatttcctgcggagtcataagttctcttccagctttattataattactattataagagcttccgtgtttaccatctcctacagtatcaatagttgtttttccaagcagttctgatatatatttatgtgattcaattgcaccttgtcctgcaccacaaaaacataaaactggaacattgtcatatattatttcagctttttcagctttaaaaaggtctttaagctgagatgttgactgaagaatcggaatcatacttatatttctacttcttattacgcccataagttctactgtatttgaaggttttgcgccagcataaaactcatctagaagcatttccaatggaataggtaaagctccaccgttttctttaaaatcatcatccgccattctgcataatattgttaatacctgggtatacaacatagaagcaatgaaatgaaatgatttctctctgtcatcaacgcatatgaacaatacaagtctattattagttggattctctagcgttccaccaactcccgttccaaactctcgcaagttcatatcatcatcctcaaatatgcgctttaaagcagccgtttcaaatagtttcaattttgcattaacaataataatgattgaccgtacagtttcagcagctccctctttcaactttctataatccctgactgctggattatctggtgaatcttctttggcaagcttatccattttaagttgcaagtaagatggaggctgttgtcctttttgtacctttattgtagtatcttttttagtttcatcatttataaggactagaatattattgatgcttccctttcttccctcttttttcgcataccaccactcatagtaaaaaagggattgcaagtataactttgctccttctggccagaatgggtcattaaccatagcatctggtggtgtaagagaatcatatatattttcgataagattaataatatcttcttcacattctatatatgcaaatggattgtatctgtcagataattctggatattttaaattcaagcatcttattgttttgtgttgtatcttggtaatatacaatccaagtttatacattatttctccttttacatctagtgttatctgatttgcactactattaagcgaattaggaattactatagatgttgttttatatttaccagatgaacccacaaccaccatattattattagatggagcaccctcaccctgcgtacttatcttcacatttttagaaattattctatttaaagaatcatcaggattagccctgcgcttagttacttcgtatgggtcagcccattcttcacttccgttctgaatatcagagtgaaaatccctgaaatgatacatgatatatgagcatagaaaaacccataatataaccgaccagccaatgcacatcattgtcttttcgttaaagaatctcttgtattcccaaatgtgatataaaagatacatcactttatccccaatattcatcagggttaaatccgaaaatgaaaaaagcccggatgcaaatattcccagcaacacaaatggtataagcatcaccatataggtacttatttgtactttattcttagtaaacatgtatttcctttccgtgacggattccgtcacattttatattctcattcctgccacctgtttgatatcaggctcatcaggcatatcttttgtgacggattccgtcacaatattattttctgactggtaacgctccctgttaatctgcgcacctattatctggctttccacatagtttcttaatgaactttccccgccaggctcattattcttaagatattctattaattcatctgtagtatagttatcaagtaccattccaatatctgcatatgcactatgatatgtatgttctctgttttctatagctttcctgacaggcatacggctctcatatccggctttttcttctgctacaactgtgacggattccgtcacattcccagaagctttattttcatatgaagaaagaaggtcacctgtactcccaagagctgctatcatcatatccctgctgtgctgtaattcacctgtgacggattccgtcacattgggatgagattccgtcacattgggacgagattccatcacattttcagatgcctgctctgatacattcatatctttatcaagtcttagcttttcaagcttctcttcaatgccggttataagacctgatgaagtctttcttattgtttctagtgaggctttaagctcactcaactccttatctgccgaccatccggctatataaccgaatgaataatcggaggtatctatgccaaaatgtttgcatactgtatatgcaacactttcagcctctacctcttttgtccttctgttcttctctccggcatcagctacattgtcattatgcagtattgaatgtgctatctcatgtatcattgttttgacggtctgactttcgctcattcctgatttaactgctatgctgtctgttgcccggttataatacccatgagcatcaccatctatttcctcaaagtgaataggaacacctgatgcttctttaagtgcctgaatatacagcaggtaatcatttatattgccctcaagatcatgtgccatgcttggcagttccttaccttctgtctgggagacatcaaacacggacacaaccctgaatgatgtgagctttatttctgtttcttcttttaccggattaccattcttatcaaggattatttccccggtatcaggatttaccttttcatgcagaacttttcttgtataaggagctggggctagtatctttattgctttttctcctctttttacatgtctgtcaaagttcttttcccatgacttaaagccagctacaagtgaagcctgcggattctgtgctgcaataaggagcgtgttattaaggctgtatccgtggaatttagacattgtgtttagataacccatgtatttttcactggtaaacatatcttttattccatcttcaagctgctgtgttatttcttttacacggtcttcacggttgtatgcagcctgcggttcttctattacaggcataagtccattgtaatcatcaggcagctctttatcctgtctttccggccgcatggtaaattcaagattaagataattttctgtaaaataattatctgcttctggcagtaccttctggcttgaaaagctgaaatattcttccttatccccacccacaataatatggtccatcagaggaatattaaccatgtcgcacagctgaatcatgcggtctgtcatctgcacatccatcttgcttggtatgagatatccgcttggatgattgtgtatgagcatcatgcttgccgcattggataatattgcggcttttaatatctctcttgggtgtgacaatgtaccattcacagctccggcagatacaaagcttacatttatcggtctcattctgctgtcaagatttattattcctaacacctctctgtcaaaatccctcatctgttctgacagtgcccttacaacgctgtctggattgctgaatggttcatctgacacaagtggttctctgcttcttacaagtcttacggctacattatccagttcaaacgccttttcaggttcatcaagattctcctgcgccttaactgtatctatgttcatcttccttcacctctttcctgtctatcccatccatcttatctgtaagggctgtgaggtctgccgttacaaagaaatcctccggctgtttttctatgtactctttaagtctggttatctggatatccatttgcttattcctccatacaaaaagacagacacttttatgtgcctgccttataatcttggtattgcttcttctttatattcttcttccgtttcctgcatttcacatgtgacggattctgtcacattaggacgagattccgtcacattggaacgagattttgtcacttctgtttctgtattctgtgatgcttcaagcactttatttgatgcgtcaagtgctgctgtaagcccatcaacacatgccgtaaggttgttcttttctttatcctcaagtgctttggtcattacatgcctgtactcatttatatcttccattgaaagccattccggtttatcagcttctgaaaatgagttccacagcttttccattgcatcacaatgagccgcaacattcttatagtacagtgcatcttcatttccagctccgtacccaaggaaatattcacaatcctgtttcagcctgccaagcatccggtaatcattttcccttgtatgtcttgcaaacggctctgcacatcttacatcttctgttaccttcttatctggctctcctaagatatccccgaactcatccctatatgctcctgtatatagatttaaaccgcctattccattattctcatcgaaatacagctttccgttttcatcttcataacagggaacttccatatatccgccaaaacctgcgtattttacatctaacatattatcatcctcctatctcacatgtgacggattccgtcacattaggacgagattccgtcacactggatttttacatcacaaaaaaatacctcttaaatctgttgttatttcctcatccagctgcggatgggctgcctcaatggtagtttcttttaaatcatctgcatcaagaatgatttctgaattatgatattgctcctcaacatcctgtattgcttcctgcagacttgcagctttcgtgcttaccactttctgcagaacctctgttatctcaatatcatattcactcctgttgtcattttttgtgctgtgcattgtgacggaatccgtcacaatcctgtcttcataaaaatgtgtccatcctttcatgacatctgaaatcatgctgcttaattcttccggtgcatgtgtgaactgtatcttatctccctgccatgttccgttagtatgattgattccgttaatcagctttattccccttgccggaggctcccattctgacagattcttggtatagtcatccagcaggtagtcatctggtcttataagccccggaactgcaacgctcttgtctgttccgcatggtacaaagagtctcttttcccgcggcaactccggcagatatttatcaagccaggcatttttttcttcaagtgcatagcggctgtctgtcagatatgcagacagtatatatacatcaaaatcattatctgcaataagctgctttattgctcctaagacattttcattaggcttaaggttaatgaagtaatctttttcgtatagtgtttccagtgtatccacagtcttaaactctgcaagtgttccgtccatatccacgaacagtctctgcttgtctgtaatatgtactccgttgtagattgtcttaagcattgtttctgtctctgcctttcctgcttcggtcatccaggattccttgtctccgacaatccacttaaacagttcaaagctctcacattttcttgcaaggtctttatatacattcatcttgtcatctgatatatccatgatttatcctcctctcatgtgacatcaatgttacattgtgacagtagtgttgcattgtgggattccgtcacatttaaaattactttactggggcagcttttggcactggagcagcttcaagtgccttcgatatatttcttgtaagttcagcattgttgtcgtgcttatcgaatttttcaaacaactcttttccggtcttgtatgtagttccgccatccggctcaccttttacccacagcttcgccggcttctggttgtttacaaatgcaatatatcttgccttgtctgcatcatttacagcaaaaacctggttctttggaagcattaatgtctgctctcccttagttcccggcactgtacagaagaagaagttgggaaatctctgctcaagctgtgcattaatattgttacggtcaacaagtgtttccttatcaatggatatttccgaaaatgccatgttgcctcttagtgcttgacagtttacattcttgctgtcctgtatttccatatcccatttctgcatggctttctctgcttctgttgcttcaagctgctcaaactctgctatctgtgccttaatttcatctgatgcagactccatgtactcatccgggcttcttcttgcagtgtttaaataatcatcttcggagtatatcttcatatccggtacatttgtgacggattccgtcacatctgaagaagcattttttataagagagtgtttatagctctcatagcactgctttgttgtatttaagtctgccgtagcaacccttaactgcttttctccatcatccggtataaggtcagcaagctctgcaaaatttactttcgtttctgtaagtgcatttttcattacatcaagggctgcatccggaacagacactattgttgtcttaccgtttgtaagattaataaggtcgtttgaattaagttccttatcagatgtaaggttcgctttgatatagtcagtaaacattacattaaacttctgctcatcttttctggcaatgcttacatgcaccgccttatcttcatcatttacagattccagtatgcagtatttcacacctgccttatcaagataatttttaatgtttccgatcgcagcttccctggtatcactctccttaaatggcactctgaatatgctgtaatcaccgccagtttctttgagaaactttgtgaaattttctgtgatatccttatcaaagaactttgcttttacaccccttgcaatgaactgtataagctttattgttgcatacattgccggctggcttatcttaaaatacattctcatgcctcttgcaattttcccatagtcagcataaatgctgttgctgtattcactcattgtcatttcctttccgtgacggattccgtcacatattacattttaattcctgcagtctgttcaaggtccggttcatctgttatgtcaggtgtattctcactgtctgcactgatttcatcagtgatatcagttgcgacggattccgtcacattttcggatgcagtcttttcctgctcatatttttcttcaagctcttttactgcctgaaaagcttcctttgctgttgcatacataagaggctcacccttttcatcacggacataatcagcagtcaggctgtcatatattgcaaagccagcagtccttgttgctgtctgttcgtcaagatatcttccccgatatctctcggatggattaagttcctgcaacatatcaagtatggctgcttctgattttgccgcagctttgtaaagctcctgaaactttccgaggctttcttccagttctgccgctgtggttcttggtctgtactcacctttccttaaagcggcacttgatgcgtcaagtacattggcacacagcgtaagctcgctgtctgtcagtatctcttccccagcttccactctcatcattttttctggtgtaataagaagaatattagcaagctcctgtgttgtcatgttgttatcctgtcttaacctgcttatcaggcttccatatacatttttgtccatatacgctcctttcttaaaaaggacagacaattttacatgcctgccccttgattaatattgatatgtgcttatgacggtttccgtcacaatgtgacacaactcgtcacattataatttaggattatcattatccggcttgatatccggctgtatttctcccatctctttaagttcattgattcttaagtttcttaccttgtcaatctgcttattgatgcagtattctgtacctttttcaagctcatgtttatctgcatcatatatgcttaccgaatatcctaatatttcctcatcatcaagcgtttcattaacctcggataccatttccatgattgactgcagtgtttcagaatccggctggaacggactgaaagtacccgcagaatttaatatattattaccaaccggaagtgttataacttcatggattgatgaagggataacaaagaagtcattaccaccgtaaagctctgatacccgctgtcttacattatcatctaaaataagagatgcaccccctgttttatttgcgttggttacgacaagcattgtctctggcatagctgaaatctcaaaatcagcattcatgttagaaaatatgtcactcatggaatttattgatacagatgtgacatttgctgtgtttgatatggcatcctggataagtctctcttcgcttattccctgccttaagagccattcctttggtattgccgacactgacctctcctgcgttccgttggataccatgagtttagggacaaacttcatgccgttcttttcatatacaacagctctgtcattgctgtaattatgtgatacggcatccatgaatatataaggctttgcagcctcatagcttgataacttctcccttaatccttcaatatcaatattgccctgtggtgcagcctgtatgaatcggttcatgcttcctgcaagtaattctgccacttcttcctctgaattaataaactgcagtctttccaccgggtatgcagcgcttttctgttcaggattaaccagaacgattcctgtgtatgaacccatctgctctacattaacctcatactgtgccatttccggcggcaggaaacctcttaatcttccacttttaactaattcgattacttcattctttgtcataaaatttaccgtcctttctgtctggattagataataattgtgacggattccgtcacatttttgcataaaaaaaggacttaaaacaaaggtgcaaacctgcctaagcagattcacacctgttttaaatcctctttttatacttcttgcaagtataatgtaacacatctaattagtctcatccagtctcatttagtcttatttatctgtgttccttacacttaatgcaagtatagagtagcatatctaattagtccaatctagtccagtttggtacaatctgtatcaaaaattctattttgaatacatacaaggaaattgaaagggtttttgcaatattttacaaggttattttatctttttcctgtagtaattcgccaggcgttccatcatttcaacatccagctccggtcttgcgattcttcttatttcttcatatgcaataccatcttccatgcagcgcatcaggaagtctttctgttctgcagaaaagcgtttatccgttgcaatctcttttacaaatgcatcatatatgtaagctgcattttcatccttcctttttcttttctcaaacagtctgtgtaatctgcctgttttcttatcagcttcatcttttgcagaagctgcactgctcatatttattctgtcctgtgcctgtgaaagcttatattcaagattctttatttcctgtcgtgcctcatcacgctgtgtcatcataagtttgtaggctctttccttttcattaagcgtaagctggtactgctccataagcttcttctgtgtttccttctccttatcatatgcagccttgacctggttctggaacaggtctcttatctcaatatttgcctgcgtcactttaacggcaaggtcgttagcttcctttatctgtgaagccagtttgtcattttccatgtatgcttctgaattgtaattctgtacagcatcataaaatgtatttttattagcattatagagtctctttagtctttctgtattcctgaccgttactattgcatatatcattctctgcaccgtgacggaatccgtcacatattcagatatgatatccggtacttcaatattaaaataatctgctattcctgttacaagtttctgttcctctgtaagttccatattttataatccccctttcggtacattctgtgtgacggaatccgtcacattttcggatgcctgctctgatatattatcctgaactgcctttgtatttttcattgacctttcagcagcgattttaaccagcggtctttgcgtgacggattccgtcacatctgcttcctttatgattcttaaaagtattctcttttctgcgtagagcatttcaagtcttttatcatattcagaagcagttgttaaatttccttttacaatgtccggatgagctgcttctatttcttccagcctatcagacagcgtttcgtattcttcatctgtcatttctgccctggcactaatcagttcccggtaaatatcctcatattccctttttactcctaaatcgtctacattaatatctttatcagaatatgccttatcactttttaattccttaacagcttttatctcctgttttactgcatccagcttttcctttgcctggttcacatccttaatattgttatcaagaatgtaattacattcctcaagtagcttatcaatcccgattaggtcctgtcttacccttatctgttctttgagctgcaggtcaaaataatggtactggcttgcctgtccgtaacgcattattgcacacacctgaaatcttgagtccttgtgttccgtaatagtagtaagcctatcctttacataaaccatatctgaaggaattatatctttatctggctgcatgattcttctcttaacatctgcaaatgtataaccaattcctaagttataatctcttctggctttcttagaagtcttaccatcaacctccttcattgccggatgatggtaagatacatactctccatgtttttcagactgacctatgcgcatgtcatagcccattcttttcatttcatcaaagtattcctgcagattgtttgatacggatactgccatgtctatatcaagtcttattatctttttccatgtgaacttgtctgctttacctgcagaatgttctgcataagactttccaactctcttgtcagatttatcatattcaagtctgccaagcccatacttttctgttattttatctgtcacaggttgtatatatttctcccagtcaccattaacatatctgtacttgcttccgtccaatcttcctacagaattaaaaacaatatggcagtgcatatgttcatggtcgttatgaacagcgaagacatattcgtagccgtcaccaaagtaagcttcgcaaaattctttgcctactttatagcatgttgcttcatcacatgctcccggaggaaaggatattacatagtgatatccctgcctgccgttctcttttccatattctttttttgtactcatcatgcagtcgtatatttcatcaggagtaacccctgcattgcttcctacccacagaccaccttctgttttatcaggattcattatgtatttaattgaattaataagatgctgtgatggtcttccctttgcagcttcttttatatttttaagtatcgttgtcgccatctactgcctccagtcttattttaatatcatctatcttttcatcagcctgggtaagaagttctttcatgtgttcaacagattccttgtcattatatgcggtaagtcttaataacccctgatgaaattctgtgcgtagcttgcggagttcgttcatgatttccttcaattgtctttcattattttcataaattagctgcgacctcatgaagtcactctttcttaatccgtccgatttttctttcgcttttttataaagtgtatcaaacttttcgtattcattttctgtcatgcgcacaatgattcttatgctgtgtcgaccttcctttttatccatacatcaatccttcctgcagtaaaaaatggaatggcatttatttctgccatcccatttttatcatgcaatttatttagtatgtctgatgattatatgtaacggagtccgtcatattttctgtcgtgctttcattaatgctttcagaattattatcatcattttcattagaaacttttgaactttcacctgcgttttcgtttgcaatcgcaagaaatttcttaagcatctcgtctgtcacttctgttccaagtttttcttccagagtggaaatgaagttctctcccatcttctgtttttcctgcacctgtaacagatgctgctgctttttcaattcagcaagttcctttttcttgtcagaaataattttctgatatttgctaatttcattttcaaccttttcaatttttttagataatgctgacagtgtcatattcttttaatcctctctttctcatttcattatttactatctgctgtctaaatcttaactcatcacgctgtggtgttgtcatatgtgatagtcctttcataatccagagtgtttcccttcctgcatatttttttgcaacacgcttctcacactctgcaatcatttcatcaaatgttccttcaaagtcataccagacgaacaccatttcatcagatgtaatcattatctttttatcaggaactgaaaactttgcaattatattttctgcatttctaagcaatgctccctgatgcttttctatatcgagtgtccagcagaagttgttccatccgttgctggatgggaggcttgccggaatccttttcgttacatactgcgtataatatcttatctcatccggtgcagcttctacatacggctctccaaagaatccggtacaactgggagactcctttgtaggtgtcgctgcaaaaagttttagaagatttttctccggttcggatatattttcaatgcagccgccggatattttttcttcaattattttcaccttctgctttaacttttcgatttcttcatagacaatttccagttcctctgatgaaatgttttcatctggttcttcaaaaatttccgaattatttttcacttcatcctgtgacagaacctgtggaagaacctcaataatttcttctgtaatttttttaaccctcactggaaattcttcttgtgaatcttcattttctgttactactctgcttattgcattgataacaggacgaagcattgcatcaattgttttcggcatgctccacccatccggctgcatgatttctaacgcactgtagatatcatcagatactcttactaaccttgacattttcactgtctcctttcttatcgttgcctgttacatctgttacaaaatgtgtaacatgtgctgttacatttttgttacatgcctgttacactgttacaccctgttacatttttgttacacccctgtaacacagagcctgtctgcgtgtaacagattttgttacattttcgccctctgttacactttttccacaatttttcctacttctttttgcaagatacgcattttgtcatacaaaatcgccccttaaaaagtggcttgcaaccttgttagggagtatccctaagaccctctggcacagcacatggcacagatatttacatttttccatcacacttttattttccttcatgaaaattttctccttaaattttctaaaaaccggaacgctgattttaaaaatctgcgctccggtttttgcgtattcttgtaaaaggctttaaatattttcttaaaaaaatcttccgatttttttagggggcttaaattaatccgtgtaatttttcatataaattttcattgcttcatccagagaaatatcttcatggtctgttgcatatctgtaaaactcgtcaagaagattgattgatgtactcatccttataagcttgatgtctttattatttttcacctcgtctcttaagaaagatgtgatagcttttttcgtttcaatctctctgcttcgtgagtacagaagttcttttgtacagctcatcatctgcatgaagaacagttcatattctgtattaatctttgctaaaattttatctgtcatgtccgtttagtcctttcacttttaatcatcactttcactgccagcatcttcaattcctttcactcttccgacatgaagctggttcgttttatgccactcatctgttgcactgtatattccaaccgggtctcctgcttcaaaaacttttccgtttccaaggtagattgccacatgtcctatctccccatcagaggtttcatttttataaaaaatcaaatcacccggctctgccttgtctgcttcaatttcttcacaaacttcaaactgttccttttcaagtctcggtaaatctatgcctgcctgaccgtatacatattgtactagacccgaacagtcaaagcctccatcatcaggagtgcttccaccggatatgtaatcccagccggaatatttcattgcttcgtcaacaattttctgcaccgttgtatttttataattgtatatgtactgattaacaagctgtacataaaacatatttccgtaggcataacgccatccaccattgtaatcaatggctatctggtttttataatcaacctgtctgcctccggatttttcctctgcaaatgcaattgccaaatcaagtgtgtacacttttccattttcagccacataatcaatgaaacctgttccataattgtaagcctgtattgctgtatttatgtcacactctttttcagaggcttttgttacacatgaagcaaaatattttgaaccttgtgcaatcgactcctgtggtgtcttaaagctgttagggggaagtcctgcagattctgaggactgcataacatcagttcctattccatgtgattcaacttccattattgccataagataattcacatagtcttctatcttttcatttgctgcagcatcttttacttcatcagaatagcttattgtattatctgataaaagttgtctgtataatcctgcaatgacctgtgcagatgatgcgtccttaacagctccggcaattgatgatataagtgcaacaagaagcgaaacaatcactataacaacagctaacacaataagcagtggaataaaaacaattccaagctgtgatattaaagctgctgcaaatgccatgattaccgctgttattttctgtataactcccatatctgattttgatattgcaatatcagatgaatgttctgtctcgtaatccgcaggctctgattcagattgtgctgcagcttcctttaatgtatcagaatattttttaactgcctccgtagccgcctttgccacttcacttgctcctccggtgccggcggcagctccagtctgggccgctgtttttgctccggttctggctgctgttgccgcctgctttcctgcattttctgcactctctgttgaagtttttaatgcttcctgacggcttatgttcattgaattatcattagaagtccttaaggaatatcctctgctttctgcatcttcatgtgaattgcttctgcgctttttattatcggtccgggtattatctgaacctgcagtatccatgttgctttcaaaaaatgtgacggaatccgtcacatcctttgaaaatatttttgtctgtgcatcaagatttttcttaaaccttttatactccggcgactgtttaaagacttcaaatgccctcttttgctgtgacggtggaagtgtcgaaaaagctttgtattcttcttctgtcatataattttctacagacagtttttcgtattcaggcttcggtatttttaatccactttttcttatctcttcctgaaccggattagttatttttctctttgagccaaactgtactgttgattttatattcactttttcatcagcaaaattaattcccatatgcagcctctttcattgcagcttccttcattttttcctgtcgtgccttttcggctttctcatggaagtttgttgaaaagacttcatagagaggattatctttactcataaggctgtctaaaataattatcttcttgccccagaccattaccgaccttccgggtctgtcgctcttcaatgcttcgtactctgctgttgtcaaatcctgtatctttgaaagcctttctgcatcttctcctacctgctggaagaacatcttgtacccacagttctgaaacatatcccttaaatcaggattttccagtgcccttgtaagattctgcattgcaagagtaactattcctccaaattttcgatatgtgattactgcatcaagaagtatctgtgctgatgaagcattctttgttacgacctgcgtttcatcaacaacaagccttgtagctttctgcagctcctggttataattcatcctgattgaaaggaagaacattattgatatcattactggctgccagtaattctcatcaacattcttaagtccgaacgcaacaagtctgtagctgcttatatccacatcagacggataagcaaacatgtcatacacaccttccgtatagctgtaaaggcagtttaccatctcatgtattattgctttatcatgcttattatcattggcttcctcaaggctcattaactccttacgcacgtctttaattgttggctgaatcagcgtccttcctgcaaagactttctcatacaccttctgtactgcctgctcaatgaagttgctgtgctcctgcgtatacacaatctttttcattacggattccgtgaagcttgtcgcccattttgtaacatccgcaataaacagctccctgtccttctttgttccggctttaaagaggcttaacggtacttccattggatttatatgtatatctgatttaggagtgaaatcgaggaacagaccaccgtacatggcgcatacattctgtgtctcattctgcgggtctattatctggatatcatcatccgtagataaaagcgtctgtgttatctctgtctccttgataagataactcttgccgcttcctgtcggtcctattattattccgtgaggagaggttaatgtcttacggttggcaaacacaaggttcttggtagtattattaattccgtagaatattcctcccggctctgtaacttccggtgcaaagaacggctgcaatgctacaagtgaagatgtgtagaagcttctcatctttttaacctgtcttacgcctgtaggaagtgctgtgttaaatgccttaagctgcacataattatatgtctcaagatatgctcctgcgttctttcctgtacgctgcactgactctatccttgctgcaagctcatcctcgcttccagcagtaacaacaactaaaagacctgcctgtatgcattcctctgaatcatcatcaagctggtccatatatccttcaagctctgctttcttctttttcttgctgtatgatattcctgtaacagactggttgttgctcttcttggaatcagcttcctggctgattgccctctcgttgtttccatatgcacttcttaacatgcttcttgttacagcatgttccacaggcgcataatcgattgtcacaaaggactggtaagctgtatccgatatcgtatgtataagctttccctcatcaagtgctgtatcataatccctggcaaacagcactgatacatatgtgtcattattaaacatgaggaaatccctgtactggtctactgacacaggaatgacatcatataatacatcatggttgaaatcatattccttcttttcttcctgatagaagaaattgcgaatcatgttaagtctctgttcagccttcattggtactattatgctcctcattgcgccaaacagtctttcaagctccgtatccattgcaagaaagtagcttcttgcctcatcatatgttcttgtcctgactgttattgtaagggtaagcacccggtttaagtcgtgcaggtcagaatcttccatcttctctttaatccacatgcttattcccttgcttacttccggataatcactcctgttaatatctgtgaatatatcattaacgaactgtgtcatgttctgatactggttagacactgttatcttaaatgatgtactcattccctttaagaaatccatcagggaaagaaggacatttgccttgtcctcatcatctttattgacatatgatatatctgtaaatgtgtaacatctgtcataaagtacagcacccctgccagttcccttttcaatctggaatatgccgttaggatatgccttatgtataaacaatgattccctggtgttcttaggtgttttaactggtgctgcagtaagtgttatgctgtcactgaatcttttcgccggattcatataaaatgccatggttaagccccctttcttctgctttctgctttgtttttgttatcagtgtatcctgtaatcctgaatcttctgtctggttctgtctcttctgattcatacagaagtcttttagtattgcctgtatacatatattctttcacaagctctttgactgacaaatagccctgatacttgtaaaagcctatgaatatgactggtgcagctacaggaactgcacaatatattgctatcgttatcggtatcttaaacccaatcacaagcccggcaaccactgcacccgcacatagaaaaccttctgcaatatgtacaatatctgtcatagaaaagcctttccagaaatcgtttttatactctttcaggaaatccttatttatgttaattttcatctgctttcattcctttctgtgtgacggaatccgtcacaataattatcttaaatcaaatgccctctttaagaagttgtcgcttgattttactgcggttgccataaacggcatgaatataagtgataatatcaccgccacggccccgtcaaaccatgaggctaaaagacctgtattacacatgcctgtaagacctgcattaagtccggcgcacagctgcattacaagtgctattattattatctgcagcgcattagtaagaaagcttttaaaccacgctatagctgaattttcaagacctcttcctcctgcaagtgtagaaagtgcaagaggagcaacagccatcagcatgaacagatttaagaatcttccaagtatctcaataagaacagtgattgagcatacacctgatatgataagatatataggcgcaagcatcagcattgccagtctgaatccggcatcataatcaccgcctattacagtaggcactccctttggaagcagcaccttggtcgttgtgattgcaaaaccggtaaattcctgcattatatcaaggcagtttgtcatcaggatattggcaattacaagctttatgaaaagttctatccatgcttccattgttattccttctttcaggttgcttgcctgacggcagaaacctataagggtaaacatatttaagaacaccgcacccatagacatgaacaacggaaacgccgtattctttatataatcccatgcgccaatattgccaccaagaccaagtgcctgtgcaattgcattaattgccggagtggtaaatgaagtaacatttttacccatgagcgtatatgctattcccataacaaaattccacaattcctgtgctatggtatataccgagccgccggataacaggtcaattacccactgcggagctgccgccagtgctaccggatttattaatatgttcattggttctcctttctaagagaggcagatgccgctaaacacctgcctctcttaatcattatttctgtaaaacatatgtgcattgcttacgatcgtaaacagcaatacacttttctatccgataattgcatttacaagctgtggtgcaagtgtcattacaagaccaccgcctactctcttgaatcccatagcctgcattgttccttcctgtgactgcattgatactcccacttcaaagaatgcccataaaaggattattgcaccgattgagcttatcagtgcagtaacgattgctataagattactaaatgctcctgtaacaatggctgcaccatcctgtgcgccatcatctgcaagaaccctgagctgtggtacaaatataattacgcttaccagtgcagccagtattaaaaactgtactgccttcttctgtgtttcattaagtttaattttctgtgttttcatttaatcatcctttctgccttacggcttgacggtactaaaaaagagcctgtacctttccggtatcagaccctttaatgcatcctgtgacggattccgtcacattttaattattattatcctatctgtccctgcctacatacctgccgacaagaaatactcctattcctgcaactacaagaaacataaagaaaaatatcattccaaaccatctctttaatactgccggattgataccaactatgactcttgataataccaggcacaacacaagtgctatgataactactcctattaatgctaatactttgaccggacttaatcctcttctcataatgttttacctcgtttcttttaatttactctattgttgctcctgtgacatatccgttatccattgtcacggatattcttctgtcaccgaacatgtactgtattattcctgttcctgtatcagacctgtaatcagtctgtacctccctgtctgcatttttaaaggcttcctttaatgcagcataatctgttctggcagacagccccataaaggttgaaccttcctttagttctgcagcaagtgcatagcagtcagatgtatttcccgccttggcgttgtatttaaccattatcgtactcttatatgcatccgtatacatatcaagcgttgttgtctcgcttgacagtgtattgcttacatatatgtatccaaggtcttttattgccgctgcactgacaggatatttaaatgtattgccgtttaattcaaatgtaaatgttttgctgttcttatcataagaatagctttttacaggctctgtcttttttaccggacttgtctgctgtgctgtacctgatgatgtattggctgtggttgttttcactgcactgctggtttcttccgtttttgtttctttcgtcactgcctctgtcaccttttctgtatgcttcttaggaagtgtaatttttccaccgaaagaaaaatataagattactccggcagtaataagaatcaccagtgaaagaatcagattaatcacaaaacctgcttttgcaaagtttttcttattctcgttcttctcacgctttttagccgcaaaaaagataaacccggctaccggaatggctgacattaacgaatatatataccagcccttcttaggtactgcctgcttattctctgctctcatttcggcaactatctgtgcaagctgcttctcttcccttgcctttgtgttttcaggaagcatgtctggagtaaggctttcagtaacaccatctgtttcatccttactgccatcattatcctgtgtgacggattccgtcacattttcttcttgtgctgctttttccagctttaatatgccggaattgctgcttaacttcatgttgttaccacagttactgcaaaacattgcttcttccggattttctgtaccgcatttattacaaaacatcgcacatctcctttctacatgcatattccatgttcaatatctggctcttccagttcttcatccacttcctccgatatatcatccgtgacggtttccgtcacatttttagtttctgcagtctgcttctgttctgacagaatcgcatctgtagcagataacacatctttcattgtctctatgttttctgccattttcttatcgtcaggaagtaatacaaggtcttctaccggaatatcagccacacccttatagtattcctcaatgcctgatgtctgttctatgtagccatattcagaataaagaccgcccctgtttattgcttcatctcttccatatgcctcatagtcaatataatcctgcaaccattcaggaactttcctctcatcatcattgatgagcttcattccaaaatcttcatcattttttacattctcatagagtgtaaatttatcaagattatctgtaaggttaatgagctggtctatgcttgtaccaaatatatctgccgcagcctgaaactggctctgcatgttatcatctatctcatctatcttctttgccagatagttaagctggttgatattctcatattcaccaagattaagctgtaccagctccggtaagttatagtcataatctgttatgaatatttcttcataaactgttccatcagcccgcttgtcacctattccgatacgcttcatagtttcctgaagcttttctttagtagtcggaaaatccacccactcaccttccgttctgccctctgtgtatttcccaagattagtgatatatgcactaaacggaacttctgcattatttcgatactgcatatgctctcctttctaaaaatggcagatgcgattaagcacctgccatgaatgtgtgatatattttaatccttataatgaaggatattgtgacggattctgtcacattttaattatgatttctgctcttttttaccattacaagacctaccatgaccgcaagtgatatcagtgcaatcagtgcatatatgtatgcatttgatgtatcacctgtttttactatctcaacagtctggtttacatcattgatatctgcatgtcctataactttgacattattctcatacagattttcaaagactactattgtatttccggcaagcagcgaactgtcaaatgtaaatgttacatcaacacttccgtctgccttttgcgctgtaaatgatgctgaacctgtaatctcgtttccatccttatctaagaacttctcgcctgtctcctgattcataaggacaccctttacctcatatgtctttccggctatgagattcttataatcaacaacatccttaagtattacgcttcctttttccgtaatgctcttggcactgtcaatagttgcagtagtgtgtatctcagggaaatgtacactctgtccttcatccttaatatcagcatgtgaggcaaccttaattttttcattaaaaagttcttcaaacactaccgttgtctttccggcaaatagtgagctgtcgaaagtaaattcaatgtcaatgcttccgttccggctttttgcagtaaattccttttcagatgtaatcgcatttccatccttatcaagaagtttttctcctgtctcctggttcataagaacaccggataccttatatttttctccaacagtaagattgctgtaatcaaccttatctgttattgtggtcttttcatcaaccacaccggtatgtgttcctgtagtcttatctgtcgctgtagtatggatttcagggaaattaaccgtctgtccttcatccttgatgtctgtatggaaagcaaccttgatattctcattataaaggtcttcaaagactacaactgatttaccggtaagcaatgaactgtcaaatgtaaaagcaagttcaactgttccatccggcttttcagcagtaaacttctttgtagctgttatctctttcttgtccttgtcaagaagtgcctttcctgtagtcttatccataagaacacctttaatctcataactgtttccggctacaagattcttataatcaaccttatctgttatggttgtctttacatcaggagctgcagtatgtgtctttgtggcagcatctgttgctgttgtatggatttcagggtaatgtactgtctgtccttcatccttgatgtctgtatgaaaagcaactctgacattctcattataaaggtcttcaaacactacagttgtctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtaccgtctgtccttcatccctgatatctgtatggaaagcaaccttgatattctcgttataaagctcttcaaatgctaccactgatttcccaataagcagggtactgtcaaatgtaaaggcaagctcaacactgccggaagccttttcagccttgaaggttgtcttagctgtaatctcttttccatctttatcaagaagtgctgcacctgtctcctgattcataaggacacctgatacctcatatgtgctgcctggaataagattcttatagtcaaccttatctattacagttgtctgctcatcaacagttcctgtatgtgtctgtgaagctttatccgttgctgttgtatggatttcaggataatacactgtctgctctgtatcatcaatatctgcatgtgtatatatcatctttccatcctggaacatgttttcatatgccacaagtgtctttccggcaagctctgcctcaaaactgaatgttactgtaactgtctgctttactcctgttgccttaaatgtgacggaatccgtcacatcatttccattgatatccttaagtgtctttccggtatccttatctgttaatgctccctttagtgtataagtctttcccggaaaaagattgtcgcactcaacatgatcgtaaacaacatatttattgtcagcactcaaagcaccctgatgtgtgcctgttgctgtatctgttgcctgtgttcttacaatctctgtatggtcgtcctcaaagaaatatgaaaatgtctgcacctttgtagtctgtgacttatatgctgcatctattgtctttgattcaaacctgtttccatagcctgtaggagaatctatctcttttacaatgtaatggcctaatggaaggtccgaaacaaatacggcttttcctaatgcattggtggtctgtctctcaatcattgcacccttcttaattattacagtgccgtcatgattaacaatatcctcatctgcataaagggcaaatactgtattaagaagagggttcattgttgcagcatctgtcttgtttgcatccactgcaatcttctgtctttcatcttctacagtcttggaatccttaacaatatccactgtctgtcctgcatatgtaaatgttacatctaccgggtctgtatcaataacaaagcctgcaggtgcttttgtctctgttaatacatagcttcctaatggaaggttatctattacagagcttccgtcagctcctgtagtaaattctgctactacatcaccagccctgtaagcatatccgttattatctgctgtctttatgtcttcctttgcagtaagggtaaatgacgcaccctggatattggctttcttatagacaaagtgattatcattgtctgctgttgcggcatcccacttatcaagcacctcaccgacctttgtaactgtaagctgtcctgttactgccttatctgccttttcaaccacaacaatttcagttccgccatcttctgtatatgtgttttcagataccgtaaatgataccggagttgaatcaagtacatatccttctggtgctttagtctctacaagggtatagttacccttaagaagcttttccagtgtatatacgcagccgttttcattggttgtgaagctgtcaaaggtctgtactccggctgatgtcattgtcttaaatgatacctttgagccgttctcatcatacagttcaaaggttgcacctgctacatttactgtgttgccagtatcagcgtccttttttaccatcttaagataaaattctatcggagtattttcaagaatcttatggtaattggcattattatcactgattgtcacatcaatatcatcaataaagtaatacttgttattacctttcgtctgatgaattgtgtatgtaccatatggaagacgctttgttatagcatatccattggcatctgttgtgattgtctgtcttgaatcttccggtgatgcatcatagcttcctgcagatttaagataaatcttaaactctgcatcaggttcagaagcctttactgcattactgccacctaagaatttctggatgctaatagttccttcatacggagtctcctgtgctgccttgtcatctgttggaaggtttgtcgttaccacaatatttgtatccaattttgtttgtgctatgtatatagtatcattaatcagatatccttctggtgctttactttcttgaatagtaattgttcctaatggtaaagtgtatcttcctgcagtgttgacaatcagaccatcactaccgcttacaagataatctgatgtaagtcttattctaccattcgcatcagtcttaaatacccatttatacttagctgtacttcctgtctgtgccgggtctgtatctgataaagtatcataatactttactgtgtactccgccccttccagtcttgtgttaccagagccatgtccgtctgctgttctttttgataataaaagtgttatagggtcattgcctggcatatctgttattgtctcggtgtagctgtcttctgaatcaagtgttattgaacgaacctcatcattaataaggaatccctttggcgcttttgtttccttaaagtatagtgttacactttcaccttccctgaatgttgtgctgtaataacctgtatatccgtcctctcctgtcgtaagggtatcaagcaaatctgtacagcctgaatctgaatatacggatatttcagctcctgcaagactgtagcagctgttaccatctgatatggatggcattgctgacttcttatgaaatcttacacttccggtaagttcttttaccggagtttcactatatagtccaagactctgattagtactggaatcatttgaaagatatgtaagactgcactcgtatcctactgatgaaggacttatattggatgctatgttaagaagctcctggcacaattcccagccaagctttccttccccatcacccaagaatgtgccattaccatttaaaggtgtattccagtcatcctgcccgtttgcaagggcaattgtgtgatgggctataatccatcttaattcataaggataatctttaagcacaccccagtcttcatcatcccatccagctcctacagcccagaacattgctcttgcttctatatcatctgttccatactctgttgttgctgtaaatgtttcactctcccttggtgtatccttatgtggttcaatacatatagcctcatactcattcccataatcgtcctgtacagtaaaatgatatgtcttccagtgtcccatggaatcatcatagccagaaaacacatcatcataccatttttcttctccaagacttataagagtataattagacccttctgcttttgcagtaataggggttatacatgtcagcaccgttgttattatcataagtgccgacatcagacctgacattactttttcaagcaatgcatgtcttttcctctttccctttttcattataatgttcctttccgtgacggattccgtcacatgtgcgttagttactcttttacctttattactctggcgagtctcttacacttttcatatccgtttcctttcctgattttttgcaacaaaaaaggaaacccctaccggaatatatccggtaaagatttccttattatttataatgcaagttaaaacttgtcccattatatgtgacggattccgtcacaattatttaattgttatttagttgctccacatgagcatgtgtaacctgtagataaaaccacataactgaaagatgaatttacacacaaatttggacttgactgtcatgcgtatttagagtttgatgggggaaatatagatccggagcgtctggaaaaagcatggaatgtactgcagtatcatcatcctatgctgcgcgcctgctttttggatgatggaacacagaaaatcctggataagccgtattgtgaaaaaataaaggttcatgatttttcccggatgtcatctgaggaagcagaggcaatggcagtatctgtcagagaacgtttatcccatcggaagttaaagattgaggaaggcgaagtagcaggaatagagcttacgctttttcctgaaaataaggcacgccttcatgtggacatggcacttttggttgctgatgtacagagtctgcagatattattgagggatttggcatctgcttaccgaggggaaaacctgccgaaagaatcaaaagggtggaattttgcttcctatctagaacggcagaaacaggaagaaggggaggaacggaaaaacgcagaaaaatactggaagaatcgtttagagcatttgccaaaaggccctgaccttccattggcaaaacgtccgcaagaagtggaaaaaacggtgttcaaccgcaggattgtgagaatcgaaaaggaagaatgggatcatttgcaaatgcgggcaaaaaaataccagacaactccggcaatggttcttcttactgcatatgcggtggttctggaacgatggagcaggaatcattgtttccttattaacattccgttttttaaccggaaaacagagcagcaggggttagaggaagtaatagcagattttactactctgttattgctggagattaactgcgaagaaaatccgacttttgcggaattgttggacaggattcagaagcagcttcatgaggatatgaagtatacggcatattccggcgtgcaagtacagagagacattgcgcagatgtgtggtgacgcatcggcagtggcgccggttgtttttgcctgcaatctgggaacgccgttggtaaatgatacgttccggaatgaactggggcagttttcctatatgatttcccagacgccgcaggtgtggaatgattttcagagttatgaagatgaaaatggcgtacagcttacatgggacagcgtggatgagttattcccggagaatatgatcccggatatgttggagagttttgagattcttctgcatgaattgggaaagaaggactggaatcagagatttgatgtgcttcctgaaaaaagaaaaagagaaattgaagatacagcgcgtacaggagtgccggagcgtgtggaatgcctgcattgggctgttatgaaccatgcggaagtttgcccggaagatattgcgcttattgatgcgggaagcggaagatcggtatcctatggggaattaaaagcacgggcaacagcagtggcggcaggaatttcagaaaaggatattaagggcgtcccggttgcacttaccctgccgcgcgggatagaacagatcgagtcggcattaggaattttgctttccggaaattcataccttccggtcagcttaagccagcctaaagatcggagagcgttaatccatgagaagacgggagtccgctatgtggtcacgaatcgggaattatccgaaaaactggactggccggaaggtacggaaatccttgtgatggaaggtatggaagagggacaggaaaatgtgagactgccagaggtgtcgccgaaggacagcgcctatatcatcatgacgtcaggctctacaggtgttccgaagggtgtagagattgcgcatgaaagcgcatggaatacggttcaggatattaatgaaaagtaccatgtgacaagtgcagatcgggcgctggctgtatcagctatggattttgacctgtcggtatatgatgtttttggaattttaggcgcaggaggaacattggtattgcttccagagcaggagagaaggaatgcggattactggctggaacaagtgttgaaatatcagattaccgtttggaattcagtgccggtgcttctggatatgcttttgatacgggcggaatccatgaaacagaaactgccgatcagggcggttatgctttccggagattggattgggatggatctcccgcagagggttgcggcatggacagaggattgccagtttgtcgctatgggaggagctacagaggcaagtatctggtccaattatcagaatgttaccctgccgatgccgaaaaactggaaatctattccctatggaaagccactcagatatcaggcatatcgtgttgtggatgagtatggaagggattgcccttactgggcagaaggcgaactctggattggcggttttggtgtagcaaaaggatataggggagattctgcgcttacggggcagaaatttatcacagatcagtatggaagatggtatcggaccggtgatctcggaagaatctgggatgatgagataattgaatttttgggaagaaaagatcatcaggtaaagatccgtggacacaggattgaattgggagaaattgaacatgcgattcaggagtttccgggtgtggctcatgcagttgttgatacagttagtgatggtcatggcaataaaacgctggctgcttatatcggagcgccgatacaggaagattctaaagttacaacgtatttgtacggcacagatatctttggcgggggctggaaagaactgaaggatgatgtcagcaattggcagatgcagcaggaacggaagacagcatacaaaaatttccttgcctatgcagaccagagatgtgtacagcttatgctggagacactcatagagttaggcatttttgtatcagagaaggaagttctttcgcagaaggaaatttttgaaaaagggagcattacggaaacacagaagaatactgtggcaagatggttggaaattttaaagaaggaaggaatcctgagagaagaggacggcagactatcgcgtaccgggaaggaagtggctgtaccggaaaaagctggagatacggaaacgtattttaataaactgaagccgtatctgaagcatatggttactgggaatgaagttccgctggacgtattttaccagaaagagccggctttggctccgaatatgctgcttcggaggattccgggctgcgaggaaacagtggaaagactggtgcagggattaaggcttctggcagaagaacgcagaaaagagccactccagattatagaaattggtacaagggacactgcaattacaagacagtttttgaatgcactggaagatgtaagcgtggcttatacttatgcggattcttcaaaatattttctgcaggaagcagagaaagaacttgcgggatatgagagagtcgagtttgagatgctgaatctggaagaaggcatggataagcagcagatgtccttgcatagttatgacattgtgatatcggtaaatgctttacatagaaatattgatgctgctgatgcggtaaagaaagtagcggaattactgaagccaaacggaatattgctgatgactgaccttgtggtaaggacataccttcaggaacttacagcggcttttttggaaaatggttttgcggatattcgggacaagagaaaagaagcagggctggttaccccggattgcctgctgtggagagaatgtttatcagaggcaggattgggcgaagactgtgctgtgacagagagatatggaagatgtatatgctgcagcagacagcaggcgtctgtcctgtcctatcataatggagcactaagggaatatctgtcagaaaaactgccggagtatatggttccacagaattatcatttcatggagcagctcccaacattgtccaatgggaagattaacaggaagcaattgcgggaagattttaaagaagaaactgcggttatccgattttcaaaggcaacgacagaaacagaagaaaagcttttagatatctggaaacaattatttggatatgaaaatatcggaattgaagataattattttagccttgggggagactcgctgattgccacaaggttgatctcggaagtacagaaaaccttcggctgcaaaataacgatcagcacgatttttgaaaatctgaccgtaaaatctctggcaaaagctattgaacagtccgaacagaaagaagaagatacactgcagatcaaaccgaatctggaggaagcatatcatccgttcccattaaccgatgtgcagtatgcttactggcttggcagaagcggattgtatgaattggggaatgttgcaacgcactgttattttgaactggatgcagacggccttgatactgagtgcgcagagacggcatggaatctgttgatacagaggcatgggatgatgcgtgttattatccagccggatggtatgcagcgcatactggagaatactccccagtatcatattgacgtgacggatatccgacaattggaagtgacagaaaaagaaaaggcattggatgaaaaacgggcagagatgtctcatcaggtaattcagacagatgaatggcctctgtttgatgtgcgaatcactaaaatagaggaccagaagcatagaatccatatcagttttgacaatattatctttgatggctggagtatgttccatctcttaaatgagtgggcagaagtatatcgaaatggaaaagcggaaatgccgattactttgtctttccgggattacgtgctgggactggagcagataaagtctacctctgcttatgagaaagataaaaaatattgggaagaccgggtggagacttttgcggacgcaccggatctgccgcttgcaaagaacgaaagccagattacagagcagcgtttctgtcgccggagcgcaaaactgtcacagaaagaatggcagtctgtaaaagacgcggcgggaagactggaggtaacgccttctgttcttttgatgagtgcttatgcggagactctccgcttgtggagcagtaataaggattttacacttaatctgacgcagtttgaccggaaacaattgcatccggaagtgaacaatctggttggagattttacaacactgacattgctggagataaagaatgcagggaataattttgcggaaaggacaaaggcaattcagaagcagcttacagaagatctggagcatacagcttatggcgcggttgaactggagcgcgaattaaagaaaaagactggaaatatgcggggcgctattatgccggtagtgtttaccagtggccttggcgtggagcagtggaatgaaggaaagtggcttggaaaactgaactataacatttcacagacgccgcaggtgtggctggatcatcaggtggttgaaatggatggctgtttatgcctgttttgggattccgtggacgaattattttatccgggaatgctggatgagatgttccgggcatataccggcctgcttcatacgctagcagttcatccggagatcatgcaggaaaaaacggcaagtctggtaacagcggaaatttcagaaaaacggcgtcaggcgaatgaaacggcggctgaatttgaagagaaaacgttggatggattattcttggaggcggcagacaaatttccggataaggaggcgctggtaacgtgcagcaggcggatgacttatcgggagataaaagaagaggcgttttacatttccgggcagttgaagagcatgggaataaaaaaagaagagacggtagctgtatttatggaaaaagggtgggagcaggtagttgctgtttatggaatcctgtttgccggagccgcatatcttccgatagatatccataatccgagagaacgagttgaaaagattctccgtgacagtggaacaagaatcattcttgtgcagaatcaggcgtatgatcaggataccgaatggctgcacgagtgggattgtatttctgtgtctggattaaaaaccgattctgaatacaaagcacaggagaataaggcgggagaccttgcgtatgtaatctatacgtcgggaacaaccgggatgccgaaaggagtaatgattactcaccataatgcagtgaatacaatactggatatcaatgcacgctatcagattacagaacaggatacggcgtttggaatctccaatcttcattttgacctgtctgtttatgatgtttttggcgttttaggcgcaggtgggaaattggttcttccggatccggaatatggaaaagatccagcgcattggattcactggttgaatcatgagaatattaccgtatggaacagcgtgccagcttttgtagaaatgctggcagaatatgaggaatatcaaaggcaggtaacttcacaatcgttgcggttggtaatgatgagtggcgactgggttccggtttcacttccggggagaatccgtaatctgtttcagaatgttgagattgttgcacttggaggagcgacggaaggcagtatttggtccaatcatttcgagatcccagagattgtgccggaagattggaagagtattccgtatgggaaaccgcttgcaaaccagaagtattatgttctggatcagaatatggaagattgccctgactgggtaccgggaacactttatattgccggagatggcgttgcacagggatatttaaacgataatgaaaaaacagaagaaaagtttgttgttttagatagaactggggaacgattgtattgtactggagatgtgggacggtattggaatgaaggtaatattgaatttcttggaagattggataatcaggtaaaaatcaatggatatcgggtagaattgggcgaaattgaagctgcattacgaaggattcaaggtataactgaagcgtttgttttttttaaaagggataatgcgatagaagacatatgtgctgtattagtagaggaaaaaaggtatcgtgaccggatagacaagttttataaggaaatgttaaaaaaagatcttccgatctatatgattccaacagaatatattaaaacgaatgctattccgcttaattcaaatgggaaaaaggatattcataaaattttgattgttgcagaaaaaaatagaaagcctatttttaaaaagaataataattgtaaacagcttactcaacttcaggagcaattactcgcaatttggagagaagttttaaaaattgaaaatattgatataaatgataacttttttgaaataggtggaaattcgatacaggcaatacaaattactaaccaaatgacggagaaaatagggtgttttatggatatcggcaagttatttgagtatccgactatcagcaaaatcgaaagatatatattagaggaaacgtaatgagtaaatacatatttaataatgataccgatattttggagtttttggagcaacttagagagaatggcattcaaatttggggagaaggggagaaaattcgatacagatctaaaaacagacaattggcaccggaaacattaaggattcttaaaatggctaaaggtcaaattttagatttctttcgaatgatcgaaaaaaatgtgattccattaacatcaatacaaacagcttatgttgtgggacaaacggctgggtgtgagttgggaaatataaatgcgcattattacatcgaatatacaatagaatctttggatgttgaacgacttgagcaaatgataaatctggttatttctaaaaatgatgcattacggttgattgtaacacatgaggggaaagcgagttttttagataatgtgccatattattctgtgccagtttattcattatatgatgggaatgatagagagcaaaagcggctagagagaagtcatcataggtataattattataaatggcccatgttccatttttgcgttgggaaaacatcaggaaagacaagtgttttacatgtagattttgattgtattattttggatgcatggagtgcaaaattactgttgaacgagattttcagtttgtactatggaaaagatgttaaatttccacgaatctcttttatgaattacatgagattaaaaacagataaaggagatttggaagctgaagaatactggaaagaaaaagtaaaaaatatgccgagctttcccaaactgaattaccagaaaaaatttgcagaagtgcagaatgtaagatttgatagaattgaatgtgatttttcttttatagaaacacaacgattatatcagaaaataaaaaactatcattttactcctgctgcagtaatttctacaatttttatgaaaacactggcacaatatagtgaaactccaggactttccataaatgtaacattgtttaatagacagttattgcatgaagatgtgaatgggatactgggtgaatttactaacaatgcagtaatatcataccaagaaaaaacggattctttattggatgctattcgagcaactcaagaacagatgtggcggttagttcaatatagaaaatttgaaggaagcaatatattaaaaatgctttcttcaggtagagcaggaaaagcgattatgccagtagtgtttacttgtatgctggaggggaatgtgtctaaggtaacaaaaaaaagatattcattcaaagaagaatatgcgataagccaaacaccgcaggtggttttagatcaccatgtaagagatgatttgggatatttgaagatttcatgggattatattattgacatctttgataaacaatatattactgatatttttggcgcttatgtaaataatataaagaaatttatggaaaaatattagggagaataaaaatatgtttgtaaaagaattggaaattactttggaaaatggaatgaaaatttcaggagaattagatttgccagaaaggcaaggtcaatggaaaacgattattttatttcatggttccggtccatctgatcggcacgctacagttgaatccatgggaggtatagtatcccgtaattttgatttattgagcgaagggtttgtgaaagctagatatgcggtatttcgttatgataaaagagaaaattatgatatagaaataattattcgggatgccagagaggtaacgagatttgtttctggcttgtctgaagtggaaggaattctgttttatggatggagtgaaggagtacgagtttgtacaactttagtttcagattttccgaatgcgcaggctttgattcttcagtcgggtattgcagaaggatggagttcctatttctcttatatattgcgcgaacttacagtagaaaagttgaaagagttggataacaataatgatagcatattagaaatttcggattttttgaattgcataccggactccacatctatctctttctctctgtatttacttattcttggtacggataaggagggaaatatgaaatttaatgaagaacttgatccagaagggaaaggaagattcagcataatagataattggataccattggcagatgaaatagttgcagatcctactactttaattcgatttgctgaaaatgctcctggagaaacatgggcaggaatattagatgacataaaaaaaatccaattacctattttagtacttcatggtttgaatgacggatggatttctccggtagaagctgtgcaaatagcaaaggcagcaaggaataatgcagatataattttgtttaaagggttgggacattcactttctaaggtaagttctccattaaaggatgaaggcggtactatagaagatgaggttattgtgagagtcgtagaatggcttaaaaagaatgtggaatagttgaggaaaggaaatgtatatgatgaacgatcgagagttttctaatagaaaggaaacattacatggagaattttatgaaaatgcattgaaatatccagagagaattgcgcttatctatgaaaatgagaaagtttcttataagatgttgcgtttatatgcgttgcgtgcagcaaactatatgtggcaaagaggagtaagaagaaatgataagattgtagttatattgccgagaggtattggacaagtagctgcattgttaggaattcttgcaataggtgcagcgtatgttccgattgcgatgaagcagccgttaggacgtcggaaaaaaatcatagaaaatgtcaagccggctcttgtattgcaggatgaagcctttttagaagagaatccatggactgggtgtattgaaaataattcaaaagatactgcctatattatttatacatcgggctctagcggagaacctaaaggagtagaaatgagtcatgtggctgcaatgaatacaatagaagaaattttacatatgtggaatattggtgcggaagattccgtattaaatatatcagcatttgattttgatttgtcggtttttgacatatttggtcttttaactgttggagggacaattgttttaattgatgaagacgactttagagatccagaagtatggaaaaatctgatagagatttatggaattactatttggaatagtgcccccgcgttattggacatgtttttgataatgggggaaaataatcattttggtaaattgcggttggcattagtgtcaggggactggattcctttatatttaccggagaaatggtataaagtaacttcagcaaactcgcaatttgtagcgttgggcggagcgacagaaggcggaatttggtccaactattattgcgtttcaaaagtagataaattgtggaattctattccttatgggcaagcattaccaaaacagaaatataggattacggatgaaaattttgtggagtgcggagttgatattcctggtgaattgcaaattggaggtggaagtctggcgaaaggctatattaatgatgaagagctaacaatgaaaaagtttattacggatgtaaaaggggaacgttggtatagaacaggagatcggggaaggcgatgggcagatggaacgatagagtttttagggcgaatggatacccaagtaaagatacgtggacatcgaattgagttgggagaaattgaaagtgtattaaaaagtatttcaagaataaaagaagccgtagttgttgctcagggggataaataccataaagaattagttgcattttacttgggagagtacattgcagagagtgaaatagaagattatcttaagatacatcttcctgagtattctataccgaattctataaacagattagaaaattttcctcttaatgcaaatggaaaagttgatagaagaagattggcagaatatcagaaaactgatagtgtggaaataatgtctgacaaagtattaaatattgtactgatgatttgggaggagctattgaaaaataaagtggctgatttggatgagaacctttttaagataggtgcagacagcttgcttgcggctagatttgttgcggctattaatgctcgttgcggaatagaggtacgcatgaaagaggtctttatgaatccatcaattaacgcactaacaaaattggttgataagagaaaaaatacagatatagcagaatttgtagaagagggggaaatttaaaaaatgcaggacacgaaaaaagtagcaggagaattattagtagagcttgaaaaaaaaggcgttacttttgaaactgttgatggaaaattaaaatataaagattccaaagggaattttacagaaaattctaaagagaaagttaaaaaatataaagaagaaataattgaaattttgaagaaaaaacaaacgatagacgagtttattacggataatgattatgaaactaatgtatatcctttgactgatgtgcaagcagcctatttagttggaaaaacagaagctgtgaagtggggtggaattggatgtaaaggatatattgaggttgattttggttcctacagtgcagaagaactatcaagagcttggaaagtattggtaaataggcatgaaatgctaagagcgaaagtaacagaggtcggatttgaaattttagagagagatgagattgattatgaaattaaaatagtaaatctacaaaaaatggcagagagggaaaaagtagatactttatctaagattagggaagattttagtgaatatgtttttcatacggaggaacctccattatttaaagtgctaataacgaagcgtatagaaggaaattttttccatctacttgttgatttaattgtttcagattttgcaagtgtgcaacttctgatttctgaaatgggagaacttttgaaaggagcttcattagaaaaaataaggtataagttttcagattatgcaatgttcaatcaacaacgtaaaggaagtttaaaatggcatcaggatagaatgtattggttagaaagactgaaaaaattaccggaggctccaattcttccacaagatggacgagccgcagataagtgtgaaaatacatatgaattttatcgatttcagaaacatattaatcagtctgactggaaacgtataaaggaaattgcaggagaatacggagtaacagtttcatcggtgcttattggtatatacgcagaagttatttcaaggtggagttcgaataaacattttacactcaatttaccaattcaaaatagaccaactatcggaaataatactaattccatagtaggagactttacagcagtgaacttgctagaagtaaatgtaactcaaaatatgagttttatagaaagagtcaaagaaattacaaaaagattgatggaggatttagagcataattctttttctggtgtcgaagtgctaagagaactgagtaaagtgtctgaagaaaaggaattattaatgccgatcgtatttacaggggttttgaagactgatggcactgtaggcactattgaatatgggtttagtcatacccctcaagtatggattgattgtcagatagtcgatgagatagattcagaagatcaagaaaaaggcctgatgataagctgggatacaagaaaaggtgcgataaaagaatctattgtaacggagatgtttgagtcttttactgaaacaataagaatacttggaataaaacattcggaagaatggaagaatccattggaaattatagtgccaagtgcgagtaagaaaaaagtaatttgcgaacgaaataaaggtattacgaatcaatctcgtattcaacagagatttgttaagtatgcgaaaaagaattctaataaaactgccgtaatagatgctgttgaaacagtgacatatggagaattgttggaaagagcagaatatatagcaggttatttaagaaaagaatttgtggaaaatagaactggactggttgcgataagaatgaaaaaatctgtaaatcaaattgcagcagtaatgggtgttttgattgctggattttcttatttacctattgatataaaacagccattggcacgacaagaaaaaattttatcaaaagcaaatgttattgtggaattggatgagaaaaaagtaaatatgatacttcagaatttggaataccgattagaaaagcatccagaattccaaaatcctattgcatatgtaatatttacttctggctctacaggagagcctaaaggtgtagtaatgtcacatactgcggcacaaaatactcttatatctattgaaaatatgtataatatctcggaagaggatacaatccttggtattgcggaactgtcatttgatctttctgtatttgatatatttagtgtattgggagttggtggaacattagtattaccgaatccagaaaaaggaccagatgcatcccattggggcagattacttaatgaatacaaagtgaccttgtggaatagtgttccagcgcaggcggaaatgttagatgcttttgcgtctaaatcggagagttatccgacagttagattagtactgttatccggagattggataaatactagtctgccaggaagactaagaaagattatgaccaacgctcaaatgattagtttgggaggcgctacggaaggtgggatttggtctatatatcatgaaattgatgaaatagaagaaaggcctactatattatatggaaaagctttgcttggacagtggatgggagttgtagacgaggaattgagaatttgtccggaatatgtttcggggcaaattgccataggaggatattctttggcagaaggctatttaggagatacaatattaacaaaagaaaaatttgtttatctggaagaagaaaagaacaggatttatctcactggagataatggaagatatgtagagaatggcgacattgaatttttaggcagattagataatcaggtaaaaatcaatgggcatagaatagaaattgcggaaatagaaaatgcaatacgtggaatgcaaaatattgaagattgttgcgtggtttataatcaaagtatagggaagggtgtgctgatagcttttataaaaaataaaatatcgagcatttcctatacgaaagaagaatacagaaagcagttagccttttttttgccaccagcaatgattccttcagagtttgtaaatgtagagagttttccactttctactaatggcaaaatagacagaaaaggactggcagagagtatacaaaagaacatcaaggtaaagcataatgcaaaagcaactttaatttcgcaaaagaaggaatatgtagaacttgctaaaagtatcaaaaaaatcgtatgctctatttctggaaatgattatattgattatgaagataatttattagaaaatggacttgattctttgttattatctcagatttctgggcgcatagttagtgacatacaagaagcacaaggcatgagatttgatgaaatattacgggcatcgttgacgatgccaacaattatggggattgctcagtatatatcggattgtaaaaatccttcaaaaaatcaaatgcatagtaatgcaggaaatcaaacaagaaattcatatactgttgtatatatatttggggataacgaaaatgaaataagagatgttcttatagaaaagttgagcgcttcaaacataagttgtaagagagtgggagggcaagaaataattgaaagatgtcatgaagacataaatgttaaaaagaaatatattattgccttttccgaaatggcttctttatgcataactaaggcaagtgaactattgggggaaaacattattattaaccgcatttttttaataaatccatctaaagcaaaagaaagtgatttatatttaggagatataagcataattgacggaaattcagttgctattaaatcttgggaaaaggctgttttaggtaacgttagagaatttgaatctaatagtaatgacatttttgatattattatgagggaactagaaaatgataaataatcgcagaacaatctgtattcttggcggaacaggtactgttggtgtgacagcgtgtaaggttttaagtaagttaggctattcattaagagtcagtgtacggaatatagaaacaataaaagatacaggaatgtatatggctcccaacatccaattatttgaacttgatattgataaggaaagtaatattggaaaattctttaaaggaagtgatttggtaataggagcaatcggaccttccgcagactatagtgaaaaaatgttacttggagcaatggcagagaatattccgtatgttgacccaggaggaattcatttaattagaaaaatgaggaattctagcatgaaaggtaccgctatagttggttcgggaatatttccggggttatcaggatggatgttgtcttctgtgcttaaagaagctttcaatgatgacttaatagagatgattattggaggtgtctataatttttcaaaagctgccgcaatcgattatgtggaagaaataaaaagttataaagctggaattcctatggcatgtgtgcgaaatggaaaaattttacctgctcagaaaagaagtccgctgaatcttccaacaagaatttcgaaattatctatattgccatatgttacagaagaaattcaagaaattatacaagggaaatatatgcttaatattgattcatatacggcggcacctgtaagtttattttcaatagtaaataaggcgcattgtcaaaaaaaagatttagtaaatgcattaatgggacagaaaaatagcaaccaaaaagcttttatatgggtaagacaaaataaaggaaatgatagtagatgcatttattttgaaggaaaaaatccgagtgttttaactggcgaaatattagcgattactgccaatgcaatatttgaaatgcctaggaaggatggaatttatacaatggcaagttatcttgaaaaatatcaagtgttagatgaacttaaaaaaatagataagttcaaatcagagggaaagatatgaagaaaaaacagattttagtatgtggaacaggatttgggaaaatttatttgaaagctattgcagaaagtaaagaatatgagcttatgggtatattgggaaaaggaagcgatagatccagacttctttcaaagaatctaaatgtgccaatgtatacggatattaaagaaataaatcaaaatgttgatgcagcatgtgtagttgtacctaatgcggctggaggtggaaacggtgccaatatagctaaaagtatacttgcaaaagggataccaacattattagaacatcctgctcatgaggtagaaattgttaattgtataagagaatccggaagtgccgcttttatgttgaatccattttatcggtatatcaagccaattcgagattttttagaggcggcacaaataataagtaaacatgctcatcttataaatgcatccttggaatgcgctatacatgtattatatgatggaatagatatattggggtgtgcgttgggaggcttatcaacatggaaattgggaaatgtagcagaatcttatacaacttctatggcaggagggggtaacagagttattagtggtataattggaatggttccggtaacatttatagtgaataccaatgtggatcgtaacgatatagaccatccattacatttatatcatagaatagaattgacattttccacagggcggctctgtctggtcaatacccatggtccggtaatatggcttcctttcttgcatatgccaagagatgaatatggaacactaagtattaatgtagaagaggaagtaaatataccctctggtgttactataggaaatgtaatgttaccatcagtaaaagaaacgtttgaacaaatatggccggatgcagtaaagaaagctttagagattttatttaagcaaaatagaacagaaaaaatgtccatggcgcaatatcaaatatatgtatcaaaattatggtctgaaatatgtcagaaagtgggctatatgaatatcgttgattatgacaattttggtgacataaaaaatatattttatgatttggaaaaaagacatttaataaaaaaggagaatgacgggattgaatgaaattgagaatgtatacggagagacagtagaattttatgatttatcagctctttcacagatagggaacaaaaaaattgttttaaacaaatttgctgatatggttaaggatttagatggaatcattttggatataggtgcaggaactggaaaaacaacaatagagatggctaatatgatatgtgataaagaaataattgctttagaaccatcggcttatatgagaacagcgtttatggcaagattaatggagcataatgaagttaaagagagaatttctctattgccgatagatgtaggtaaatattcatttcgagataaaataagtggtgtaatgtgcatgggagtacttggtcatttaaaaagggatgaacaagaaaaattattgtataaattagataaaaatttgaatataaatgtcccaatcctgatagaacttttagaaccgaaatttcttgttgcgccagtaggaagcagaatatcggtggctactcaaggaagattgcgctatgagacgtatattaccgatataaagcaagtggggatggatcaatggacatggagattgacctataaagttttttgtggtaaaaacatagttagtactgtagatagcctaatgtcgtggaattatcagagtgtggaaaaaattttaaaccaattgacaaaaatgcactttagaacagctaaattatcagaaacattattacttgcaataaaagcacgataaatatgaacttcagataaaattaactctcgaactgtcaggtgttcctaaaatgccatatttataagataatttagcgatgtgcagggagaataatgagaattaatattaaattgtcagtacaatgggttttaaaagtgactttatcgtcttgtgagatgcagaaagaaatggaagtaagtgaagtttgtaatttacattaagtagtgtctgctttttacatgattacaaaatttgactttttactttggaagttgtaaaatttaattagtcttatctaacttcgggaggaatgcttgtacatgacaaaccaatacatgaataatctttatcgtgatctgctctctaattcaccgcagacaataaccatagatattccagcagacatggggacagggcagattttacaggtggtcacgaaacagggagcagttgtttcggactggaaaatgaattatttttcagatatgaacgtgcagggagtgagtagcgaagaatacattcaaatgttgttctgcttcaatgatggtgtttcctggaatattgcagatagccgacaaagtatcagcatacaaaaaggtgagtcctgtatttatcgtggacacgggaaaatggaatatctgtgctattccaaacaaaacgatttccttttcaaaaatgtaaaagtaccactgtcgtatttccgtaaaattatgaatgactattttgatgttggtgagattgaggtttatcagaaaaaactattggaaggtatatcaaaagtaggtattactccctatatggagcacatttttgcggaactgaaagacttcacgcaatatcgcggcggattgggatacctgtttttggaaagcaaagtttttgagttgttatctgtatatttgagtgagattttggaactgagtattcttgcgtcaacttatatagcaatttccagaagtgaccgagaatccatcatagaagcgaagagaatcattgacagtcagcttgctttggcaccaagttgtgaggaattggcgcgaaaagtcaatattagtacttcaaaattgtcaaagggtttttcctcgctgtttggaacatcggttcatgcgtatattatagatcagcgattggaaaaggcggcaagtctactattagaaagtaatttgaacgtaagtcaggtggcagcatttgtaggctattcaaaaccgagtaactttgctgcggcattcaaaaagaagtatggggtaattcctaaaaactataaaacggaaaatacgattggttaaaattaaaaaataccgattttgggtagaataaaaccgtttttgggttggaaatgtaggcgtaaattgttattatatgtggtgtagttagaaaatgctaactacaccattttttagataggaggatactggtatgagttcccagaaaaaaagttcccggcttgagggaaaagatttaattactatcggcatctacaccgtcatctatgtcgtcattgttatgctggtggcgatgcttggcttcatccccatttttattccgctgatggcggtgctgtgtcctttgattggcggcatcccctatatgctgtatgttacaaaggctaaaaaattcgggatgactgcaatcatgggtttcctgattggcctaatcatggtgttcttcggcaacggctatcttactatggtaactggtcttgttggcggcctgttggctgacgtgatcctgaaaaaggcagactacaaaagtgcaaagagtacagttctttcctgcggtgtgttcagcatctgggtgtttggcaactttgctcccattttcctgaaccgtgaaagctatatggtaatgctgactgaaggatacggcgctgaatatgcagctacccttaatacatatatgcctatgtggattgcgcctattttgctggttgcctgctttgtgtttggccttgtcggaggtatgattgggaaagccatttgcaaaaagcacttccagcgtgccggtattgcataatggcgcgggaaattctgctcagcaaaaaaacagaacaagggttgcggctcgatccgcgtacaaaactgttgctcatcttcatcataagcatttttgtcatgggtggaacaggcggagaagctatgggactgatccgccttgttctttgtgtggttccggctatattgctgcttacctcgaaacaatgtgcaaaagctgtgggctatattgctgtgttttctgttttttatgctgtccaaatttatgttttgccgcaccttacggggatattgaatttccttgttctgtttacaataggattcttctgccgaatccttcccagtgttgcgattgctgcctatgcagtgaaaacaacaacggtcagtgaattgatttccggcatggaaagaatccatatgcctaaagaagtgacgatccccttaacggtcatgttccgcttctttccaactgtctttcaggagtcagaagcaatcagtgacgctatgaaaatgcgtgggattaaacttggagggaaaaaatcttcaaaaatattggagtataagctgatcccgatgattacctgctccgtgaaaatcggtgaggaactttccgctgcggcaattacccgtggcctcggcgctcctgtcaaacgcacaaacatttgccagcttaaattcaattttgccgatgtggtgctgatcttgttttgttgctttgtagtgttttgggcgattgcttccccgataatttccgcaggagggattttgccatgatagattttcaaaatgtttctttttcttatggtgaagaatccagcggcggagggattagaaatgtcaatctcaccataaacacaggggaatttgttttactcacgggagaatccggctgtgggaaaacaacgattacccgtttggtaaacgggctggtgcctcattattacgagggcaaattagagggcgatgtccttctggacggaaaaagcgtatcagatacgccgctttatgacttggctgctatggtgggatctgtattccagaatcccaaaagtcagtttttcaacgtggatacggatagtgaattagcctttgcctgtgaaaatttaggctatcctcaggaggatatcctgaaaaggattgaccggacagtttccgattatcatattgaagatttgatggggcgaagcgtgtttgctctgtccggaggcgaaaagcaaaaaatagcctgtgcttcatcaagtgtattgctgccgggaattatggtcctggacgaaccatcttctaatttggatatggctgctattgatgacctgcggcaggtcctaagcctctggaaaaagcagggcaaaacaattctgatcgcagaacaccgcctttactaccttcacgatcttgcagatcgtgtgctgtatgtaaaagatggggagattgaacgggaatacacgcctgctgaatttgacagcttatcggatggcactcgaaaagaaatagggctgcggccgttttctctctcgaagttgaagcctgcgaatcagtatcaggcgcatacagctaaacagatggaatttcaaaatttctgctttgcgtataaaaagcgggaaccggaaagcctccatattccgagtgcagaactgcctgttggagaaacgattgccattatcggtctgaatggcgctggaaaatctactctggcccgctgtatttgcggactggaaaagaagtgtggctttttgcaggttgaggggaaaacccttgattggaaagcccggctcaaacattgctacatggtaatgcaggataccagccatcagctatttaccgaaagcgtggcggatgaagtgcttctgagcatggacaacaaggatgaaactgttgtggataaaatccttaaacagtttgatctgctggaatataaagacaggcacccgctttctctttccggcgggcaaaaacagcgggtagcgatcgcgtctgccattgtgagtaaccgggagatcattgtgtttgacgaaccaacaagcgggcttgatctcaaacatatgagggaagttgcgcggagtttgaagtcactcgcggatcagggcaaaacgcttcttgttattacgcatgatccggagttggtgatggcgggatgttcgtatgtagtccatatggaaaaagggcaagtaaaagaaagctatccattggacgaatccggcagtaaaaaggttttggattttttccgaatccgccagtgaattttagaaattatgaatgtcagggccgccttgactggacagaaagataatgataagaggccactttactttggcggcctcttgtttttgaagcacagacagtacggctcaatataaggagggcttatgttcaaaaaaatctttgagtacgcagggccatataagaaaaatatgtatgtggccacggttgtcgtactggtcagcgttcttacgggtatcctgccttttgtgctggcctatcaggtcatttcgccattggttatgggcgattctgttgaaacagaatttgttttattgcgtgttataggggttttgatctgtcttgttttgcaggcgtttttttatggatggggattatcaatttctcataaagcagcatataacacattgttgcggctgcgggtatctctgcaaaagaagtttgagaaacttccccttggcattgtggaggaaaaagggacagggacaatcaaaaagctgtttgtcgatgatgtggacagcttggaattgctccttgctcattcagtcccagagggtatcgcaaatttactgatcccgctggtgatttatgttgctatgttttgtgcggactggaaactggctcttatgtctttggcctctatcccgatcagcctgctctccatggtcattatgtactctgttggaatgaagcgcatgggtccctactatcagtctgcacagaaaatgaacaacacgatcattgagtacatcaatggtatggaggttgtcaaggttttcaaccgggagagcgaatcttacgagaacttccgcaaggatgtaacggactatcgggattataccttggcatggtataaggccgcctggccctggatggcgatatacggaagtctactgccctgcactgttattctgactttgcctcttggggcatggtttgttctctgtggcataagcactttacctgatttgattttagtcctctgcctttccctcagcattgggattcctctcctgaaagcactgggctttatggagacgattccgaatctgaattataagatcacggcacttgaacagatgttaaatacggcaccgctgcaagctgctgaggatgatttccacggacaggattttaacatttcttacgatcatgtttcctttgcgtatcagacgacacagcctggcccagatgggaaaccgataatagcggaaaacgaagtcctccacgatattacctttgtggcacaagcaggacaaaaaactgccctagttggtgaatccggttctggcaagagcacccttgcaaaactgttgatccactactatgacccgcagaaagggagcatttccattggcgggcataaactttgtgatatgagcctggaggcattgaacagccgcatttcctatgtggctcaggatcagtacctgtttaacacctccctgctggaaaatatccgtcttggacgtttggatgctaccgatgaggaagtaatgcaggcggcgaagaaagcccggtgtatggagtttctggaaaagctgccgcaaggtattcactccatggcgggcgatgcggggaaaatgctttccggggggcagcgccagcgaatttccctggcgcgggcaatattgaaggatgccccgattgtagtgcttgacgaggctacggcctatgctgatccagaaaatgaggaaaaaatggaggctgctattgcggagctggtggagggaaaaaccttggtagttatcgctcacaaacttcccgctataatgaacgcagatcaaatatgcgttatggatcacggaaagatggtggcaaccggaaaacatcaggagctgattcaagcttgcccagaataccaaaagttgtggaaagcggctcaggacagcgccgagtggaaagtatctactgcaaaggagggaagataaatgtttgcattgatttcaagaatcctgaacctctccgggaggtataaaagccgtattcaggctgcatttctatgtgcatttgtcgagtccattctctccaaaatgccgatcttcatggcgtttattgtcttggccgggtttgctgataatacgctgactggaaagacctgtctgtttgtcggacttggattattagctgttgtagtggttcagacagtggttcactatttgagcgaccgtctgcaaagtgccgctggatttatgatctttgctgataaacggatggagttgggaaatcatttaagaaaaatgccgatgggttactttacatcggggaatattggaaaaatcagctctgttctcagtacggatatggtattcattgaggaagtttctatgagtaccattggcaacatgatgagctatatgctgtctactttggttttagctgtttttatgttcgtactggattggagacttgggctgattgcggtaatcattaccttgctggcatcactggttgcaaaatatatgaataaggtttccttcaaggaggctgtcgggcgtcaaaaccaaagcgagaatttgacggatgcggtcttgtcttttgctgaaggaattggggttatcaaaagttacaatctgctcggagaaaaatctgacgaattaacggaaaacttcaaaaaatcaagggatgtcaatacgaagtttgagcagaaaatgacaccgtggaccactggcttaaacattctctatggcgtgggtattgccgctatcttcggtttatccgtttttttacatcaggaaggcgtactctccctggcttatcttttgggcgtgctgctgtttgtctttgatctctttggacctctgaaagctctttatggagaagcaacccgactgaccgtgatgaatgccgcattagaccgcattgaagctgttttggacgagcccgaacttcccgataacggaaatcaacatattctgtcacaggcacagccggatcagccagaagtacaatttagcgatgtgggcttcgcctatcaggacaaggaagtcctgcacaacatcagcttctctatgcagaagaataccatgaccgcacttgtgggaccgtctggcggtggcaaatccacgattgcgaaccttctggcgcggctgtgggatgtgaaatccggcaaagtgacaatccgtggtacagatattcgggatgtacctctcgccgaactgatggaacagatcagcatggttttccagagggtgtacttgttccaggataccatttacaacaatatcagcatgggtaaaccggacgctaccgaggaagaagtctatgaggctgcaaaaaaagcccgctgctatgattttatcatggcgctgccagatggattccagacagtcatcggtgaaggcggcgctactctgtccggcggcgaaaagcaaagaatctctatcgcccgatgcattttgaaggacgcaccgattgtcattctggatgaagcgactgcaagtgttgataccgataatgaaagctatatccaggaggcaatcaatgagctggtaaagggtaaaacattacttgtgattgcacatcgcctgaataccatccgtcaggcagatcagattttggtgatctctgatggacggatcagcgaacagggaacccatgacgagcttatggcaaaagccgggatttatcaggattttgtaaatatccgtaaaaaggcttccggctggagccttgcataaaggaggaaccgatgaagattcatgcgtccggggaggattatctggaggctgtgctgattcttcaaaagaagcagggtatggtccgatccattgatcttgcccggcacatgggattcagtaaaccgagcatcagccatgcagtaggtgtgttaaagaatggcggtttcctgactgtcgatgaagatggatacctcaatctgactaatgccgggcgggaggttgccgagaaaatttatgaacgccatcagttctttacggagcagcttgtagctgtcggggttgatcgggaaactgcagaaagagatgcctgtcggatagaacatgtaatcagtgaagaagcttttgaaaaattgaaaacttcggttgaaaaaaagtattagtacaatgttgattcaccgaatcttttatgttcatcatactatagaattgttgagaaacgtgaaacagggtatgaaactcgtatactaaaagacattcagagtggaattacactagaaacacttatggcaaaaggacataggaaaacgccggaagaaaaagcagctgttgcgaaacaaaagaggaaacagaggcgagcaaaacggaaaaaagaagcaagagataatctgaccaaagaagagatcttgcaagatgaccgatttttctgtattgctggttatacctccggaggtgcaccgtatggtgtcacctgggaggaaaaggatttgaaaccttgggaagatttggaagaaaatgagtgagttgccagtgcaatcttatttttctcttgtgacagaaacaggttccttttttgccggaagtaagtctgaactgatctctggagcatcgagcagtacagtgaaattttgctgaatgatctctagggttttctgctttttctgcaattcctgtttttcccggacagtagcatcctgttcagattcaagattttcaatccgcttctggattttattagagcttgggattttggtgataccgagatcctgaagctctttttttagtgaatcgtggagctggtattctgcctgatgtttggtgcggtatgcttttggatttttagcagatttacaatcttcaattactttacgacaaagccggtaagaattgcagtgtttctgaatgactttctgcgtgctcagctcactgttgatttgtgctattctttggtcggcaactttcacagaagcttcaatgtcagatacatgctgcctgaaatcgtcataattcagcaagttattttcggaaagatagttgaaggtgcgggctgcctcttttagattattgagctttgcccatcgttcaaatccctctcgatttccagttgtgacataagtggagatattgatatacaagcgagcttctctggacagatgtcttggagtttttactttgctacgatttttagccagacggatgcgaacattttcttcggaataatagcttccgagagatttcatataagtgaagttcttctgctccggtgcacggaaggacaggtgctttccctgccggacttcatatccggctaactgcatcttttgcagaaattcctcatagttgatggaagtccagattgatttatcaactgcgacacgtagcttggctttccaactggtgccacgatgatattccatgttctctttatagcttgtacctttttctccggttggcatgctggtggcaagtccattttcatggcagatacgattactgattctgcagagtttatggtagctccgcttattggaaacatacttgtgatgatcaacaaagcttgcagcgttgaagatgatatgattgtgaatatgatttttgtcaacgtgtgtgctgatcacgtactcatattttcctttcagcacttcgtcagcaaattgttgacctaagcgatgggcattttcggcatcaacttctccaggtttaaatgattggatcagatgaaatgccaggttatcgcctttatccattccattcttttttgccatttctcttgtcatagaaaattcaagatctgcagtttccggggaacagccaaaactggaaactaacagtttttcatctgtcttatctggatttgtaatatagtccagagctttcttgtcagttaccttaatggggaagattttaagatacgccataattctttcaccatctctttcaattcttgcatttcttctggatatagatctccggtggtatttaccttttttgcaatctggttgatatttacaccaatcttgtgcatttcctcatactgtttcttcagtggggtggtatcggtgttgacgatgtaaccgtcgattgccatcttacgcagataagctcccatgtttttggtttttgattctatcatcttcctgcgtataagcttcctttcttcttcggtgacataaaaatggatttctttgtttctctttctttcagccattggtgggttctcctttctgagaggacagtagtatcgttgctttcaacgtttttcaatttagggcagggtaccctaaattgggatttcccggaagtgtatcctcacttcctgtccttgctgttttacccctctattagttaaagtcaggagaaccgggaaaatgcaaaagaatttggcaggtagcacgggaagtgaaaatatggtatgattatgggcaggatatcaggagaatcaggagttgaatagattgtgaagaaagaagaaatttttgaatatgtgaagaaacagtatggtacgatgccggagtatttatgggcacaatcaccagataatgctgtgttgcgacataagaatggaaaatggtatgctgtggtcatgagcgttgaaaaatgcaaactaggattagaaggaaatgaatttgtcgatattatggatgtaaaatgtgatccggaaatgacaagtatgattattcagacctttggatttttgccaggataccatatgaacaaacagcactggatcacaattttactggatggttcagtaagtgaagcaaagacattagattttttggatatgagctatgatatgattgatgggaatagaggaaaggaagaatgatgagaaaggtaatcgtatattcatctgtgcatcatggaaacacagagaaattagtaaagagcattgcagaagagtgtcaggttgatttgattgatgctgtaaaacagccagatgcagatctgagcagttatgatacgattgggtttgcatcaggaatctatttttcaaaatttcatcagtcgatattgggatttgcagagaagaatctaccggacgacaaaggggtatttctgatctgtacttatggtggaagtgcgaattataaatccatagagcagattttgggcaagaagcattctacagcaatcggaaaattcggatgcaagggctatgacacatttggcccatttaaactggtgggtggtatagcaaaaggacatccagatggaaaagatataaaaaatgcagttgagtttgtaaaaggactctaaatagtttagcgaaaaagaaaaaccggggaacagtcctcggttttctgatatttgcggttcagtcttcaatttgaaaaatctcttctactggcattttcagataatgtgccagacggattgcaatttcgagagaggcatttcgctcaccacgctcaatgcgtccgatggtatcactgcaagaaccgacagcttttgcaagatctgcctgaacgagatttcgttcttcacggatatctttaagtgtgttgttaattgccattttatcacttcctttattattttcagcaagagcaggctagaagtctgcagttgatctttaatgaaaaccagggatttctgctcctttgcattttccgattactttcccaaagattttaaaagaatcagattcataaatctggattggatgatacttttcattcaatgaaaccagataaactccatccggaccgtcatgtagctctttgatataggtattgccattgagatagaagataccgatttcaccgttggagatactgtcttgtttatgaacccatgcaacatctccggtatgatacattggttccatactgtcaccagatatacggattccaaaatccgtcttttcaggtgcgagatgaccgacattgtaactttcttttacactgtcttcaatataatttccagtaccggcagaagctggctctactgcaatcggctgataattttcaaatggaatgatatcggctctatgcggaagatactttctggacgcccgcagaagattggcaaattcaataatcttagctttgccgtcttcattcaaattttccatgacatgatcaaatggattttcacctaaaaattcttcgtatatatcttcaatatctaaaatctgacaaactgtcaggattgtgtgtaaggagggttctcttgttagattctcccatttggagactgctttcgtagtaacttcaattccttcctgagcaagtaagtccaccagatccgcctgggagtagcctttcctttttctgttttctactaatacttctccgaaagcacgcatatgttcgcctcatttctttttgatttttctatatgcattataacccgaataaaatcaaaaatcaagaaaaatctccgaaaaggagataatacgaccaagatgtcgcttgactatctccaatacggagatatatactaagcatacagaaattgataagacaataaaccaaacagagagaaggtggtggagttaatgggagacaggacaattcttcatagcgacatgaattcattttatgcaagtgtggaaatgctgcatcacccggaatttgccggaatgcctcttgcagttggcggtgatccggaagccagacatggaattgtgctgacagcaaattatattgcaaagcgaaaaggtgtaaagaccggaatggcattatggcaggcaaaacagatttgtccggaaatcatttttgtgccaccacggatggacttgtatttgagattttcacagatggcaagagaaatctattcggagtatacggacaagatcgagccatatgggattgatgaagcctggctggatgtatcagccagtagaaatctgaaaggaagcggaataacgattgcaagagaaatcagccatcggattaaatacgaactgggtgtaacggtaagtattggaatttcctggaataagatttatgcgaaacttggttcagattacaaaaagccagatgcgattacagagtttaaccgggagaattataaaagtatgatttggcagcttcctgcatcggatctgctttatgttggaagacagactcggaagaaacttcagaagctggggattcgaaccattggggaacttgcagaaagtgatgaagcaatgttagaaagccattttggaaagatgggaattgtgttatggtcatttgcaaatggctgggacgatgatccagtttgcaaagatgggtatacagctccggtgaagtcaattggtaatagtaccacaactccaagagatttagaagatgatctggatgtctggatcattcagatggcactggcagaaagcgttgcagcaagattaagaaaacatggttttaaatgcaaaacgatagaaattacggtccgagacaatggcttgtttcgtttttcgaggcagaaacaattacatcatccaacaaatataacagatgagattgttacagcagcatttcaattgtttaaggattattataaatgggagcatccaatcagaagccttggtattcgagcagtagatcttgtgttggatgatattcccgtccagttggaactttttggtaatcaagagaaacaggaaaaattggaaaagatggatcgcactgtagatgagatcagacgacggtttggttatttcagtatacagagagcagttatgtatcaggataaagtcttatcccacttggacgctggtacacatacagttcatccacacagttattttcatggataatgggagggatagatttgaaacagacattaaccagaaaacaggaagaaagctatcagtgcattttgaattatacgaaggagcatggatatccgccgacagttcgggaatttggaaaactgatcggagtaagatcaacgtcatctgctttttccagaattaagcagttggaacaaaacggatatatccgaaggattccggcatcgccaagagcaatagagatcttatagtgaggtgtcggtatgaataaagtgtatgtagatgtagtggcagagtttcggaaagacggaaaactggttcctatatttttcacctgggaagatggaaaaaaatataacattgacagaattttgaaaattgagcgatgtgccagcagaaaggcaggcggtgtaggaatgatgtatacctgtatgatacagggacaggaaagccatttgttttatgaagtggataaatggtttatggagagaaaaacagcataaggagagattggtatagacgatattatttggattattaaccggcagggatagtcactttccctttatattcctgtaggttttacataagaagatggattccggtcagcaaaggcagctcccacaatgccttttggatatccgcttctgcaagttgtagtaagtaattgcttcccatcaaaatcatggggaaagcgaactggtctgaaagaccgccagttagtgtgatgatgataaggagattttgaaactgatgacagacagagattatgcaattaaatcaatgaaagagattaccttccagatggcaagccatgcacaggattatctggaagtaacgatggagagacattatacagatatcaaggaactgatgacaagctatcagaaattgattttggaaaatcagattgtgttagaagaattggatatggagtgccaggagaaaatcaatgaagatatggcatatgcgttgagttatctgagcatttataacaatcagctgaatgtgccaaagatgcaccgggaaatgaataacctgatgattatttacggcttgtcagatatgatctatcgtggaatgacactggtaaagttctatgcaccgaatggtgtgatgctcagtgagattcttcattcctgcttttgcagtcattataataagacagatgtggaagtacagcaggagttaggcgtaggcaggacttctttttataaaatgaagaagcaggcacttggatatttaggattttatttttatgagatagtggtaccgcaggcaaaagataaaagatttaaaccatcactgggcgttgaggaagagtaggtgaataatatgagatacgaagattcgatgaagggtgtagctgatcagataatcaaagaacagcagcgagccagtaaaattaaaaacaatccagaagaattccattggcatgacgaatatgcaacgttgaatttctttcggtttatctgtaaaaatatcggtaacttgggaaatggagaaattgaaaaaatggtcacacgcttaaagcacatagatcagaaagcagtggaaaaccatgtgaatggtgctgtctgggcatttgattatgataagatgttctgtgtattgatggaaaatgaaatttgccgaaaggtgtgtgaaaagaataaatataatagttggatgaaactgattggaaattattgttttcaagtggtgtaggataaaatagtggcttgtgaaaagctgattttgatgttaagatgaaattgggataggagacatttaggaacctatcctgacatagcaaagaatggaggcgagaatggacgtggcgaaagaagaaatcgtgaaaacagaagaattggaaacacgttacgaaagatacaagggtatcttaaaagaccttaccatcatgagcgatgtgtttatgcggaatgtattcaagaaacgggaatgtacagaatatgttctgcaggtaattatgaataaaaaggatctgaaagtgattgatcaagttctgcagaaagactataagaatttgcaggggcgttcagctattctggactgtgttgccagagattctgaaggcaagcagatggatgtagaaatccaacaggacaacgaaggggcatctcccaaaagagcaaggtatcatagtggtctgatggatatgaacacattaaatccaggacaggattttgatgaacttccggaaagctacgtgatttttatcaccagagacgatgcacttggatacggacttccgatttatcatatagacaggaaaatcgaagaagtcagtgagaattttaaggatgaagctcatattatctatgtaaattctaagaaacaagaggatacagaattaggcagactgatgcatgatcttcactgtaagaatgcagaagatatgcacagtaagatacttgctgacagagtatacgaattgaaggaaacacagaaaggggtggaattcatgtgccgtgagatggaacagatttacagtgaaggtattgaaagcggtgaaatgcaaaaagcaaaagagacaacgattgcccttgcagagatgggtttacctgctgacaagattgctaaagccgttaagattggcgtcgatgtcgtacagaaatggattgatgagagcatgagtgttgcacattaacaaatactgaatttcaaagaagctgccagaagatatgattttctggcagcttctttttaagaaattggaacacaaagaaaaagtgctttctcagaattgatgtgaatagaaattaggaagcaaaacaatgcgaagagattgttcactcgtgcaactggaagacatgttggatagaaatttatttataagaattagtaagagcggcattgtaaatttaatgaatgttgattcttataaaaaaggaacaataaatataaatggataagaaataaatgttgcaagaagaagacgtaaagatttcgaaatcgcattccaaagatatgatcttgaatttagaggggaataaatggaaataggaatattatatttatagtagtaaataaagcttttaatgattaagcttaatggcataatcgacataatctaagaacattgcagtaattactcatgtaaatgtcgtaaagctaatatataatttagtcactcgataacaaagtcgagaatatacataaggaggaaatgccatgaatcctagtatttcaccaatgggaaacggatgtaaattatgtgcaggatgtacagggtgtatgttctgtggaccatccgcaattgctgcagcgggtgcagcaggctttgttggatttttctgagtaataaatcataacaagcagaagactggaagtgagattttaccgctagatagtaataattctcacttcctgttctttctataaaataattacagatgataatagaaataagattgattatattgtaggttaaacaacaataaggagaaggtatgtatctgagattaattaacgtaaaagcaatagaaagacaaagagattcttatattcttgtaataaataaccgttatgaaaagatgggtgaatcattgtatcgcattaacaaagatgctttagaaattatacgtaacctaaatgggacaaaaacatttgatgatctagttgacatgatgatcagttgtcatttagagaagaaagaacaggctaagtataaattaaataattttttgaatgaattggagaaaaatccaggaatttctgtggagtatttaaaaaaaacaaatccaatagaaataccaatacttggaaatggaaaaacacagtatccatcagctatttctgtagaaattacacataggtgtaatgcaaagtgtttgcactgttatggagaatattgtgcaacgaatgcatttaaagataatacagaggaaataaagaagttacttaaggatgcacgtaaagcagggacaagagtagtagaatttacaggtggagaagtcacgtgtcatccgaggtttttagaaatcctgaatgaagcgtataatcttgactattcattagtaagtatactatcgaatggtttattttggaataaagaattgttcgcactgattgcagaacataaggagcagacagttgtacaaatcgatttacacggagataatgatgattatataaattggtttatgggaacacaaatacccaatattactcaccgtgttaaagacacaattatgagaattaataattcaggaatactgatgagagttgttacaatggtaacaccgcaaaacattgaccaaattgaaaatattgcaggatgggtaaaagaagcaggtatcgaaacttatggtatatcagcaattactcctatgggaagagctgatttagaggataaaaataatttgcttttaaagacattagaacaacatgaaagggttggtaaagtaatagaaaacattaatacccgatatggaaaagggtttttatataaaattaaagacggaaatagcaacgcaaagaattgtggagcatttacatcgaatccttcaataacgccagagggagaaatcaaattttgtgcaatggataaccagacagtgattaaatctttgggaaatgtatttaaagaggatatcggacagttgttttcaaataattatcaattaatgaatatgattcgtggtatacaagctccagattatacaagtaaagaatgctcagggtgtgaaaaaaagtacttttgtagttattgcataatacgtgggttagtagctgctaaagaaaaaggctttgaaaattgtgcatggtattcccaatatataccaaatgagtttaggaggctgttaatataatgacaaatattatttctatttacaatctttcaaaagcgtttgatggtaagaaattatttcaaaattttaattttactgtcaagaaaaattctgtccatgccttgataggagcaaatggagcaggaaaaactacactattgcgtttactcaccggattatacgaaccagatgaaggaaaaatatctgtatcgggtaaacatgcaatgttgcttgagaatgattatttatatgaggataaaacaggtttggagaacttgaaaatctttgggttgtattttggatactacgtaaaggactataagaaatatagtgattcattaaatattacagaacatttattgaaacgtgttagtacgtattcaaaaggaatgaaaagaaaattgtcaattctaatcgttatactaatcaacagtgagattatttaccttgatgagccaacatcaggggtagatccgttgtctcgtgttgaaataagaaagattatccagaaactaaaggaagaaggaaaaacaatattgattacatctcatgatttaagtgaaattgagaaaagtgcagattatgtcactatgattgaaaatggtaaggttgttttcaatgaggatatagataacataaaagggacaacactggaagagttatttataaaagaaggtggagattatgaataatattaaaaaagctgttttttatattatatttaagagtaaatctacaatttttaatatgttaggagtaggagtgcttgggacactgatgttggttgtatttcaacaggatcaattttattcaaaaggaacagattatcttattttagttttttttgtagttcttttaggatgtactcttcttcaggcaaattctataataatagatttgacagtgaaagataaaatgagtaaacggatggagttttttttagcatcagggattgatttaaagtttattattaaggcctacacaatacaaattttaaaagcatcaattataattccttttattatatttgtattaggttattatctcatagattttaaaatttcattttttggtattatagccttttttatatcgacagtaataatgagttacactgaagttctatttttcaatacaattacattttctgtagaaaaatataagttatttaaaaatatggtcttttttggaaatttttttctgatttatattagtgctatgtgtgcgaatgaaattgttgaatttgtatcaggtttaaatattagtatgtatatttttattattattctgaatataattggtgcgacaattttagctgttatttctttcagaaagatttctaaattagacaatgaaagtgttgtaaggagtgttggacaatggatttgactattattaggattcatgtgaaaaaaattttaacaggtaattttgtttttatgagtctagtagcaattatttttggtatattaaccttatttagtaaagggcaggaaaaaataattggctcatatacttatattgatatgctttggaaggggtatatttttttatatattatatttgcctgtgaattaagtaaagatttactacaaatggaaaaaatcacaagaagaatagagtggttgattgcaaatgggactaggcttcaatctatccttattaatcatacagtttctttgtggatatcaactctcttacttcttatgccactgttaggtattactatatacaaaataggatcacctgatgttgcccaaatacttgatttctttacatttaccttattaagcagtataattattaatgcagttattttggttataagagatatgaataaatataagggaatttctttgcgtatatcagtattttatttttttattttaattattgagagtatgttttattcctggagcaataattttattttaactgttataataaagtatgtaataagtttgtgtgttagtgtatttgttctgcgaatggccactaaagagagaattgtaatggcatactactagatacggtaaatgatgtttcagtgatgtgggtgaaaaagagtatgaagagtaagtacagcatatatattctgctccatatagctataattgttatgtggagttttttttataaatttaatttgattacaaatgatgctgtagagataaatgcattatctatgatattgttagtttgttttattagtgcattatatgtatatattatgacatcacaaaaaaaaacagatatagtggatagtattgattatacagttcctatattattctgtagttccatgatacatagaacaggtattataatttttgaaatcgcatttgtattatttttattgtataaggcaaggaatttattagccaggaaaagatataaggaagaaataactgttcttatttcttattttttgggattgcttttttacattaatcggtttgtccttttttcttcgtttatgatagtattgggcatggcggtagatatttttgttaagtataaatggataaatttcaaatatgtacatatacttccgacttctgcaaagaagtcaaaatatattttaaccttatggataccactagtagtatatatatcttatatttttgattgggattcattttgccttaatatgattttccaggtttttatgctattgtttgaaatattaactatgatacatatagaggataggcaagaattttatagagaaataagttccttttttttcttaacaaagtatataaatactgaaagagagaatttttcaagaatacttcacgatgatattgtccaggatatcagagcatcttacaatttattagcattagaacaaccggatattgtgctatcgaaaaaggttttattaaatctggaagatcgtgcaaggaaaatgatgaatttttattcggcaaatatttttctggaatatggtgcctatattaatttagaaaatatgttaaattctatacaagccatatatccaaataagaaagttcaattaaaaattgatataaatgaaaaagcagaaaaatatctaaaaaataaagtgcatttagaaatgctgttacagattagtaaggaattgattaacaatatttttaagcattccaatgcgacttatatcaaatacgaaataaaattggacgaaaatatggtgttaataattaactgcaagagtgatggggcgagtgcaatagattatgaaaatattttcaagtctaaaggtggtgtgctacttttgagggtgcttgtagaggcaaacaatgggaaattgacatataattattcaaatggcattttatggtctagtgtcgagctggaggtagattagtgaaaattttactatttgatgatcatagattatttggagagagtttaaagaaattactgatagagagtcaatttgtatcactttgctactatgttgaaagggagaatgattttttccgtacgtttcgagaaaaagaatttgatattattctattggacataaatttaaagaatagttctgaaaagaatggatttgaaatattggcagatatattatcaattaatccagattcaaaagtagttatactttcttcgtatgatatgcctatatacaaaaagatggcatttgacaaaggagctgcggattttataaataagtctgtttctatggaggaattagtagaaagattaaagagagttctttgtaataaaacatattataataaaattccagatattgaggtattaacagagagggaaattgaaatattacgagcaatttgtaagggggatataaagaagaaaatagcaaagaatctttttataagtgaacgtacattatataaccatattcaaaatatttatgataaacttgaagtatctaatacagttgaagcttataacaaagcaataaagctaggatatattgagccattaatgtaatctgttccgaatttaagtattttttactttttttgatagaattgtaggcagataattaactataaatgagcaagttcgtgattttgcataaaagagagacaccttgattccgtgtgttgtataatgaaagtacctaaacaaacatttgcaacatttacgaaagaaggtgtctctcgcaaatactatacatcattctacattcatatacaaccagcttaagaaattaaacttatacaaattttattccaatcgagtgataaatcatcttatgagcattctgatcagcatatttcttttaggataccatgggaaaaccacggactttgctaaaaacagttcctgtcacaggactacgatcgcacatttccttaattcaggaaaatgggatgattcctcactttcagatacgttaaaacgttctgttatagagattatttattcagaagcagctcgcaccggaaagccttttttctgtattgtagatgatacgacagcttcaaaaacaaagccttcgtcacaggctctgcatccaattgaagacgcgtactttcaccaatcccatttaaaggggaaacaggattacggacaccaggcagttgctgttatgctttcctgctggtatacttctgaaaaaataatcaacactttcgcagccggaggatttcataccataggtgcactgaaaacaaaccggatgctttatccatttggattcaaaaagaaacttaatgagtttgctgcttttttaacgtccacacgttccaattttcgccttgtgacagtgaaaaaacaaaaatattacgtgtatcgttatgagggaaaactcaacggtattgaaaatgccgtagttcttttaagttatccggaaaaagcatttggaaatccaaaagcactgcgtgcttttctcagtacagacgtttcattatcattggacgaaacactgtcttattatgtctgccggtgaccgatagaggtattttttcgccagtgtaagaataaactggcactggacagctatcagatacgttctgcacagggagtccgaagatactggcttcttatgtcaatggcacattttatgtgtgtgacagggactggtgaattctgttcttttgaaaaaggctaccaccggattggaagcattattcagacagaaaagtatcagtatctcttccaacttgcaaaaggaagtaatgattttaaggcatttatgaagttagcaggataattttgtgcaatttttcaaatttgctcatttatagtatatttcttaacttcctgtaaaattaactctcgttccaaataaatggcttatttatgcggtttgtgcgtgttatatcgttaacgacacgagaattaattaactctcgagagttaacttataaaacagtcacaaatccattattataaggttctcgtacagtcgagagttaattcatcaggaagttaacaatattatacacaggatctgttaatgtacatatcaggataactgcttctggatttaagctcgagatgttcatggaaagtttgtattaagagggcctctgaaaatgaggtcctcgatatttttatcagagtattataattgaaaaatagtaacgaatttatgaagtatctctgattgtgcagattatgtaccagaagtttgggctgggattactgcttgcaagaaagggaaaagactggtatcggataggattagtattaaagaaaagttcttttattcgataaagttttctacggacagaggatatgcgacgagccttggtatgaatatatatctatggaaagaggatattgaagacggagcgtcggtgatgacagtcgaatacagacctgtagaatatggaaaggattatgatgttgtcaataatcctgatatatttgaactctatatagatggaaaagaagtaaaagaatagcagggtgaacttttaacaccgaaatatgtacgatttctgttatgacatgaacttatgggaacgtattgcggatactttgtgaactttatcctgatacaatgattatgctgatgaaagagggcatagataactgaatacaagaaagagacagaagcctcagtagttaagaaaaactactggggctttttttcgtgcctgaatttatcagccaataactgcggatgtgtcccggcaggatgaaggcggagcaggcatgatcctaaacaaaggtcctccttccgaatttgaaacgagcaacaagatttcaaattcaggaggaacggatatgtatattgaacacccatatttttacgaaggaaagtattacgcaaatattgatggagaaatgatcgagattacaaaagaagttgcgtatgcgatgaataatttttacagaagcagcaaggcaaaaaaagttgagattaagaatgaactgggtgaggttgtggataagatgctgagagaagtaccttacagcggtcagtccattgatggagaaggcttcatgattgaggattttccagatctgaactgtgatgtggagcactgtgtactgacaaaaatggaacagcaggatattcacacagtgatcaatcaactgaacttagaggaacgcatgattatttatggtattttctttgaaaacaagacacagacacagatggcggagattatggggatttccagacagatgctgtcatacaagttaaaatccactcttaataagatgcgtgaaatgtatatgaataaatttttttaaaaaatttttcaaaatcttttgcatctgccaaagtcatttgactttagtaattagaggaagttaaaggacttcctaaaatgaaccatgataactgaatatccaataataactgacgtgacatttcatgcaaagagcacgaggaagatgccgctataggattataagacaaaacaaagatttttagttcagtccgtaatgctgcgaaaaagcactgaccgaagccagctggcaggctggtgatgcgatgatatgtatgagatgcgatacacttgcagatcctgagaagtctgtaactggtaaacctatgaactgctggagcctggaaacgagagtttccgggttgtggtccggagtatgcatccgggcaggttattattcccttcctgcatatgcgggagtaacgattcggggtatcgaggataaatagaatcgagcgagcactgtttaataatcaaattggctatagaggttatgcggcagagctttccgtcttggaaaggaactctgccgtattcctgtggagctaatatagcgctatgaatgctttacaaataaaaaaggattggagagatgacaagtgacgattcgaagaggagatatcttatgggcggatctcggtatgttcccgacaacttcggttcagggtggagtaagaccggtgatcgtagtaagtaacaacaaagctaatacatacagttcagtcattacagtagttccgctgacgtcaagaatatataagaagcggtatttgccaacacatgtatttatcagtaaatatgacatgacagggatccgaaaaggaagcctagccttggccgaacaggttatgagcatttctacaaaatgtattattgagaaatgcggaagagtaaataagtggagcctggatcgggtactgaaagcagtacggattcagatgggaatggaaggagaagggcatgacggcagaggaatatagaaactatctggagcaggatttcagtgatgtagatatcaatgaaatgactgacctacggatgataaaagcagacagaaataaatcgcttcaggaacggagagatatttttctgaataaagtaggaaatccatatttggtccggatcggtaatatgaaagtaaaagtcagatttgctaataacggtatatctatggagcaggcatttgagaatatgcttctgagtgtctgaaaaagtactggcaagattgaggggactgtgttagaatgtcggtaaggacaaattatgcagcccccttttattacatggattttctgacgtaataaaaggaggtaagatatgtatcagaatatcaataaaatctatcatgccgccatctatgtcagattatctaaagaagatggcgatatttccagttcagcaaaactggaaagtaatagcatttctaaccagaaagctttgattctggatttcctgaaagacaaaaaagatattgaagttgtttcagtccgagttgatgatggatactcaggctctaattttgagcgcccagcattccaggcaatgctggaagatatccggcgtgggattgtagactgcatagtggtaaaagacttatcacgatttggaagggaatatattgattccgggaagtatatcgagagattattcccggctcttggtgtgcgcttcattgccatcaatgacaattatgacagtctcaagggaaagaatcaggcagacgaaatcattatcccatttaagaatttaatcaatgatgcttattgccgtgacatttctattaagatcaggagtaatcttgagattaagaggaaaaaaggcgaatgcgtgactccgtttgtagcttttggatacaggaagacaaagacagataagcataaattagagattgatccatctgcaggcagtgtagtacaggatatttttaagatgaagctgcagggaatgagtcaggatgcgatcgctaatcgtttaaatgaactgggtattctttccccatttgagtataaaatcagcagtggcagtcattatgaaactggcttccgacagaaagaacaggcactttggagttctgttacagtccgcagaatactggaaaacgaggtttatatcggaaaccttgtgcagggaaaaaggacaacaccgaaccataaagtgaagcagacttatgtgaaaccggaagatgactggatccggattgagaaaaatcatgagccactggtgagtgaccgtgattttgaaattgttcagagacttctgggcatggatacacgtacttcacctgaccaaaagcaggtatatctgttatccggaattgctgtatgtgcggattgtggtgcacctatgacaagaaaggtttccactgtggcagggaaaaaatatgcttattatctatgttccacaaataaagaaacaaaacgctgttccagtcatagaataccggaaaaggatctggaagatgccgtactggtgatgctgaaacagcatatccagaatatcctgcacctgaaaagagtcctggaatttgttggtactgtgccatttcaggagatcaatatgaagaagctgcaggacaggctggagaagaaaaaacaggagacagaacgctgtaaggagttacggatgatgctctattcggatatgaaagagggcattgtatcaaaagaagactatgtagagcttcatgcagcctatggaaagaggcttaaaaatgcggaagagagtatccgtgcgatccagaaagaaatggatagtgagctggaaaaagcagacaatgccaatacctggctggattattttgtgaaatatcaagatattgaagaactgtcccgcactgtggtggtagaactgatcaggcaaatccgagtatatgataaaaagaatatagagatcacttttgattttgatgattgttatcagacattgctgagtcaattaccggctatgggagttgatacggtaatagatgatgataataatctgcaggtcaaggtaaaggaggttgtataaaatggcacgaaagagcaggaaaaacattccggaagtagtcagcagtgcaaccgtccagacagagatgagcagaccattccgggcaggattgtatgccagaatttcaatggaaacagaagaaacactagaaagaggaacgatagaaacccaggtggaattgatgaaaaactttgtagcagatacggaagatatttcggttgcgaaagtttataaggactcagactattcaggtacaaattttgaccgtcctggattcgtacagatgatggaagatatcaagcatggaaaaatcaattgtgttattgtaaaagatttgtccagacttggcagaaattatgtcgaaaccagcaattatattgaacgagtattcccgtttttccatgtaagattcctggctgtgacagatgatttcgattctttcagagaaggtgtggatcttacagttccactgaagaatatcatcaatgaattctattcgaaagaccttgccaagaagagtagcagcgcaaaaaaagcactttggaaagagggaaaatttacaagtgcctgggaaccgtatggttacagaaagtcagaagaagaccatcatcagctgattgttgatgatgaagctgcagaacatctgaaaagtatattttctatgtatatggatggcaggaattatagtgatattgcaagacagctcaataaagatggagttttatcgccgactttacagagaaaattctataaaaccggtgaaaagccgcttccggagtctaaaccctggaataattatgaagtgaagcgagtacttcaggatgttcattgcacaggtgattctgtatttggaaaatatcagcaaagtgttttccaggaaaataaacagagaaatcgaccagagagtgaatgggtgcatgtggagaacacgcatgaagggattatagatagagagttgtttcaacaggtacaatctaaaattcaggaatatacggaagcttataagaagaaacatcagcagaacaatggggctattcgaaatcataatttctatacaggaaaaatatggtgcggaggctgtggcaaccgcatgacgttgtccagagaaagaaatggcacattcttttatatctgcggagccaatactaaccataaatccggaggaaagcaatgcaaagggcacagagtcagaaaagaatatgtggatgacgatgttcttcgcctgatccaaacgcatatgaaaaccgtattggatacagaaaaaatgattcaggaaatgaatgcagcttccaaaaatcagacacagtacctgcttttggataaagaggtggggaaactccgacgggaactaagccgaatcagtaagcgtaagtcggatttatatgaagattactcggaacgtttgattacagaagaagagtacatacagttttctcggatctattccaatgaaattgagaatatcaagagccgtctggacacagtattggcggcaaaggttcggtattcccaggattaccacattgaagaaggctggggaaatgtgatacatacttatatgtcaaagcgtaagctgacaaaagaaatggcagatgcctttgtggattcaattattatccatggtaagtatgattatgagatcaagctggtatatgacgatcagtttgcagatttacagaaattaaagaaagagaaggaggcgcagtcaagatgacagatcatagaaaaacagctgtttacatccgtttatccgcagaagatgacaatgtagatggcagagccaaaaaagagagcgacagtgtaacttctcagagaattctgttaaaatcatttgtgattgatcagttgggtgttgctgaggcagatatcctggaatatgtggatgacggtgtcagcggtactcattttaaaaggcagggatttcaacagctgcaggatgacatgaaaagtggagaaatcggctgtgtagttgtaaaagatttttccagattcggaagagactatctggaagttggattttatattgaatatattttcccacttctacagattcgatttatttcgattaatgacagctatgacagtgcagcaagcagcggaatgactggtggaatgaatgtagcattgcagaatctggtatacaatatgtatagcctggatttgtccaagaaaatttcatcagcattacagacaagaacgagaaatggtacacgccttccagtaaatgccagatatggctataaaaaaggaaaagacggaagactggaagttgatccggaggctgcaaaagtcgtgaaaatgatttttcggatggcagcggaaggaacaagttttgcagatattacaagggaattgaacagacaggcgattgccacttgtgatgagcagaaattatcaagaggggatcaggtgcagttccagaggtttgacacgatcaaaaagaaacattggagccctacgacagtagcggcaattgtccgggatgagatttatattggaaccagaatctggggaaaaacacgttgcagtatgcataccggtcataaagcagttctgaatgatgaaacagaatggattcgcctggaaaatcatcatacggcaattatagacagggcattgtttgaaaaagcaaatgaaatgcatccgaaaaagaagagaagtgttgcggaatcacgcaccaattttactctggaaaggcgtaaaaaacagccggcattactgatatgtgccaactgtgggcattctttactaaaagaaacggagcatctgctaaaatgctcagatgctcgaaccaatggagatcctgtgtgtcgaagtctggtgatccgacgggaaccgctggaggagaatatccttgggcttgtccatcagtatgcagcgtcaatgttggaaaaagaaaagaaagtatcttccaacaggcaatgcgacgacaaagagatcaataccgcagaattgcaaaaacaaagccgacagttgacctcggaaaagatgaaactctatgatgcttacaaagatggtcgtatagatcgtgattcgtataagcagagagctggaaagataagtgtacagctggaggaaataaaacgaaagatagaagatgcggagaatagtaaaaagcttcttgaacaaaatgaactttctgataaaataaaactaaaagatttcttgggaattcagaagttcgatacagagaagttgcgtgagattatcaaggtgatccgtgttcatagtcaggatgaaattgaaatcgaatggaattttgacgatattttttcggaacagaggtaacttgagcaggacaagaaggacttatcagaagataataaaggtgctgggactacctgatggaagcgtcagatagtcttcggcagaaaaaaataaaattttttttgtcctatacttgacacatccacatgtatgccgacatacctattgctcgaatatggcgaaatcgggaatgaatcctaagacactacagtacctcatggggcattcggatatatcggtcacaatgaatgtgtacacgcatatcggattcgatgatgctgaggaagaattgaagcggatagaagagtttaggaaggcacaggcggaggttgagcagacgaaggagaaaccgatgtcgcagaagatgtttaaggtagtttaatatggaaaagggatgacgctccagcttggctggggcgttttttctatggtgaaaaatggagattgttgatataatatgtataagtaaagtctttttatagatataatgaaagttggaaatggttaatcgaattggagggcactatgggaaagcttaagcattttgtctgcagtaatgcaataaaagaaaaatcaaaaggactgttggaaaatttaactgttgctttagttagtggtgatattactgtaattggtaagctgttgaaagatgtaatgggatctccatattttataagggaggagattttttggcaaagttttattgagtatcttgataatgcatgtgatgatgagcacgatttgagaaagttatctgagatgttagcagaagatggaaattctaatgaaaatgcaaaaagactgttaaagataattgatgacatcggaacgcaaaggaaagcaatatatttatcaaatctgacgagagcatgttgccaacatttgattgataagaataaattctttaaattgtcccagtgtattgttaggttgacagatgaagatttaatttttttatgcgacaatattgataaaaagaaaatttcaacagatgaagagtatattgatgattttagaaattgcggcttgatgaaagaagtagagggaggttttgtatatactaaaagagcgtttgaattaaaaaagtactcgttgtggtatggacatgatgttgaaattccggaaataccagaaaggcaaattattgctatagcgaatactgaagatatagagaagctgtttgaagaaaagacttcatagggaacattttaattataaagaaggtgtgttatgaataaaagaaaacttgattcattactatgggaaaatattcccattgacaattttattgttagtgaacattcagatataaatcaagaaaatcttgatgatgtgttttgggatgatgtagatgaattacgtgtaactagagatgataattacaatatcagtctttcatgtgtaagatatttgaatcaatataaagaaaaaaagcaaagacctacggtaaataaacgagaatttacacctggtgagacgatacccagaggtaagttagaaataaaaatatttgatgattatacggttacttttgaacctatgtattgtgatggatatgtaagtaaattggacaaaacaaattataaactatcttgttatcgtgttgaaggaaaaaactcgaaaacatcatctgtgattaaggaatggatattgaatggtagccaaagcggtttgtatttttgtggaaattcaaaatttgaatataaggtagaaggttctgtttcgggagtttacggagatttagagttccctttaaaacaagaattggaagaacaagaatatataggaaaatttatacacttgagatataaagatacagcatttgatattcattatgttggaaacaattatggaccatcgtggagtaccaatttgagcatttcttattttgaaaagtatgggagaattccaagtatagaagagaggaaacaaattagagagtatctgagtttttttattggaaaaagattgatgtatataggtgagtcttcatttgatgaaaatggcaatcaaataggttttgttatggagaatcccaaaacatatggttttgatataaaaaaagaatgcatgtttggcgcaaaggcacctattagaaatgctacatcagttcttcaaaattactttgatacaattcaaaaatatatagatccattttcggaattatatgtaaaacttgattttgattctctattttcatcatattggtatgctcaaaaagttaatcagcctatggacttacctatactttcagcagctttggaaaatttgaaaagaaagtggtatgaagaagttgcacttaatccagagactgtgctaatggacaaaaaagatttttctaagagaataaaacagataaaagcattagtggaaacacagtttgctggaacagaatatgttgaaagaatgaagagaagtgttgaaggtatgaatcgtatgtcggtgagtgaacaattaacacatttctttgaaggaatagacatggtcattgggaaaaaagagaagaaagcattgcaagcacgtaatttttcggcacatgggtcgtttacgggagataatattgattatgaagaacagtttatgataagccaggtatatcaatgtatattggttagagtaatattaaaattgctaaaatatgatggtaattatattgattatgggactattggctatccagaaaagaacataaactgtccaagtgggaatgaaaatccttagtagtaagcttttccgttttactaccaattttactactaacagaccgcaataacttgctccatcttgccctattttgccaagatgccagctaaaacacacattttacaaattctcagaatcccttgcaaacaagggcattccggggcaattcaaggagaaataaaattatgataaaaatacttttcatctgccatggaaatatctgccgaagcactatggcagaaagcgttatgacatatttagttgagaaagagggacttgctgataagttctatattaattcagcggcgacaagccgcgaggagattggtaatggggtgcatcatggcactgttgccaagttgaagaaagaaggaattccggtgattcctcacagggcagtgcagatgactctgaatgattatgaggaatatgattaccttattggaatggatactgagaatatccgcaatatgcagaggatatcgggtggagatccggatgagaagatatataagctgcttacttttgcgggaaacggacttgatgtggcagatccatggtatacgggagattttgaggcaacttacagggatgttctggcaggctgcaaaggactgcttgaatgccttaaggaagaattgtagccagccactacccacctaccacggcagaatatacatattcctctggtaagaaccaaatacagtggcagttgccttaagctctgcaccgagacggcggaaagacgaattgctggcgacgttgtcagggtgggctacggcgaggattgtgtcgatgccgcggttgcgggcaattgaacagaggcgcttgttaagctcacacataaggttgtgaccgcggaagtcagggtgaaccatgcatcgtccgacttcagctacatttgtagaacgaatgtcgagaccgagcttttcagcttcctcagcaaattcatgttcattaaagaaaagggcgctggcggcaacaagttcattatcgtcattaaatgcacctaagaagcatgtccagtcagcatcaaagaaatgtgagcgttcaatatcatcaataggaatccaccattccggaacagggagagcattttctatagtatatataagctgttcgagagcagctttatcatttttatctaatacacggatattcatagcaatctcctatacacttaaattcagaattaccttaatatatataagctataatcctaatccaccacattataatatgtatgtatcttaaaatcaaaatatttttaaattcgcgggcagaatattaagcaggcacaaattaatgccgatatacatttacaagacatattgcttcttgaatatttataaaaatatatatttagatagattttttttatttagggcttttaaatttccttttttatgtatataatggtgattagccatgggtacacatggcttctaatgacttttgattttatgttttatctgaatatatcggacagacagaggtccgcattgttttataagaaaggggaattatcatgttatcaacagatattggtatagatttaggtactgcaagtattcttgtgtacatcagaggcaaaggtgttgttcttaaagagccttcagttgttgcatttgacagggatactaataagattaaggctatcggtgaggaagcaagactgatgcttggtagaacaccaggtaacatcgttgctgtaagacctcttcgtcagggtgttatctctgattacactgtaactgagaagatgcttaagtactttatccagaaggctatcggcaagagaatgcttaagaagcctagaatcagtgtgtgcgtaccttcaggtgttactgaggttgagaagaaggcggttgaggatgctactcttcaggcaggcgcaagagaggttgctattattgaagagcctatcgcagcagctatcggtgcaggtattgatatttcaagaccatgtggtaatatgattgttgatatcggtggtggtacaactgatatcgctgttatctctttaggaggaactgttgtaagtacttctattaagattgccggagatgattttgatgaagctatcgtaagatacatgagaaagaagcataatcttcttattggtgaaagaaccgcagaagatattaagattaaggttggttctgcttatcctaaggcagaagtcacaactatgaatgtacgaggaagaaaccttgtaacaggtcttcctaagactgtagaggtaagctcagaggagacagaggaagctttaagagaggcaacttcacagattgttgaagctgttcacagcgttcttgagaagactccaccagaacttgcatctgatattgcagacagaggaatcgtccttacaggaggcggaagtcttctttcaggacttgaggatttaattgaagccaagacaggaattaatactatgacagccgaagatccaatgacatgtgttgctattggtacaggtaagtttattgagttccttgcaggctacagagacgaagttaagtaacctgaaacatttttaataagattattactaatgtttcttaacattctggcagaatggacaatttttatgccggaagaatatattatcaagaaagaggcgggctatggtaaaagggctttatacagcgtactctggtttgacagttcagcagaagagactggatgtagtgtctaataatctggctaatgcaactaccacaggttataagaaagaaggccttacgacacagtcgtttaaagatgtttatggcatcaaagttaaagatgaaactgtgggctatattaatcagaatatcggaactctgaatcttggagcaaaagtaggagaatccttcagaagctgggatcagggctctttccagaacacaggcaatacatttgactttgcgctgagtggaagtggattgttttcgatttctttcactaacaaagctggagaaacttcaacgctttataccagggacggatctttccagatgaaccgtgaaggttatctggtaaccaaggatggtgattttgtattgggcgagaatggtccgatacagttacctacagactttgaaaaactgactgtagaagagaatggcgaaatatatgctgacggacagtatgtagacagatttgctcttgtagattttgagaattatgactatgttgaggcatatggcgagaatctttacagagctgtagatggcgcaacacagacagatgctgcagcaacagttaatcagggatatttggaggcttccaatattaatgtggtaacagagatggtagatatgatatctattgcaagagattttgaaagtaatcagaaaattatgaatactatcgatgagatgttaggaaagatggtatctatatctgagatttagtaacaactgttaggcatatacatatggaggactgacgacatgatgagatcattgtggactgctgcatcaggaatgatgagccagcagacaagtgtagatactattgccaacaatctggcaaatgttaatacagtaggatataagcaggaacagactcagtttaagtctctgctttaccagaatcttcaggcgaagactacttctgccaacggagagaataaacctgttggagcacaggtaggacttggttcaagagtttcagcagtaacatcaatatatacacagggtgcattaaatgcaactgacagtacaacagattttgcaattaatggagatggttttttcgcagtaagaaatactaatactgacgagactgtgtatacaagaaatggacattttacatgggcaacagctacagaaggtgtaatgcttagtacttctgaaggatatcctgtactcagcgcagatggcgcagagatagttcttggacaggacgctaatggtaaagattataagactaatcttattactattgatacagacggcaaccttttatatcctgacgagtctaacaatccggcaccaatcggtattaagattggcttatatcagttttctaatcctgcaggactggataagattggtggaagctacctttcagagactgaggcgtcaggagttgcacttaacgaagcgtacgatgaagttggaaagaagagcttattaagacagtcatatcttgaatcatctaatgttcaggttgcaactgagatggttaatcttattacagcacagagagcgtatgaattatgttctaaggctataacaacatctgatacaatgatggagcaggctaataaccttaagagataagcggggtgtagtgtatgagcgattctattacggggcttagcagtaagaattattcagatgtgtatgattctaaagcgggttctttaactaataaacttacagatactgattattctaaggcatcagacgatgaacttatgtctgtatgcaaggattttgaaagttattttgttgaacaggttcttaagtcaatggagaagatggctaagattgattcagaagacgaggatagcaatctttttacttctatggctggaattggtggaacagaggatacttcacttaatactttgggaagttactttggagatgagatggtgtcatcttatgccaagcttatgactgattctaatcatggcaaaggacttggaatagcacagacgctttatgagcagatgaagagaaattattctacagagtctattcctaaggcagatgagcaggaataatatttaacataaaggagataacagattggattacgagtctgtgaaatatgtagagggctttgtggagaatattatcttcaggaatgaagacaatggatatacggtttttaatattgtatatgatgatgaagaaatcacctgtgttggagtgttaagctatatcaacacaggtgaatttattaccgcacaaggcgaatttgttaagcatgcagtttactacatgcagtttaaagtcacatcttatgagttcagggcgccggatgatgctgcatccgtaaggcgttatctaagctccggggcaatcaagggtatcggcgagaagatggctgaacgaatagttaagacatttggcgatgatacattcaggattatggaagaagaaccggagcgtctggctgagattaaaggaataagcatgtctaaagctatggatatagcgaatcagcttattgacaagaaagacatcagaaaagcaatgatgtttcttcagcgttatggaatccagatgaatcttgccaacaaaatatttaagcgttatggaaacgacatttataacattcttgaacagaatccgtacaggcttgctgatgacatagagggtgtcggttttaggacggctgatgagattgcttcgcgtgccggaatcaagattgattctgaattcaggattaagagcggaatattttatgtgcttaaccaggcgacaatgcagggacacacatatcttccgtatgataagcttgtgcgtcaggtcaacgaactgcttttgattgatgtccaggactatgacaaatatcttatggacctgacaatggataagaagatagttgtcaaggttaaggacaatgtaaaatgtgtctatgcccgtatgtattacaacatggaagcaaatgttgcagctatgcttaataatcttgatgtccagattgaggaagaccagaaattcatagatgacaggattgcaaggattgaggataaagaaggaataactcttgatgatatccagaaagaggctgttgcgaaagcagtaagaaacgggcttgttattgttactggcggtccgggaaccggtaagactacaactattaatacaataatcaaatattttgagctggaaggtctggaaatcaggctggcagcgcctacgggacgtgcagccaagagaatgactgaggcgtgcggttatgaagcacagactatccacagaatgttagagataagcggcggcgtgccggatggtgacagaaagtcggcagcaggtctgtctatgttctttgagagaaatgaagataatccgcttgaggctgatgttattattgttgatgagatgtcgatggtagacataagcattatgaattcacttcttaaagctgtttcgattggaacgaaactgattcttgtaggtgatgtggatcagcttccaagtgtaggtccgggaaatgtacttaaagacattatagaatccggatgttttccggttgttaagctggagaggatattcagacaggcggcacagagcgagattattattaatgcccataagataaacaggggtgaggaggtagtacttaacaagtacagcaaggattttctctttgttcacagaaacggtgcagacaatataataaatgcgatgaaaacgcttattaaggacaaacttccggactatgtaggtgccgatgtgtatgaccttcagattcttactccatcgcgaaaatccaatgtcggggtggaacgtcttaataagattatgcaggattttcttaatccggctgatgctatcaagcaggaaagacaggtcggtgatgttactttccgtgaaggtgataaggttatgcagattaagaatgattatcagcttgcatgggaaaaacgaagcagatacggtattccaacagaacagggaacgggcgcttttaacggggataccggagttatagagagaataagcacatttgatgagaatgtaactgtgaaattcgaagatggcagattcgttacttatgaattctcacagcttgatgagcttgaacttgcgtatgcgattacggttcacaaatcacagggaagtgagtacccggcggttattattccgatgtcgcagggaccaagaatgctgatgaacaggaatattctgtatacggcagttacaagagcaagaaaatgtgtgtgcctcgttggggaagaggagatattcaggcttatggctgacaatgtatcagagtcaaaacgatattcttcactcacagacaggattgaagaaatcagacatattgaagatttcggacaatgataattgatatgtttatatgtgataatgatgataataatgggggattatggattataagaaggtattaatggaggcagttaatgcggtacttccgccagcgtgtcctatgtgtggaaagccggcaccttttgttggagggataagggcagatatatgtggaagctgcatgcataatataaattatgtaagcgagcctgcctgtttaaaatgtggtaagccagtgaaagatgaagaaacagaatactgtagtgactgcagcaggcagaagcatgtatatgaccaggcatgtgcgttgtatgaatattctaagaatgtcaaggaatcaatatacagatttaaatattataacaagcaggaatatgcaggaatatatgcgaagcagatggcggacagatgtggcaggatgatacgcatgtggtcgccggatgtgataattcctgttccgattcatatttcaaaatataaggagcgtgggtttaaccaggctgggcttattgcgcaggcacttggaagagccatgcagattccggtagatgaggaatatctcgtgaggattgttaagactcagcccatgaaggagctaagtaatcgggaaagaattaaaaatctgcaaaatgcttttcaagtaagagaaaaagttgtaagatatagaaaagtattaatcgtggacgacatatatacaacaggagcaacatttgatgcatgtgcagcagtacttaaagacgcaggagtgtcgcaggtatatggtataagtctgtgtgtgggagacggattttaaagtatgagctgctttagtaactggacctgttaacgagattgataaagaggattaacaaggagaagctatggaagttaagaattgtaagaactgtggaagattatataattatataggtggtgtgtacagactttgtcctgaatgcatgagaaagcttgaagaaaagtttcaggaggttaaagattatatagaggataatccaagggctgatatgagagaaatatctgagaattgcgatgtcagtacaagacagattgaacagtggataagagaagaaagattatcgttcagtgatgattcacctattggtattgcatgcgaagtatgcggagctaccataagaaccggaagatactgtgagagatgtaagaacgatttagctaacagactgggaagcatgtatggaagcagatcttcaacagttgatgctgataagataagagagagaagagaaaaggcaaggatgagatttcttgataaataataagcttttttcaaaacgggtataaagtatttgcggaaactgtccgatatcttacacatgaagcaagagagtatctgctttaattaatggaaagtgaggcggttaatatgcgcatagatgcttataatgctgttaatcagatatatcagaccagccagatttctaaagctaagacagcagctaagacatcatcggttagtgacaagtttgagatttctgacacagccaagacatatcagacagccaggacagcagtaagtaaggcttctgatgttcgagaagacaagattgctgatattaaggcacgtatggcagcaggaacttacaacatcagttcagaagctgttgcagataagattctgaacaacatttcaacattaacattttagtggggttttattagatggcaagtttgatagattctttgattaatataatgaatgatgagaacagacagtatactgagcttttggacttgtctaataataagactactgctattgttaagggagatgtcggacagcttcaggagatatttggtaaggagcagaagcttattgatattcttaacagactggagatggagagacagtcatgtgttgcagatatatgtaagattctgcatctgtcagcagcagaggttaaggtgagtcagatagtaagactgttagaaaagaagcaggcagagcatgatgctttagaacagtcgtatctgagtcttaagaaaactgtaaaccagcttacgcaggttaatgataataacaggctgctgcttaaggaatcaatggatatgattgattttgagattaatcttgcgaagaatgcaagtatggctccacagacggctaactatggaaagggagcgtatgaggagacaggtggcatgggaagcacaagctttgatgccaggcagtaatattctgatggcatatcaggatgccacggatataagacaatatgaataatatcacggatgatttattgtgagatggggttgtccgtgttggattgaaagccacatttttactaaggaaatgtggcttttttagtctctggggtgttttgttttaaaaaaatgacgatatacatataagattatgaattaagtaagaaagaggtgaccttatggctaatggaatggcaggattgtttgttggagcaagcggtttgaaaacagctcagacagcgctcaacacaacagcacacaatctgtctaatattaacacaaccggatatacaagacagcaggttactttctctgatactacatatgtcaatgtcaacagcaaggacaaagtaagttatgcaagctatggacttggtgttgcaatatctgaggtaagaagaataagagatcagtatattgacctggcatacaggaatgaaaattcaagactcggattctatgaaagccagtataatgctgttcaggagatagaagatcagtttggtgagatgcagggtgtaacttatgagtcatatcttaccaatctgtatgattcaattaacgaacttgccaagaatccgacaagtacagttgcaaggtcatcacttatccagaatgcgactgcatttatagagaaatcagaaaatgtgtataaggggctcagggattaccagacaactcttaatacacaggttagtaatatggttaataagattaatgatcttgcaggtcagatatataagcttaataagagtattgccaaggtggaagcaccgggtattgagaaagctaatgatttaagagaccagagagatgcggcaatagatgaactcagcaaatatatagatattacttattatgaatcagagaataaggaaactattattaatgcagccggagttcctcttgtaacatcaggcgaacttacagctatgagtacaagagttgtcgagggaacaacacttgttattcctacatggccatcgtatgaaagagatgtttatgaagatggtaagctggcatctaatgctgatgatacagataagggacagcttaagggacttattattgcaagaggcaatatggttgtagattatacagtggttcctgttgcacctgacagcaatgattatgacatgagtactgaggaaggccgtacagcatatcagcaggcctataatgaatatgcaaagcagcaggaatactacaatacatatgtagagccttcagcaattcttagcgctatggcgggattcgataagcttgttaatggaattgttgaaagaatcaacgtaatcttgtgtccggagaaaactgagacaaggaataatcctcatcttaatgcagatggaagtgagattcaggcagatacatacatatataattcagttgataaggcggttctttatgacagatacggaagagaggttaccggaactgataacggtgatggtacttacagctatgcatctggtgagaaattatacgagagtgcaggcggagcagcggttccggttgattcatatgagtatcttatgcttgacatggacaagactggatacggtatggatgacgataagactgttggtacagaactgttttcaagaattggaacagacagatatattaagactacaggtgataatggagagacaatctatcttagaaacaatcttaacgagacagattatgaatcattatataagcttggcaatctgaagattaatcctgaagcagcacaaaatgtaggaaagattccactttctactgtacagggtaaggaagattttgacagagccaaggaactcgtggatatatgggatgagaaattcgcttcccttaacccggacatgtatgcgaagtcggattacatgtcattctacaataattatattggtgaatatgccactatgggtaaggcactttataattatgtaggtaaccagacaacgatggttgatggttatgataaccagagactacagtcagagggtgtatcctctgatgaagagttagagaagatgataaagtatcagcaggcatataatgcagcatcgagatatgtcaatgtagtaagcgaaatgctggaacatctcgttacttcacttggacgtatataaatgctgattaatacaggaggataatatggcatcaacattttttggattaacaattgcatatacaggattgcaggcggcgcagacctctataaatgttacatcacataatcttgctaatatcaataaccagtcatatacgaaagaaacagcatcaattaaggctggtgaggcattacgttcatatgctaaatatggaacacttggtgcaggagttatcgttgatgcaattaatcagatgagagattcttactatgatgagaagtacagaaataattatactaattatggacagtacaatgttaaggatacatacatgtcacagatacagaattatctcaatgagttcacacttaagggatattcaacagagtatgagaatttctttgcagcacttaaccagcttgatcttacaccggctgatacatcagcaaagaaccagcttatcaataatgcaaagagcatgacagattactttaatactctggctactaatttaaggaatgttcagatagacgctaataacgagattaaagatactgttaaccagattaattctctggcacagagcatttcttctcttaataagcagattaaccagattcaggctaattatggcaatgccaacgaccttaaggatgagagaaatgctttaattgatgatctttccaagctggttaatatatcagtaagtgagacagacattggcaacaatcttacagaccttcagattacaattaatggtaattcgcttgttaatggctataattaccatactcttcagactgtttcaagagatgagccaagaaatgtatcagatgcggcaggtctgtatgacatacagtgggagaccggacagccatttaacatatacagcacttcattaggcggagagttaaagggacttattgatataagagatggatgtaatggtgagattgaaaaatatgccacaacaactgacgatgatggcaatgaaacatacaagacagatgcagagggtaatatccttactgatacagtaagtaaggtggacagcaatactaattataagggagttccttattatcaggcacagcttaaccagtttatacagacatttgtatcatcaatcaatgagattcttacaaagggtgttacatcagatggctcggcaagcggaattccactttttgtaatgtcagatggaagcaaggctcttacagcgtcaagtgtaacagttaatcaggatcttattgataacgcggaccttcttgctaccaagtacaaggaaagcgatggagaagccaatacaagcctgattgtagaccttatcaattctaaagatgctaagatatatgacggaggtacgggaacatatttcctcgaaagtattgtcagtgatatgtcaatagatgcaagtaaggcaattaattttacaaagaattacaacaatcttaagacaactatacagaaccagagattatctgtaatgggtgttgatacagatgaagaagccatggatcttgtaaagttccagcaggcatataatttaagttcgaagatgatgactgtcatgaatcagttatatgacagacttattaataatacaggtgtataaaacagtaaaagaattcttctcctcaccataggggcggtttttgattcgcgatataaggaggcacaatatgcgtattactaaccagatgatggtaaacagctcaatatccaatattcagggaaataagagccagcttaatgatttaagtacacagctctcaacacagaaaaagattaataagccttctgatgaccctattatagccatcagggcattgagactgcgttcaagtcttgatgaggtaacacagtatcttggaaagaatattcctgatgcatcatcatggttaagtgtaactcatgatgcattagatgaaagcaacaagattatacaggatctgtataattactgtgtgcagggttctacggattcatattcagaagctgagcgtaatactcttgctgaaagtcttaacaagctggtggaagcttattatgagcagggaaatgttgattatgccggaagatatgtatttacaggacatgctacagataagcctctgacataccagtcagatgaaaccgctaaagatgttgattatacaattacacagaactttacaagggagaatttatctaataagacggcatacactaatgcatatactaatgatgatattattaatcttaatgtaaagacagatgctaacggcaatataatcacacctaatataacggatgtacacagaatccagctcgcatatgatgagattaacggaaaaaaattttcgatgagcatgggagataataattctgccaatatcactattgctgatgatggtagtgttgctatagatggaggacttactgttccggtaactgatgcagacggtaatacagctgataccgctgtaaatgttgttacaacgacagatcctaattatgttccgggtgagaatgagattgcaattaactcaacaaccggagagcttcttcttggtgagaatgtatacaagtcagtgtatgctgataatgcattttcagtgacatacgagaagagcaattttataaagggtgacattgacccgacaatgtattttaactgtgttgataataatacaggaattgagtacaacaagcagagtgaggatattgaatatatcattaatttctcacagaagattaaggttaatacagaagctgatgaagctttcaatatatatcttggaagaaatgttgatgaccttgtcaatgcggtacagaatgtccttgatattaatgaccagatatcaaagattgagtctatgcagaaggaaggacagtacagcgatgaggcttcacagaagaagttaagtgatattatggaaggccttacaaagcagagagattttgcaaaatctaagatgaaagatgcttttgaagcgggaatcggtcagatgcagggctatcaggagcaggtatctaatgcgaaggctgatgtaggaaacagacagataagactggatcttacgaagacacgacttacagaacagaagactaatttcactgatcttaagtctcagaatgaagacattgatttggaagagattgttgttacatatacatcagcacagcttgtatatcaggcagcattatcagctgcgagcaaggttgttcagcagacactgcttgatttccttgggtagccagcataagagaggaatacagtgaggcaggctgagagttaagctgtataaacagcattgacagataaaggatagaattaagatttggaggtttgacatgaaagtacagactaaatggtttggagagattgaagttagtgatgataaaatcatcacatttgacaagggaattattggatttgaggactggaagaagtatactcttgtgtatgatgcagagaaagaggagaatatatcaattatatggcttcaggcgattgatgagccaacacttgcacttcctgtcatgaagccggaattcgtgtatgagacatatgatcctgttgttgaggatgagcttcttaaatctcttggagacgatatacaggatgataatatcagagtgtactgtgcgcttacggtaccacaggatattactaagatgacaattaatcttaaagctcctatcattgttgattttgatacaatgaaaggaatacagcttatagcagataattctgaatatcaggtaagatatcctatatacgatattctaaagaaggaggagaactaatatgctcgcattatcaagaaagaaagacgaagcaatcattattaacgatgatattgagattacaataatcgaaatcaagggcgatcaggtaaagcttggcatatcagctcctaagtcagtgcctatatatcgtaaggaagtgtatgcacagatacttgattctaataaggaagcagcaagttcggttgatgttaagtctcttaaccagttatttaagaaatgatttgttttatttgtgtatatttttttccgaagggttaaattttacttaacattttccgatatatgcagtacaacatgaatgtaactacaggataaagttttgttttcacacggaggtggaattgtatcatgggaatggaagttaatggagtagcggcagcgtcaagctaccagagccagaatttacaggctgctaagccggtatcacaggtaagcagtgttacaacaactacagataagagcaatgaggttgttgttgattcagcgaagtcagcagcatctaatgtggcagtttctgtaggacaggcagcagacagtgagaagaatggcagcaacgctaatgacaatgacaaggcaaagaagcaggctgaatctatggctgatgttaaggatataaggaaggttcttaacaacaacacaatcgctgaattcggctacaacgaaccaactaacagaatcacgattaagattaaagataaagatacagacgaagttattaaagagataccttcagagaaagctcttgagatgcttgctaaggcatgggagcttgcaggtatcatggttgatgagaggagataagctatggcaataagactatctggtatggtatcgggtatggatacagaatcgcttgtttcagcactcgtatcatcatataagttaaagaaggataatcttgttaaagcacagactaagctttcatggaagcaggaaaagtggaagaccatgaatacaagtatttatggcttttatagtggaaagctttcaagtgcaagattttctacaagttataatctgaagacatcaagtgtgtctaatgataagtatgccaaggtttctgcaagttcatctgctgttaatggtacacagagacttaaggttaagcagctggcgtcaacaggatatcttacaggtggacagattaaagctgctgatggaagcaagattacaggtgatactaagatatcagacatagttggaacaacagatggttctataagttttaagactgcttctggaaccaagagtattgatataacatcagatatgaatgttaaccagttcgtatctaagttaaaggaagctggcgttaatgcaagttttgatgagaataatgcaagattctttataagttctaaggagtcaggcaaggataacgatttctcacttgtggctaatgactctaacggacttaatgcattacagaagcttggaatatatacagttaatgatactgattcagcagaatacaagagactggcagctttaacagagggcagtgatgcatataatacagaacttgaaggtatgtatactaagattactgccaaggatacagcgaagagttatgctgataagtataatgcagccaaggataagcttgatgcactggcagcagatgatacttgggatcattcattgacattagatgaatatgtcgcaaagcttaagacagagacaccagatattcttaatgcttatgataagtataagaaggaaaaggtggattcagagggcaatacagttaaagattctgatggcaaagttgtgtacgaatatgacacagaggctatggaaaaagatggtgtcaaggatgaatatgaggctgcggtaaagaaaaaagcgtctaatgaatcactgattaaggtgtatgatgataattccaaggttatacgggatactaaggattatgtgacaatcggcgatgatggaaaagctgtggcagatgcttctaatgccaatgtattacaggaagtaagcgatactaatgctgacagacaggctaaagctaaggcactgcttgactctaagattgcaatggcatcaaatgttactggtagtgcatcatcttcgggtgctgtcagaataacaggacaggattcagagattgagcttaatggggcaacatttactaacaactctaataactactcaatcaatggtcttacaattgaggcaatggaagttactggtaatgatgaagtaactattacaaccaacacagatgtagatggtatatatgatatgattaagggcttccttaaggattataatgaccttgtcaagtctgtagatgttgcctacaatgcggcaagttctaagggatatgagcctcttacaagtgatgagaaagatgcaatgtctgatgatgaggttaagaagtgggaagaaaagattaaggattcacttcttagaaaagactcaacacttggaagtgttcttgatactatgaagaatgatatggcaaaatcattcaaggtgggagataagtcttattcactttctagttttggaatagctacacttggatattttaattctccagagaatgaaacaggtgtatatcatatagatggtgataaggatgattctaagacatcagctaatacagataagttaagagagatgatatctaatgaccctgatacggttatatcattcttttcacagttatctacacaattgtatactgatcttggaaagaagatggcagcatcatcaacaagcagtgcttatactatatataatgataagcagatgaatacgcagtattcagagtataatactaagatatctgcggcagaagacaaggttactacatgggaagattattattatagtaagttctcagcaatggaatcagcgcttgccaagatgaatgcgcagtcatcatcgttatctggactttttggataatagtacatattaacaaccgcataagcatggaagcttatgggaaatgaggaaaacatggcatttaatcagaatatagcacaggaatataacagaaataagattcttacagcaagtcctgcagaacttacacttatgctttatgaaggggctattaagttctgtaatatagccctgatagctatagaaaagggtgatttacagaaagctcatactaatattaagaaggctgaagatataattacagagtttaaggtaacacttaatcataaatatcctgttgcagaagattttgagaaaatatatgattacatatactcccttttagttaatgctaatgttaagaaagatccagagatacttaatcaggcattagatgaaataagaggcatgagagatacatggaaagaggttatgaaccgtacaaggggaatgaaccagtaggagattaatatatgactactaattatcttcagatgatgatagacagccttaataagaagaaaggaattcttatcagaattatagagcttaatgaagagcagaatcagattctttcagaagaaacattgaatggtgatgcatttgatgataatatgaaagcaaaaggaagctgcatcgatgagcttgatttgctggatgagggatttcagtctctgtttaacagggtcagagatgcaattaatgctaataaagaaatgtatgctaatgagatatcggtcatgaagagactgataacagaagttacagagcttggagctaagatagaggttcaggaagcacgcaacaaagtcaaggtagaggctatgtttcgtagagaacgccaggagcataaggaagctaagagaagtgcatctatggcaaagtcatattatcagaatatgagcaaggtgagcaatgaaccacagtttatggataccaagcagtaatttttaaaaaagttatattacggactaaagttttggtactaaggtccgatatataaagtacaaggaaacagacagtttcctgtaaaccataactagatgtagcagggacgctgcatcataatataatttcaaggaggaaaatattatggtagtacaacacaatttatcagcaatgaacacaaacagacagatgggtacagtttctagtgcactccagaagtcaacagagaagttatcatcaggttacaagattaaccgtgctggtgatgatgctgctggtctttcaatctcagagaagatgagaagccagatcagaggtcttaacaaggcttcttctaatgcagaagatggtatctcacttattcaggtagctgaaggtgctcttaatgagacacattcaattcttcagagaatgaatgagttagcaacacaggctgctaacgatactaacacatctactgatagaaaggctatccagcaggagcttactcagttaacatcagagcttgacagaatctactctacaacacagttcaatacaatgaatctgttagatggtaagttcacaggaaagagtcttcaggttggttctctttcaggtcaggttattggtatctctattgctagcatgaaggcatcagctcttggtatcaaggcagcagatgttaaggttagcacaaatgctgtagctggacagtcaatgtctattattcagaaggctattgacacagtatcttcagagagatctaagttaggtgctcttcagaacagacttgagcatactatcaacaacttggatacaacatctgagaatacatcagcagctgaatctcgtatccgtgatacagatatggctacagagatggttgagtacagcaagaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcgtatccgtgatacagatatggctacagagatggttgagtacagcaagaacaacatccttgcacaggctggacagtctatgcttgcgcaggctaatcagtcaactcagggtgttctttcacttctcggttaataacaattactactataagcagaagagccggtgcttgcaccggctctttttgcaattaataatatatcataggggaatagacatatatggaattatctaagagtttttttgaagatgaagtaagagatgggttctatgtaacatcagatatgaaacatgcgtgggcagctcagttagaagtattgaatgatgttgataaagcctgcagggagaatggaatacagtattttgcagaatggggaacacttcttggagcagtaagacatcatggattcattccctgggatgatgatatggatatatgcatgaagagacccgattataacagattcctacagattgcagaccagataatgccagagggatataagatatttaatataagtagtgatgaagataatgataatatgcttaccagaattattaatgggagagcaattaattttgagaagacacatttggaaaaatttcatggatttccatatgtttcaggtatagatatatttccattggattttatagctcccaatagggaagatgatgattttcagtgtgaattaataagcattgttaattcagtagccaagtttatcaggacattacaggagaatgaagaatctatcaatgaagagaatcttcaggaacttaatctcaaaattaatcagattgaggaattatgcggagtggagattgacagagataaggatctcgcacagcagcttaatgtactggtagacagattatgtggattatatacagaggaagaagcgggatatgtaacaataatgactatatgggcagaggaaaggcagtataagcttccgaaagaatattattccaaaacagtgcggcttccttttgagaatattaccataccggtaccatattcttatgatgcgatattaaagaagaaatatggtgattatatgaagcttgtacatacatgggattcacatgattatccattttatgacaggcagaaaaagcttcttaaggataatggggttgtatttaatgagttttgtgatacatatgaggattatattaattataagaaacaggtcaatggtataagaaagacaagaaatgcgataagagaaaagaatataaaccatgaaactgcagtatttatggtgtataaggcagaatattgggatatgcttgatggattgttcagagaatatgaaaagagaaaagaacaggaaatagtagttattccattgaggtattattataaaaatattgatggaacagtagaagaatgtgcaagtgatgcagttctgccagaatatgttcagaaatatataaacagtgattataatattgaagaggagaatcctgagacaattattattcagaatccatatgatggatataatggttctgttacaatacatccacgatattacagtaagaatctggctatacatacaaataaacttatatatatgccatattttgtaacggaagagattaatcctatggatatgagagcatatataagtatggatgcatatgtaaccatgccaggtgttgtgtatgcagatgaagttatgctgcaatcagaagccaataaagaattatacgtaaaaaagctgaccgaattctttggagaagaatcaaagaaggagtgggaagataagattaatggccggggagctttgtatatagagaaaaaagatcctgttcttaagtataacataatgccgtcagagtggaaaaatatggcattaaagaatgacggcagctatagaaagataatactatattttataagtactaatggagtgctggaacataagagaaaaatgtttggaaaaattagacgctcaatggatgtatttacagaatatcagtcagatgttatgccacttctagcatttgagggcaatatggaagatatattggaactcgaagatgtaatgcttttgatggattataagactatattgagaaaatatgaaaaaaatatagtcagacctgatatgttaaaaagagctgttgatgcatgtgatgctttctatggagaggcaggagcagaagcacagatgtgcaggaatcaggggaagccggttatgatagaagatgttgatatatagtgaggagaaagtatgcttcaatttccagaagaatattttgaagatgaagtaagagatggattttatgtaccatctatgataaaaagagcttgggcaactgaacttgatgtgcttgatgaggttgacagaatatgcagaaaatataacataacttattatgcggaatggggaacattgcttggagcaataagacatgccggatatgttccatgggatgacgaccttgatataggaatgagaagagaagattatgtgaagttctgtaaagtagcaccaggtgagtttgtggaaggatatcagataatcaatttcaggactaacaaagattttcatcattttcttgccagagttgtgtgtaagaacaggatatgttttgaggatgaacacttgagaagatatcatggatttccatatcttgcaggacttgatatatatgtgcatgataatgtgtcaaaggataaagaagcacaggggaaatgcgaaaagacggcagaatatatagttgcggtcgcagatgctattgaggcaggacagatgtctgcagcagatgaactggcggctgtaacaagaattaacatgatatgtggaaccgatattaaggttcaacaggataaatgtcaggaaagaattgaattatatgctgcagctgaaaaagtgtttgctacatttaaagatgaagactgtgaagaaatgactcagatgatgccatacagtctgtatggaaatcatatgaggatacctgtaaaatattatgagcgtgtagtaagggtgccttttgagaatacaacaataccggttccgattggctttgatgctatgcttaaaagcaggtatggagattacatgaggcttgtgagaaatgcaggaggacatgattatccattctatgaatcacagaaaaagcagttagaggttttgatggattttaaactgccggaatatacatatgatgagaaaaaagcagtaagggcagctgatttagatgaattggcaggctacagaaagattcttaaaaactgtcttgataatattgataagcaaattgaagaaatcggacatatgcagaatgtagaagtgataagagaagaacttgttgatatacaacagacagtaattgacatgggagggcttattgaaaaagttaaaggcgagggaactgaaagtgtgagaagctttgaaaaattctgcgatgttatatatgagatatatcagggaaataatgccgatataaaagctgaatttgataaagttaaaagaataatagaaagagatattatcgcaaagaaagaagaactttttctagtgagcaaagcttcagaatggaaatatatagagaatgtatggaagaaacataaagaggaaagagatactgaaatagttgtggctgttgttccatattattataaagaatattatggaagcataaagaaagaagtaaatgaactggataaattcgccacagatattggtgccattgattctgcacagtatgatatggaacttcatcatccagatattatatatatacagaatccttttgataatgagaatagggcaataggaattgacagaaagtattattcagacaggttaaaatgctgtaccgacaagcttatatatatacagtcatttgaacttgaagaatttaatgagtctaatgaacgcgaatataagaatatggcttctttctgtacagtaccgggagtaataaatgctgatgtggcatatgtacagtcttataacatgcgtaatatgtatataaagaaattaactgagtttgctggaaaagaaactgaaagtatatggaatgataagatacatgctaagccagagtggatgatgaataaggagcattgcattgctaatggcaatggtaagaaaaaaatattgttctatacttcaataagcggacttatgcagaattcagagatagcagcaggaaagataaagaatgtattagatatatttaaacaatactcaggtcagatcgaagttgtgtggtgtgttcagagccttgtagatactgttatggaagatatagacaagaaactctatgagcagataattgcaatcaggaatcaatataatattgaacaaattggacatgtatgtagcgacagggataaagatatgcttaattcatgtgatgcatattatggcgatacatcgtcaattgttcaggattatagaaatgcaggaaagcctgttatgataatggattatgaaatataagaattggagaagccggatgaatgggagaatattattcataacacatcagttgtcgagaacaggagcaccaatagtgcttctggatatgataaaattatgtaaacgtgagagagcagatatagatgttataacaatgatggatggagaactgggggagcagcttcataatatgggaattgattataagattatggaaagattctatccggaaaaagaaagactgttatcggagtggagtagatataatcttgttgttgctaatacaatagttacatatgaagtaattcatgttcttaatggcagcaaaattccagtaatatggtggcttcatgagggaagacagtattttgaatattttgcaagcgtaataccgcattttggtactataggaagtaatattcatacttatgctgtaagtccttatgttaaatctgtaattaaagatatatataaatgtgatgttcccatgatgcattttgctgtttatggatatgaaggtgaagcagataagcattatgcgagaaaaagagatgtggtaaaatttcttacagcaggaacattttctaagataaaagggcaggatgttcttgcagctgctataagaatgcttccagacgaatatatgaaaaaagctgaattcagtttctgtggcaatgaagctgcagttgatgaagaagtgtacacaagtgtatgtgaattagaaaaagattataataatgttcatatgctgcatcagcttacaaggcagcagacaatttcatgtatggaagatgctgactgtctgatagtaccatcaagaattgaaccactttctgctgtggcaattgagatgatgatgacgggcggaacagtattgtgtacagatgtgtgcggaattgcttattatgtagaagatggtgagaatggatatgttacaagttcagatgatcctcagaggcttgcagaaagtataataagagttatagatgattatgataactgggaacatattggaaaaatcggacatcagacatatatgaaacatttttcaagagaagctgttgagccggatatagtgcggatagtagagaaatatatgaatttgtctaaaagaataatattcataaaaggaaaattagaaactttggattatttcatagaccagcttgcagacagtgcagacaagcttggaatagaatattatattatcaatacagggattcctgaaagctacggtgaggctcttgaagaatatgtaaagctgggcagatgcgcagtgtttatgataaatcagataggtttgttattgagtgagaatggacaaaattactggaaagagagaaatattccagtatatgacctgatagttgaccatccgtacaattatgcagatgcattagagtgtcctccagcagatattaatgtaattgttatagacaggaatcatgagaagttcataagaaaatattatccggaaataagaaatatatatttcatgcctgatggaggaaatgaagcagaaggcagaatgcagtacaaagacaggccaatagatatattgtatgtgggagattgtcaattatctacaccatttattgaaattccagatatgtctgataaaggaatggagatgtattcaacagtatataatatacttcttcaaaagccgggcttgtctatagaagaaactatggagttatattttgaagcaaagggcggatatacaaaagagcaggtaaagcagtatatattaaattatgggtttataatatctgataatgtccgcagatattataagttaaagacaatgcacgcattagaaagtacaggtgccagcatagttatatatggaaaaggatgggatgcgcgtgatgaggcatggcagcctaatgtaagcatcaatgcaagaatatcttcagaagaatgtaaccgaatgcttggaaaagcaaagattggacttaattgtatgccgtggtttaaggatggatgcagtgaaagagtattcaacataatgcttaatggagcagtgtgccttacagatacaagcaagtatcttcttgaaagattcgagcatggaaatgaactggtattttataatcttgaagatatggaaaaaatgaaacagaatgtttgctggctgcttgagaatcctaatgcagcaagccagattgcacaggcaggttatgaagctgccataagaaatgatacatggctgtgcagaatgggcgagattgcaaagatgatggggaaaatgagatgataggatatatgatgggatacagaagaaacttatgattatggagagtgggtatgaatatacttgttattggagagaagttgtttacagattatgcattacaggcattagatgatactgcacatatggttgatgtgtattattgggatggtacatttggaccagaactgtttatggattcaggtattaatgattatgactgtattgttgttatgtttaatgacgataagttatcagcagatattacatctatgattgagaaaatagttactaatgagaattgtatagtgtttaattatattttatggcataaagctatgctgcctgcaatgagggctgatcttgttatgagtaatcctttggcttgttcatatgacggactcattatgggtttatctcatgcagaggttggaatactagcagacagattaaaaggtaattatgctaatcttgctgtttcatcacaggatatatattataattacaagacgcttgagtattgcattgataagtatggggaaaagataaaaaacttgaaacatataattatagatatgtatgactatgagtattttaattttgatacatctcttgctaagaacatatacagatattttttgtggggaggttacaatcttgatggacataatatgacacgcaataagatatatactaacagccttgaagaggtgcgtaattatctgttgtatagtaaatataaagggctggatataagtaagcttggaatgtggaagaaactgtttccagatacatattatatgaatgggtattctgattacagatgtgccagagggattgaacagagaatagatatgattacggatagtctggttgaagagtataaagttacatcaagtactgtgttgaatgagtatccagaaacaatcagtgaaaatgtctctattatgaatgatatgctttcattaatatatagaaagtggccgcatattaaagtggatatagtacttcttccggtatataaaggcattcttgataagagaaaaaggtactatactaagtgggaagaacagtttatgggggttatagaacagctgggtaatatttatccgttcagattcacatcttatctggaagatgcaatgaccgcagataagaaatattattatgataaggatcatcttaattacctaggggcatatgtatttacgcagaagttaaaggagatgataggggaatagattagatgggaaagtgataaatagattattaaataatgggataaaaataaatatacataaagttaataactcaaatttaatgtccgatataatataaggtatattgtgcagatatggatgctatgacgcaatatttactaaataagagaacttcatgtatgtataacatacttgttttattatgtatagtacttattttgttatattcataaagtgtgtgaaatcataatcactaattaaattggaagttaggatattaaaaatgtactttgatgtgcaagttattaacagatgacttaaaaacatatatgagaaacttaactttaggagatataatctaatgaaagtggatttaatagacaatctcatgtagcggattatctgtaaatggtatctgagaagtgcttgtctactaaatgattaactaaaaaggaaaatgttatcgtggactattggatgaataatcttttcaatttgcttatatgaaaagataactataacaaagcctatgagaatgtcaaaagaaagaaaaagtgtaattgacggtatgcagatgaatgattttgccattctcagagtaaccaaaggaatcttaattaaatagatatgtggagaaaagtaaatctagctctgtttaaaggacagagaaagccaaagaacaaaagttgagttttgaaaattagaaatgcctgatgttgcaaaaattgcaagactaaattgctagaatataaaattctacaaatgtttatgaacgtacagagattggtatgtcacaagacggtttgtagggataattgttattaatatttagaaattttaagatgttttagttaaaagtatctaagttattaaccttagatatgatagaaaagaataatgtgtatagagattgtcagataaaaagatggatttaattgtaaatattagaaggtggatattatatggagatagagaacttagtcaaattatcgaaaaaaaataggtggaaaaaatgtatttatggattgggttttttgggacaaagaatgagtgggtattttgaaaaaactcttaatattaaaatagatttttttacagattcaaatgataatcttatttccgaattaaggaaagcaaataatatggttgcaattcacaaagaagaactgttaaaaatggaagatgatgttttagtattggtacttgtagattatccatatgattgtgaaataaaaaaagaattactgagccattccaatttgcatataatttctttagatgagttggcaaattctgaagttattcagaaagatttttatggtgaaaatctatttaatcaaatcaaaaggcttgacgattattctacatgtgagttagaagttggtaagaaatttgagatgacacggaataaaaaagttgctttttatacatgtatattgggagattatgatgaattaaaacagccagagtatgttgaagaaaattgcgattattatattatttcagataatcctagacatgctaaaagtaatatgcggtggatagatattgattcagttgtacctgatagaaatatgtctcttcaagaaaaaaatagatatgttaaaatgcatccacataaaatattttgcaattatgatatttcagtatatatggatgggtcaattcaattggttggaccgatgagacaatatttatcatgcataggcgaagtaggattagcaattcatagacatagaattagaaaatgtatttatgttgagtcaatgatggttaactggttaggaatgataaaaaaaaaggatgtattaccacagattcaaaagtatgtgagtgaaggaatgccaagaaattggggattgtttgaatgttgtgtaattgcagtagatttaagtaataagttagcaataaaaatattggaagaatggtttttagaatttaaaaatggagctaaaagagatcaattgtcattaacatatataatatggaaaaatggatttaaacccaatacgataggtgttttgaatcctaaaggaaatgtttctaacaattccagtattatttgggagagaggaaagaaacatatgaatgaattgactaaatataaaggagaatgattatggaagtcaatactcaaagttttataacaggacaaataattgataataaattattttattcaagctcaaggtacaatggattattctcttatgatttaataacaggaaaagttagttttatcaattcttttaatggttatcctattaacgttaaggggttacattcatgtagttgtatttggaataataaaattgtgtttttaccattaaatggaaaagatatacatatttttgatgttgaatctaaagaaattacgtcaattaatatttctgaatcgaattatatagcaagctcggcaaagaacatttatattaaagattcaaacatgtgggttataccacgatatttaaaaggatataccaataattctaagattctttgtgtggatttaacttcttataaagttgttgaacagttagatataaataaaaggttagaaagctatgctgaaccagatggcaccattcttattttacaaaatgaagtgtacgataataaaatatggattcccatatgtagaacaaataatttagtatcaattaatccagaaacaaaagaattaactgtccatagtatggagaatatgaatttatatagtattacgagtacaatagatggtatatgggtatcagatttatatttgggaaaagcaaagaaatataatggctcaaattttattggagatataaatttgaattatgcagaaattatttcgtctgttatagaaactaaggaatattgtgttgctttgttaagaaatcaaaatcgtgttgtgctaatatcaaagcaatcaggagagtcaaaaagatatatactaagttcatctctaattggtaatggaacattaagagaatgtagtttattatttagtaaatggaaagagatttatgttgtgtttcctaatgatagaaatactttatttgaaattatagataataatgactatgaagaagtaaaaatagaggaatgtaaagatttgaatattttaatagatgattttaatcaaaaagagccaatactagaaggcgatattgggttaggatgttatataaaattattggtaaaggataaacatgaaagataagactattgtgttatggggaaaaggaaatataggaaaagatacatataagaaatattttatgaatcagaatgtgataatggttgattcaagtgtaattgatgttgagtatactaatatattgggaaatgaaatagctgtttttaatcccactattttaagagcaaataagcataaatataatgtttttgtatgtatgaaaaagcatagagaagatgtgtataaattgcttgatataaatggttataaaaagaatgttaattatttttcttatagatttcttgacaaagatataatagatccagaggaatgtctatttggtggaaaagaaattattgtcaaagagaaaaaaagtggaaagaaagtagttgctttttttggaacatgtcatatgggagtttataaagattctcttaaacaaatgaaatcatttactgaaaaatatataattattgatttgccattagttaatgaagtagatttacaagaacataagttgataggagaaaaatggctatgggaagaatgtgattgtgtttttttgaatcagatatatgctataaatcaatataaagtgccagatactattacaataatgaaatgggctaagaatgcgcagagttttgttatatcaaatgcaatgtttaaagggtatttcccacaaactaatactagagtaaaaacgtcaatgttggactattttacatggggagatataaatattaattatatgttaaaaaaaggaatggggtgtgaagatatagtaagtaatatatgtgatgttaacttttataaaaaagaagaagttgattcgtattttttaaaagaattaagaagtttggaaaaattagaaaaaaattgcgacatacaggttacagatataattgctaaaaattataaggaatatctttataggtcatggtctcatccaacaaagataatgtttaagaaaataatagataaaatatgtaaaatgctcgatttaagagaaaaatatgaaattaaatttgatttaatatatcatgaacaaattgtatatccgtcaattattgaaaaattagatttagataaaaatttttatataggtaggaaaataaatcctggaaattatgatgtgcaatatgatatagagcagtatataaaagagtatgtaaaaaggaggaaataatgaaaaatgaaagttgttgtaatgattccaataaaattaaataatgaaagagtgcctgggaaaaatttgaaatgtttttcggatggaacgcctttaattaattttatacaaaaggcttgtttaaatgcaaaaaaagttgatgaggtatatgtatattgcagtaatgaagcagttaaagaatatttattgcctggtgtaaaattcttaagaagaccagagtttttggatacaagtgttgtaaattgtaacgatattattagagaatttatgaaggaagtagaagctgatatttatattgcaagccatgcaacaggaccattcacaagaagtgaaagtatagataaatgtgtggaagcagtacaaactggaagatatgattcagcttttctcgcaagaagattgcaagaatttttatggcagaatggtaatgcaatgaattttgatatacaaaattttccaaggactcaggatttagttccagtatattcggaagcaccaggagcctatgtttttactaaagatacatttttaaaatatgatagaagagttggaatgaaaccatatatttgtgaaatatcagaaattgaagcaagagatattgattatcaagatgattttgatattgcagatgctatatacatgaaaataattcgaggtagataaatatgtcaagaataaatgttttggattgtacattaagagatggagcatatttaattgataaaaagtttggcttagaaaatattagtggaattacacgtggattgattgattctgatattgattttgtcgaggttggattcttccaggatgacggatttggagagggaaagactgtatataaaaattcgaaagaagcatcaaaatacttaccggctaaaaagaaaaaaagtcaatatacggttttagcagattgtagtagatattcaatagagaatcttgatgatagacaggaaggaattattgattgtattagagaatgtttttttaaaaacgaaatatctcaagctatagagaattgtaaagtgataagggaaaaaggatataaggtttttgtacaacctgttgatattttgggttattcggattatgaattattagatttaatagaaaaagtaaatgctattgaaccattctgcttttcaattgttgatacatttggctctatgtatcaagaagatttacagagaatttttgaattgataaatcataatcttgtaaagacttgcaagataggatttcattctcataataatatgcagttatcaaatgctttgtcgcaggaatttatccgaatgagtctaggaaaaagagatattgttattgatgggacactttctggaatgggaagaggtgcaggaaatactcctacagagttaatagttcaatatattaatacaaaatatatgggaaaatataacatggattcaattttagatattatagatatttatatggataatattagaacaaaatgttcttggggatattcgactgattattttattgctggatgttatggtgcccatgtaaataatatttcatatcttaataaaaaacatagcattagttctaaaaatatgaggtatatattaaataaaattgatgataaagctcgtaaaagatatgattatgaattattggacaaaatctttatggagatgattgatgaggatattgatgactttgtttctttaaaaaagctaaaagatttattaaagggaaaaagaattttgataatagttccaggacaatcaatactacaaaacaaaaacaagataaaagagtatgtaaaaaataatgatgttgtagtaatatcgttaaattttaatccagattttatcacatctgattatgtatttgtgtcaaatcaaggaagagttaaaaatataaaaaatagatcgggagagagaagaatatattcatctaatatagacaaagaatatattgaagaggctgattatattgtaagttttaagaaactggttaaatgtggctggaaattgatggataattcggcattaatgttattgcgcttattagatgaaattaattgtaaggagattatatttgctggatttgatgggtattcttcattacatactaattatattgacagtgatatggaaatagaatcagcatccatgaattgcaatgaacgtaatacggaaattgcagcaatgttaagagattatatggaaactagaaagaataaaaaaactggtattaggtttattacgaaatccagatttgagagatgtttgttgaattagaatgtgggttaaaagagaggagagttctatgaatgttttggttttgttatataaggatgtttacaacattccaaccaggcatattgtagatgttttgttaaatgagggaaattatgtggaaatatatgcaaaatatatggacaatatccatataagaatgtttgatgggcttatagtaaaacctattgataagttaacacaatcttgtattgaaaaggcagattttatatattctgctgcatcatttgctgcaatgccagaatttcttgaggtaagaaagtatatttttacattttctacagcatttatggatgaaatagcaaatttttcagattatacgtttactcaaagagattataaaaatgcaataattaatgataattatattgttgaaagagataattatataaaaacattaccaggaagtgtaattggaaatccaaaattcgattataggaaaaaactagtatagaagtgaataatcaacaaatattgtttatagatgcaggacattttccatttggtgattgtgggaaaaggcaggaagcaaaaatgcttttggatattgcccaaaagcatcctgaaaaaaaatagttgtaaagcctagatttctaaaagaagattcaaatgtcactcatagaaatagtggacatctttatgaatatatacatgagttaagtgcaggacaaatacccaataatcttgtattgcttaataaacatttagatttggaacaattggttcaagagagttgcttaattattacaccagagctgacgaccagctatctggatataggcttctatgaaaaaaggggattgatagcttcggggtttgaaagtgaatatacgttaactcataatgaagcacatattaatagatttaagaaaatagaacaaagaagcggattgtgtgttccatatcaaagaataaatgaatgtattccagatgggagagaatttaataaaaatcatttatatgaaatgggagttataaatcaaggagcggcgaaaagggcagttgaaataatggaggatatctacaaaagatatttaattaataatttatatccgtctccatatgaagataatgggtttattaattttgaacaggttcaaagtcaaaggtatattaaaaaactatatgagacatatgaaaatgtatcatatcgaatagatgaattggatttctcggaaatttcaaagagtatagaatcaatatggaagtctaaaatgatatttacaaaatcagaatatttgaaaattaagaaaaagcttgataaaaaggtttctcaaataattttaaaaagtaaaagtatgttaatgggtaatgaatttaaggaaagctattatttaaaagcagtcaatgatttaggcagaatagaagaagaaaatatagatgattattgtgctaaacagatgttttattggtgtagagcaatgagccgtgtaaagcaaagtaaatttagtgaagcaagggaggattttgaaaaattcttttttctgtataaaaaaaataaatatgaaaaaagcttagcagatttaccatattcattacgtaattattatctatggaatggtatttgtaactatgagttgaataatattgatttagcttacaaacttctttttgaagcaaagcaaagaatgattggtgataatgcagatttagaaaaatatttaaagaaagtaaatatatgatttttaagaaattagaaaaatatttaaaaaatattgatgggaaaatagcaatttatggtataggaaaagaaacagagaaaaatataccagaaataaatgaatacgtagaaattgttggattactagatggatttagagataatggaaatatttatgggtataatattatctctttaaataaggctataaaaattgggataaaggctattatagtaattgcgagaccaggctcatgtcgagctatagttacaagaataaaagataagtgtaatgaaaataatattaaaatctatgatgtttatggaaataatcttttggaagaaaaacaaagtaagtgcactttggggaaattgaaaccatattataaaaaggatttgatgaataaaatagaagaagcagatgttataagttttgactgcttcaatacacttataactcgacagttattttctagatatgatttatttgagcttttatataataagctcagtttaactgaaatgagtttaaaggagtttgtgaatcaaaggataaaaagtgaaaaaagcacagcaattggtctggctcctaatttaaagaaaatttacgaagattgcgttttttttagtggtattgattttgcagaagaagagtttaaaattgacaaaagtgtaattattagaagagaagaattagtagaagttttaaattattgcataaataaagggaaagaagcaattgttgttacagatacatattattctgaaaagcaaataaaaagtatcctgaatgataattctatttatgggattaaaaaaatttatgcatcatcagagtatacaaggggaaaagatacaggtctatttgatatagtaaaaaaagattatcctaaaaagaaaatacttcatattggtgatgattatctaagtgactataaaagtgcaattaaatcgggtataaattcgtataaaatatatagctgtgaagatttattttacggaacaaactttatgccggatgttgaaccggatatggagttggattcaaaaataaaaattggattatttatatcaaatatttttaacaatccttttgtgtttgaaaggttagaaaaagatatttgtatacaaaataataaaacgataggctattcattttgtgcaccattgattatggattttgttaagtggtttgaagaaaagactagagagtgcaatgattgtcagatttggctttctgcaagagatggatatttgataaaaaaaatatatgaaatcttatatccaaatagaaaaacgcattatgttttaacttcaagaactgcagctataagagcaggcactttatcagaagatgatattgcttatgttgatgatatgaaatttggaggaaacatggatttatgcctaaaaaaaagatttggcattgatgttaataagatagatataaaacaaatagatgacacacaacaaggtatattaaaatataaagaaataattataggtgaagcatggaaaaaatatttgaactacaaaaaatatttaaagaaaatatgcgaaaagaataaaaatatattgttctttgattttgtagcaaagggaacttgtcaattttttataaaaaaaatggtgcctaataaaattaaaggtttgtattttttacagttagagccccaatatatgaatgataagcaaatacaaatagaatcatttttttctgagcgtgaaaagataaagagtacaatatatcaagattattatattttagaaacaattttaacgtcattttcaccatcagttaatgaatttaatataagcggagaacctatatatgcagaggaaactaggttaaaggaagatttggactgcatatatgaggttcaaagtggaatactaaactacataaaggattttattaagatttatccaatagaacagctaaaaataaataaaaaattggatgagcaaattctatcggctattcataatgtaaatctgaatgattgttatttttcaaagttaaaagtagaagatccattttttaatagaatgacagacataaaacaagttttataattgttttgaaaataatttatttacgtattgaagattttgaatattaccaatatcatatcgtctgccaggcattttataaacataaagatctgattttattgataatttttctaataatgtacctggagagtccatggttttatcaattttgcataagtctaatattgtatatatgtctgaaggagtatagatataaaaaggtggaactgcccaattgcttttaggggcaattggcttttcttccatatggattattttgttgcttttatcaaaggtaacaactcctgttttttgcaaattaattaaagaatcttcataataacacataacacaagactttttgaaattcaaataataattaataaagcctttaaaagaaaaatctataatattatcagctgcaatgactaaagttccatctgtttgtgggctgttattgctcatatagctaaagccgagacacatatcattaacagcaccaagtcgtgattcgttactgaatgatccatcgttaattatttctattacagtgtttgataagtagtcttttttcctggattttttccaattttcgaaatgcttaaaatatttatcattcgtaactataattatagagtcaattaatttggttgaaatacaatcgtataacaaccaatcaataataggttttttatttacttcaagtaacggttttgggaaatttttagttataggataaagtcttgtagcatatcctgctgctaatacgatacaattaatcataattctactccatcagttgtgtttacaaaaaaaagagaaaactttttctctagtaaagggtatttagcaatatatttttctctaacaattgcttgtattcggtctttttcttctggatttatgagagcaatgcttgaaccgttaaatcctgcaccagaaaatcttccaccataaattccataagtgctttcgaaaatatcttgtaaagtttttaaattttcagtacctgattcatataattcaatagaacttcttccagattcaaatatcaaattgccgaatttttctatatttccatttttccaagcattaataccagaaataaccctagcattttctgaataaaaatgatcagctcttttacgccaattttcaggtagaaatgaacgatattcgagatatatgctattaggaatgtttctaagatatgcatcttcaaattttccgtaatccataccggaaaaagcggcaattgcataagcagcagatttacattcatctacacgtgtattatatgcagatcctgcaagttgtcgttctttacctgcaaaaactatcataagttggaaatctttggacaatgtttgttgcggtatgttttgacttgaatcgttaagtgtgtccaaaaagagtagattgttttttttacaatatacctcacaactttgatctagtttaccaacatttacaccaatataattacgctctgcccatatagcattcataattaattcgggtttagttaaatggatattatttgtttcacaaaatgctattagatatgtgatgattacagatgcggaagatgataaaccaccaataggtaaagaaccactgatttttcctttgattccatattttaaatcatactttagcttaagtgcagcaacagctgcttttgagaagtcaccccacatcatttcgcgagtaggattatcgtaaatattaaaaactgtatgaccagagaaattagcacttattaaatcaaccgtgccatcaagagtgggttcgtattctaaagtaacacctttatctatagcaaaacctgttacaagaccaagttgatgatcaacatgtgctccaagtggacatattctatatggtgtaaatatattttttttcataaatacctccgtaagaatgaacaaaattgtcttttgctttttcttatgtcatttgaaattatcaatttataaatttatttactatataatttcatatatactaagttttgtcaaaaaaatttaggaaaaatttgataatacatatgaattctcatatatggatgagcacaattatgtatatacaaattataatatatagtatattatataatcatatatgtaataattcagatatagattacgttgaatattgagggtatgggtatgaagataaatagattatgtgttagtaactttatggcttttaatgatttggatattgaattctcagataatattaatattataagtggcgagaatagtacaggtaaaacagctttgattaaattactgtatacaagcttaaaaacatgttctaaagcgtattcatctaataacacactttcaaaggaagagttggaaagtgcaatggtaagtaagtttcaaggaatttttatgccagataatggagctattggaagacttgttaacagacatcgtggtaataatagtacagatgtaagaatatttctgagcaataaagatgatataagatttggattttctaataaacattcaaagcatatagatataaagcacatggggataaaaggtaaagataattttacaccagtgtatataccgccgaaggagataatatcatctactgagaattttggttcgttatatgatgaatttcatattgcttttgaggagacatattatgatttatgcagattgcttgaaagacctttgagaaaaggacctaatacaatagagcagaatatggttatgaaaagttttgaagatatagtcaatggaagtatagtccaaaaagataagaagttctatctgaaagttaagggacaaggggaattcgagatgggacttgtatctgaaggatatcgaaagatggcgactataatgtatcttatattatcaggaagcttgacgaaggattctattctattttgggatgaaccagagactaatatgaatccaaagatgattaagcctatgtgcgatgcattaactgagcttgcgaagatgggagttcagatttttgtagcaacacataattattttgttcaacagtattttaatatggaggcaatatataataaggattctaagataaagtataattttatatctctttaccgcaatagtgatagtggtgagataaatgcacagtgtgttgataatcttgatgatatgactgagaatgctattatgaaagaatttgatgacttatatgatagagagcagaggtttatatatggagattaacgagagcagattatcatttgtatttagtgaggaaactaaagcttataaatttgatgatgataagttttatagaaaagaattcaataatatgtcaggttctaagggggttgatattattgcttcatcagataagtttattcacatgatagaggtaaagaactgtgtgggggatgagaagaacaatatttggagaatagttgctaacaataaaaagctatctaataatgattcgaatagacataaagaaagttatgatgtggagatatcgaaaaaggtggctatgacgatagcttgtatttatggggcatttacaatgagaaattctaaagagacagcagtagaattgaaaaagtattggtcgataattaatacagaatctatttctaaagataaaaagcagttaattattactttgttcttagagggggactttgataattgttttacttcaagaagtaaaaagatgattatgacagatttgcagaatagtataagaaaaaaactgagttggctgaattgcaaagtctctgttgtagattcaaatacatataacaaatcacattataaagtagattatgttaaataatctacttttttaagcaaatgaggtacacatgatatcaataaaacccttagattcaccaattaaccagcaacaatatggtgatattacttacagacagtatgcagatacatataatattgacgacagaaaagtcccatatggacctgatatgttctatttgtctgttaatacaattgcagataagaattttacatttgcagtagatgaagatggaaatttagttgcagcattagtttttgacggtggaacatatgcacataaatatacatattcaggaggagtggatacggcttttattgataattatgactgtatatttctatatgactgcaatgagttttctgttgaattgtgccggacagcatttagattttggaaggggaaaagactggttcttgtaggagctaactgggagaagatgattgagcatctggatgatataccggggattgagtgcttttatgagattgaacctgaaaataacagatttacagaacttatgaatggattcaaatgtcttcatgtgacatatggcataccacatcaagaaagcatggaacgttatgaacagggagttatgtattatgatgaggtgatgtcgtttacatttatgttctctgattgtagagaattgggcgagagtaatccagacaagtatttttttgtgatggatggttattatggaaatctggggctttttactattcgttcaaagattgaagtatgtcttagatatgcattatctaaaggaatggaacctgttgtcagaattgttaaatcaggagagagtttttattcagattatagtggtgatgatatatgggggaagttctttaatcagccaggggattattctttagatgatgtaatgcatagtaaacatgtatttttctcaccaggattttataatggaagtgttcagagcaatataatgagccagatgagtaaaggaatttcgttagattggaaacatggtgtgtttaataataacctgattggatatattgcggagagaaagaataaataccttccatatccacaacggacattgggtgtgttagccaggggaacggattttgttaatacacatctgcataatcatccaattcacgcatctaaggagatgattgcagacaggatagatgaagctttgcgtgattggaatcttgattatgtgtatatagccacagaagatgccgtttattgtgaattcttcaaggagcggtatggtgataaggtgttttttactgaccagcagagatatgtaacgaggcagaatgaattactgagtgagcttcacagaagtgaagaagtgaaaagaaatggatttgagctgggggctgaatatgctgcttcaattaatcttttatcacagtgtaactctttgattgcatctggcggatgtggaggagtcgatgaggcattgagggaaaatgcaggtggatatgagcacgtgtatgtgtttgatttgggaacgaataggtaagaacttataaaaaccagtaaaaagtagtaaaagtaattaaaaccagtaaaaagtagtaaaaatataatgagtagttggaagaaacacaggaaggaatatatatgtacacagaattaacagcatctatgatgtgtgccaattttggcaatctagagaaagaagttaaagaactagaggcagcgggaattgattcgttccatattgatatcatggatggacgatatgtgcctaattttgcaatgtcacttaatgatatgcggtatatccgctctgcaacggacaagccattagatgtccatcttatgattgaacatcctaatacgcatattagtctgttccttaattcacttaaggaaggggatactgtgtatattcatccagaagcagaatatcatacgtctactactttacagaagataattgatgcagggcttattccgggcatagctattaaccctggtacaagtattgagactgttatggagatgctgcagattgtagataaggttcttgtaatgtcagttaatccaggaaatgcggggcagatgtatcttccatatgttggcaagaagatagagagacttcttaagattagagaagagatgaattttgaagtgtactgggatggtgcatgcggtgcagataagatatctacatttgctcctatgggagtgagggggtttgttctgggaactacattactttttgggaagggaagaccatatgctgatatattaaaggagataagacagttatgataattgataatgttccagagcaggtgtcagaagataatgttatagagctggcaaatgaatttactgaatatctggagaatagcggaaatctgttttttcaaaattatcagtcatctgtactgacatatgagcatcttatagctatgttttatgtgacgcgtgcaatgactggtggtatgaggttatataattattgttatgatgccgccattgaatgtgcaaaatgtaatataaaacgcaggctgacagccaatgaaaagataaaggtcacatttctcccaatatcagcagcagaatggccggcagaatatatttacagaaaattagaggctgatgacagatttgagccgcaggtggttcctgttccgttaataggaagaactaaggaagaacgaggaaagacatattcacagacttatgatttcttcatggcaggtggttataatgtgaaaaaaatatatgatttccagactgaggagataattggctgggaggaaataggtggtattcctgatgtggtgataaatgttacaccgtggtatagtgatattgcaaagaactatcagattgccagattgcctttatatgtgcttaatgtgtatatttcgtatggacttactgtaggtaattcacaagataggggatatgcagaaaaattcatgtataacaaagatttcatgaatgttatgtggaaggtatatactgaaacaaagaaggattatacaggttttcagaaatatcaggcactaaaagcaaagaatgtagttaacagcggatatattaagatggattattttctggaaaagcatgactattcagaagaaaggcttagaagtatatggtctgttccggaggggacagatatatacagctataagaagattctcattacaccacatttttcattgggagatgataatatattatctttttcaacatttaataagaatatgtatttttatatatatctggcaaagaaatataaagacagtgtctcatttatattcaagcctcatcctaatcttagaaattcccttgttctggatggatatatgaaatcaattgaagaatatgaggcatatctggacgaattcagaaagatgccgaatgcatctgtttgtgaagaaggggattatctggcactttttgatacttctgatggtattatcaatgactctatatcttttgttggagagtatatgtatgttgataaaccaatgctgtttcttgaacgaccggaacagaggtttaatgaacttggagaggctctgattaaggctcattacaaagtggatggacatgattatatgggaattgacagctttgttaatgatgttgtaattaatggaaatgattatatgaaaaaggaaagaaaagctgtatttttagaagaattggattattattctaagaatgggattaaggcgtctgaatatgtgtataaggatattacggatggtttgtttaagatgtaaaggagcgttatgaatatagcattagtgcttgccggtggaactggtacaagactaggaacagatattccaaagcagtatattagggtcaatggcaggatgattattgattattgtcttgagacaatggaacattcaaaggatattgatgaagtgtggattgttgcagataaaatgtggcagcagcacattaagaaaattaataaatttaagggatatgcatgtccgggtagtaacaggcagttatccatatataatgggcttagggcaattgaagcttcattatcggatgagcagaaagatgttaatgttcttattcatgatgcagcaagaccgtttctaacagataagcttatacatgagtgcgttgaggcagttgccggacatgatggggtacttccggttctgcctatgaaggatacggtatattatagtgaagacgggaaggcaatttcatctcttattaacaggaacaaagtatatgccggacaggctccggaattattcagattaaaaccatatattaaggcaaatgagactttacttccggataagattcttttagttaatggttccacggaacctgcaattatggcaggaatggatattgtgatgattccgggagatgagaataattacaagataacaacgaaggttgatatggatagatttacagcagagttttaagggataaggtgtaatgaggatggagaatatatatgaatatatagccagactgcagtcagaggggaaatggcaggaaagctttgatgtgataagagcaggactgaaagataattataatgattatgaattatattttgctttgggagagtattatcttaaggataatattgataaagcatatctgtgctatgaaaatgcgttgttttattgtgataataaagatgacagagcatatatttcaggggttatgtctgaaataagttcatgtggcattaaagtaaaacctttatctatcgtgattgtttcatataattctaaagatgtaatgaaagcctgcataaagagtatccgtatcaataatatttcttcaagttatgaaattgtcgttgtcgataatgcatcaacagacggagttacagagtggttagagagtcagaatgatatcacattaataaagaatcaggataataagggatttggtgctgcgtgtaatcaggggattaaagcatcaagtcctgattatgatatatttttactgaataatgatactgttgtatctcctaatgctatattctggatgcggatggggctgtatgagaatgacaggattggagcaacaagctgtatgtcaaataatggtggatttcagaatattacagaagtatttgattctgtatctgagtacatatattatgccacgaaaaataatattccggaatattatccatacgagaacaaagtgtggctggctggttttgcggttattataaagcgtgatgtacttgatcagattggtctgctggatttaagatatggtaaaggatattatgaagatgatgacattggaatcagaatacagaaggctggatatcaatgtattgtatgtcataacagttttatatttcattgtgggtcttttagttttaacaatgatgtggaagagaaaaacagactgtccagaaataatagaaaagtttttaaagaaaaatggggatttgatattgattattattcaaaatcacggaatgagattattcaatttataaaagatgatgaagataagcctattcatgtccttgaaattggatgcggatgtggggctacacttgcaaaaattaaatatttatggccacatgcggaagttaaaggtatagagcttattggggctgtggcagatataggggctaataatttggatataatacagggaaatattgaagagatggatgcgcttccatatcgtgatgattattttgattatgttatatttgcagatgtgttggagcatttaagagaaccacagaaagtattagagaaaatcagaagatatatgaaaaatgatgcagcacttattgtcagtgttcctaattttatgaatataacggttatgctgcctttgttaagaggtaatctggaatatgcagatgagggtattctggataagactcatcttaagatgtttactatgaagtcgtgtgttgaaatgcttacacaggcgggatattctgctgaatatagaggagttgtgtctggtaaggctttaggaatagatgtatctgatgaagaaaaaaatcagtttattaatgcattacaatgtatatcaggctcagcagatatagagcagtttgatgcatatcagtatatatttaaagcaagagttatgaagtaaaaggaaggtttcgggagaacaataattatgaaagcacaggtattacatggtataggagacatacggtatgaagagactgataagccccggatagagaaaggctgggtattagtaaaggtaaaggcagcaggagtatgtggctcagatattccaagaatatataaaaccggtgcacatgttcatccaattgttaccgggcatgaattttcaggtgaagttatagaaacagcagatgacaatttttcatggaggggaaagagagtaggaatatttccgctgataccatgtggagagtgtataaactgtaagaaaaagatgtatgaaatgtgcagtaattataattatcttggttcaaggtgtaacggcggttttgctgaatatgcagctgtaccagaatggaatcttattgaacttccggataatgtatcttacaagcaggctgcaatgatggaaccaatggctgttgcagtgcatgcaatgagaagattttatatagaaaaggattcatctgtgtgtgttataggactgggaacaataggacttctgcttacgatgtttcttaaagctgaaggaatacaaaatgtttatgttgagggtaataaagacatgcagaagcattttgcacagaaacttggagttgatgacgaacattataatgtagataatgttgtggcagattatgtatttgaatgtgttggaaagaatgagacaataaacagggcaatagaacttgctgcaccagcaggaaatattgtgctagttggtaatccatattctgagatgaatataccaaaggatacatactggaagatattaagaaaacagttaaagcttagtggaacgtggaattcatcatatgcaggagaatcaggtgatgactggcattatgtgcttaatatgcttgcagatggacggattgatccggaacagtttataacgcatgaatatccgcttgacgcaattcagaaagggatggaaattatgcgtgataaatcggaagattatgtgaaggttatgtgtatatcatagaatgattatctggagaggttattatggtaatagatattctttctcctgtaggtggaagatgtggtggtattgagaatgtaataagagcatggactaagaatctgccgcgtgaattatatgatgtaagagttattcatatgtcttcaggaataaaatatcttgaaggatatgatagggcatatgcatttgacgcatgcgaagaagtggatattaatgcaagacttacacattttacaagaaattatgcagggtttattaatctgtatggaaaaccggatatatgcgtagctgttaactggccagcaatgtgtgttgtggcagatgcggttaagagacttttaaagctggatttcaggattgtttcatgggttcatagcagcatagatgaatatgaacaatctgggtttggcagtgtcagggagatgcttatggcagatgctcatatatgtataagcagaagtaatgagcgaagaattaaggaattatgtccggatgctgttacatattatgtcggaaatcctgttaatatgcaggagtttatagaaaagcctattgataataatactctgtgttatgttggaagacttcaggatgtcaagcgggttgatgttatacttgaagctttatacagagcaagacacaagtggaagttcaagattgtcggttcaggggagtcagaagatgaacttaaggagattgcagcatatcttaagcagcaggatcaggtgcagtttcttggctggaaggattcaccatgggagtattgtaaagatgcttctgcactggtatgtgcttcggaatatgaagggtttatgttgacaggtgccgaagccttgtcgatgggaatgacagttatatctactcctgttgacggggttattgactatgtacggcatggtgagaatggatatttctttaaaaatgaggatgcaataggtcttgcacatttgttggatgagatatatgaaggaaaagttaaactgtatgatagaattgattgcagaaaatcagttgaaatgtacaatatagataattattttgacaatatcaaaagaatattggaggatatgagatgacattttataatgtatgtcctgcagagattgaaagcggcggaccggagcttgcacatcagatgtgccacaggcttaatgatgcaggcttggaagcatatatgtattacataaaatctaatgatattaatcctcaggatgtgaatgcaagcgacaaatatattaaatataatacatttcatgcaaagcagttatctgagatagaacaggacaccagtgttgttgtgtttaatgaaggagcaacgggacttattcccttgataaaacattgccataaagtactctggtggatgagtgttgataattatcttattaatacagatggcagggatattgatgttataagaaaagaagttgtactacatctggtacagtcaaagtatgcatatgagtatgtgagagatgttgtaggtgctgatgagaagaatataatgtatgtatcagattatatcggtgatatatatatgacagaagtacccgagattctaaggcagaatattgttctgtataatcccaagaaaggactggacagaattaagccagttatggagagaacttcgtcatggctcaaatggattccacttataggacttacagaggaagacatgactgcctatatgcatattgccagaatatatatcgattttggaggacatccagggaaggacaggattccaagagaagctgcagtatgcggttgttgtgtaataactaaccgcaggggaagtgccggatattacgaagatgtaccgattccggacagatataaatttgagaatgaaacagattatgaaggtatagagaattgcatgcattatatatgtgataacttttatgaagcaaggaaggatttcgaatattatatagatcagataaaacaggaaaaatcaaagtttaatgatgatgtggtaaaattttcaaatttttttatgaacaggggttaagtatttcatgatggctccgataaataatacataagtgataaacattatttagtaatcactatttaatctgtacagtaaagattagatattatataggagatttattatcaaggaggaattacattatggtagtacagcacaatctttcagctatgaacacaaacagacagatgggaacagtaacaagtgccctttctaagtctacagagaagttatcttcaggttatagaattaacagagcagcagatgatgcagcaggtctttcaatttcagagaagatgagaagccagataagaggtcttaataaggcttcatctaatgcagaagacggtatctctcttattcaggttgcagaaggtgcacttaatgaatctcattcaatcttacagagaatgaatgaacttgcaacgcaggcagctaatgatactaacacatcatcagatagaagtgctatacagcaggagcttacacagcttacttcagagcttgacagaatctactctactacacagtttaatacaatgaatcttcttgatggtgatttcacaggaaagagtcttcaggttggtgctctttcaggacaggttatcagcgtaagcattaagagtatgaaggcatcagctcttggcattgggtataatgcaattaaggttagctctaatgcagttgctgggcagtctatgtcacttattcagaaggctattaatagggtttcagaggagcgttctaagttaggtgctatccagaacagacttgagcatactattaataacctggatacaacatctgagaatacatcagcagctgagtctcgtatccgtgatacagatatggctacagagatggttgagtacagcaagaacaacattctcgcacaggctggacagtcaatgctttctcaggctaatcagcagacacagggtgttctttcactcttacagtaatatagaatatagtactttaggagctggagcttaacgataataatcgtagcttcggctccttttttgataaggagaatgtaatgatattattctatcagtggaatgcatttatgcagaaggggatggaaaatgcattaaagaagcttagaattgaatatgaagtgtattatgatatagctgataactgggataaggatgatgcatttgaaagaagatttattgacaggcttgagaaaggaaattattcgggtgttttatcggttaattatatgccgattatatctgacatatgtgagaagatgagaatcaggtatatttcgtgggtatatgattcgcctctgcatataaggcatctggatactatgaagaattcatgcaataagatatatttttttgacaggatgcaggcggaagaattcagaattcagggtgtagatggggcagagtatttacctttggcagctgacccggaagtgtttggtggagtacgctcatattatgatgagtatgtatgtgatgtatcactgcttggacaattatataagtcggaatattctgatttatgtggtggattaagtatgtataacaggggataccttgaaggaataatagcagcacagagtcagatatccggtgggtttataatagatgagatgctggatgagaaactggttaataatatcaatcttgattttagtaaggcaggagatggtgtattcaatgcatctagaagagaactttcatatactcttgctaaggaagttacaggaagacagagatttacagcattggcattgcttcaggacagatgcaatgttaatgtatattctaaagatgttgataaaagactggaaaaagttaatttctgtggatatgcagattattatacacagatgccggatatattcaggaagagccgtattaatcttaatgtatccctgtgtactattcagacaggaattccgttaagaattcttgatgttatggcatgtggaggctttgtattaactaatgcacaaccagaattatttgaatactttgatgtgggtaacgatcttgttgtttatgaagatatgaaagatatggttatgaaagttatgtattatctgaaacatgatgagaaacgtattagaatagcagagaatggtcacagaaaggttcgcgaaaagttttcttttgatgacaggttaaagacgttgttagaaatataggagaagtttatgagtggggaaaagatatcagtaattataccctgttataatgttaaggatatggtatcagagtgtcttgatagtattgtagctcagacaatagggcttgaacatctggagattattctgattgatgatgcatctgcagatgagactgtaagtgttttgaaaaaatatgaagaaaaatatccggacaatattatgcttgttttatgtgaaaagaatggcaggcagggaacagcaagaaatattggcttatcatatgcaacaggagattttataagttttgttgattctgatgactggattcatcctgacatgtataaagtacttgttgatattatgaataagaatgaatgtgatgtggtacagttcagatatatggaaacaaaagacaagcctgaagaaatgtctcgtgcaatagataatattgattacaagatagtagattattcatgcaatagaaaagaaaaattgttaaattcacagatacttaatgaatcatgtacaactaaattataccgtaaatcattaattgattgtgctaatgtaagatatgcagaaggagttgcatatgaagagcccatgtttacatatccaatgaaattctatgtgaacaaggtagcggttacagaaacaaagctttattattacagatataatgaaaaaggtacaatgttatcatatatgaataatccttctacaatggttcaacatcttcaggttcagcttaatgtttatttaacaatgctccaatcggatttttttaacgaatataaagatgagattgacttgtattttatacattctttttatgcggagacgttttactttatggcaggcagagggatgcctatgttagctgttatgttgcgctatatggcaaaaacggtaaaagaatatgtaccggattacagaaataatccgtatattggcttaccaggggtaaaagaggagatgaaaagccttgaattgattgataaactgaatctgactgataaagaattagagtattgtgcaagtgagtatatgaagggattgtcgttagcatagactaggtaattaatatatgaaaatattatattatacatggaatgagataataaaaacagatgtaatccagacatttataaaaatgggatatgaagtcagttcctttgaatatgagttaaaaagttatataaaagatgttgagtttcttgaaagattagaatctgaattaaatagggcaaatcagtctggaaaaggatatgattttattttttcgtgtaattttatacctctgatttctaagattgcgttgagaaataagacgccatatgtctgttggatatatgacagcccatgtatgactatgtattcggagatggtattcaatccttataattatatgtttcatttcgatttatcagaagttgaacgggtaaaaaagcttggggtttcacatatatatcatcttccattggcagtgaatattgagagagtgaacaatgttattaaacaagcaacaactgtaagctggaaatatgtaaacaatggtgttgcgtttatgggaaatctgtataatgatgaagtggattttattgaaagtatagcaggattaccagattatgaaaagggatatatgaaaagtctggaattagcacaacttacaatgccaggaacagatttgatagaagaactttttgatgattattataatcaaagactgaatagatatgtaagtttttcgaaagaaaaagaattttttattaaggacacggaactggcattaaatatgattaaaaagaatatttcatctatggaaagaatcaaaatgttagaaatactatcttcaaaatgcgatgtgacattatattctgattctaagaagcaatgtctgcctgcggtaagaaaaagaggatatattgattatatgaaagagatgccggtgatgtttgctaatagcaaagttaatcttaacataacattaagaaatattaagacaggcattccattaagagctttagatataatgggggcaggaggatttcttcttactaattattgttatgagttaagtgaatatatgaatgatggagatgactatgtaacattcattgactcagaggaatgttgtgacaaagcagagttctatattaagcatgatgagaagagaaagagaatagcaagaaacggacaggataagattataaaaatgtttacatatgataatcagatttctaaaatgatggaaatattaagaaaggaaatttcctgatgaatatacttatttttgaatataataattttggaacagaagatgttaaagaatgtcttgaaaaaaaggggtacaaatatactgttgtagagacagatgagtatagaaacagggtgagtccggaatttgacaggttgtttgaagagaagtttagcgagggaataaatggagagaaatatgattgcgtattcacatttaattatagccctgttatatctaataattgcaaggcaagaaatgttccatatatagcattagtttatgacagccctcaggttttgttgtattcgtatacgataattaatacatgtaattatgtgtttatatttgataaaactcaatatatggaattaaaaaaagagggtataaatactgtgtattatgttccattagcggttaatacagacagaatgaagagaatgtctgctgctcaggagcagaatagaagcagattcacagaggtatatggtggggatatagcatttgttggagcaatgtataatgaaaagcataatctgtatgataaattagatggtatatctgattttacacgaggatatctggattctgttatgaatgcacagagaaaagtgtatgggcatttctttcttgaagaggtgcttaatggagagattcttaaagatatgcttaatagtctgccactggagccaaataacgatggagttgaaacaatacaatatctgtatgctgattattttcttgcaagaaagatggctaatgatgacaggacagagattatgtcaaggcttggacgggattttggaaaagaatacatggttaatctgtttacatttaatgaaacaccaatgctgctgaatgtgaataacaggggacctgttgattattataatgatatgccatatatatttaataatacaagaattaatcttaatattacattgagaagtattaaatcaggaattccactcagaggaatggatgtaatgggagcaggtggctttcttatgtctaattatcaggctgattattatgactggtttgttccaggagaggatatggttatgtatgaatctgtagatgatcttagcgataaatgcagatattatctctcacatgacaatgagagaaaacagatagcagcgaatggatatggaaagatatcagagtttcatacttatgatgtaagatttaaagaaatgtttgatgttgtgttcaattagcattaaagcgttttctacccattaatgggcaggaaacgctttatctattatctgcaggacacggatatcatatgtgtgatattttttaattgtttcgtaaccatgccttgctatttcttttctttcgtcatcatgttcaaggtagtatgaacataattctttcaaatgtgtttcgctttcataagctacaaggtctttgccaatttcaaagaattccggaagttcagcctgataattggttataaggaaaccgccacagccaagaacatcaaatattctaagagataatcctgagcggattgattttgcagtgatattgatattgattttgctgttattaaatataagcggcatctctgtcagggattttgcaaaacccctattatgtatatcaggcatgcctgaagtatcgcttccggtgtatatatcgacgttgaaattatcagacagcatgcgcaacattctcaaacgttcctgttcggcaacttttacacttaaatagtattgtgcaacaagtgctttgatgttttttcgtgagctggcaggaaattcataatggtcaggtatgctttcaagaagtttttctgccatatcttctgttagcatgctttctataaaattaaaaccatacacaccaatctgtgcattaataattccgtcaacaaaacctctttcataatcggaaagtacagcgttattaaatggacatttttcctgataggttgagccgatgaatgatatgtcgctggcatattttttcttatcagaataagaagcgagactgattatttcgtcggttcttgaagtgttagctgcgagcggcatatgaaaaatgtgtcctttgttgtactgttcgaattcttcataaagcattttgtcaaaaagaaatatcctgtttacaggattggaaatagcatttgaatataattcaagaacaggactgtcaacgataaggcttatatatgttatgttaagaagctggcatatatctgaaagccatggaaaaaagttgattgtgaatgcaaatgcgaatcctcctttagtaagcacagaagaggcaagtgccgcactttcggatggtatgattgatttattatatatctcagcactttcttcaacaatctctaatccgatgcgtttaaaggcatctattatatcaggctcacagagactgccatatctgtatatgtatattttcataagtatccccttttacaaaatatttatgtaaactattatatattaactaggttggcaattgctatggcaaatgttataattttaattagtttataatgtgttcagataatatgggggaattggagtgaaaaaactaagtattgttgtaccatgttataatgttgaaaaatatattgacagatgcgtgaattctttggttaatcagacgctttcacattcagagtacgaaattatccttgttgatgacgcatctgctgatgatacttggaagcatattactgattgggaacagagattccctgaacttataatggctattcattgtgatgagaatggaaagatgggtaaggcaagaaatattggagtttcttatgcttcgggagagtatataggttatactgacagtgatgactgggttgaacctgatatgtataaaacattgcttgatgaggcgtatgcaggtaatcaggatattgttgtatgccgatcaatgcgtgatgcaggtaatggcataattgataatcctggaactggttcagtgaagaaaatatatatagatatggatagtaagagaagagagctgcttgtaaccaatgaaatgagttatgttgtatgggataagataattaagcgggatttgttattaaacaataatattgtttttcccgaggggattgcttatgaggatatatattatggaacgctgcttcatgtatatgccagacgaattgcctttgtagacagaattttttatcattattatgtcaatcctaagtcaactgtactatctaagaatgctgaatatcataaggatattatgatttctaatatgcttttgtataaacaacttaaggaaaggggagtgtgggattgttttcatgatgaacttgaactggatttgttgtttacatggtatctagggactatgaaggtgatttgtttaaggtatgaaaaacctccatatgatatgtatattcagttaaagaatgatgtacttgaggcaatgccaggatgtgttaataatccatatattaagacaagcatgaaagagttttatcagctattagttgaacttctggattgtgatgttacacctgatatattatatcaggtggcagacaattttagaaaagtgtaatatgtatatggcaatgttgttattttttaaagaacggagaaaatcatgacagataagaatacattttataatatgttaaagagtaatgccgagagccagccagacgctgtggctgtcgtttatgatacgatgaaggttacttatgcgaagctatttgatgatgtaactaagaaggcattacattttcagaaatttgaaggaaagaggattgcaatattcgggccggcttcatatagatggatcgttaatatgttcggaacgattgttgcgggaaaggagcttgcacttgttgatttcttccttcctcatgattcgagggttgaccttcttaagaagacggaagttaattatacactgacatctactaaccagtatattctctctgatgagaattctattatcatatcaagtgctgagaaggataatgttgacggacttatatatgatgagaatacgcaggagggcgatattatcatgtttacggctacagctaatgaatgtgataagccggttgttctgtctgttgataatattcttaatgctgttatggctataaacagcagggttgaatgtacaagtgatgatattgtgcttgcacagatttcgcttcataatgaatttggatttatatacagcctcatatggcctctgtataatggtgctatggtgtgtataggcagaggcttaagacatgttgatgcagatacttattattataatccaactattcttataggtactccttctatgattgactatcagcgagctataagtgggtttaataaagaactcaatactattatcataggtggtgcaagctgcccgttcagactttttgagaatctctgtgacagtgatttgaaggtttataatatatatggaatgacagagacttcgggttgtgtaggggttaatgagctttacgatggttcgtatactctttttgataataatgcagtatctattgctgatgatggagagattattgtaagtggaccatgtgtcatgaaaggctattataatgacgtggagtctactgaaaatgtattaaaagacggtatgtatcatacaggtgattacggaaggattaacaatgccggcagacttgttctgttgcagcgcaatccggatattattctgttgcctacaggtgagaagataagccgtgtaagaactaatgaacagattacagctattaatggagttgcagaaggttttataatattttacaataacaggcttacggcggttattgtgcctattgataagagtgcaactgaggatatattcaagagacgtattgacaagtataacgagaaaaaaggttaccgctgggagattcagaagattgtgttaagaaaagaacctttgccaagaaagtctgatggcacggttgatgaggaagctgtatgcgagtttattggtgattaatattaactttccaccaatccagccgatatatattctataagttcataaagaaaggtgattagaatcatggatgattacagacagcagcagatagatgtacttaaggaagctgttccttacagcgagaagcttattggagcaatagagaaagtttcagaagaactttcaggagttccttttccagagactcatgatgcggtgaatgttattattgaagggcttaactggctttttgaagtatataatggaactaaggatattattgaggctggggcagttgacgaggcagaagctaattctggtgttaaggagctttcagaggctgtaaaggctgatgatgatgtgactgtttctaaagcgcttgtaaggcttagtacatttgttaagcagttacatgatgcaggaagcagactgattaatgaataataagaaacataaaggcatccgccggtttatgtattacatgaaccagacggatgccttattttatattatggtagttagatatagccattaaacatcatgcctgagtaggcagaaagattataagggtcattcacaggcttatgtggattcttataagcgacaatcttattgtttacatagttcatagggttgatggagatatcatcagcctttctttggattgatttcttgaatgaatccaaagcgttaaatacatcggaaagtgtgccgtcagaagcagctttctgaataaccaccttattaacttcaagcgaaccctcatcacttactgtaagtccattgcgttcaagctgtggctggtaagccttcattattcttgaaaattctttctttaacttggcattgccctcaaacttatcgttctctttatctgcggcgatggaaacaagtctgttgtagccggaaacaagttctgtaatgctttctgtgattgaatcagcatcatctttaagactgatggttgccggcttgtcagttgtattatgaaatgatattgcaaatgttttgttaattgttatgtcattcgaagcagatgagcgttcttctccattgacagaaaagattgcattgccaggatactgtgttacacggtcaagaccatatgtttcaatgaagttagtgttcttctccatagtaggctcatcaaaaccttccacgaaatcaggattgtctgtctgaatatcgttattaggcctgatgttaaatattgtaggcttgattacacttacacctgtcatgtctgattcaatgttcagcgcagtattgccgaggctgtcttcacttacagaagcattaagtccgatattggaacggttaataagtctggcaagcttgttctgtatgtcagaattgctctcttcttcatctacattaaactggaattcataggtcagattattgatgttcaaatcaaatgaataatctcctggcttaactgtgcggctgttaggctgcaggtaatgtccggtattaatctggcttgttgcaagctggcggacttctatatcaaggcttgtatcatcggcagatgagctgtcgcctataaatgtggctgttaccgcatcaggattgtctgacactgctgatttcttaaataccatgccgtgaccgtcgcttcctgaaagctcattggcaatgttacttaattctctggcattctctttaaggtcgattgcatatttctgcgcagcctctgacatatctgccttatatgtaggagtctgactgttagatttcagaactctgccatatgtattctttaattgtgctttagtgtgtgtatcgtactttgagttagtcttatgtccatactgggcaagataatagctgtacacgctgctgatcataacagtcacctccttgtctgtaataatcggtagaaaatgtaaggaaatccatttccttatatatatcgtatgtttttgtacaaatattataatatgaagttcattttttgtcactatattttctttaaaaaagttgttgacgagttggaatgtactgtgctatattagaacggctatggaagcggtcttttttgcgtgcctgaatttcaacaacccaacattgattaggcgggcaaagaaaccaattggtgttttaacacctacaaaaataataattggaggtggaagttgtgcgagtaaagataacattggcatgtactgagtgtaaacagcgcaattacaacatgactaaggaaaagaaagctcatccagacagaatggaaacaaagaagtattgtaagttctgtaaatcacacacattacacaaggaaacaaagtaattagtacagtgaggagtatttcatgggtgatactgtaaaagctaagaagcagaaaaagaactggttcaaaggtttgaaagctgaattttcaaaaattatttggccagaccgtcagtcgcttactaaggaaaccgtagctgtattggctgtgtccgtattattaggtgtaatcattgcagttgtggatttaattgtccgctttggaattgagttcattgtaaaataaggaataggtgattgtatggatgacgcaaaatggtatgtagttcacacttactcaggttatgagaacaaggtgaaggctaacattgagaagacagttgaaaacagaaatcttcacgatcagattcttgaagttatcgttccacttgaaacagtagtggagattaaggatggctctaagaaagctgctcagaagaaaatgtttcctggatacgttcttgtgaagatggtaatgaacgacgatagttggtatgttgtcagaaacacaagaggtgttacagggtttgttggtcctggatcaaagccagtaccacttacaccaacagaaattaagaatctcggcataagccttgaggaagaacaggaagttaagcctgttatccagttcgctggcaaggtcggcgataaggttatgatcctctctggtgcatgggaagatacagttggtgagattaccaatattaatgagggcaagcagtgccttacaattaatgttgagatgttcggtcgtgaaacaccggtcgagattgatttcacagatgtgaagttattgtaagaagcagtcccgatcctgggacgtgggagaccaaaatgaattagcttcgctaattcatttgcaagaatcacctaaaggtgattcttgggagatggatagcgggtaatattatgatggtcgccaattaccacatttatttttaggaggtgccaaaatggcaaagaaagtaacaggatatattaaattacagattcctgccggcaaggctacaccagctccaccagttggtccagcacttggtcagcacggtgttaacatcgtagaattcacaaagcagttcaatgctaagacagcagatcagggagatcttatcatacctgtagttattacagtttatgctgatagaagcttcagctttattacaaagactccacctgcagcagtacttcttaagaaggcttgcaacattaagtcaggatcaggcgtacctaacaagactaaggttgctactattaagagagcagaagttcagaagatcgctgagcttaagatgccagatcttaatgctgcatctatcgaagcagctacttctatgatcgaaggaacagctaagagtatgggtatcgttgtagaagactaatctacatttgattcatgattattgtgggaggaaagatagaatccttccgatattaccactaggaggtttataatgaaaagaggaaagaaatacgttgaggcagccaagaatattgaccgccagacattatatgaagcagcagacgctatctcattagtaaagaagaacgctactgctaaattcgacgagacaatcgaagcacatatcagaacaggttgtgatggacgtcacgctgagcagcagatcagaggagctgttgttcttccacacggaacaggtaagactgtacgtgtattagtatttgctaagggtgctaaggctgatgaggctcttgcagctggagcagatttcgttggtggcgaggagcttattcctaagatccagaacgataactggttcgagttcgacgttgttgttgcaactccagatatgatgggtgttgttggtcgtcttggtcgtgtacttggtcctaagggattaatgccaaaccctaaggctggtacagttactatggatgtaacaaaagctgttaatgatatcaaggctggtaagatcgagtacagacttgacaagactaatatcattcacgtgccaattggtaaggcttcattcacagaggagcagttatcagacaacttccaggctattatggatgcaatcgttaaggctaagccatcttcacttaagggagcttatcttagaagtgtagttctcacttctactatgggacctggtgttaagttaagcacagccaagtatgtgggttaatcagatttttgattaaaaacggttgacattaatatattttgatagtatactatcagcttgtgagcagcattttgctgttaacataatattttgccgtagacagcaggtccggattcagcattactgatgatggttaaaggtaacacgcctaccgaggatttaaggatttgattaattattccctctctgtcgctggcagagagggttttgtttgtagggaaactatagacgaataatcttcacttaggcaaaatcgcttctatatgaagcaagaatctaacaggaggtaattattcatggctattttaaagaatgtaggccttaagacatctactatcgatgagattaaagataactttgacggcgctcagggcgttgttgtagttaactacagcggtcttacagtagaacaggatacacagcttcgtaagcagttaagagaagctggtgtggtttataaggtttataagaacactttagtaaagagagttgttgctggaacagagttcgagccaattactgatactcttgaaggaactaatgctattgcattctgcaagacagatgctacagcacctgcaagaatcttagctaactttgctaagacagctaatgctcttgagttaaagtgtggcgttgttgaaggaacattctacgatgcagcaggtatcgctacaatcgctactatcccttcaagagaggaacttctttcaaagttacttggaagtatccagtcacctattacaaactttgctcgtgttattaagcagattgctgagaagaacgaggaagttgcttaatcagtttaacactgaattaactatgaaagcagcatagatgctctttcgattttagaataatattaaaaaggagattataataatgacaacacaggaaatcattgaagttattaaaggtttatcagtattagagcttaacgatttagttaaggcttgtgaagaagaattcggcgtatctgcagcagcaggcgttgtagttgcagcagcaggtgctggcgcagcagcagctgaggagaagacagaatttgatgtagagcttacagaagctggagatcagaaggttaaggttatcaaggttgttcgtgaaatcacaggtcttggattaaaggaagctaaggacgttgttgatggcgcacctaaggttgttaaggagcaggcttctaaggaagaggctgaggaaatcaagaagaagcttgaagaagttggagctaaggttactcttaagtaattcacttgattgttctaatgaatataataagaaagacagcgggccttcacggctcctgtcttttcttttttctataaatcacatctttattttattatgccagctatggcagaaacactattatctttatacaattctgaatattcatggaaattttcaaaaatcccttgacatatatatatctttgatgtactatggacaatgcactattgtggtaaattgtgcttattctttgcacatttactgataatgtaatatattaatgtgaagaaaactaaggggtgaaacgtcaatggagaaaaacagattacgcccaataacgtcgggcaaggcaatgcgtatgagtttctcaagacagaaagaagttcttgagatgcctaaccttattgaggtgcagaaggattcttaccagtggtttttgaatgaaggcttgaaagaggtctttgatgacatatctccaattgcagactataatggaagattaagtctggaattcgtagattttgcgttatgtgaagacgaagttaagtattcaattgaagagtgtaaagaaagagatgctacatatgcagcgcctcttaaggttacagtaagacttcataacaaagagacagaaagcatcagcgagcatgagattttcatgggagacctgccattaatgactaagacaggtacatttgtaattaatggtgctgaacgagttattgtcagccagttggtacgttcacctggtatttattatgatatacagaaagataagtatggtaagattttcttgtacagctgtcaggtaattcctaacagaggtgcatggttagagtatgaaacagatgctaatgatatattctatgttaaggttgaccgtaataagaaggttcctattactgttcttatcagagcattaggatttggtactaatgcggagattcttgatatttttggcgaggaacctaagcttcttgctactatggagaaggatacttctactaactatcaggaaggtattcttgaactttataagaagttaagaccaggagaaccattatctgtagagagtgctgaagcacttatttcaggtatgttctttgacccaagaagatatgatcttgcacacgtaggaagatataagtttaataagaagctttctttcaagagcagaattacaggacaggttcttgctgaggatgttgttgatgagaacggaactgttattgcaacagcaggtgagaagcttacaagagaatcagcacaggctattcaggatgcagctgttccttcagtattcattactgtagaagttaaggctgctgatggtacagtatctgacagagttgttaagattctttctaaccgtgcggttgatattactaaatgggttgatatcagcgaagaagaagctaaggagcttggtgtaacagagtatgtatactatcctgttcttgcacagattcttgctgagaatgaatctttagaggatattaaggaagctattactaagaatattgctgatcttattcctaagcatattacagtagaagatattcttgcttctattaattataatatgcaccttgaatatggtgttggtactaaggacgatatcgatcaccttggaaacagacgtatcagagctgtaggagagcttcttcagaaccagttcagaattggtatctcaagaatggaaagagtggtccgtgagagaatgtctacacaggatcttagcggaatatctccacagtcacttattaatattaagcctgtaacagctgctattaaggaattcttcggaagttcgcagttgtcacagttcatggatcagaataaccctcttagtgagattactcataagagacgtctttcagcccttggtcctggtggtctttcaagagatcgtgcaggtttcgaggttcgagatgtacactatactcattatggtagaatgtgtcctatcgagactcctgaaggacctaacattggtcttattaactctcttgcatcttatgcaagaattaatgaatatggattcgttgaagctccttatcgtattgtagataagtctgatcctaagaatccaagagttactgatgaagtgcgttacttcacagctgatgaggaagatgatttccatgtagcacaggctaatgctgagattgatgagaatggttatttcgtaagaaatactgtatctggacgttacagagaagaaacttctcagttcgataagagccagattgatcttatggatgtatctcctaagatggtattctcagttgctacatcaatgattccattccttcagaatgatgactgtacacgtgccctcatgggttctaacatgcagcgtcaggccgtacctcttcttatgacagaagctcctgttatcggaactggtattgagaataagactgctgttgactcaggtgtatgtgtagttgcagaggctgatggtgttgttctttcttctgaatctaacaagattgttatcagagaaaaggatggcaaggcgcgcgaatacaagcttactaagttctcaagaagtaaccagagtaactgctataaccagagacctattgttttcaagggtgatgaggttaaggcaggagatgttattgctgatggtccatctacatctaatggtgagattgccctcggtaagaaccctcttatcggtttcatgacttgggaaggttataactacgaggatgctgtacttcttagtgagcgtctcgtaagagatgatgtgtatacatctattcatattgaagaatatgagacagaagcaagagatactaagttaggacctgaagagattacaagagatcttccttcaacaggttcagacgctgtaaaggatcttgatgagaacggtattatccgcgttggtgctgaggtaagagccggagatattcttgttggaaaggttactcctaagggagagacagagcttactgctgaagagagacttcttagagctatctttggtgagaaagcaagagaagtaagagatacttcacttaaggtacctcatggtgcttatggtatcgtcgttgctgttaagacatttacaagagagaacggagatgaactctcaccaggagttaacaaatctgttcgtatatatattgcacagaagagaaagattggcgttggtgataagatggctggtcgtcatggtaacaagggtgtcgtttcaagagtacttcctgttgaagatatgccattccttcctaatggccgtcctcttgatatcgtacttaacccactgggcgttccttcacgaatgaacattggacaggtccttgagattcatttgagtcttgctgccaaggtacttggatttaacatttctacaccagtattcgatggtgcagatgagaatgatattatggatactcttgatatggcaaatgcttatgctaaccatccattcgatgatgaagagcttgcagcccagaaggctgaggctgagaagaatggcgaagaatatcctgaggatatggttacatttacagcacagtataaagatgttcttaataaagaggtatttgattacctttcagaacacagagatcacagagctgagtggaagggtgttccaatcggccgtgatggtaaagtaagacttagagacggtagaacaggtgagtacttcgacagccctgtaactatcggattcatgcattacttaaagcttcatcatcttgttgatgataagattcatgcacgttcaactggtccttactcacttgtaactcagcagccacttggtggtaaggctcagttcggtggacagagattcggagagatggaagtttgggcacttgaggcttatggtgctgcttatactcttcaggaaatccttactgttaagtctgatgatgttgtaggacgagttaagacttacgaagctattattaagggtgagaatattcctgaaccaggagttccagaatcattcaaggttcttcttaaggaacttcagtcactcgcacttgatgttagagttcttgatcaggacaacaatgaagtcagacttcttgagagttctgaatatgaagttactgatttcaagaaggttcttgatgaaggtaatggatacagaagaaacagcagagaggaagaggcagagtacaaggctggcggtatgtcaacagttactcttaatgaagatggaacagaagatgctgtagattcagatgatgaagctgattttgatatggccgatgattttgatgatgattacggcgatggcaattcagatgaatattaattagaagggagcactataatggcagaagaaattaaatcaaataagtcaatgaaatttgataagattcagattaagcttgcttctcctgagaatattttggagtggtctcatggtgaggttaccaaacctgaaacaattaactatagaacacttaagccagaaaaggacggacttttctgcgaaagaatatttggtcctagcaaggactgggagtgccactgcggtaagtataagaagattaaggacaagggtattgtctgcgataaatgtggtgttgaggttactaaggccagcgtaagaagagaccgtatgggtcatatccatcttgctgcaccagtatctcacatctggtacttcaagggtattcctagccgcatggatctcattcttgatattggtcctaagaaccttgaaaaggtattatattttgcttcatatattgtaattgatccaggtgaaacagatattcctttcaagaagattctttcagagactgaatacagagaactctgtgagcagtacggaagcaaggctttccgtgttggtatgggagctgaggcaatcctcgagctcctccagatggttaaccttgaagaagaagaagtaagactcaaggaagaacttgctaacactacttctcagaaggctgccagacttataaagagaattgaagttgttgaagcatttaagaatgcaggaactaagcctgagtggatgattcttacagaaatccctgtaattccaccagatttaagacctatggttcagcttgatggtggacgttttgcaacttcagatcttaatgatctttatagaagaattattaacagaaataacagacttgcaagacttcttgagcttggagctcctgaaattattgtacgtaacgagaagagaatgcttcaggaagctgttgatgctcttatcgataatggacgtagaaatggtcgtccagtaacaggtcctggtaacagagctcttaagtctttatcagatttattaaagggtaagcagggacgtttcagacagaaccttcttggtaagcgagttgactactcaggacgttcagttatcgtagtaggaccagaacttaagatttaccagtgtggtcttcctaaagagatggctattgagttattcaagccatttgttatgagagagcttgtaagacgtaatcttgcagataatattaagaaagctaagaagagcgtagaacatcttgagccagaagtatgggatgtacttgaagacgttattaaagagcatccagttatgcttaaccgtgctcctacacttcacagacttggtattcaggctttcgagccaatacttgtagaaggtaaggctattaagcttcatccacttgtatgtacagcgttcaatgccgatttcgatggtgaccagatggctgtccatcttccgctttctgttgaggctcaggctgagtgtagatttatgcttctttcacctaacaaccttcttaagccatctgatggtggtcctgttgccgttccttcacaggatatggtacttggtatttactatcttacacaggaaagaccaggcgcaaagggtgagggtaagatttttaagagcattaatgaagcagttcttgcttatgagaatggtgtaattacattacatgccaagattatggttcatgtaactaagaatgttaacggagaagagctttcaggtaatattgagtctacacttggaagacttatatttaatgagattctccctcaggatttaggatatgttgacagaagcaaggaagagaatttattacttccagaagttgatttccatgtaggaaagaagcagcttaaagatattttacagcatgttatcaatactcatggtactacaacaactgcagaggttcttgatgatatcaaggctatgggttataagtactctaccagagctgccatgactgtttctatttctgagatgacagtgccaccagttaagaagcagcttcttgctgaggcagaaaagaaagttgaacagattactgttaaatataacagaggtcaggctactgacgaggaaagacataagaatgttatccgcgtatggcaggagactgatgataagattaaggatgcccttcttcagggtcttgataaatataacaacatcttcatgatggctgactcaggtgcccgtggttctaaccagcagattaagcagttagcaggtatgcgtggtttgatggctgatacatcaggtaacactatcgaacttcctatcaagtcaaacttccgtgaaggtcttgatgttctggaatactttatttcagctcacggtgcccgtaaaggactttcagatacagcccttcgtacagccgattcaggataccttacaagaagacttgttgatgtttctcaggatcttattatcagagagacagattgtagcgcaggtaagcagatacctggtatgtatgtttactcatttgttaataacagagctactaactcaagtgatgccaaggaagatatccttgagccattacaggagcgtattacaggaagatacttagctgaggatattgttgacccggctacaggcgaggttattgttgaagctaaccatcttgtaactcctaagagagcagaagctattattaagactggtgttgataaggttaagattagaacaatccttacttgccgttcacacattggtgtatgtgctaaatgttatggaactaacatggcaactggtcagactgttcaggttggtgaagctgttggtattatcgcagcccagtcaatcggtgagcctggtacacagcttactatgagaacattccatacaggtggtgttgccggtgataacattactcagggtcttcctagagtagaagagcttttcgaggcaagaaagcctaagatgcttgctgtacttgctgagtttggcggaactgtaagtattgttaagactgagaagaagactgaaatcgttataactgacgatgaaggtaattcaaaggcttatccattatctaaggatacaagagaaaaggttgttgaaggacaggttgttgctaagggtgaggaaatcacagagggttctgagaatccacatgatatcgtaagaattcttggtgtaagagctgttcaggattatctccttcgtgaagttcagaaggtttaccgtatccagggtgttgatatcaatgataagcatattgagcttatcgttcgtcagatgcttaagaagatagttgttgatgaagctggagattctaagttccttccaggatcacaggttgatacaattgagttccaggaagttaatgagagacttgaggaagaaggaaagacacctgctacaggtactccgattatccttggtattactaaggcttcacttgcttctacatcatttatgtcagcagcttcattccaggagactactaaggttcttactgatgcagctattaacggaaagattgatcctcttattggtcttaaagagaatgttattattggtaagcttatccctgccggtacaggtatgaagcgttatcaggatatcaagatcagttctacagataactacatcgaagaggatgaggaagaatctggtgaagatgagcttgtgttcacacaggaagattaattcattaatataatatcaggcgtgtcaggttgtaataatctggcacgctttttattttatttttttgaaaaaatgcttgacactgaatttgcaaatatatatactaataaagcgtgcgaataggcaagtactatttttgcgctgttttggtgacaaaacattttcttagttgatactaagatgcaaccattcattattctaatttcgggaggtgaaaacggaatgccaacatttaaccagttagtaaaacagggaagaaagactgcagtaaagaagtctacagcaccagctcttcagaagggttacaactcacttcagaagaaggcaacagatatctcttctccacagaagagaggtgtttgtacagctgttaagactgctacacctaagaagcctaactcagctcttagaaagatcgccagagtacgtctttctaatggtatcgaggtaacatcttacatcccaggtgagggacacaatcttcaggaacacagcgttgttcttataagaggtggaagagtaaaggatttaccaggtacaagataccacatcatcagaggaacacttgatacagcaggtgttgcaaagagaagacaggctcgttctaagtacggtgctaagagacctaaggacgctaagtaattaagcctgaattaagacacgcatttatatgaatgcatgcaagttttacaatttgcaagagtcagatttgtaagaatctgatttttacgaacaaattaaattttgaattgtgccggaattagattaatcaagaggttgcaggttaatatatacggcgcgaacacattttttatttgtgagtacctatgatttaataaatttattaaggagggaagaaccgtgccacgtaaaggacatacacagaaaagagatgtattagcagatcctatttacaacaataaggtagttactaagcttatcaacaacattatgcttgatggtaagagaggagtagctcagaagattgtttacggtgcttttgatagagttgcagctaagactgagagaccagctatcgaagtatttgaagaagctatgaacaatattatgccagttcttgaagttaaggctagacgtatcggtggagctacttaccaggtacctatcgaagttaagccagacagaagacaggctttagctcttcgttggatgactacattctctagagcaagaggcgagaagactatggaagaaagactcgctaacgaaattcttgatgcagctaacaacacaggtgcatcagtaaagagaaaagaagatatgcacaagatggcagaagcaaacaaggcttttgctcattacagattctaattataattataggaggttttatccatggctggaagagaatatccattggagagaaccagaaatatcggaattatggctcatattgatgctggtaagacaacattaacagagcgtatcctttattatactggtgttaatcacaagattggtgatactcatgaaggtactgctactatggactggatggcccaggagcaggagagaggtatcacaatcacttcagctgctacaacatgtcactggacacctgagaaagagggtaagccagataagacacagccagaataccgtattaacattatcgatactccaggacacgttgacttcacagtagaagttgagcgttcacttagagtacttgatggtgccgtaggtgtattcgatgcacagaacggtgttgagccacagtcagagaatgtatggcgtcaggctgataagtacaatgtacctcgtatggctttcatgaacaagatggataagatgggtgctgatttcttcggatcatgcaaccagcttattacaaagcttggaaagaatcctgtacttgtacagattcctatcggtaaggaagatgacttccagggtattatcgacttattcgagatgaaggcttatgtcttcaacggagataagggtgatgatatcgctgttggtgagattccagacgatttaaaggatcaggctcaggaatatcatgacaagctcgttgagcagtgtgctgaacttgatgaggaccttatggagaagttctttaatgatgaggaaatttcagttccagagttaaaggctgctttaagaaagggtactatcgagggtacagctattccttgtctttgcggtacagcttataagaacaagggtgttcagaagcttcttgatgctgttatcgagtacatgccagctcctacagatatcccagatatcacaggtgttgacgaagacggtaacgaagtaacaagaaagtcatctgatgaagagccatttgcagctcttgcatttaagattatgactgatccattcgttggtaagttagcattcttcagagtttattcaggtacattaaacggtggttcatatgtacttaactctaataagaataagaaagaaagagttggccgtatccttcagatgcacgctaaccagagaaaagaaattgataaggtttactcaggagatatcgctgctgcagtaggtcttaaggttacagtaacaggtgatactatctgtgatgaagcacatccagttatcttagagtctatggaattcccagagccagttatcgagcttgctatcgagccaaagactaagaatgaccagggtaagatgggtgaagctttagcaaagcttgctgaagaagatcctacattccgtgctcatacagatcaggaaacaggtcagacaatcatcgctggtatgggtgagcttcaccttgatatcatcgttgacagacttcttcgtgagttcaaggtagaggctaacgttggtgcacctcaggttgcttacagagagtgctttactaaggcagttgatgttgatagtaagtatgctaagcagtcaggtggacgtggtcagtatggtcactgtaaagtacgtttctcaccacttgaagctaacgttgataagtttgatgttgagacaaagaacacagtattaattaacgaacctccagtactcttctgtgagtcttcagtagttggtggtgctattcctaaggaatatatcccttcagttgctgacggtatcagagaagctgctaattcaggtatcttagctggattcccagttctcggacttagagcagatatttacgatggttcataccatgaagtcgattcttcagaaatggcattccacattgctggttctatggcattcaaggatgctatggctaaggcagcacctgcccttcttgagcctatcatgaaggttgaggttactatgccagaagaatacatgggtgatgtaatcggtgatatcaactcacgtagaggacgtattgagggtatggaagatatctcaggtggtaagatgattaaagcattcgttccacttgctgagatgttcggatatgctactgaccttcgttctaagacacagggtcgtggtaactactctatgttcttcgataagtatgagcaggctccaaagtctgttcaggataaggttatttctgatagaaataagtaataactataaaaatatagttgaaatatttcactaaatgaaatataataaatatcagctatgacaaagcccgagggggatacccctcagggcaatctaaatatttttaggaggattttaaacaatggcaaaggctaaatttgagagaacaaaaccacattgtaacattggtacaatcggacacgtagatcacggtaagactacattaacagctgctatcacaaagactcttcatgagagacttggtacaggtgaggctgttgcattcgagaatattgataaggcaccagaggaaagagaaagaggtatcactatctctacagctcacgttgagtatgagacagagaagagacactatgcacacgttgactgtccaggacatgctgattatgtaaagaacatgatcacaggtgctgctcagatggatgcaggtatccttgttgttgctgctactgatggtgttatggctcagacaagagagcatatccttcttgctcgtcaggttggtgttccttacatcgttgtattcatgaacaagtgtgatatggttgatgatccagaacttcttgaattagtagatatggaaatcagagaacttcttaacgagtacggattcccaggagatgatactccaatcatccagggttcagctcttaaggctcttgaagatcctaacagcgaatggggtgataagatccttgagcttatgcatactattgatgagtatgttccagatccagaaagagatacagataagccattccttatgcctgtagaggacgtattctctatcacaggacgtggtactgttgctactggtagagtagagagaggtgttctccacgttaatgaggaagttgaaatcgttggtatccacgaagatatccgtaaggtagttgtaactggtatcgagatgttcagaaagcttcttgatgaggctcagccaggtgataacattggtgcacttcttagaggtgttcagagagacgaaatccagagaggacaggttctctgcaagccaggttcaatcacaccacaccacaagtttacagctcaggtttacgtattaacaaaggacgagggtggacgtcatactccattcttcaacaactacagaccacagttctacttcagaacaactgatgtaactggtgtttgtgagcttccagctggtacagaaatgtgcatgcctggtgataacgtagagatgacagttgaacttatccataacgtagctatggagcagggtcttcgtttcgctatccgtgagggtggtagaacagttggttctggtgctgttgcaacaatcatcgagtaattgttattaatacagttctttcaagggtttccgagtttatcggaagcccttttttgtgcgggctgctccttgagaagtcatggaaatttagcagtcgtgctcgcgaagtaatgaactagaatatgataaaaagaggagtacaacatgctatacataatgcgtcatggcaggacggactggaatgtgcgtcataaattgcagggaagaacagatataccgcttaatgatgagggcagaatgatggcggcagaggctgggaaacggtatgcagatatacattttgacatatgttattcatctcctttggaaagagcaaaagaaacggcagagattttcttgaagggaagaaatgttcctgtgtatacagatgatagacttgttgagatgggatttggagtatatgaaggaatagagaattcatttgctatagatgactgtccgattaatactctttttaagaagcctgagaagtatgttacggttgaaggtggagaaagctttgaggagcttttcgcaagaacaggagagtttatagacaatgtggttatgccacaggttaatagtggtaaagatatactgattgttggtcatggtgcaatgaactgcagtattatagcaaaattcagaggaacaccactggataaattctgggatggaatgactgataattgtcaggtggtaaagcttatataatattataaaacacaatttttacgatttattcagaccaaatcatgctaggtttcgtatataagtatagaagttaataaatgagactttgacttacaacggaaggttaggatggtgattgggatgagtaggagagatggcaggacaaaatacaaaagaagaggaaaaaggaagaatcaaatattccttgtaatgatgactatactggtatgtacggtagcaattgtattaacagtaaagatgaataatcagaatgtcagcaaaggtgtagcagtaggtgcagaatatacagcgattaagagcgatggtaatgtgacggaggaacagctttctgtaagtgaagagactgtaaatgatttaccagatgtatacagaatagaatgctatgaatcgcttaatcagaatccagagctgccaacaggatgcgagattacatcgttaacctccgtactgaattattatggatgtaatgttgataaaacaactatggcagatgaatatcttaagaaaggcaatggcagcttctacgaaatgtttcttggtaatccaagggataacacaagttatggatgcatgtcacaaccaattgttaatgcagctaataaatatttcaaagttaataatatgtcagcagttgcaaagaatataagcggaacagattttaaagagattctaggtatggttgctcagggtgacccgatagtaatatggaatacaatagatatgagacagccacatgaatctaagacatttgtatttaatgggaaagaatatacatggatgtctccagaacattgtgttgtaattacaggatatgatcttaataagaatattgtttatataatggatcctatggaaggtaacataacaaggaatcttgagacatttcaatcaagatatgaagcgatgcacagccaggctgtctatattatagaataattaagggagggcaatattgtcctccctttagtcatgttattagtttgatttaatattgtgccttgcattaagtttcttggcacaatgtatgaatgcagggaataaaaatgcgtcagcagcaatccatgcgattggtgaggcgaggcatgcccccatgaatccaatatttggaataagtatgatggctgcaaatgcacggccaatcatctctaagataccagctgatattgcaaatactgagaagcccataccttgtatgcagaagcggactacgttaacacctgtaagcggaatgtagaagcatgcagatgcaaggatgaactgtcttgtaagagcaattatggttgtctctgatgcattaacgaataataatgcaatataatctgtagtgaaatacagtgcaataagagaaagaacactgtatactgaaccgattatcatagcggagcgtacgccctgaccaagtcttttaatcttggcagctccaacattctgtccggcataggttgccatggttgagccgagtgcatcaaatggacaacaggtaaagttgaacatcttagaaccggcagtcattgcggctacatatgttgaaccaagtgtattgacagcagcctgaaggattgtacttccgatggctgttattgaatactggagtcccataggaacaccgttcatacacaggttggtgatgaatcttctatcaagtaccctttctgatttgtcaccttttaagatgtcatatttcttatacatatatataaggcaggtaagtcccgaaattaactgtgatgttacagttgcccagccagctccggcaacacccatcttacatacaagaataagaaagaaatcaagtactacatttattattgaagaaagcacaaggaaaactacaggtgtcttactatcgccaagcgaacggataacaccagataccatgttgtacaggaatacagttgggattcctatgaatataactactatgtaattataggcatggtcaataatatctgccggtgtattcatgataataagtatcctgcggcagaatattacggatgcaagcgtaagcactatggcaaacacaatactgcagatatatccgttaaatacatattttctaaggtcagcaggtttctttgcaccaaagcattgggcaaccggaatcacgaatccgttacagactcccatacagaaaccgattatcatgaagttaatagaacctgttgctccaactccggcaagagcttcaacaccgagagttttaccaacgattattgtgtcaacaaggttgtagaactgctgaaacagcattccgaacagcattggaactgcaaatccaagaatatgcttggaaggcgaaccatttgtcatgtcttttaccataggatttcctcactttcgtatatttataaagccaaatgattatactatatttttacaaactgtcaaactgattttgcatgaatttgaattaatttaacgaattattgtcttaatatgaaatgtctgttaaaatgcataggtaatatttatgcggaggcagacatgaagaaaacttttgatgttaagagacttacaacgctggcattacttacaacaattgcactgacaatatttgttgtggaatcagcgatacctacgcttgttccaataccaggagttaaattaggacttgccaatatagtcacactttttgtattaaaaaggtataaattcagtgatgcagctattgtgctggctatgagaattatactggctacaatatttacagggcaggcagtatcatttatatatagtgtaagtggtggatttttatgtcttattgtgatggcagctgttaataaattgcttaggggacagtatatattccttacaggtatacttggcgcggtgtcgcacaatgcaggtcagattcttgctgcatttttcatactcagattgtcaggtatatttgcgtacatgccgttccttgtgataagcggtgttataacaggtctgtttacgggccttgtgtgcttctttgcagacagatatattcctaaaaaatatactatgtagcagatggaggagattgtgaaaaaaagagttgttgcagtggtggccgtgattgttctgcttgtcggggcaagtgtggcttctattatatatatgaaatcaggaaagaatgacggtagtaagaccgcttatatatacagagataacgaattgttaagaactgtttcgttagatgatgttaagaatccgtacacgttcaggattgaatacggggatggagagtataatgatattcttgtcgagaatggaaagattaagattgctgatgcaagctgtccggataagctgtgtgtgaatatgggatatatatctgagcctttaatgccaatcacatgtctgcctaatcatcttgttatcaggattgtgaatgacggcgaagaatcgccgtcactcgatggagttgtgtattaattatttcatccagcggccagaagcaccacatggaagtacaagtccgttacttgaaacaggaagacctacttcctgtgaatcacagtgtccgccaaagctcttaagttctgtgcttaacatataagtaagaacggctggctgaagacctgtagtgtatgaattaataaggaaaaataatggttcatcagaaagaagctgtgcacaaagcttaacaagcgggtgtatggcttcttctattttccagatttctcctttaggaccacgtccatatgaaggtggatccatgatgattgcgtcgtaatggttgcctcttcttatctctctttctacaaactttacacagtcatcaactatccagcgtataggcttgtcaataagtcctgaagactgtgcgttttctttagcccatgcgactatacccttagaagcatctacatgcgtaacattagcacctgcggctgcacatgcaagtgttgctccaccagtataagcaaacaggttaagaacctttataggttcgctgccacgctttttcctggcatcagagattatctttccaaaccagtcccagttagcagcctgctcagggaatattcctgtgtgcttgaagctgaatggctttaagttgaatgtcagctcctgttcaaatgaaggactgttgtagtgaatctgccactgctgtggaaggtcaaagaactcccattctccgccgcccttggaacttctgtggtaatgaccgttcatattcttccagccacgctctttcttaggagtgtcccatattacctgtgggtccgggcgtacaagaatatacttgccccagcgttcaagtttttcgcccttagaggtatctattacttcataatctttccagttgtcagctataaacataattaagtatccttttctatataaaaatgtgttgcagtttggtaccgcatttgttattaaataattatatacgaaaatattaataactgcaatcgtgcaaaaatgttttgaacaggcatgttttatgttaatatatttctatcgaaatctgattaaggggcgttgcatattgaaaaatgttagtttaaagaatatacggaaagatattgtatcgggaataattgttgctcttgtgtcaattcctatatcaatgggatatgcacagattgcgggactgccagcggtgtatggtctgtactgctctattctgccagtgcttatatatggactggtgacatcttcgccacagtttgtgttcggagtggatgcaactccggcggcacttgtcggtggaacacttgcaacgcttgggatagtgtcaggctctgaggaggcgaaggcagtagttccgtcgataactttagttgcagcattgtggctgctgcttttcttctttatcaaagcagggcgtattgtcaattacatatcgacacctgtaatgggtggattcataagcggtattggtgtgacaataattcttatgcagacagcgaagctgtttggcggtaatgcgggaacaggagaggcaataaagcttcttatacatatagctggggagatgaagtcgtttaatctgttgtcagcaatgcttggagtcggaacagttgtgattattcttgttgcgaagaagttcattccaaagtttccgatgtcagtacttcttatggtacttggtgcacttgcaactgcaatttttcatattgacagattcggtgttaagcttcttccacatgttgataaggggctgccgggattctcacttcctgatatgtcagttgtgtttaagaatccgtcagatataatacttcttggactttcagtggcaggtgttgtcatggcgcagacattgcttgcaactaataattatgccaacaaatatggctataaagtaagcaataacagagaaattctgtcttatgctgctgcaaatgcggcttctgctgtaattggcggatgccctttgaatggaagtgtgtcaagaacaggaattgcagaccagtttggttgtaaatcacaggttatgtcaataacagcttctctgacaatgcttcttatagtgctttttggaacaccggtgcttgagtatcttcctgtaccaatacttacaggaattgttgttgcagcactgataggaattactgaattcgggcttgcagttaaattatggaaaacagaccatacggagtttgcaatatttgtaggagcatttttaggcgttctgttattcggaacgatatacggagttgtaatcggtgttattctttcattcatagctgttattgtcaaagcggttgaaccaccaagagcatttctcggagttataacgggacaggaagggttctacagtcttaacagataccgtaatgtaaagaagataaaaggtgcggttatatacagatttaacggtgcgcttttctttgcaaatattaatacatttgttgatgatatagaaaagaatcttgatgataatactaaatgggtaattgtagacgccggaggtgtgggttctattgatgtgacggcagttgacaggcttatgtctttatataaggcacttgaaaagaaagaaatcagattctatattacagagcatgaacacacacttaatgaccagctaagagagcttggtgcaggtgagctagttgaaaaaggtgttgttagaagaacgattccgcttgctctaagagatgcagggctggacagaccatatcctgtcgaggacggggaagaagagcaggttgtttctggcgaggtacatgaggacaacgaaagacttgcagaaattgagtgggcttttggtgcagatgcagacgaatggcttgagaagatggcagcagaaatggctgatgagattggcagtgtcaagaaagatgagaagaatgttattgttgatgctgaaaagcatgctgcatggggaagaatcggactctttgatgagaatgacctgcttgagcggcttgaaatgcatttgtttgacgataaaaaatatcctaatcttgatattgatgatattgagaaaagaattgatgagcgccgtgtggttgttgagaagaaactggcacagattaatcctgacgcaatccagatgcttaaagaacacagaaaggaaatgcttgacagattaaagcttcacaatccgtatgcatatgagcatatgatggagcagaagaggaagcattatgaacatctgaagaagaaagatccggagcttgcacagaagcttaagaatttctataatctttcaggcgatgacaaataatttatataacggagataatagtgaatatattaaatgtagaaaaggtcagcaagacctacggagaaaaggaactttttaataatataagtctgggaattaacagtggcgataagattggacttataggtgtgaatggaactggtaagtctacacttttaaagattattgcaggtgttgaagaaccggatgagggacaggttgtcaagggcagggggattgagcttgcgtatcttgcacagacacctctgtattatgagaatgaaaatgtactggaatatgttatgcgtggaaagcatgcggacagccagccaaaagcaaaagagattcttaacaagcttggaataacaaatcatggcgcaatgatgaatattttatcaggtggtcagaaaaagagagcggcacttgcgagaactttagttgagccggcaagacttcttattcttgatgaacctacgaaccatcttgataatgacatggtactctggctggaacagtttattaagaatttcaagggagaacttatcatggttactcatgacaggtatttccttgataatgtaactaacaggattgtagagcttgataaagcttccctttatagctatgatacgaattattcaggctttcttgaactgaagacccagcgtgaggagatggagagggcaactgaggctaagagacagaatatattaaggaaggaactcgcgtggataagaagaggatgccaggctcgttctaccaagcagcaggcacgaattgacagatttgaggatatgaaggaggcttcaaagcaggcgagagcaagatttgacaagcagctgatggatatgaattcagtcagcagcaggcttggaagaaagactgttgaactccacaacatttgcaaaagttttggagagaggacaataattgacgattttacctacatttttctaagagatgacagaataggtattgtcggtgataacggatgcggcaagtctacgcttatgaagattatagcaggccagcttgaaccggacagcggcagtgttgaggttggagagactgtaagaatcggatatttcatgcaggagaacgaaccacttgacgacagccttactgtgctagagttcgtaagaagcataggtgaatatgttacgacggcagatggaaaggcaacagcgtcacagatgtgtgagaagtttctttttacaccgaagcagcagtggacgcctataagcaagctgtcaggtggtgagaagaggagactttatctgttaagtgttcttatgagtgcaccaaatgtacttattctcgatgagcctaccaacgaccttgacattgaaactcttgagatacttgaggagtatcttgatggatttgcgggtattgtaatcactgtttcacatgacagatatttccttgacagagttgttgacaggatatttgcatttgaggcaggaggccaccttacacagtatgaaggtggttatacggactacagggataaatgtgtttcttctatatataatgtggcatcaaatggaacatctgatacatctaaatcaaaggcagcaggtcaggtgaagaaagcatataacagccatgaggataagattaagttcacatatatggaacagaaggaatatgagactatagatgatgatatagaggagcttgaaaatagggtttcagaacttgatgacgagattgcaaagaatgcaacttcttattctaagcttgcagaacttactaaggaaaaggaagaagtggagagacggcttgaagaaaagatggagcgatgggaatatcttaatgatcttgcagaaaaaatagagaaacagaaacagtagtaaatattaacaaaacaagtgacagcagaacagattatttggttgagcaaatcatatattcatggtatgatgatatatgatttactatattaatcatatgagggaggaaaaattatgttttgtccaaattgcggaacaaagaacgaggacgatgcactattctgtggaaactgtggaacacgcctagtgatagatgtgcctcaggagacaccggtgcaggaaagtgtggaagaagagccagaggtaacaccggtacaggagaatgtgccagcagagccggaggaaacaccggtacaggagagtgttacagcagagccggaagtaacaccagtacagcaaagtgttccagttcagccacagcaggcttttggtcaacagcctgtacagcctacacagtttacaggtcagaattctggtcagcagcctgccaataataagcctgccagattccctaagggtataattgcaattgtagttgcgggagttgctgtgatagctgccataattatatttgtatgtgtgggaaagaatgtgacagattataagaaaactgccaagcagtatgttaaggcggttgcagagtgcgaatggaatgatgcgtatagtcttattaatctacctgatggggagttccttacaaaggaagcatttattaatgttcatgcagatgcgactggtgagaaagttgaaaagatggcagcagatgacattgtctcaacatatagcaagatgcctggtaacaaggctgttaaggtcggatatataacagattcgggaatgcagtataatgatgtgtatctaacagtagccaataagcactatatgcttttctttaagaagtataaagtcagcgctgagaatcttgtagtaaaggatgttacaataaaggttccaaagggacttacgttatatattaatgatgttattgttggcgatggatataagtcggatgcatctaagaatggaaacggctcttctgatgaatatgttataccatatctgttcaatggaaagaataatattaaggtaactggagaatttatagaggactacacaacacagctttatgcagcacatgatgaagatacatttactgttggaacatacaatgcaaaatatgttaattcgaagcttgaagaacttaagacacaggcaagaacagatgtggatgcaataattaacgctgtacaggcaaagaaagattattcagctatagccgacagggtgtgtaaagaagaaaagaagaacatagagtcagcttataagaatatttacgacagctacaatgacaaatacaaaactgtatccaatttgaagatttccaaattcacagcttctatcgcggatacatctttcagagtggattcagatgatggatgcccggtgattaaagtttcaattaaactaggatatacatacaagatacagtactcaggaagtgataaagctaacgacaagaataataacaataattcagcttacatatattataaatatgaagatggtaagtggaagattaattctatgtatcttggatttggattttattaaaatactgttttgaccgggacttatgttccggtcaaatttgttctgcattgtactaaaaaaaatacaattttttctgttgattttatatagagagtagtgtatattaatacttgctgtgacattgatagctgtgaagcgtgaggttgctgctttaataaagcaggttttccgtggagcgaatgtcaatgctggagataatctccggcgaagaaactggcgacaagtcactgtaccaaaatcatctgcaatccgcagaaatgacgcgcgtgggtcgaattatgaatgagactatatgatacgcgtgggagtgtgtacagtcaccgcttgtcgtacttaaacaataaagtgcgaaggaggcgactttttttatggcaaatcaggtaatcagaattactctgaaggcttacgatcatcagttgattgatcagtcagctaagaaaatcatcgaaactgctaagaagacaggagcacaggtgagtggtccggtacctcttccaacaaagaaggaagttgttactattcttagagctgttcacaagtacaaggattcaagagagcagttcgagcagagaactcataagagacttatcgatgtattatcaccatctcagaagactgtagatgcattatctaagttagagatgccagctggtgtattcatcaaccttaaggtaatgaactaatcattatctggaatttttcattattaaagcaataatcctaagggtttaatatagaagtaacaagcagtggtgcgggttccacttatattagctgttctaggatgacaggatgcgctgtgtatcacacatcatcttgtccgctgtagattaaacaggaggaaaatcaatgaagaaggcaattttagctacaaaagtcggaatgactcaaatcttcaacgaagacggtgttttaacacctgtaactgttcttcaggctggtccttgtgttgttacacaagttaagacagtagaaaacgacggttacgatgcagttcaggttggttttgctgacattagagaaaagttagtaaacaagcctgttaaaggacattttgataaggcagaggttccttacaagagattcttaagagagttcaagtttgagaatgcttcagagtactcagtaaaggacgaaatcaaggctgatatcttcgctgcaggcgataaggttgatgcaactgctatttcaaagggtaaaggtttccagggcgcaatcaagagattaggccagtcaagaggacctatggctcatggttctaagttccacagacatcagggttcaaacggatcagcaacaacacctggtagagtattcaagggaaaaggaatgcctggacatatgggttctaagagaatcacaatccagaatcttgaagtagtaagagttgatgttgaaaacaacgtaatcttagttaagggtgcagtacctggacctaagaaatcattagtaacactgaaagaaacagtaaaagctgctaagtagtttttgctaaggaaggaggaccacacagatggcaaacgtatctgtttacaatattgaaggcaaagaagttggttcaatcgaattaaatgatgctgtatttggtgtagaagttaacgaacatctcgtacacatggcagtagttaaccagcttgcaaataatcgtcagggaacacagagcgcaaagacacgttcagaagtttctggtggcggaagaaaaccttggagacagaaaggaactggtcatgcaagacagggttctacaagatctccacagtggacaggcggtggtgttgtatttgcaccaaagccaagagattattcattcaagatgaataagaaggaaaagagaattgctcttctttctgcattatcatcaaaggttgctgacaacaagatcgtagttcttgatgcatttaaccttgacgaagttaagacaaagaagttcgcagaagttatgagcaacttaaaggttgataaggctttagtagttattgaaggtgagaacaagaatgtagttctttcaggaagaaacattcctacagttaaggtttcagctactaacgaaatcaacacatacgatgtattaaagtatgaaacattagtagttactaaggctgctgttgaaaaattagaggaggtgtatgcataatggcaaacgtacagtattatgatgtaatcctcaagcctgtaatcacagagaagtctatggctgatatggcagataagaagtatacattcttagttcatacagatgctaacaagacaatgattaaggatgctgttgagaagatgttcgaaggaactaaggttgcttcagttaacacaatgaatcttgatggcaagaagaagagaagaggcagaacagctggtacaacttctaagactaagaaggcaattgtacagttaacagctgacagcaaggaaatcgaaatctttgaaggcctttaattagtagctttaaagtgtagaaaacaatattacacagactcgaaaggagagaaataatgggaattaagacatataacccatatacaccttccagaagaaatatgactggatctgatttctcagagattacaaagagtactccagagaagtcattacttgctaagaagagcaagaatgctggtcgtaacaaccagggtaagattactgtaagacaccacggtggtggaaacagacagaagtatagaatgattgatttcaagagaaacaaggaaggcgttccagcacaggttatcggaattgagtacgatccaaacagaacagctaacatcgctcttatctgctacgcagatggcgagaaggcatatatccttgctcctcagggattaacagatggcatgacagtacagaatggtgctggtgcagaagtaagagtaggtaactgcttaccactttcagagattccagttggtactcaggtacacaacattgaattatatccaggtaagggtggacagcttgttcgttctgctggaaactcagctcagcttatggctaaggaaggcaagtatgcaacacttagattaccatcaggcgagatgagaatggttccaattatctgccgcgcaacaatcggtgttgtaggtaatggagatcacaaccttattaatcttggtaaggctggacgtaagagacatatgggtatcagacctacagttcgtggttctgttatgaaccctaatgaccatccacatggtggtggtgaaggtagagcaccagttggtcgtccaagcccaatgacaccttggggcaagccagctatgggtcttaagactcgtaaggctaagaaggcttcaaacaagcttatcgtaagaagaagaaacggaaaggctattaagtaattagcctacaatcgtaactattattattcacgaagattataaggaggtttcaacctatggctcgatcacttaaaaagggagcatttgcagacgagagcttacttaagaaagttgatgctttaaatgctgcaaacgacaaacaggttattaagacttggtctcgtcgttcaacaatttatcctcagtttgtaggtcatacaatcgctgttcatgatggtagaaagcatgtgcctgtatatgttacagaggatatggttggtcataagctcggtgagttcgttgcaacaagaacttacagaggacacggcaaagacgaaaagaagagtagataatttgaatttttgaaaggaggtttaatccatggctaacggacatagatcccagattaaacgtgaaagaaacgctgttaaggatacaagaccaagcgcaaagttatcttacgctagagtatctgttcagaaggcttgtttcgtattagatgctatcagaggcaagagccttgatgaagcacttgcaattgttatgtacaatccaagatatgcatcatctattatagagaagttattaaagtcagcagcagctaatgctgagaacaataacggtatggacccaagtaagttatatgtagaagaatgctacgctaacaagggaccaacaatgaagagagtacatccaagagcacagggtagagcttacagaatcgaaaagagaatgagccatatcactgttgttttaaatgaaagataattattttctaagagatagaaaggagtctttatgggacagaaagttaatcctcatggtttaagagtcggcgtaatcaaagactgggatgcaaagtggtatgcagaagacgatttcgctgataaccttgtagaagattataacattagaaaattcctcaagaataagttatatgctgcaggaatttcaaagattgaaacagagagagcttcagacagattaaagatcgttattcatacagctaagcctggtatcgtaattggtaagggcggtgctgaaatcgagaacttaaagaagcaggtagagaagttaacatctgctaagaagttaagcattgatatcaaggaagttaagagaccagataaggatgctcagcttgttgcagagaacatcgctcagcagttagagaaccgtatctctttcagaagagctatgaagtcttgcatgggcagaacaatgaagcagggagctaagggtatcaagacatcttgctcaggacgtctcggtggagctgatatggctcgtacagagttctatagcgagggtacaattcctcttcagacacttcgtgcagatatcgactatggatttgcagaagcagatacaacttatggcaaggttggtgttaaggtttggatctacgaaggtgaggttcttcctacaaagaataatgccaacgctaacgtagaaaaggaagggagcgataagtaatgttactacctaagagagttaaacatcgtagacagttccgtggttctatggctggtaaggctacaagaggcaataagatcactaatggtgaattcggtattgttgcaacagaaccttgttggatcaaatcaaatcagatagaagctgcccgtgtcgctatgacaagatatattaagcgtggtggtaaagtatttataaagattttcccagataagccggtaacaggtaagcctatcggtgttcgtatgggtaaaggtaaaggtaacttggagtgctgggtagcagtagttaaacctggacgtgtaatgttcgagatttcaggcgttgctgaagaaacagcaagagaagctttacgtctcgcaacacataagcttccttgcaagtgcaagattgtttcacgtgcagacttagaaggcggtgataacagtgaaaattaataagtatgtagaagatttaaaggcaaaatcagctgcagagttaaatgaagaattagtagctgctaagaaggaacttttcaatttaagattccagaacgcaacaaatcagctggacaacacaagcagaattaaggaagttcgtaagaacatcgctagaatccagactgtaattgcacagaagaatgcttaattaaggcatgtagacttagatatcctaagaaaggagaataactgtggaagagagaaatttaagaaaaactcgtacaggtaaggttataagcaataagatggataagacaatcgttgttgcagtacaggacaacgttaagcatccactttacaataagatcgttaaaagaacttacaagttaaaggcacacgatgagaacaatgaatgtttaatcggagatgttgttaaggtaatggagactagacctttatctaaggataagagatggagattagttgagattatcagtagagcaaaataataagaatttatttgtgatattactgaaaggagtagtattatggtacaacaggaaaccagacttaaggttgctgataatactggtgctaaggaaattctttgtatcagagttatgggcggatctacaagaagatatgcaaatatcggtgatgtaattgtcgctactgttaaagaagcaacaccaggcggcgttgttaaaaagggtgacgttgttaaggccgttgtcgtacgttcagtaaagggcgcacgtcgtaaggacggttcatatattaaatttgatgagaatgctgctgttataattaaagatgatcagactcctaagggaactcgtatctttggtccagtagccagagagttaagagataagaagttcatgaaaatcgtatctcttgctccagaagtattataggaggtaccacaatgtcagctgttagaattaaaaagggtgatactgttaaggttatcgcaggaaaagacaaaggcaaagagggcaaggtattgtctgtaaatgctaagaatcatacagcattagttgagggtgttaacatggttacaaagcatgctaagccaagcgcagctaatcagcagggtggaattctccaccaggaagcaccaatcgatatctcaaatatcgcttactcattaaagggtaaggaaacaaagattggttatgacttcaaggacggtaagaaagttcgtgttgctaaggcaactggcgaagttatcgattaataaaggaaggaggcaataattttgagtagacttagagaattatacgataatgaaattactaagaaaatgactgagaaattcggttacaagaacccaatgatggttccaaagattgataagatcgtaattaacatgggcgttggcgaagctaaggaaaattcaaagcttcttgacacagctgttaaggaaatggaaacaattgctggtcagaaggcagttcttacaagagctaagaattcaattgctaacttcaagttaagagagggtcaggcaattggttgtaaggttacattaagaggagagaagatgtatgaattccttgacagattagtaaaccttgcattaccacgtgtacgtgacttccgtggcgttagcgctgattcatttgatggaagaggtaactatgctttaggtatcaaagagcagattatcttcccagaaatcgaatatgacaagattgataaggttagaggtatggatgtaatcattacaactacagctaagactgatgaggaagctcgtgagttattaagattattcaacatgccatttaagaaataattaaggagggaaattcaatggctaagacttctatgaaggttaagcagcagagagcacctaagttctctacaagagcgtatacacgttgtacaatatgtggtcgtccacattctgttttaagaaaatacggaatctgcagaatttgcttccgtgaattagcttacaagggacagattcctggagttaagaaagcatcttggtaaaatcaattaacgtagtcctggtaacaggaaaccagttaaaataaggaggaaaatttcaatgacagatccaattgcagatatgcttacaagaattcgtaatgcaaatacagcaaagcacgacacagttgatgttccatcatctaagatgaagcttgcaatcgctaagattcttttagacgagggttatattaagtcttatgagctcgttgagaacggtaagttcaacgatatccgtattacattaaagtacggtgcttctaagaatgagaagatcatttcaggtcttcagagaatctctaagccaggtcttagagtatatgcaaacaaggaagaacttccaaaggttctcggtggtcttggtgtagctattatatctacaaacaagggcgttatcactgacaaggaagctagaaagctcggcgttggtggagaagttctttgcttcgtttggtaattattgaacacttacacacagggaaacgggaatcctatcccatcgtagttcagcgtatatgaatgtttccctcattataattaggaggtgcacggcatgtcacgtataggaagaatgcctatcgctatcccagcaggagttactgttgagattgcagaaaataataaagtgactgtaaagggtccaaagggaactcttgagagagttttaccagcagagatggacattaagcaggaaggttctgaaatcgttgtttcaagaccaaatgacttaaagaagatgaagtcattacatggacttacaagaacacttattcataacatgattattggtgttacagaaggctatgagaagaagcttgaagttaacggtgttggttatagagcacagaagcagggtaagaagttagttctttcattaggctactctcatccagttgagatggaagatccagaaggaattgaaacagttcttgatggaacaaacatcatcattgttaaaggtatcagtaaagaagcagttggccagtacgcagctgaaatcagagcaaagagagctccagagccatataagggcaagggtatcaagtatgctgatgaagttatcagacgtaaagttggtaagactggtaagaaataattaaaggagaaaacataatggttagtaagaaatcaagaacagtagttcgcgaacagaagcatagaagattacgtaatcgtttcagtggtactgcagaaagaccacgtttagctgtgttcagaagcaataatcatatgtatgctcagattattgacgacacagttggaaagacacttgtatcagcatcaactcttgataaggaagttaaggcagagcttgagaagacaaataatgttgaagcagcagctgctgttggtacagtcgtagcaaagagagcattagaaaagggaatcaagactgttgtttatgacagaggcggtttcatttatgcaggtaaaattaaggcattagcagaggcagctcgtgaagctggccttgaattctaagcggaagggagattacagtatgaaacgtacaataattgatgctagtcagttagaattaaatgataatgtagtatcaatcaagcgtgtaacaaaggttgtaaagggcggacgtaacatgcgttttgcagcattagtagttgttggtgacggcaacggacacgtaggtgcaggtgttggtaaggcagctgaaattccagaagctatccgcaagggaaaagaagatgctatcaaacatttagtagaagttccaatcgatgagaacggttcagttccacatgattttcttggaaagttcggaggagctacagtattattaaagagagctccagaaggtactggtatcatcgctggtggtccagcacgttcaatccttgagcttgcaggtatcaagaatatccgtacaaagtcacttggatcaaacaacaagcagaatgttgtattagcaacaatcgaaggacttaagtctatgaagactccagaagaagttgcaagacttcgtggaaagtcagttagcgagatccttggttaattaaattgtgattcctgctaagcaggagatggaggttaaaatggctgagaagttaagaataactttagttaagtctccaatcggcgctgttcctaagcatagaaaaactgttgaagctatgggtcttacaaagatgcataagacagttgaacttccagataatgctgctacaagaggacagattcagcagattggttatatgttaaaggtagaagaaatctaattacagataaggaggtgcaatgatggatttatctaatttgagacctgcagaaggttcagtattaagcgataatttcagaagaggtcgtggacatggctcaggtaacggcaagacagctggtaagggtcataaaggacagaaagctcgttcaggagcaccaagaccaggttttgaaggtggccagatgccattatatagaagaattcctaagagaggattcactaacagaaaccgtaaggaattcgttgctattaatgttaatgtattagatcgttttgataacggtgcagaggttactgttgatacattaatcgagtcaggaatcgttaaagatcctaaggacggaattaagattcttgcaaacggcgagcttacaaagaagcttactgttaaggctaacgcattcagtgctgcagctaaggagaagatcgaggctctcggcggaacctgcgaggtgatctaatatgtttaaaacacttgtaggcgcttttaagaacaaagatataagaaaaaagataatatatacattattaattcttgttgttgtcagagttggaagtttacttccaatccctggtgtagacaccaattattttagtagcttacttagtggaattaatactggtgatttaagttatctcagtgcttttacaggaggttcattcgaaagaatgtccctctttgcgctgagcataacaccatatatcacatcttcaatcatcatgcagcttctcacaattgcaattcctaagttagaggaaatgcagaaagagggagaagatggtagaaagaagattgcatcgattacaagatacgtaacaattggtctttctttaatagaaagtatcgctatggcggttggatttggtagatcaggtcttatcaaagattcagcacagcttagcacattgcattatgtagtatgtataatcgtagttatagctgcacttacagctggttcagcagtattaatgtggcttggtgagcgaatcactgaaaagggtgttggaaatggtatttcaattgtacttttaattaatatcatatcaggtatgcctagtgattttgctacattatatagcacatttgttgcaccaaagacacctgcaaagggtgttttagcagcagtaataatattagcaattcttattgttatggtagttcttgtatgcttccttcaggatggagagagaaggattcctgttcagtactctcagaaggtcagcggtagaagaacagttggcggacagtcaacaaacattccattaaaggttaatactgcaggggttatgccaattattttcgcatcatcacttatgcagttcccagttataatcgcccagttatttggtaaatcatatgagtggaccagatatctcagctcatcatactggtgcagagttgaagctccaaagtattcaattggtttattagtatacatagtactgcttataatattcgcatacttctatacatcaataacatttaacccaattgaggtagctgataacttaaagaaggctggtggagttatcccaggaataacacctggtaagtctacaagcgaatatcttaacaaaatacttaattatatcgtatttattggagctgtcggacttttaataattgccctcattccaataatgtgtacaggattctttaatgcttctgtttcattcggtggaacatcaattatcattattgttggtgtagtacttgagacattaaagcagattgagtctcagatgtgcaatcgttactataagggattcctcagtgagtaattctttatatcacggatgatattagtataaaatattgacttgcccggtttatgccgggtaagtcctttgtgtattatgatttattacgaatatttatgattttggaatggagaaaatattatgaagataattatgttaggtgctccaggagcaggtaaaggtacacaggctaagaagatagcagcaaaatatgctataccacatatctctacaggagatattttcagagctaatattaagaacaatacagagcttggacagaaggcaaagacatacatggataagggagagctcgtacctgatgaattagtagtagatcttatcatggacagattcaaggaagcagattgtgctaacggatatgtacttgatggattcccaagaacaattcctcaggcagaggcacttgataaggctcttagtgctaatggagagtcagttgactatgcagtcaatgtcgaagttcctgatgaaaatataataaacagaatgtctggaagaagagcatgtgtaggttgtggagcaacataccatatccagttcaatccaacaaaggttgaaggaatatgtgatgcatgtggcgagaagcttatcttaagagatgacgataagccagagacagtaaagaacagactttcagtatatcatgagcagacacagccattgattgaatactattcaggaaagggtgtacttaaggaagttgatggtacacagcctatggatgatgtatttgctgcaatagttaagatcttaggttaatcatctatgagtgatataaagggatattttgcaagttctaaagcaggccatgacaaaggtactgtgtatatgattctcgaatctgatgatgtatatgtttatctgtcggacggtaaattaagaccgacagataaacttaaaaagaaaaagctgaaacatgttcagctcataaaacaaaaagatagtgatcttgcagaaaagatagagaaaaacctgtttataagtaatgaagaaataaaatatgcgattaagcagattaaaaccagtgccaaataataggaggtaaacttatatgtcaaaggcagatgtaattgaaattgaaggaaaggtagttgagaaattacctaatgcattttttaaagtagaacttgagaatggacatcagatacttgctacaatcagtggtaagttaagaatgaacttcatcagaattcttcctggtgataaggtaacaattgagttatcaccatacgatttaacaaagggaagaatcatttggagagataaataaaaacaataggaatatatgtacaaaatattctttataaattttgtaaaattttccttgcgttgatagaaaaggttgtgctataatagcaaccgaacttgtctgaaaggaggcttttgcagtgaaggttagatcatcagttaaaccaatttgtgaaaaatgcaaagtcattaaaagaaagggcagcatcagaattatctgtgaaaaccctaagcacaagcagagacagggctaattaccctgaagcagagaagtagaagtacttctcatatttctgcgttatagtatcaatgtcactagttggtattataactaattctgtctttaatataatggacagagaacagttttgcggctgcagcgatgacacatccggataagttgacggtgttcattgctatcaaatatagtagactgaaggtgacgcacacatttcaggcgttcaaagcgggggatagagcttaggacgagctgcgtaggaatcggactacatttttctatctttattattaatattaatttaattgatcaaacggaggttaaagaacacatggctcgtatttcaggtgtagacttaccaagagaaaagcgtattgaaataggacttacttatgtttacggtattggccgagtaagagcatctaagattcttgaagaggctggcgttaatccagatacacgtgttaaggatcttacagatgaagaagttgcaaagattgctaaggttatcgatgctgatccagaacatttagtagaaggtgacttaagaagagaagttgccatgaacattaagagattaaaggaaatcggatgctacagaggaatccgtcatagaaagggacttccatgcagaggtcagaagacaaagactaatgcaagaacatgtaagggtcctaagaagactgtagctaataagaagaaataattgaattgttaaactcacaggaggttagttatcatggctcagaaagttacaaaaaaagtgacaaagaagcgtgttaagaagaacgttgaaagaggacaggcacatattcagtcatctttcaataatacaatagttacattaacagatgcagaaggaaatgctttatcatgggcatctgcaggtggactcggattcagaggatctaagaagtctactccttatgcagcacagatggcagctgagacagcaacaaaggctgcattaatccatggattaaagtctgtagacgttatggttaagggaccaggttcaggtagagaagcagctatcagagcactttcagcagctggtcttgaagttacaagtatcaaggatgttactccagttccacataatggatgccgtccaccaaagcgtagaagagtttaatttagggaggtaagattacaatggcagttaatagaacacctgtcctcaagagatgtagatctcttgaaatggatcctgtatatttaggaatagataagaaatctagaagaaaggcaaagaacgctggtagaaaggttagcgagtatggaatgcagcttcgtgagaagcagaaggctaagttcatctacggtgtattagagaagcctttcagaaattactataagaaggctgagagacagaagggtatgactggtgagaaccttatgatcatgctcgagctcagacttgacaatgttcttttcagattaggattcgctagaacaagaaaagaagcaagacagatcgttgatcacaagcatgtattagttaatggtaagtgcgtaaacatcccttcataccttgtaaaggctggagatgttatcgaaatcagagagaagtctaagtcatcagcaagatacaaggaaatccttgagtctactaacggaagacttgttccagagtggttagaggcagatgcagacgctcttaagggatcagttaagtcaatccctacaagagaagttattgacgttcctgtaaacgagatgcttatcgtcgagttatattctaagtaatccgtaccggaaatatagaataaaacttataaaacccataaaaaggagggactatacatggttgatgcagattttaatttcaagatgccaaagattgagatgacagaaaaatcagaagatggcaagtatggaaaatttgttgttgagccactcgaaagaggatatggtttaacattaggtaattctttaagaagaattatgctctcttcattagttggtacagctgtaagcagtatcaagattgaaggtgtacttcatgaattcagctcaattccaggtgttaaggaagatgttactgagatcgtcatgaacatcaagcagttatcaatcaagaacaacggaaattctgttgagcctaaagaagcacatattgacttcgtaggcgaaggtgtagttagagcatcagatattcaggttgatcctgatattgaaataatcaatccggatcttgttattgcacatcttaatggtgcagacagcaagctcacaatggaacttacaatcactaatggtcgtggttatgtaagctctgagaagaataagagagatgatcagccagcaggcgttatcgctattgattcaatctacacaccagtagagagagttaatatggcagttcagaatactcgtgtaggtcaggatacagattttgataagcttacacttgatattttcactaatggaacaatagaaccagatgaggctttaagtctcgcagctaaggttttaagtgaacatttaaagggattcatcaatctttcagagaacgctcagaaagtggaaatcatggttgagcaggaagaggatgagactactaaggtcctttcaatgagcattgaagatcttgaattatctgttcgttcatctaattgtcttagaagagctggtatcaacacagttgaagagctttgcaacaagacatcagatgatatgatgaaggtaagaaacttaggtaagaagtctttagatgaagttctccttaagcttaaggaaatgggcttacatcttagacctaacgaagattaatttgtagatacggcggctatacagtaagtccataagcgcatgtgtagctgttacaaatggaggtaaatcatggcaaaatatagaaagctcggcagaacatctagccagagaaaggctttattaagaagtcaggtaacagcattaatcgagaatggcaagattgttactacagaggcaagagccaaggaagtaaagaagatggctgaaaagctcatcacacttgcagttaaagagaaagacaacttcgagacagttaaggtttcagcaaaggttcctaagaaggatgctgaaggcaagagagttaaggaagttgttgatggcaagaaggttactgtatatgagacagtagagaaggaaatcaagaaggatcttccttcaagacttcatgctagaaagcagatggataaggttctttacacagttacagaagttcctacagcagctgctggaaagaagaagaatactaagactgttgatcttacaaacaagttatttgatgagatcgcacctaagtatgctggtcgtcagggcggttatacaagaatcgttaagatcggtttaagaaaaggtgatgcagcaatggaagttcttcttgaattagtttaatttcaattgcaatttaagcgggtaaggaaacttatccgctttttttggaatctgcggtaagacttaaaagggcaggaggtcatatgggaatagttaaagcaaaaaacctcacatttgaatatataagacgagatgaagatggtaatgttgagggaataactaaggctgttgataatgtgagtattgacattaagcagggcgattttgttgccgtgttaggtcataatggctccggtaaatcaacatttgcaaaacatctgaatgcgctcgttatgccgacagagggaactgtgtgggttgatggtatggacacaagggaagaggagaatactttaaaggtaagacagactgccggaatggtatttcagaaccctgataaccagatagttggaactcttgttgatgaagaggttggattcggaccagagaatattggtgttccaacggaagaaatatgggaacgagttgaaaaaagcctgaaagcagtaggaatgtatgctttcagaaaccagtcgccaaacaagctatctggaggacagaagcagagggtagcgattgctggaattgtagcaatgaagccaaaatgtattgtcttagatgaaccaacggcaatgcttgatccgttgggacgaaaggatgtacttaatgtgctccatgaattgaacaggcaggaaaatgtaacggttatacttatcactcattacatggaagaagtaattgatatagacaagctttatgtaatggatgatggaaagctggtaatgtcaggaacaccaagagaaatattctcacaggtagagaaattaaagaaattgagacttgatgtgccgcatgttacagaattagcctatgaacttcagaaggaaggagttccattaaagaatggaatattgacttcagaagaatttacagaggaactcattagagttagaaatgagggtttcaatgtcaataatagtagataatatcagctatatttatgaaaaaggcactggctttgagaggcaggctttgaaaaatgtgagctgtgcaatagaagatggtgaatttatcggacttattggtcatacaggttcgggtaaatccacatttatacagcatcttaatggacttgttaaaccgactgaaggccatatatattacaatggcagagatatatatgagcagggctttaatatgaaagaattaagaagcagggtaggactggtttttcagtatccggaacaccagctttttgagactgagatattcaaagatgtatgttttggtcctaagaaccttggcctttcacagaaggaggttgaaatcagagcatttgagtcgttaagactggttggaatagatgataatatgttttatcagtcgccatttgatttgtcaggtggacagaagagaagggttgccattgcaggtgtacttgcgatgaaacctgatgttcttattctggatgaaccaacggctggccttgatcctaagggaagagatgatattcttaattgtcttaagtatttaagggaagagacaggaatgactattattcttgtgtcacacagcatggatgatgttgctaattatgtgagcagaattatggtaatgaatgatggtgtgctgacatatgatgacactccaagaaatgtattcaggcattataaggagctggaggaaataggactagcagcaccacaggtaacttatttgatgaatgatttaaaacaggcaggctttgatgttaatacagatgctatcacaatagatgaagcgaaggaaagcattttgtcagcactgggataaaggaagtaatatgattcgagatataacaataggacagtattatcaggcagattcggtaatacacagactggacccgagagttaagcttatgggtaccttaatattcgtaatatccctgtttctgggaagtaatatatggctgtatctggttgtagcagcatttttggcgatagtaattgcactgtcaaagatacctcttaaattcattcttaaaggtcttaaggcaattgtaatattaattgtaatcagtgcggcatttaatctgtttctgacaccaggaacgcctcttattaagatatggaagctgacgataacgcatgaaggccttaatacggctgtattcatggttataaggcttatttttcttattatgggttcatcccttatgacacttacaacaacgcctaataaccttacagacgggcttgaaaagggacttggatttcttaaatacattaaagttccggttcatgaaattgcaatgatgatgtcaattgcattgaggtttatcccgattcttattgaggaaacagataagataatgaaggcacagatggcgcgaggtgcagactttgagtcaggtaatattattaagaaggcaaaagccatgatacctattcttgtgcctttattcatatcagcgttcagaagggctaatgaacttgcaatggctatggaggcaagatgttatcacggttctgaaggaagaaccaagatgaagccgctgaaatactccagaagagatattaatgcatatcttattatcgcattgtatcttgcatgcattattgtggttaaggttacgcttaagttaatataatcagtgtgtatacagatatgacatttataatagtttgattctggcttttaaggaggaacgccatgcgaagaataaagcttatcgtagcttatgatggaacagaatattccggctggcagattcagccggaagcaccaactatagaaatgtatcttgacaaggcaattcgcgagcttaccggtgaaaatgtgcatgtgaccggagcaagccgtacagacgcaggtgtgcatgcatatggaaatgtagctgtatttgatacggaatcgacaatacctggagacagattcacatttgcactaaacagattcctgccggattcaattgttattcaggattcatgggaagtgtctgtagattttcacccaaggcactgtaacacaagaaagacttacgaataccgcatacttaatactgctgttccgttgcctcagaagcgcaatttcacatggcatgttactggaagtattgatattgaaaagatgaaagaagctgcagcatatattgttggtgaacatgatttcaaaagcttctgctgtgtgagaactcaggcagaatcgactgtcaggactatatattcacttgaggttctgcaggaaggcagtgagataataatccgtattaaaggaaatggattcttatacaacatggtaagaattattacaggcacgcttattcaggtaggaaaaggaagattcaagcctgaatatgtgaagcagatgttagaggcaaaggacaggactgttgcagggcagactgctcctccacagggacttacacttgttggcattgaatatgtggataatgatgacgcaaaggttgtctgatgtggataacttttttggataaaacatttgcaaaagtatattgacacacgtggttatgtgttatataattcagaaatgtggcgtgataagtgcgcccataattaaggttttaagtgtttcaccaatgccccggagagacatttatatacattaataattaagcattatagcaatatttcaggaggaaaactaatgaaaacttatatggctagtgcatctacaatcgaaagaaaatggtatgtagtagatgctgcagattatacattaggtcgtttagcatcacaggttgctgctgtgttaagaggaaagaataagccaacttacacaccattccttgactgtggtgacaatgttatcgtaattaacgctgataaggttaagttcacaggaaagaagcttgaccagaaagtttactacagccactcagactatgttggtggtttaaaggaaacaacacttaaggaaatgatggaaaagaagcctgagaaggttatcgagcttgctgttaagggaatgcttccaaagggacctttaggacgtcagatgttcacaaagcttcatgtttatgctggtccagatcatgagcaggcagctcagaagccagaagtattaaagttttaatataaggacacatataaggaggaattaacagtggctaagaaagcaaacggaaagttctacggaacaggtagaagaaaaagcagtattgctagagtatatttagtaccaggtacaggtaatatcacaataaataagagatcacttgatgagtattttggtcttgagacacttaaggttgttgtaaagcagccattagctctcacagagacagctgacaagttcgatgtaatcgttaacgtacacggtggcggatacacaggtcaggctggtgctatcagacatggtatctctagagcacttcttcaggttgattcagacgagtaccgtccatcacttaagaaggctggtttcttaacaagagatccaagaatgaaggaaagaaagaagtacggtctcaaggctgcacgtcgtgctccacagttctcaaagagataatattaagaaaattgacatttcaaaagccccgaattttcggggctttttcttatgtcaaaaattaaaaaataagtcttttttgaatagtagccacattgtagacacacagtagccacacccaaaaataaaaatcaattttctaatatataacaatataaaaaagtcatattattaataagcaaaaacaataaaacttttatttttttcaaatgtatgtatttgatagttccaaacctttcacttacatactttttttatattcgaaattattattatgttgtgtcaataattgttcagttaaatcattatctgtttcaaattcttattggaaaagaatatgccggactctccgtctaaattcttgatagaaatgtcgaatgcttcatcaatagcaaatagtaaggaatattactctaaagagagtgttcagtgggagattatagcaggtaatcgtactggtactgttgaacagatggatgttaatgttgaggtgatggcaagagatttgcaggaaatattgagaataggagcggagcagaagagattgtgggaggtgtatgagggaagatagctgtagataaaaatagttgcaattataaaaagatagttcaataaaatggatgctaatttgcagtaagataaatgtaagtgtagcatccatttttaagacataaattaagatatatattgataaattaagatataatgatataattaacataaaaagtgtccaataagggataaaatatgttgcataaaatggagatgaaattatgagttattcagcaacacaattagcaaaaaaattagacatttctagatcatatttatattatcttaaagataatggcgtagttgaagttgagataaatgataatggcagagttatatggaatgaagaagcataccaaaaacttagtgaatatataaagaaaaacaaagcggatagttcagatgagcctaaagatgcgccaaaagaatataaaactactaaaataaataatcgcagatatttgggtaataaatataagttacttccgtttattacaagagtagttgaaaatgaatgtaaaaatataaatacagtagcagatatttttgcaggaacaggtgctgttgcttctgcttttattgataagaagattattaccaacgatattatgtatagtaattacatatgtcatgttgcctggtttagtagtgaacattattcagaagagaaaattataaaaattattacacaatataacaatttgaaagttgttgaagataattatatgagtgacaatttttctgatacttatttttctttggatgattgcagaaaaataggatttattaggcaggatatagaggataaatttaattcaggagttattaacgcaagggagagagctttactaataacatcattgttatatgcaatggataagattgctaatacatgtggacattatgatgcctacaggcagggagtggaatttgaaaaacatttggaaatgtatgttccacaaccagaacctgatgttaatgagaacaatgtttgttataatatggatacaaacgaattggcaccagagatagaagcggatttaatctatattgatccaccatataattcaagacagtattgtgatgcgtatcatttattagaaaatgtagctagatgggaaaagccagaggtatttggtgttgctagaaaaatggacagaacagctttaaaaagcgattattgtacccaaaaggcaacagtagcatttgaaaatcttattgattcaattcatgcaaagtatattttactttcatataataatatggcagataaaggaaatgacagatctaatgccaaaataagtgataatgacattatgagaattttaagtaaaaagggaaaagtaaaagttttctcggaagattacaaagcattttctactggaaagtctgatatacaggcaaatcaggaaagattatttttgtgcatatgtaataatgaaaaaaaagaagttattccatcagcattgaattatacaggcggaaagtataaattgctttcacaaattcttccattgtttccgaaagatgcagatcaggttgtagatttgttttgtggtggttgtaacgttgggataaatgtagattgcaacaaagttttgtttaatgatagtaatgaatatcttatggggttattggatacatttagacgattaacgaaagaagagatatttgattggatatataaaagtatagacaaatacggattatcgctagtaagtaagaatggatatgatttttataattgcgaaagctcaaagggattaggtgaatataataaagccggttacaataaacttagaggtgattttaataaaaaagccagcaaagataatgagtattatttaatgttatatttgttaatcgtatattcatttaataatcaattacgattcaacaggaaaggagagtttaatttacctgttggcaaaagggattttaactctaagatgcagggaaagctggaagcatttattgatagagttaagagtggagattataggtttacaacagatgactttaggaatgtaagtatggaagactatacagataaaagttttttctatgctgatcctccttatttgataacatgtgcatcttataatgaacaagctggatggacagaaaatgatgaaaaagatttgctgaattatcttgaagagcttgataaaaaggggattagatttgccttatctaatgtattggaaagtaagggtaagaaaaatgtaatactttcggaatggattaatcaaaataagaaatttaaagctattccattgaattatgattataccaactcaaattatcatacaaaaaaggatggaataactaaggaagtgttagtagtaaactattgattagaggagatattttatggcaaaaaagattggatttaaaagttattgctgggctattggtacaacaagctatcgtactgacaactttaatctgagtatagaaaaacaattgcatttactgaggcaattcagagagttggaagaaaataaaaacaagaagtggggaaataataaaaagtttcaagcagaatattacaattttttgaaagaaaataactttgtaaaaggagatgctgctcttccagataaagatgcaagagaaaaaacatcaggattaagagatataggacttctagatgatgagcgtaacataacagaagcaggattagaactgttaagaatcactgattcagcagatttttcagcggataattttttggaaattccgaaggacagctttttatatttcaaacagatgttaaaaacatcaaatgttgtagagggaaaaatcgtaagaccctttgtcgtatttctgtatgctgtaaatgaattaggttatctcacaaatgatgagtttacatatctattaccattatgtgtggatgagcatactacaaaaaatatagttaagagtataaagaactatcgcgagactggtgagaaagattttgatgatattattttatccgttttgatggaaaaagataattataaacaggcgttgaatttgttgaaaacagaacctatctcagaagaattgatatgtaacgttggaatcaatagaaaaagtgcaaaatatgacaagccgtattataccttatattcattattaaaaaagattgtattttcaaaagataatcttgcattagaattttatgaagctacaaagaaattaaccaatagtaaggttggaggagcttggagaaaatattttttcaacagtagtgcacgaagtgtaatttcaagagaggggctatctgtacttaatactgttcctatattacaggtaacaacagaagaacagtttaatgaagaattttttaaggtggtgcatacttttaaggctagagcaacattatcagattactttgatttgaatagaagatatttcaaaataacagatatcgttttgtttgaggataataaggtaaacctggatgtacttccacaatgctatattgagattatagcaggaaatctgttaaatatagcttttgaacagacagagttattaccccaaaattcaaagcttaaagatatagattcattctttgatatagacataaatatattatatcagaaattagggcatgctctaggtactagtgtaactaataaagagatggctcagaaggttataaaagatgagcgttatacaagatttaataagcttatagatgataagtttgataaaaatactattattagactgcttgatgattttgaaagcagaaatgacgatgaaataagaagcatagttacagacaatgcggatattcctacaatatttgaatatgtgcttggtatagcatggtatataatcagcgaacgaaaaggtgatgttcttgaatatatgaatttatcattagaagcggatttattaccgaagactcatgctggaggcggagaagctgatatagtctggaagtatgaaatggcatatgaatatcctaagcatacattgttaatagaagcaactcttgcagatggtcaaaatcagcgtagaatggaaatggagccagtatcaagacatttgggagattattgtctggcacatcctgaagacgaagcatattgtgtgtttattacaacatttttaaataataatgtaatatcagatttcagggctagaaggtttatggagtattataataacgcaggaactaagtatattacaggaatgaaaattctccctatacagactaccgagcttaaaacattactaagatttgatgttaagtatccacagatatacaaaatgttagatgcagcttataaaacggacgggtcacctaaagagtggtatgagaatagtattgtgagagaaactggtatgtataatggacaggagatatgataaatggatgagataaaagagatatttaagaatatcaatcaaacgacagatgagaatgttattgatacagttaatgaacataataatgaaattggtaaacttttactaaaaatagagttgattcaacaggctggtttttttattaatagtagttgtaatgaagtacttaaagaagttgaaaatgacattattaacagtttgatttttatgtcacaagctttttatagaaactcgatgatgtgtttacgaagtgcaatagaattatcattaagctatgtatattatcatgatcataattatgaatatatcttatggaaaaataataaagtggatatggcatgggcaaaattgttttctgaggaaggaataattagtgaaaaatatctaagtctctttatatcgggacaacttaaaataggagaatttagggataaaataagggaatgctatcatgaatgttcagaatatgttcatggtaagtatatgtatatgcaaagtataaatgaaatgcagataaaatatgatgaaacagcggtaaaagaatattttgttcaggttaataatgttgttgatataatgatcttattgttgtttattagatttggaaaagaatatgaattttatattaaattaaatgataagattgatatatggaatcctattataaaaagatacggaggagaatggaaatgagtgaagcacgaataagaacagaggacttatccatagatgaagtgaaagagttatatgttgaaacagcaatggatcgtgagaatatagaagcgttgaaatcatttcaaccattgttacttattggtagtagaggaactgggaaaacaatgcttatgagaaaagcagagtcagaacttacagatgattttgaagaaaaaaggatattgccaatttatacgagctttgcaacatgtccgatttatgaaaatgtgaatatgttaaggcttatggtaagtaaaatattaattgcacttagaactaaactaaaagagcaggggataatagtaaatggaagtatatttaaacctattgttaataaggatgtaaatccaattgtaaaaaagctagaggattacataaatgatatttcaagtgaaagttttgaaatagatagtgaatatgttatagacgatgaaaatattgtaaataatatagactattttagagagtttattaaagaattatgtgaagaatttaatataaagaagattataattatgtttgatgaggcatgtcaaatttttgcacctaaacaacaaagagatttttttgaattatttagagcattaagatctccaatagtaatatgtaaagctgcagtttatccaggtttggtttcatatggtacatttcagcagtttcacgatgcaactacaaaaaagatagaaagaggaatacttgcttctgattatattttaaaaatgagagaaatcgtaaagaaaaattatccggatgaatatgataagatgattcaaaatggtgatttgctgaatacaattatatattgttctaatggtaatccaagatttttattaaaaagtttaaatgcaatacttgataagggtaatgctataaagacagcagttgtaaatgatgttataaaagacttttatagagtaacaatttggacagaacatacaaaattagaagaaagatataaaggtcataaaaaaatgattgagtggtctagaaaatttatagaaaatactgttacaaatgatataactaggattaatacaagagatggaagtaattcaaatgaaaagaccacggtgtattttgctatttcaaggaaagcacctgaagcgataaagcaagcaattaagatacttgaatattcaggtgttgttacattggatgtagaggcaactaagtttagatatgattattatgacagatatcaattgaattttgggatagttttattatcaatggctaaaacaaatttagcggtatcttgtaaagaaataattgataatatatcacaaaaaaaatttcctaattatggagaaaattctcctgtttatgaggatgcacctaacttaatttcgacagaagaagaaattgatcaaaagatgtttttgaataatattttaaataaaaaagtaagcgaattggaaatatctacaaaattgctgaaaagattgaatgacgctggatatatattgataaaagatatttttgaaagagatgaaagtgaattgaaaaaaatcagctatataggtaaggttcgttctagacaaatatataataatgttatggcagcagttatagagtatatatctggttaatgactaataaatagtaaatgattaatttttagttaaagtgatgagtagttctgggaatgtgtgggtagtgctacgcatacaacacatatgcaacactgccaaacacaaatcccctatttatgggcttttcatgttctcaaaacgttaacaaagagataatatttacaatccaaagcgtcttatggcgtttcagagaagtatgctacacctcggaatttcggttccggggtgttttttatataaaatgtgatagaatatattataatagttaagtattaagtgtaattaaaaagctattttcgtattaattagaatggagagatatttatatgacaactgtaagcacaaagagtggtagaattataaaagttgtatccagagaagaagagaagagtacattgactgaatcagacagtgaaatggacgaaagagcggttgaagctgttaaggcagcgataaataaagctaagatttgtaagaaacctatagcaggttatgataaagaaaaaaagcgggcttatgtagagtatgcgaatggggaaagaaagtatgcagaatagaaaaacgatgattcttgtattagcaggaccaaatggctcggggaaaagtacaataacaactttttttgataaagttggcagatatgattggagatccatatatgattaaaatagcatttttcgatatagatggaacattgttgaaaatgggatgtaaagaaccgacagataaaacagttaaagcgttaaattctcttcaccagaatggaatattgctttgtatggcaactggcagaggctatctttcaatccctaaattcaaagatattacatttgatgtgctgcttacatttaatggttcatatgtaatggctggagaaaagattattttcaggaatcccctgaataataatgataaacatcagataattcaaaatcttaataaaatgaacagagcagctgcaatcagcaatgagcattttattgttactaatggcacagatgagcatctggaagagtactttaaatttggaaatgaaacattgacaattgcagacaattttgatgagttatgtaaagaagatatttatcagattatgtgtgcgtgcagaaaagaagaatacgcccagatactgcaaggaactgaaaatacccagataactgcatggtgggataaagcagcagatataattccattgaattgtggtaagggaaatgctgtaaatgcagtgcttaattattatggattatcgaaagatgaggcgattgcttttggtgatggtagaaatgatattgaaatgctagaagctgttggtacaggagtggccatggggaatgccattgatgaagtcaaagcaagagcagatgtcatatgtaaatccgttgaagaagacggagtgtatcattactgtctggagaaaaaactcattcaatgttgatggacttattatacagcagggttgcagagtgttatatactctgcaaccctgttagtcatttatagtcttaattttaccaccatttctcacggtaagagtattcaccgcggtaattagaagcattataatcaggatacttgaaaggtgcatatacatcatccttaggtgcatcatcctgtgtatatatgtacattgaatcataatcccatgtgacaatctcatcacgggcatcgccgtagatgtttacagcttcagcacacatggtaggatgaccatcatcagggaatttaacaacctgcataccattgccatcaatcattccgccgcgctctacatcagcattaagaaggatgaagtcctgaccgtcaccagtccagtttacaggagttaagagattgccattaagctcgttctccatttcccataactgattaccctcgctgtcatagaaatatataattccctggtgtccccagaaattaacaacaaccatttcatagcccgggcggttaggaagataattagcaagacttacacgctgtgcatgaccgatgccgtccttcttaagaagctttccgttaaaatcagatatcaggaagccttcctttcctgcaacacaggcaaagaatttagtacctttgtgtggtcctgactcaaatctgcctggaacaatctcatcaatatggtcttcattaacaggcatagtccacattttattaccgtggcagtcaagcatgttataaccaactaaaagttcatcatgtccatctccgttaatatcaattgcaaaaggaaaatgtccggtattcttatcactctggaaatgccacataacctcaaggtcatcgttaagtgcatatactctgcaataacggtccttaatgagaatatcgcgtggcttgtcaagaccacggaaattacatatacgcataccatcaggattaattctgtcaaatgcgtagattttatcaggaacaccgataatagttccgtcctcttctggtgtagagaaaggtgttttggcacgtttcttcacttcacctgttctgccatcaagaatcagcacttcaaaattcttggctgtaataacctcatcaaagccatcaccgtcaatatcatatatctgcataggcatatctgctgatatagttccaatgtcgtgattatcagtaggttcaccatgctgccataatatattgccatcaaggtcaaatgcggtgagacagctgattgttccataagcatcacggtttactcttttctggcactgagccataaccatctgatactcgccattgccaagaagatgaccgaaacgaagctgtcttccggtgccgcagcctttgaggtcaattttcttaagaagcttcatcttaggataatgtgcctgtgcatcttcacattcagctttataagcatttcttgcagcatcaatagaagcagcagtactttcagaagtagtaacatttacaaaaccaaactgtgtagggatagttgcagtaatggcaaccttgccaccctgccttgcatattcagtgtcaaggtcaaaataaaccttatcatcaacactgcatataacatggctgcctttaatctcagccttaagtacataagtatcatcacagttgtaatcaaaaggtacagaatcgagtacagtaacctcctccttatgacgatactcaagtcttaactcatgctcttcaaaaacaaggacaagaagattagcagagttctgacaacaaaaaccaatgccggcattgccccatttggtagtaaacatacgcacacttgcagttatagtataatcgcgccagaatctgtcaccgcttgtgagcataggaaatgtgcggtgtggcttgtcattgcggatacgcatctgctccataaaatgttttccattatattcagaaataatccaggaagccccctgaccgttataagtgtggttgcataccgggtcataccatttaccataatatccaggataatggataaaatgatactcacccattgccgaatgattcttatcataaggaaattcaccaataggaaaatcagagaaatcttcattaagtaaaataaaatctgccataataacctccgttctaaaataaaaaatataattaatggttctttctgtagcttccgggcgcttcgcccatgatttttttaaatgtgccgcccatagtattactgtcggcgaaaccacatttgtcagcaatctcagtaatagagaggctggtgttgactaaaaggtctgctgctgcgtgcgttcttacataaataagatactctctgaatctgaagcctgtaaaagccttaaatttcttggaaaggctcgattcactcatattaaaaagttctgcagtagcagccatagttatgtcattgtgataattctcgataatatattcaataaccttctggataagttcattacctgtatccattttcgtaataacattatcttcatacatctgacagcgcagaataaaaagtataagttcatgaaaataagaatgtatgaaagataaagacagactatctacaccattgtgttcataagaaatcttctggataattgatgatatataatcaagtcgtctttctggtatatggacaacaggatgtttatggaaaatgctttctatatccagagaggaatcatcagcaatcaactttaaatcatcattattaaaatataacacatatcttgtatggtcacttccggcgaggtaagtagtcatgtgcgccatgtctggtgggataagagcaagtccgcccggatttaacatatatatttcatcacctacataaagggtgcaggaaccagaatatataaacatcagctcccatctgttatgttcatgaaaatgtttcatcttataagatggaggcacagtagcaatatccgtgtggaaattgtcattaataaaatggtacattgccgtctccttggtatatgaataatatcttacgaagcaaaatcatatactgattataggtcgtttatagagaaactgttactgattttttacatatttttttgattttgaaagatttcgtgctgttttttgtatctataaaaaaacaatgtgaatataataaaagcatcttaagaagcagaaacaatttaatattaaggaggaataatatgatacgaagaaacaaaattattgcttctgttgctgtcagtgtcatgactggcgttcttgttgcaggcaacttagctccattacagggatactatgcatttgcacaggaaacaggagtaaaaactgcaaggtattcagcagtaaaagacattaacaaaacattagaaggttacacaccaatggacagttctgatccggttgaattcggtggaacttacattaagtatcagggtgagacaatccagttgtcggagacagccatatatcttgatggatcgttatcagatgagcttgctgcccagtacccatatgtatataacgatattactaaggcattgtcagcagatgcattaaagaatggaacagcagataaaccaatgacagtatatgttgcaccatatgtgtattggattgatgatccggcagcaacagatacagtacagaagaccgagggatattcagtaccttatggaatggttgttaattcagaatatcttactatcaaaggtcttacaggaaatcctgataatgttgtattagcaggaaacagaggacagtcacatgcctctaacggtaactacacaatgttcagattcaactgcagcggtgcacttacagttaagaacataacaataggtaactattgtagcgttgaccttgattatccgcttatgagtgagcttaatcaggcaaagagaacagagacaatcacacaggcacagcttgctgatgtttcaggagacaagatgtttgcagataactgtaacttcataagcagacttaatcttgacccaataaatggagcatcaagaagtctttataacaactgtcattttgaaagtacagatgatgcccttaatgcaaatgctgtatatgtaggatgcgattttgatttctacggaaacagaccattatattcatcatatggtacaggttcaacatttttaggttgtacatttaattgtaagatattaaatgttgaagctgaacctacacagttctttactaaggaaggcggcacaattaccgcagtagactgtgtatataacagtaatttaagtgtacctatatcaattggatggactaaaacaccatcaacttcattaaagtgttatcagagcaacataattcataatggacagagcatcacaatcggtggtgagggtgctaaagaaaccgttgatatgacaggcaagtcagtacttgatgcctacaaggttgtgtcaggtggtaagacatattacaacacatacaatcttttaaagggcagtgacgactgggatccattaggagttagggatgtaattaaagcagccggacaggacacagttgcaacacagctttcaataacatcagatgtcacagagattgaatctggaaaggaaacagcttcaataggaggaacagttaactatttctatggaactaatgatacaacacagaagataacatacagcgtatcagacgaagataaggcatatgtgaagttaacagataatggtgacggaacatgcaaagtagaaggtactaataatgatgatgcagctaggaaggtcattataaatgcatctacagagtcaggtcttgaagcagcagttggaattactgtaaagccaagcaagattgaagcaccagcatttacaaaggcaccagttattactaatgacggacagggcagtcttaaagtagattactcacttgatttaggaagcagagaagacatgtctgcaatctcatggtacagatgtacagatgcagagggcagcaatcctatacttgtagcagtaacaagaaatgattcaccagagtatacatataagttaacagcaggtgatgtaggatattacatcatggctaaggtagaatctaagaacatcagaagtgattatggaacaccggtaaatacagtatatgacaaggcaatcggagtgaaagatgtaagaagcaagaactttgctacagatttctctaacttccctaatgtaaagcagtctgaaatcaaagctggcttctggacagtagattataaccgtccggcagatacagaaagttttggaagctggcagggagctgatacagaagaaccttggaaatatggaacaacaggtaacggctgtgtaggcgctggattatatgaaggtacacagggcgcaagacttatgtatacaccagtagaaggaacatatggtgatatgtcacttaagcttgtagttgacccagccaagacagcaggtcagggatttggtagtgcaggacagtatatggatgtacttcttaagttcgatacatcaacacttacaggatacggattaagaataataagaacaagggattcatctaatgccgtaacatttgtacttgtaaaatatgacaatggaacagtaacagagatttctgataaagttattgcaagctgctatgcaacaggctgtacaatcagcttaaaggctgaaggcaataagctcacagctcatgttgagacaccaacagaacagcttgcagaccaggcagctaagggatatccacatgtggttgaccttacagcagatattgaagctaacagctttggcggagttgcaatccagcatacaggaacacttggcgcaggcggatggcagaatacaacaatgcttcataacttaaatgttacatgggaaggtgagaataaccagaacccagaatatgttgaaggaaatccatcagataacgagaatcctgccgagacacctgatgattcaacaggaacatcaacaggagcagacacaacagttaagacaggcgatatgagccatgcaggaatgtatgccgcattaactacagcaagcctttgtgcattgcttggaatggcagcagtatacatgagaagaagaaaagatatctaatttcataagaattttctttacaggagcacccgcaattatattgcgggtgtttttgcgtggtgaatgtgtgaccgtatgtgattgacattttaattattatgctataaagttttatagaactaaccagtataagatggaggataaaacttaaaagcatgaaatataatatcagaaagtatatattgtcaggaattacagtaattcttgcagcggctgttctgacagcatgtggtggcaacaagccagagaaggacgatacagtccagagtacacaggaaatatttgcaatggatacatatatgtcgcttactgcatatggcagtaattcagaggaagcagtaagtaaagcagttcaggagattaaccgtcttgatgcaatgttttcggtaggaaatgaggacagtgatgttactaagataaatgaaaatggaagcggtgaagtatcggaagaaaccgcatttataatgaacagggcaatgcaggtatctaaagaaactaaaggtgctttcgatattacgatatacccggttatggagctgtggggatttaccaccaagaattacagagtgcctgaaagcagcgagattgcggatgtacttaagcatgtttcttatacaaatgtggaggttaacgggcagcaggtgacattgtcagatggtgcaagcattgaccttggtggaattgccaaaggttatacatctttgcgggtgattcagattatgaaggactgcggcatagagcacgcaatcattaatcttggaggcaatgtgcaagtgcttggaactaagactgatggctcggactggagggttgccatacagaatcctgacagtgaaagcagttatcttggtgtattaagcactgctgataaggcagttataacatcaggtggatatgagagatattttgagcaggacggacaagtataccatcatattatagacccacagacaggttatccatcagagagcgacctgacttctgttacaattgtgtgttcagatggaactacagcagatgcattatcaactgcgctttttgtaatggggcttgatggtgcgaaagaactttacagaagcggggctatagattttgatataatacttttcgatggaagcagagtgtatgtatcggagggcattgccagcggtttttcaacagatatggataaggaaataattaccagacagccttaatgagaattattattaactgtctgtattgacaaatgtggtgagaaaaatatattctatagagcagttagcgaaaactaatcgcagatagattaatatacttttgttgaagacagctaaccaagatatacagacccgaaggagcagacatgttattaataatatcacttataatcgtagctttatttatatattttctcaaggattcacttaagaaatatgccaatatattttatataggtgtggcagtaatctctattgcagtattcctgcttgagtttctgtcaatgcctttgtttgtaaagaacaatatattaggaatatttgcaaaaggctctcttggaacggcaatgttcgttgcagtaatgtatgcaggtgcacttcctaagggtagcaagctgattgcaccgcttatgaagataagaggtgaattgtcaattacagcggcaatactcgtcctgtgtcataatttcacatatggaatgacatatttcagaatgttatttactaagacaagcctgttatcagccacacagcttgcagctgcggtaataagtcttgtgcttatagctataatgcttgtgcttacagttacatcttttccatctgtaagaaagaagatgcaggctaagaagtggaagcagttacagcgcacagcatatgtgttttatggtcttatgtatgttcacattatgctcattaatataccttatgcgagacttggacttggcatgtatattgcaaatgtagttatctacagcatagttttcttaggctatgcagctatgagaatagcaaaggctgtatcagtaaaggcagcaagagccggaaagacatacggtaagaaaccagagacggttctgtatggactggcattggttatatgtgcagtgatgacggtgttgtgctttgcaggaagacagacagtgtcggcatcggaagacaatgaggaatggaacgatttctttaacgaagagacagttgcagcaatggtcaaagagattgagagcagtacggctaagacagatgccgaaggaacaacacaagagagtctggaagaatcagtttcatcagatgaacagtcagactcacaggctggtggtgaaggaaatgaagtgtcgggaaatagcaataattccggttcggataatgtttctggtaattcatcaggtaatagttctgacagtggtaatcagtcagccaagccggataatggttctgacaataatggagagctgagcggcggttcaggcagtgatacaccggctaataccacatttaaagcagacggaacatatacgggttctgctgtgtgtgatacttataattacaatgtaacggttacaatagtcatatcgggagatgtgattacatcagttacagcaacttcagaagcaggagcacaggacgtacagtattttaatatggcaaatgcaaaggttcctgcacagcttcttgcaaatcagagtacatcaggcgttgacagtgtttctggtgctactaaatcaagcaatgccataaagaaggcattttactatgcttataaatctgctaagaagtagagcagatttgtaatagataaaattataaggaggcaaaattcctctcctcaccaatgggttcggattttgcttcgcaaaacaaggaggaattatgaggaagaacatttttactaagattgctgctgttgcagccgctactgttcttgcagttacagcacttccagctcttgtgtctgatacacatgcagcagatgatgagtattcatatgtatatgctggacttacatggcaggaatactgggctaacgagggcgtatataacgcaggagatgtaacaacatctaatgagaaggatacacatggtgagtatgataaaggtgcttttgatacagtaacaagagctacaaccaatcatggtcttcacagaggaagctaccagtgcatggcaacaattgatacagaagatggtaagaagtatgagcttgccggctggagcagtgatggaaaacagatgatacttacagatggtacacagctttcatatagtaagggaacaattactaatgcagatggcacaacatctaagctttcttcttatgaagtaactggtattaagtatgttccggttaaggttaagacatctgatcttgctgattttgagcagcattacagagttgtcaagaatggtgagaagttatacggaggattcggtgaggtccagcttagttcatatgagtatacagcagatgttaatgcagatactaacggacttaagacagcagttaagaatgcagatggaacatattcattctctgcaagacagactggaagtggaaagtcatttgcagagcaggatatcagtgaagctgctaacattacatctacggtaaaagaagctacaggttcatatggcgagttcttaagagttgatattaatggtgatggttatggcgcattaggtgctatgatgcaggctgttaagtggacatactatggaaatgatgcaacaagaacaaatgtagttgctacatatggtactaaattcgcagcagacaactggatgcacaaatcaatgggaatccagcttggacttacagattcagcacgctgccagttaccagcaggatatgatggaacaggttactggtcacttactgtatatgcattaggatatactgatactacaattgattttgaagcaactgatgctaatatcgttaaggttaaagcacctgtaagtgatacatcaaagctttcagcagctattgcagcagcagatgcacttaacgaagctgattacacagccgaatcctgggcagctatgaagcttgagtatgaggaagcagtcgatgcacttgcagttgcagaatatcaggcagatgttgatgaggcaacagagcatcttacagcagcaatcaatgcattagtaaaggttgatgcaggtacaggttcagaaagaacagatgatacaaatggtgctggtacatcagactcaggttcagcagatacatctgtatcagatgttaagactggcgatgcagacaacatggcagtatattcattagctgcattacttgccatggcagcaggtgcagcagttgtatcaagacgcagaattaaagacatcagataactgatatgctaaaatctaataaaactataaacaagccaaagaaccggggcataagtcaaatctatgatgggatttgcttatggtccggttctttgattgtgttatgttgatttttgttagtttttgtacttgtcaagagcgcatttggaggcgttgataatatctctcagaatataaaaatcctgagtagaacaagaatcaaggacgttgagaatttcagttttggtagataaattgatacttggtgtgtcataaagtaattcatcagtctgtacagacagagcctctgcaatatcaacaaatactggtaagcttagctttgtgttcccagtttcaatgtgactgagatgcgttgttgatattccaaccttttcagccagttgttcctgtgataatccacagccttttctaaattttctgattttttgcccaatcatataataatccataatccacctgcctatagaatataattatacttgaattgtatggtcgaaaatgctaatattacataaactatatgggctattttatatctatgtggttaaaatatacttatgagaggtagaacatatgaaagggaagataatacgcataatatgtatgcagataattttggctatgttggtattgagcatagggtgtgggggtaaatcgttcgtaggaaatgaagtgacatctgaaagtagggagactatttctacagaactaaaaagtaccaattcaagtgctgaaaataacactatcagcgttggagaggtgaaagccgtcaggtatagcggatataaagattattactatactggtgttgatggaaaagcgtatttatttgatatgacaggtaaaataataaaagaatacgcatatgaggaactttgtcccacagatttttttgatggaatagctatgaaagaaatggtagatacagcacatagtaagggatattatgttattactgattatgatggaaatgtgataacgtccaaatatatttcatcgtcagatcgtttttttaagatatacaatataaatgatgaaccattaatagcagcatttgtttttaatgacaccgctctgacaagtgaaggacaagttgtatttaaaacaaaagatggaaaagataaatatgtatttagtacagaagacgataatatgaagtctaatggaattgatgtatcatatttaaaaaatactgatacaagtttaagttatgtaggcgatggaatggcatatctgcataattggtataaaaatagttattttataaatttagaaactaaagaaatctttaaagacacatttaatgcacatggagattatattaatggatatctttcttttaatggaaatggtggttgtggaattgtagatacacatggtaatgaattgctggatactaatattgttcctgaactacaatgtacatttagtcagggattgtattataattgttatgataaaaaattttataatattaacggtgaatgtgtaattgatttatctcaatatgatgttgttaatccatacagatatatggatacgtatgaaaataaaatgaaaacatatgtatttgatgaatcaggaatatgtaaaataacagttaataatccttctggcaaaaattattatggactaataaataccaaaggagaatgggtgatagaattacaagaacagcaattgagttattttggaaaaatagggaataacttaatattacttcaggcgaatggtggttatgaggtgtatgacattaataataaaaaatatgttgggaagaccatggatttaactacaaataatattactcataacttctataagggtaaattaatgtatgcatataatggagaaatatacatatatgactataatacagagaaaaatagtaaagtggtgttgtataagtaaaaaacaaattgaaaaagatgttgtagtgatttagactacagcatctttttttataccaaaatgtgcatgtggttaaaaacaacttgaattatatggtctataatgctataattttattaacttgataggcagaacgtgtttatacagttaataaagcgcaaaggagaatttttatgaaaaagaagattgctttagtattggcagtaatgatgttatgtggtcttgcagcatgcggagaaaaatcgggagtacagcagaaaacacaaaatcaggcaaatttggttggaagatgggagcttgtagatgtacaaacagattataatagctcatattatcatatcggtaaaaaatttgaacttttcagtgatggaacaggtataagcagtgcaggatatgaggagaaatggatagctgaaaatggaagattaaagaggggcgatgatgtatgtagttataaaataagtgggaataaattaatattaacgcatgatgatggtactattgaaacctatcagagagtacagcagtaaattaataggcaaaggagaaaaatatggaagagaaaaaatattgtcaatattgtggttcacctattgatagtgaagcaaaattctgtaccaaatgtggaaagagcattaatggtgagcagaacgcttccgttcagaagaaggtttatcagcagactaactttgtgatggatatgttaagaaactttggaaatcctaatacagtaataagaattataagcatttttagtgctatatttctggcaatagtacagtttttcggaatgggctatatgctggaggctggcggatggtttgtaagtaaaacacagaagattagtgcaataaaattcttgtatagattggttttcaaatcgggagatatgtcagactacggtatagaattaaattttttaattgttatatgttgtcttgcatttataattggatatatagtgctgttagttgtagatgtattattgttaaaatatataatagcagattatcatatagacacaattgttgatgtagataagggaatgtctatatgtggaatagttatgtttggagtaacaataattattggaatgtatattagaagcaaactagaagaatacggaatgcaagatatgtttaacataaatgttatgtgctacataggtcttatatattcccttgttttgcagatattctcaagattaattattaaatcacagttagaagatgaatagtattagaaattaggctgggcgaaagcaaatcgttcagtctttttctgcgttgaaataatgaaataatttaatgaatgcatcttatgtgtcaaaaactaaatccgacagaaaaatgacagatgacgacacaaaagcaatagaatacgacaagtatatttacaacactatatatctatgatactatgcgtatataaatatgcatgtttattaattcagaggagaaagaaacaccggtgtcgtatattttatggaggataaagagaagaaaaattattatgacacggccatgcatcagattaatggggactcattatgcttaagtgcatatgaatatcttaagaataatgcagaatggattggaaggtatgaggattttctaaagggaaagaggtcacttccattattgtatgatccattttttaagaagatatttaatccagttgagagagaagacaggctttcagaactggtaagctgtctgttggggcagaaggttacagttcttgaagtgtttcctaatgaggattcgcagtttcttggtgtgatgattattatggatatggttgttatgatggccgatgggagtatcgccaacattgagattcagaagatttcatatgattttccggcagagagaatatcgtgctattcagctgaccttgtgctgcgtcagtataagatgatcactggaaagaatcaggcaggaaagcataattcttcaatgaatggttcttcaaagccgtcttataaagatatgcgtaaggttcatacaattattttgtttgaggacagcaataaaagtcttataagtgacatggataaggcattatattttcatgttggaaagacacgatttaatactggagtcaagatagagcttttgcaggattttgtgcttgtaagtcttgacacgttcaggaaatacagatattctgatatcagagaagggtgtaccgagataacggattacgattatgacagtagtcagtataatgatgaattagtctcagaaaagatgaagagagacagattaaagttcttgtcattattcgtagcagagacaccgcaggagatagacagactgatagagatatttcctgatctggaatcagtacgccaggatattaatgagtatttggaaagacccggggaggtgctcagtatgttttcagaggcgttgaggatattggataggaatacggcagagttgatggttgacaggatgaaagatgagatggagactttgaaggcacagaatgaagaactaaagtcatcatcagaagaaaaagacgcagagatagcaagattaaagaaactattagaagaacagaataagtagtaaaaaacagcagctaccacaaccataagtggtaactgctgttttcagattaattacctgttaatcttaatatccccaagattaacatcagcatttatactctttccgctgccggcattattagtatagctgtgagaataagtagaatcattaaccttgatgtcgcctaagtctacagagagattagcactgtatttatcaatatccataccgcttattttcagtgagcccatatcaacagagagattaaagacatcactgttgcaattggtaatcttaatatcacccatattaacatcagcagttaaattcttaacggcagaatcaacgatcttaagagaacccatatcaacagagaaatcagcagaagaagcatgtatattgttaacatccatatcacccatattaaggtcagcctgaatggaattaagactgacattgtcaggaatagtaattgtaagtgtgcagtctgagtttttgatattagtcataagatgtacttttacatgctgttcaatatttaatgaagttccagaaacagatacagcaggcttaaacttttcagcacctgtatagataacttcaagcttgctgcctttcttaatctcaacactgccaagattcatatcaacagatatgtctgacacattatcataagtggaagaattttcaatatatttgccactggatgccatagttatgcgtgtaaaaggagaaatgttaaatacattaccaagaacgccaataattatgcatataagtgtaataaaatatataattgacagataaattcgtttactcataattacacctccccggaatcgtctttaagtatactcttaaatatagcgtgtattacagccgcaacaggccatataacccatgttaaagcccatgcaaatgtgataaaactgattgacagatatatacatgtaacggtaggccagaaaacagacataatagttgttgcagtattgttaatatatctgacttctttattctccttcttaacatagctgccggctacattgtcaccattaagggcaagtaaagtcttacatgaagtctcagccattgaaccgaaaacaataaggaatacgccgacacttactatacaaatcattgctgcaccgccgatatcgtcaagtccctgtattgggattgcgtcaaaaacagcagcagggacaaagcttatgatacacataataattcccagagtgcggcacacaatagaaatgttgcgaagctgttccttcttatcctgcacatatccgacagtggcataatcaatgatacatttgtgtttcttaatatagttgtatctattcattaaagaattggttattataaatatgccaacaccgcaggcaactataataaacagagcaacagtgcccattgtctggagaaaattattatgaaatgcactgcaggctgccgctggaactactgagaaaatacataagaaaacccctaatgcagtcagaaatgcatgtcggctgccggcacttacaaagcttctggcttcatcctgtgttaaagtgcgtctgttatcaacaggagcagaagactgtctgttaagtccgagagtttctgcgagttcgtcaagattgccaaattctgagataacagtgcctacagcctcattctcgcttttgccttcactgataagttcattatatttgtcctccatcatgccccacaattcgtctttagcctttaaaacttcagcagttgcggggagattggcaaacatagtttcaagataacttttaatagtatccatacattaattctccttcacaataaatttttcaataacttctttagtgagagcccactcttcacattttgactgataatacagtcgtccttcgtcagtaatctgataataggtgcgcttctttcccccattctcgcctacaccggggaaagaagtgatatatccgttcttttccattcgtgtaaatgcggagtaaagagtagtttctttaacaatatatttctcattggtcatggccttaatctgcttggaaatctcataaccataagatggcttatcaagcagaagatacaggataattgtatcgttgtagcctcgtataatgtcgctgctgatgccagccatgcatattcctcccttcgaattaattgaaggtgatgattcacctgataataaatattaaataaatgataattactacgacaggcgatactacgacagccgtagtacatctgtcgtagtatatataacatgatatgcataatatgtcaacaggagaatataaaaatccctcaaaagcaggtaaacagtgcttttgagggatatattaaaaatgtggattatttgaaatatactttagctgcagtagcagacatgatattttccttgtcggatgttgatatttcattgcttaagacaatgtaatcaataaggtgtctgtagctgtccttgcacagattcataggcaggtcgcttccccacataagtcggtcgcttccgacaagttcgatggcgcgtttaatataatggattgcgtcaggataagggtatctggcgtctttaccctgattagaaggaaggcttgcaaggtcgaatacaacattgtcaagcgtgagtgcctccattcctttaagccagacattttcctgaacaagacctcttggggcaagcagatggcacacaacaaactgcgtgtcagggtgtcttttaattgcgcgggcgagggattccggctgccagcactcggcagggtagcgtccaatatcgaacacaacagtattattatgcatttcagcatatgacagcatttcctcaataacatcaccatcaaggggaatagtaggatgataactcataagaccgcttccggtacttacctcgaattttacaatcttaattccgaggtcttcaaacaaatgctttcttatagaatcaacatttctgcagaatgggtcgtaagtagctgctgcagcaagacggtcaggatatttctttgcagcctcataagtgtagagattctgcggtcctaagaaattgccctgaagcataacagccttggaaacgccagcctcgtccataaccttaagaactgcttccggagttacatcatattcaccgagacactctggtatcatctggaatacagttccatcagcgtagcttgcgtaacctccgcctatagcctgcatttctccgctgtttccaaatccattgatgcagcggcatatatgaatgtgtgagtcaattatgttcatagttaagcctccttgttgctagatgtagaaagaatattgagattatgtccatacagaaattcattaataattccaatgtcatattcacatttgttaatcataattataattgcagcatcgcggctgaccttggaatacaaagggcttaagcctgcagtttttaacgcacggttggtatcagtaaggttcatatggcatgcgatgcagagtgcaattactctgtcacggcttggattggtacgattgccattaagtattccgtatgcataattagctggaatatcactttgtcgtataacatcacttaattgaagtccgtagcttcctatatacctgttaaagaattcgctgacagatatctgtgagtcagtatcctcttcattacggtatctgttaaaatgttcaggctcaactgaacttaagattttatcaagttcataagtcggtttttcgttcattattaattccgcctttcacaatagagtacacattttctattgatatagtgtataataataaacactaaattacaataaggataaaaatatgactttagaagaagagagcaggctgtcattttacagggaactgacagtacttgatgaaaaaaagaatatagtgctggtgcaggatataaggaacagtgagctttgcgttaaaaagacacttgatatatattcgcgtgatgtatatgagcagcttgcctctgtaagaattgagggagttcctgcggtaaaggaatgtgttgctgatgatggaaagcttatagtagttgaggagtatgtgcagggcaggagccttaagcaggtattagatgagcagggactattaaacgaggaacaggcatatgaaatagcagtccaacttgtggacatacttgtgagactgcatcagttagagccggcaattgtccacagagatattaaaccatctaatataattattgaaaaaaatggacatgtgaatcttatagattttaatgcggcaagacatgttaatgcagataagaatgaagataccagaatgctgggaacagtgtattttgctgcaccagagcagtttggattcgggcagtctgatgagcgtacggatatatatggtctgggagcaacaattaattatattatgacaggtgacaagccgggagcaggaattgcagagtgcagattttcagatattcttaagaaatgccttatggtagatgcaaaggatcgatatcaatcggctgaagagcttcgtggcgtgctggatatgttaaattatagtatagtacaggataataggaaaaaagctgaaacagcatttggtaaggataataccatttcggttgtgagaacctatcgtaatataagagatataattgttaaaatgtacaggaaatatcagaaaaggaattacgatattgatacttcatggcgcagatatctactgccgggattcagacggctgaatgtcgtgtattgtctgattgcgctagtatggtatgcggttattgtatggatgacaataacttttgcagttacggacagtaaaacgggaataccggtaacgggcggagaacttacaatgtataagatagctgtatttgtactcctatttggaatgacaatgtggtttggcaactatcttaatataaggagaaagcttccgggaatgaagaagataaatgtattaagtactattctgacatttggttatgcatttacgattagctttatatttttagctttttttgcaatatttatggcaattataggatatttgtaattataaaaagacaggatatatgttgagactattcaatattatatcctgtttttttgtgctgtcagcacacggtttgcagccatcattgtgataacatccattatatgaaaaagatatttatatatgcaaacatttcccttccaatactggcaggcagtctgttttactatgtgacttcaccacaagtcatttttgcacagaatattgacaggctgcttggagtcagtctgcatgttggaacggagaacacatttgtagtaaatttgcgtagttatatgccagatatgctgtgggcgtatgcactggtattttcattaatgctggttacaggtaataaaacagcttatgtatggaaaatgtttgtgatagcaggcatgttttcgacaattatggaagtccttcaggttaccgaatgtgtaaagggaacatttgatgtgatggatattattgttgagataattgcagaactgatggctgtttttattataaaaagacatgatatgaggaggaaatcatatgaaaagaatcaggaagtacataggggtactgctgtgtctgatagtatttgctgcaatggcgatgggaagtggatctgacacaagcgtagataacagtaatgcgagtggggcttcggacaagacaggcacagaaagtgataatgttgtcatggtaggtggaagctttgagaaagatggattaaagggtaccgttaatgatgcagatacagattttaccgattacgatgatccatatggattttacaagcctggtgatgggaaaaaatatgtcaaagcagatttttcatttgaaaataacggtaaatctgatgcttatgtaagtagtgcagattttagctgttatgcagataatgagagctgtgatcaaagttttatcgcatctgtaaatgagttctcaggagatacattatcaactggtcgtaaaataaacttcagtgtagtatttgcagttccagttgatgcagaatctatcgaactggaatacacagccaatatatggtcaagtgaaaaagtaataataaagcttcagtaggaggagtagaaaatgagagtttggaaactggtatcaggaatattatcaattatattatttgcagtagttatgtttcagtcatgcgccgcaggagtagttaatgcacttgaggacaatggtggcatatcaggaagtgtcggcgtaatagttggaatacttatgcttgctggtggaattgtttcgatagctacaagaaataagactggcaagggacacgatatagcgttgattgtacttttcggacttgccgctgtattcggatttgcaggatacggcaattacagtgacttagtaatctggtcagtatggtgtcttataaatgctgttctagcagttgtaagcatgattaagaacagataaaaataattcgtaatataaaaaatgtctggtgtgccgcagtagagcagcatgccagacatttttgcattaatcatattaatatgtaatttccctgccttcttttctccactgtctgaattcagcagaagcagaaagtaaaaggtcagatgatgagttaagtgcagtttcaacagaatcctgaataacaccgatgatgaagccaattccgacaacctgcattgcaacatcattaggaataccaaataatgagcatgccataggtataagcaggagtgaaccaccggcaacaccagaagcaccgcaggcagaaagcgctgcaagaatacttaaaagaattgcgcttggaatatcaacagtaatacctaaagtattggctgcggcaagtgtcataacagtgatagttattgcagcaccatccatgttaatagttgcaccgagcgggatagtaacagagtaagtatccctgtcgagtcccatatcctcacattccttcatattaataggaatattggcagcggagcttcttgtgaaaaatgcagtgagtgcgctcttttttaaacatctgaatacaagtgggtagggattcttgtgtgtacaccagaaaacaagaatcgggttggtaacgaaatagataaaaagcatagtaccaacgagaagcataagaagctttccatattccttaaatactgacataccattgtttgacacagtatcaaatacaagtcccataataccaaatggagcaaaattaataatccaggtaacaaccttggaaaggccattagagatatctacaagcatatctttagtagattccttggcatgtctacatgcaataccgataacaacagcccatgcaagaatacctacatagttagctttagtaagagaagtaataggattctcaacaatattcatcaacaaagagttaaatacatcaccaatacttcccggtgatgacatttcttcaatgccttctgtcagagtgagcgtaaccggaaataatttgcttgtaaatactgcgattacagaggcaagaatggtactgaacatgtacagaataattacggttttaataacaccaccatgactttttcctgaatggcataaagaacttatgacaagcacgaaaacaagaagcggtgcgatagccttaagtgcaccaacgaaaacgcttccgaaaagagcaatgccggaagcctttggaacgagcaggccaagaataataccaagagccagtcctccaataattcttttaatgagactaatactgatccatttgtctaataattttttcatatctaacagattctcctatgcaaaactttttctattataaacttacagaatttatttgacaactaatactgtaaagaataaaaattatattgtaaaatataaagcaattactatattaagagagaaaatgtcatgaagagaatctataattatttaaagaaagatgcagtacttacaataagctgggtgcttgcaatagtttcaatgttttttataaaaccagacaaagcatatgccggttacatagactggcgttcacttggaatattgtggagtctgatgataataacgaaaggctatatgcagaacggcatttttgaaaaaatcggacatgcccttcttacaagaacacgaaaaatgtggcagcttattgcagttcttgtaggactgaatttctttagcagcatgattataacaaatgatgtgtcgcttataacatttgtcccatttgcaataatgatgcttaagcagtgtggcaggcaggagcttatgataccagtagttgtattgcagacgatagctgcgaatcttggaagtatgctgacaccgattggtaatccgcagaatctgtatctgtatggactggctggaaaaggaatcggagaattcataatgtggctgctgccatacacaatagtttcagccctgcttctggttatatcaatccttcttataaagaataagaacgaaataatatgtatagaagatacagacagcgaagctgcacataatacatcagtgccacgagtcatggcctacagcgtattatttattcttgcacttttagttgtcgcaagagtgctgacatggtatatacttgcagcagccgttctcataacggtattactgctggagaaaaatgtgcttgcgaaggcagattatgcactgctactaacatttatcggctttttcatattcacaggcaatatgggaagggttgaatctgtggcacattttcttgcaggaatcgtgaaaggccgggagctggaagccggaataataacaagccagtgcataagcaatgttcctgcggcactgttattatcagaatttacagacaatataaagaacctggcaataggggtgaacatcggaggtctcggtacgctcatagcgtcaatggcgagcctcatatcgtacaagctgtatgccaatgaagtgccagagaaaaagggaaaatattttgccgtatttacagtttacaatataatatttctagtggtgctgtatgtgtttacgaaattgatataacatatggaaaatcttacataaaatggtagtatcaaatagcacatgaaatattaggtttaaaggacaagtttataaaacaggaggggaaagaaatatggattcaattaatatgtgctacgaaatgtgtgattatatagagcagaatggcattgtgaagctggcaggaaatacaagacttcgcgacaatcttaagaaggagtttctgcattttctcatatacatatcaatgacagatggaagatatggtgaggaagagaaagcatttataaagaaaaaactggggttcgatgtaagtgcgtcaatggcggctgatatcaagaaccgcaacatgcttggcgcgggttatattacaagagtgccggagacatttaaatatttcatattagccaatgccggtcataagattaagaacgaccgatacgacaacaaagaggcgcggacgctggcagaaagctacaggaagctcggacaggaatatctggctgcgaatactgaaagcaccggggtcgagataaatgttttatcatcatactgtgtgatgctggacgagaatcttaaatcatacggcctgctgcgtcctgattacaagagtgtgacaatacaggcagagacagaagatgacgaaaagccggacgctgatgaactaattgcagaacttaattcactgacgggacttactgcagttaaagaagatgtcaatgcacttattaatcttcttaaagtccagaaaatgcgtgagcagatgggaatgaagcagacaagcgtcaacaaacaccttgtattcatgggaaatcccggaacaggcaagacgacagttgcaagactgcttgccagaatatataaggcaataggggcaatctcaaaaggacatcttgttgaagtagaccgttcaggacttgtgtgtggttacataggtcagacagcgacgaagactgcagaggtaatagaatcagcacttggaggagtcctgttcatagacgaagcatatacacttactaatggaaaaggtcagggcgacttcggacaggaagccgtagatacattattaaaagaaatggaagacaacagagatgatttagttgtaatagtggcaggttatacagaactgatggaggaattcttagattccaacccgggactgcgttcaagatttaataaattcattaacttcgaggattacacagccgaggaagaggttgagatacttataaacaactgcaagaaacaggaatacatgctttcccgtgatgcacttgaggaagcaagaagattctttacagaccgggtagccaataagccggaaggctatgctaatgcaagagatgtaaggaactatcttgaaaaagccatatccaatcaggcaacaaggatagtcggacttaaggatgtggataagaatatattggcgatgctggagaaggaggatctggtggggattgagttgtgacatacgggaggttgtggcagacggacgctgtgggcgggggatagtgtcattttcagacacgctcccgctcggtggaaaacgcagctgtactaaattcgctggttaaccgcataaaatgcggctcccagctcattaagtgcaggcgttttccaacggtctgaaactaacactatccacccgccaccgcttacgttgctgcccctcccgatgtcgcaagcttatcgggggacttctggcgtggcgggttgaatgaaggctcacctcaaaattttgcagacccaggtgagcgaagcgatatcgtcaggtgttagtttcgggattgtaagaggcagggagagagtcagccgggttaattgtgtatatttcctggagcagaccgttgaaaaacgtcggcacttaacgaggcgggggagccgcctttggcggctgccccgggcgagtttagtaccgctacgtttttcatcgagcgggagcgggtctgcggaaggaaatatgccaattaacccggcgtctgtcctttaccaaccgtaacaagcagaaaggagtaactacaatgggaacagtatattttacacgacatggccagactgtctggaatgtcgagaacaagatatgtggtgcaacagattcaccactcacagatttaggccatgaacaggcaatagagttaggaaagaagatccttgcagaaggaatacagatagatgaaatcctgtattcgccacttataagagcgaaagctacagcacttcatgtatctgagattacaggaataccagcgcgcgaagagataagacttaaggaacagaatttcggtaaatacgaatcaacaccaagagatggagaagaatttgcaaaagccaaatgcaactttatatgtagttttgatggaggagagacaatgcttcatcttgcacagcgtatatataatctgcttgatgatataaaggcacagcctgataaaacataccttttggttgcacataatggaattgcacgaatggtaaagtcctattttgaagatatggggaatgaagaattttcagcattcaagataaagaattgtgagatattgaagttcgagttgtgacatacgggaggttgtggcagacggacgctgtgggcgggggatagtgtcattttcagacacgctcccgctcggaggaaaacgcagctgtactaaattcgctggttagccgcataaaatgcggcttccagctcattaagtgcaggcgttttccaacggtctgaaactaacactatccacccgcccgccacttacgttgccgcacatcccgatgtcgcaggctcatcgggagacttccggaggggtgtgtgaccgggacggtggttgaatgaaggctcacctcaaaattttcgcagacccaggtaagcgaagcgataccatcaggtgttagttttgggattgctagaagtatggagagagtcagcggggttaattgtgtatatttcctggagcagaccgttggaaaacgtcggcacttaacgaggcgtgggagccgcctttgacggctgccacgggcgagtttagtaccgctacgtttttcatcgagcgggagcgggtctgcggaaggaaatatgccaattaacccagcgtccgttcgcccttccccctctcataatcaccaaaactaaaacacaataccccctagaccgcatcatttctttgagctataatcaaacccggctgggaaagccaatgaattgtatagggaaagaaaggcagtaatatgtttaacaaatcatacattaaaaaggctgcagcgatagcagcagtaatacttgcggcaacagcacttccggttaatatggcaaatgcagatacacagacaacaggaagtactgtgacaggaagtactttaacaggaattacagcaaatcaggcagcatcagaatacacagaaatccgcacagcatcagaacttgtggaggcagcaaagacagctacaggtaattataaactgatgacagatatagatatgacaggagttgagtggacgccatgggatttttcgggaacatttgacggtaacggacacagcatacttaacctgtcagtaaagacagtaagcaagaagacaatgaagacctatgacggcaatagaaaagagtacgaaacatacggtgcaggtttctttggagtgcttacaggtgcgaaagtaacaggactgaatatatatggagcaagaattgagatttctacaacagaaccatgttttgcggcaccaatagcagggcttgcggacgacagcgatatatcagactgtataattaaggatacatatgtgtcactaacagattcagctaagatgtggggaacaggtggaattgccggatttggaagcggcaatcttgataacatcactacagatgtaacacttgtctgcgttgatacagatgcagccgtaagagatgagcagttcatgggaggcgcgtatgcagcaggtttccttaatataaggaattgttctataacaatagatggatacgattcagaccacggatatgtacatgatggcggacttgtaggaatgtacatggtatatccgttagaactgtcaaagacatatcagggcgaagtgcttaacaacaaagttaagggaatgataacatttttcgaagataatacagaccgtcgtgcatactgtcaggcaaatatgggtgaggtcatgaactggacatatgcatattcaggcttcacatcagatttcaagagaaatgagacatatgattattcagtgacactgcttccggaaatgtgcagcaatccttcatacactgacacagtgacagaagcaacagcagcggatttcggctacacaacacatacatgcagcacatgtggttatacatattcagataaatacacaatacacgagcataaggttgacaattacagtgttgtaaaggaagctacgggaacagacaagaaagacggaatagaggcaggaacatgcagcctgtgcaatcagacagtttacagggaatatgctgcaaatgtagtaacagacgacattacacaggcagcagacaataaagcatcaggcacgtctgtcaaaaaaggaatgaaagaaagtacagcagtatttgcggtaatattggtggtaatagttgttgtaataattataacagtagtcatgatggtacagaataataaaagaaaaagaagacataacagacaaagaagacgcagatagaagggagcagttatggaagagaacacatttataaatgtatcaaaagatatgatgtcattcatagaaaaaagtcctacagcatttcaggtaacggcgaattttatggatttgctggacgacgcaggatttgtgcgccttaatgagagggacagatggcatcttataccgggtggcaaatactatgtaacaagaaatgattcttccataatagctttcagaatgccggcggcagagggctttatcaattatcagattgcagccgcacacagtgattcaccgtcatttaaggtaaaagagaatcctgagctgacaccggacaagaattacgtttcgttaaatgtggaaaaatacggcggcatgcttatggcaccgtggtttgaccggcctctttcagttgcaggaagggcaatagtaagggaaggtgcagtattaaagccagtccttgtaaatgtagacagggatttatgcataattcctaatcttgcaattcacatgaacagggaagccaacacaggacttaattataatgcacagaaggatatgataccgcttataggagagacagaatccaaagggctttttgacagcataatagcagacgctgcacagacagataaagagtcagtgataagcagtgatctttttctgtataacagacaggcaggaactatatggggtgcggataatgaatttatatcagcaccaagacttgatgatgtgatgtgtgcatattcatgcatgaatgcgcttatagacagtgatgagagcaaccaggaaagcgttgcggtatgtgcggtatttgacaatgaagaggttggcagcagcaccaagcagggagcagattcaacatttttatcagatgtgcttatgcgtatagctgcgtgtgcctgcaaggataatgaggattatataagggcgtgtgcaggttctttcatgctttcagcggacaatgcgcatgcggttcatcctaattatcaggagaaagctgatccgactaacagacctcatatgaacaaaggtatagtcatcaaatacaatgccaatcagaaatacacaacagatgctgtttctgcggcaatatttaaagaaatatgtacaagagcgggagttccgacacaggaatttgctaaccgttcagatattccgggtggttcaacacttggaaatatagctaactgccatgtgtcaatgaacacagtagatatcgggcttgcgcagcttgcaatgcactcaccttacgagacagcaggaattatggacacagaatacatgataaaggcagtaaaagaatttttcgagacagccattgtgactaacagcaacggcacatttacattagaataacagaaagatacggtatatgagcaatactatatatatggccccgatggaggggcttacagattttacatacagaaatgcctatgagaaaacatttggaaaaggcagaattacaaaatatttcacaccatttatctcgcctaataagtcagagaattttttggcaagagagctgcgtgacatagaccgtgagcataataaagaaacatatacggttgtacaggtcatgactaatgaagctaaggattttatatggacagcaaaaatgctttatgaaaaatacggctacagcgagattaatcttaatgccggctgtccgtcaggcacagttgtttcaaaggataaaggctcaggaatgcttcgcgacacagaaaagctcgaccgttttcttgatgaggtgtatgaggatgcatttataagagagaatattaaggtttcggtcaagacacgaatcggtgttgaagatgatgacagttttccacagataatggatgtgtataattcttatcctcttgaggaacttattgttcatccgagagtgcgtacagattactacagaaatgagctgcatcttgacgctttccgatacgcagtggataacagcaggaataaattggtgcttaacggagatatatttacaaggaagaatttccttgagatgaaggagatgtttccggaggttgatacatttatgcttggaagagggcttatcgcggaccccggactgattaatgtattaacagatgataatcctcaggcgatggtgcgagaccttaatgcagacaagaagctgatgaaagagcttcacgaccttgtatacgcagcccgcacagccataatgccgggagatacacatgccatacacagaatgaaagaaatgtggtgttatatggaatatgtgtttgatgattgcaaaaaagaaatcaaggcaatcaagaaatcccagagaatggctgattacaaggctgcagttgatgtgttctttaacaaggcagtgcttgttgaaagaaagaatattgtattttcaaaaaaattctaaatcagtgacaggcagtatcatattagatattgtctgtcttctttttctgctggtggcctgtcataaaggcaagcacctgtcttggcaggaatctgctgccaaaaactccggctttcattgtaaatgtcggaacaatcgtaagttttcctgtaaacattttacagagtgcataataagcacagtagtcagcaggaattcctgatagtgcgaacttgacattggcaacattgttaaagttggtatcgactggtcccggacagagcatgcttatgtgaacgttactctttaagtcgcgcagttccccgtgtattgcagtagtgaggcttgtcacataagccttggttgcataataggtagacatatatggtccaccaggaagcagcccggcacttgacgccacattcatgatgtagcccctgtcacgttgtataaagcccggaagtacggcctttgtaagtatatgcacagctttaatattaacattaatcatgttgatatcattctttaatttcgtttcagcaaatgtgccaagttctccgaatccagcattattaatcataatatcaagtggatatttgcggagttttttgccaagctttacacatgatttttcatcagataagtcacatgtgatacatttgcacctgacagcaacattatcagcaatttcatgaagcgccgctgagtttcttccaacaagaatcaggtcatattcaaggtctgaaagcagatatgcgaattcttttccgatgccggaagatgctccggtaatacaagcaagtttcataagaagactcctttctttttcaattcatgtttctgattttcaaagtttaattccaagatattggcttaacctataagaataaaaaattctcatgatttataggcaaatactggcgatattttctttggaaatcttcaatattcataaagatgcctataaacaattcaaaaatataactcttataggtgatttatcgccatcatgtgtcattttcagttaatgtaatataaaaatgttcagaaatgtcctataagttgacataaaatgcgactatctataggtatcacgagaaaaatattcatgatatttaatcccagacaataaaattatgcctataaacattgaaataaaaacaatcttataggaaatgtatgtaaatattatatcagattcgtgcagtttatgccatatagcaaactcgtcatcaatgcacaccgccgcccaccgcacccctgcaatataacattgacacacctccccagccgggattaaaattattctttagataaagcctgctaaagaggcgttcataatgtagtgttatacagggaggaattgatgacaataaagaatgaaacagcattcacaaaggaatgtatggaaggtgccatgcgtgccagtaattttgataacagcagatataagacctttaagctgatttacaatatgtttggacttatattcggaatgatgatgataagagagcttgttcttaagatgacaggaaatgagcaggctgatacatttatgatagtgctgtttggattggtggcggtagtatttctgtatataggaatgattggaatggataagagcaataagaagaaattccataatatatatggaaagatggtaggaattaaattcacatatgatatagatgcagagaatattattattacagatgaagaaaacgacagtgacacattcagttggaatgaagttgtaaaatggaatcaggatcctgataatatatatctgtttgttggggatgataactgcctggttgtaagcaagaaagggtttacccagggaagtgcagatgatctgaggcagcttgctgatgctgtacttggtatgagaaatgtgacaggaaacagccagcagtaaattgacaaacactattagtagcagatataatatcttcatctgcgtttagctatgcgggaaataatcaggaggaggaaagccatgaacaatcaggaaatgatggaactttcaacagtagataagagcgattttgaggaacttgtaaaagagtgtacagcctcaggtataatcgatcagaatctgtatacagagtatgatgtaaagagaggtcttcgtgatagcaatggtaacggtgtacttacaggtctcacagagatatcagatgtattaggtaaccagagtgttcacggaagaaagatacctgtagacggagaattatattttcagggatataatgttgaggagcttatcaagagaagcagccttgacagattcagatttgaggaagcaacatatcttctgttattcggagtacttccagacaaggatcagttagacagattcataagaatcttaacagatcttcaggaactttcaggagcattcatcagagatgttattatgaaagctacaagtactaatcttatgaattcgcttatgaagagtatcttaagtctttattcatatgatgagaagccggatgatatttcaattcctaatgtattaagacagagtcttcagcttatagctaagatgcctcttctttcagtatatgcttatcagtcatacagacattttaagcttgatggaacacttatgataaagaatcctaagaaaggttattcaacagccgagaatatcctctatatgttaagagatgacggagactttacagaacttgaagcaaaggtacttgatatttgtcttgttcttcatgcagagcatggtggtggtaataactcaacatttacaactcatgttgttacttcatcaggaacagatacatattcagcaattgcttcatcaatcgcatcccttaaaggacctaagcatggtggtgctaacttaaaggttcaggaaatgtttacagatattaaggcacattgcagcgattgggacaataaagatgagatatgtacatatcttaacaagatccttgacaaagaagcatttgaccatgccggacttatctatggtatgggtcatgcggtatatactaactcagatcctagagcagttattcttaagaaatttgcaaaacagctttcagaagagaagggaatgcagaaagaatttgcattatatgagcttgttgagagcgaggcaggacagcttatcatgaacaagagaaagatgtttaagccagtctgtgccaatgtcgatttctatagtggatttgtatacacaatgcttggtattccagaagaaatgtttacaccaatgtttgcaacttctagaatttcaggctggtgtgcacacagacttgaggaacttgttaatgcaggtaagattatccgtcctgcatacaaatatgttggacatcacagaccatatgttgatatggacgagagataattacgtttaatggagtagtaaaattatgtcacagtacaaggttaagaagctggaccacccgattcactgtacagttgaagtgcctggttcaaagagtattactaacagagcgctgcttatggcagctttatcacagggtgaatgtacccttaaaggagttttgttcagtgacgattcgagacattttcttttaagtcttatcgcacttggatatattatcgaagtaaacgaagttgaacgatatgttatcattcatggacatggaagagatattcctaagaagagagcaacaatcaatgtgggaagtgccggaacagcagcaagattccttacagccatgcttgcattatcagatggtgagtacacaattgaagcttctgaacagatgaagaaaagaccaatgcttccgctttttgaagcattacagagcatgggagcagagatagagttccttgagaaagacggacatcttccagttaatgtaaagggtgcaacatatggtggaaagaaaccacagaatcatgtatcaataagtataagtgaaagtacacagttcttaagcgcacttatgatgacatctcctatgcttgaagaaggaatacatgttcatattacaagtgataaaacagaaggctcatatgtgcgtataacagctaagatgatggaacagtttggctgtgcagtagaccataaaggggcagaatatgtagttcctgcgggttcaggttactatccacagacatattatattgaaccggatgtttcagcagcctgctacttttatgcagcagcagctcttacaggcggaacagctattgttaaaggcgtacattctaactcaatgcagggtgaccttaagttcatagatgtgcttaagcagatgggctgtgctgtgacagaggaacgcgagggtatatgtgtcagcggacctaaggatggagaatattgcggtgttgatgttgatatgaatgatttttcagaccagtcaatgacacttgcggctattgctccatttgcaaaaacaactacaattatcaagaatattgagcatatcagattgcaggaatcagacagaatcgaggctatggtcaacgaacttaacaaccttggcgttgatgtcaaggaaggaagagaccgtatcgagatatctccaggtaaggtaaagccgggagttgttgatacctacaatgaccacagaatggcaatgtctttcgcacttataggactgcgtgttgacggcataattatagataattatgagtgctgttgtaagacatttgagaactattttgaagtacttgaaaaggcatgtgcacaatgaaaatacttttatacagatggaaggtgttcaatcaggatgatgtaaagtttgcgattgaatatttcggacatgaagtacatgattacacagaaacagtaatagataaggatgatgagaccggctttaagctccgtgattatgcggagcttaggcaggtcttttctgcatacgactgtgttttttcacttaattattttccacatgtatcggatttatgtgaagagcttgggaaaaaatatattgcatggacggtagatagtccgcttatatcactgtatcatcagtctttatttaataaatgtaactatatatttatatttgacagattttattgtgaggaactaaaaaatcttggggcagaacatgtgtggtatcttccgcttgctgtaaactgttcccgtgttgataagataacaggttcacttaccgctgatgaacggaacaaatggcacagtgaagtatcatttgtcggaggaatgtatcacaggaattcttatgatgaaataaaggataggttgccggaatatttaagagggtattttgatgcggcaatggcagcacagatggaaatctatggtgacagcatatttgataaagtgcttacagttgatatacttgaaaagttatgtgagcttatagattttaagcaggatgaaagagcattttcagatattgcacttgtgttttcatcaacatttttaggtttcaaacttgctaatatagagagggtgcagatacttaacaagcttgcaaaacattttccaacagacctctatacggatgatccggataaggagcttataggagttaatcttaagggtgcagttaattatatgacagatatgccgaaggtgtttaattgcagcaggattaatattaatcctgtaatgcgcaatatccgtacgggaattccgcttcgggcgtgggatattgtcggtgcaggcggatttcttatgaccagttttcagcttgaatatatggattttttcgagaatggaaaagattatgtgtattacgaaagccatgatgacctgttaagaaaaacagaatattatcttaatcatgaggatgagcgtgcgcagattgcaagaaacggacatgaaaaagcagtgaagtttcattcatatgaaaagagaatggagttcatacttgataaatgtggtatgttaaaacattaaagttcaatttatagcagtttactatattgaaatgtgcatatatgaccattgttgaaaataaatatatatggtattataaaaaaaggttgagacaacaaccatacaatattataacttttactttcaggagggaaaagaaatgagtttttgtaagtattgcggaaaacagttacaggacggagaagtctgtacatgtcagcaggcacagcagtcagccggagcagcacagccacagcaggaatttaatcagcaggcagcgcagcagacattccagcagggagcaggtcagcagacatatcagcagggatttaatcagcagcaggcttcacagcagatggaagcagtgaagaaagcaggagctaatgcagcccttgattatgttaatgtattgaagggattgtttacatcaccggtagaaacggtatcagcatttgttgctaaagctaatgttattatgattgcaatacttattggcggtcaggcaattattaacatgcttacaagattgtttgatatgttaattgctaacagtaaggcaaaggttacaacaggaagtaaagagcttgacagcttactttcatcttactacagctcatatactaataccaagccatatccagcaggctcaatattcaagaacatgcttcttgagattcttctggtagcagtagcggcagctgtaattgcacttgtagttatgcttcttgcaaaggcatttaacaaggctaatgttacatatatgcagggccttgcagtatatgccattacagcagtacttggtataccagcagagttactcagctgggtaacaggtcttacatcagtaggattcattgacagaatatcttcatgcgtaacagtattttctaatgtagcaggatatgcatttgtatacatagcaatccgtgcattatgcaaggatgagaagaagatacctcttataatggcaatctcatatgttgcagttaatttccttacatgggtattaagacttatgttctaattaacaatttgataattgattataattaatgattcccggcagaccggaagtgtgaatacacaatggtctgtcgggaattttttattatttttcaactttttacaaatgtatttcgtatataagtgtaagagaacttatatcaaggaggtacttatggggagaagaaaatgtttaattattccggtccttatggcaggaatattattaatgggaggctgcagcagacatagcattgaagatgtgaagcattttcaggagacaagcacagccgtagagaatcagaccaatcagacaggaattattcaggagaacgaatcacgtgagaacaaagttgataatgtgtttgcgggaatggtttcaagtagtcctaaatatgctgaaagatattcagatgttgatatggagatttatacagggaaactggttaccaaatttacatacagtataggtgaaacagccattgctgaaaatgttgatgagttatccaagctgatgagcgaggaggacatagctgaatatataaaatatgatactgaaacaccagaaaaattcagtgcatatgacaagatgattaatgaagatggaacatttgcaaatgatagaaaaggtatcaagcaggttgccctgctgatgaagttaaagattactaataatggtgatgaagattttcagtttctgtcgaacggattccgtttgtattgcttcagatataacgaacaggacgatgcaacatattattcaaccatagaaagcagacaatcatatcttaatattcatgatgaccatgaaatattcagacatcatcttacaattaagccgggagaaactaaagaggttgttgcaatggaggtcattccttatgaatttgttacttcttacacaagaacaactgctaatgttggaggtcaatatatagatacatataaggatataacaacagatggtcttactatagattcgttgtatacatgctacagtacaactgataaagcatttcctgttggttctccgatagtaaagcttgatatagacaagtagccgggaggaaaacagtatgaaggtgatgattaagacagagctcgaaagagcatttaaaagctggagtctgtggctggctcttataattgggatggggttaagcatagcacagattataaccaggattataccggcagccatgaatccgctgatgggatatatgcctgataatgccacacttatgccgataagtgcatttcaggtgtggataggtaatggagtatcatttgaatacagtctgtttataaggctgattccgatactggcggctatgccgtatgcagttacatatctgtcagatattaaaagtggaattattaagaattatgtaacgagaacagctaagtttaattatcttgctgccaaatatattgcagtgtttgtgacgggaggtgtggtagtggttatgccattgcttattaattacctgactgcgataactattcttccatcacttgtgtggccggttggtgtatttgcaagttctccaaaaagtatatggtcagcaatattttatacacatccacacatttatatgattatgtatatgattctgctttttgtgtgcggaggtcttatggcaacaatagcacttattgtatctaatatagttaataacagatttgtggctatgcttgcaccatatattattactgaatttgcaaatgcgatactgcgcatgtctgataagaaatggctgagaggtattgcaccgacaaagctttttaatatggcacagaccaatacaggagcatcgtttatagtgtacatagcagtattactgatacttggagttgttgtgtattttataggagggcttaagcatgaaacatactaaaggcagattcagcataagaaagcacccgtttataattacatttataataatggcagtaattgctgtagtagttgcggttggatatatagatgtgaatcacagatttccagagccggaagaagaaatcgtccagaaggatgaatgggtacagtattctgatgggataaagattaaggttacaggaattgattactgcactgaacaggaagttaatgaaaaatacagtgccagtgttaaggaactgggcaggtttagttatatagttttaaaggttaaagttcagaatgagtcacaggataagtttaatatgttcagtattgtgacagactctaatcttgttatatacccagatggatatgaaaatcagggaatggtatgtgaagataatgtatctgttaataagggcgaggtcaaagactttacactggcatatgtcattagtaaaaattatctgagtgaaaagaagctggataagctacttcatgaagatatatatctgtgttttaaggcttatccagtaagacaggcgattgtaatcaggggtatagatggatgaagaaattaaaattattatttaatgtaagtgaggctgcacttacggcggctgtgtttgtattagtaacagcacttgtaccgatggatataattctaaaacttgtgagtcagtctgttattaatggaaatccgtgcctgtatgatgcacttatcagtgtgaatgtaagtacaatgtggagatatgttgttccatttgtattgttttatgttctttatattcagaaatatgatttgaacagtgcaatagttataagaagaaagaatgtaagaaatgtgtggattaattcacagattaatatggttgtggcagcgggatttttctctgcgtatattacggtggtaactttaacagccgggtatctgatgacaggaaaagtatataactgggatgaaaaattcagcaaggcattcatggcaacaggagatatagtacagaaccgcccatcactgtggctttttataattgcatttgttatagaagcatttgcaatattgtatgtatcaggcacgcttatgatgattatgtggtggtttactaataaccagtgggcaggtttccttgctgccttggctgtgagcagctttgagaacatggcgtacatgggatttcttacatattattacaagttaagaggcaatatctatatgaacggtgtgcagatatggcggaatatattgtatccgctgatactgtgtctggctgtgtcactggtaacaactgtgattatcagaagaaaggactttttcagatgaaaaatgtgatgtttcagataaaatatgatttcattaatggaatagtgcatcagtggaagaaatttcttctgattgcagtggtatatgctgttcttataacagactttcttgtgcgctgtaagacaaaacattttatgggacaatacacatcatcggatatcatattatatatatttcgcggtatgcgctggattgtggatatacagacggatattaatattccgacagcatacatacttccgaatattcttattggttttgcaataggtaattatccattcaaggacattaacggttatggtggaatggttcttatgagagccggtaagaagctggtatggtggatttccaaatgtatatgggcagtgcttactgcatgtatctgttatggaatcttaatacttgagatagccggtgtttcgctggcaggtggaagactgagtctgcaggtcaatagacaagtgtgtatcagtatagacggttacgacaaaacactgataaagaataatccgaatcttacaagacttgcagtgtatatgattagtgtggggcttctcacaacaattgcaatatgtcttgtgcagatatgcgtttcacagattatgggacctattattggatatattgctgtcgtagttataatgattatgggagtgtttttcaggtcattcctgtttataggaaacggcttcatggcgttaagaaatattatgtatacaccggaaggcggaagccttacactgacggttattgcagatattgtgctgatagtcgtttctgtaattgcaggatatatttcgtttaggcaaatggatatattaaagaaaagtgattggagggtgtaattatggtaataaagcttacaaatgtttcaaaggttataaagaaggcaaaggttcttgataatgttaatctggaacttacaagcggtaaagtgtatggcttaaagggaaagaatggctcaggaaagacaatgcttatgagggttatatgcggtcttatatcagcaacagagggaactgttgagatagatggcaagattcttggaaaggatatgacatttccggacagtgtcggagtgctaatagagaatcccgcatttatcggtaattatacaggttttaagaatcttaaggtgcttgcttcaatccagaacagagttgatgatgaacatataagagaggtaatacatcaggtaggtcttgaccctgatgataagagaacttatagaaaatattctcttggtatgaagcagaagctgggaattgctgcagcctacatggagaatcctgaccttatcatacttgatgagcctatcaacgcacttgatgaagccggagcaaagcaggttcatgagatacttgaggaacagaagaaaagaggtgcgcttatcataattgcatgccacgataaggaagaacttgagatgctctctgacgagataattgagattagtgaaggaagaatcatagaaaagtagaggaaaagggcggtcatacaggtaagtgtgatcgccctttgatatctaaatgcttaatttgccgctgaatacaccatcgtattcagtaaaataactctcttcaatctttctcatcataacagtaacataatcatcaatatagcttaatgatatgtacatattgcctacagaactgtcaataatctgcactttgataagaagattattgtcagctctgaaagctgcgcttgcaccacatttgaaattataatcagggaagttctgaaaaacattctttccgagtccgaaatgcagctcgtgatttcctgttgcattagtatagaaaaatgttccttcatccccgttaaatgtaagctttatgtctgttacaccacatggattatcgtcaaattcatagctctttccgttgattttgcttacaaggtctgaactatattcgcccggctgcacaagaagctggcgtgaattctcgaacttctggaattcttcataatcactattatcactattatcagtacatgcatcaatatggctgtatacttcctcgtaaaatgcatcatatatcagctgtactccaccctgacgaccttgtacatcagcagtggtgacaagaataacatctttgtcagggtaatatatggcaagctgccctcccatgccaaaaaatgcataaccattgtgagttgtcatccagaactggtagccatagccttgcatctcttcccatgtgcctgattttccataagggtcactctgcttaacagttgcttccttaagatatccggaagggagtaactgcttcccgccaagtttaccattctgggatacaacatacataaccttaaggatatcctgcggtgttgcacacattcctgaaccgcccatgcttactttgccatcaggagattttaatataaatgcttctttagaaaatcctaattcgtctaagaactttgttctcagataatcaagaagttccataccagtgagcttttcaacaagtgcacctaatgtatgcgttgaagctgtatcataagagaaattagttcctggaacgtggtcgggtgtaacagtaaagaaagaacctacccagtcaggagagcctccgattttgtatgcatttttatcgtgacatgttctcattgtgagcatctgccttattgtgagcatctgcatatatgggtgcacgcctgtttctggctgcttttcaggaaaataatctgcaatatggtcatcaagtgagattctcccttcatctgcaagcagtccgatggcaagtgaaacgaaagatttggtgacagaaaacattctgtggagagtgtctcttgtgtatggtgcatagtagctttccatacatatcttaccgtgtcgcatgacaattatgctgtgcataggaatgttgttatattcaagctttctggcaaagctgataagtcctgtggaagatattcctacatcttctggtattaccttttcaaagtctaacattgttgtcctccaagatagttgtagtgattaaacacaataattgtttccattatagtccttttgtgtgtatactgtaaatcaaaaaataagaatctttaaattaaatccaatatagtatatacttaatgtaaatatgccagagggcatgaaggagaaggaaatgatagatttattacttaagaggttcataaaagattatgataagacgaagaaccctgaagtccgtacaagatatggtgtgtttgccggaattgtggggataatctgtaatcttatactgtttttagcaaagataattgcaggagtgcttacggcatcagtttcaattatggcggatgcagtcaataacctatcggatgcaggatcttcaattgttacacttataggttttaagcttgcaggaaagccggctgattatgaacatccgtatggtcatggaagaatcgaatatatatcaggcttcatagtatcaggagcaattataattatgggctttgaactgctgacaacatcattcaggaaaatacttcatcctacgccgcttgaggtatctgtgtcatctcttataatacttgtattatcaattcttatgaaaatgtggatggctaaattcaacaaatatcttggcaataaggtggattctgctgcaatgaaggctacagcaacagacagcttatcagactgcgttgcaacatcagtagtccttataggagtgcttcttacactgttttctgatattaatatagatggaatagcaggagttgttgttgcagtatttgtaatattagctggtttcggtgcggcgaaagatacattgcagccacttcttggtcagccaccaactaaagaatttgtacaggaacttgagaatattgttcttcaggataagcacataattggggttcacgacctgattgtgcataattacggtccgggcagagtatatgcatcgcttcatgcagaggttccggctaatatggacatgatggaagcacatgattatatagacatggctgaaagaagagttgaaaagcgcatgaaatgctttataagcatacatatggatccggtagttacagatgatgaggtgataaatcatttgcgaaatatgactactgaggttgtaaagtcagtaggtgaggaactggatatacatgattttaggactgttaaaggcccatatataacgaatcttatatttgatgtgcttgttccttataattatcatctttcagatgatgagataaagaaacagattcagaaaaaaatcacggagaagcagagtgaatgccgcgccgtgattaagattgataaaagttatacaggctgattaaatccagccgccatcaagagttattatctgaccggtaagataactgttcattccggaaagagatttaacaagtttagcgacttcctgcgggcttccaaaacggcctgcaggaatttcttcggcaagggaagccttgtcatcatctgagagatgaccgttcatctctgtgtcaatagctccgcaggcaacagcgttgacctgaataccacttggagcaagttcctttgcaagtgcttttgtaaatgagttgactgccccctttgttgctgaatatgcaacctcacagcttgcaccatacagtccccacacagaagatatattaataattttgccacagtgtcgcttcatcatgtctttaacagcaaaatggcaacagttaaacacagaatctatgttagtgttacatatcctgtgccactcattttcgcccatatcctggaaaagtccgacaacagatattccggcattgttgataagcacatcaacctgaccgaaacgctgaaggcacatgtcaaacattttctgtacatcactgtaatttcccatatcgcctataaatgtttcacagacactgccttttttctcaataatggatttgacttcatttagtttatccacattattcacacagttgataacaatattagtgtcttttccggcaagttctattgcaattgcttttccgattccacgggaagcaccagttataactatagtttttttcatgataatatgcctcgcttaatttcaataatatcgttattataatacaggaaaatactggatatttctataaaaaaattaaaaacaaatattgacaaaaacttccttgtgcatacttaccaaaaagaaattcagattgtatttatttcaataattgcttgacaagattttaaaatgctttgaaaagttttccacatttttaaagatcgattttatctaaaatgagacttatcaaccaagttatccacattatccacaattatccacaatattttgttattaatttagtatacctggaacagaataaatgttttgtgaatatttgcaaaaaatcagaaaacttacttatgacacttgacatatttgcataaaataattaaaggacatacttgttaatttacaaatatatgatataatacttacataaaataagtatacagaaatgtatcttaggtcgtgttagctgcatgtgtatatattctttcgacacatgtggtgatttaagaaggaagaatgtctgatagattttataaagagaaggttggaaaggaattacgatcagattcttacctctgcccacgattataaaacacgtaaaggagttggacatcatgagatttataattacaggaagaaatattgatataacagagggattaaagtcagcagtagaggagaagcttggaaagcttgacagattttttgcaccagagacagaagttaatgtaaccttgagtgtagaaaaagaaagacagaagattgaggtaactattccggttaagggtaacatcataagaagcgagcaggtaagcagcgatatgtatgtttcaattgaccttgtcgaagaagttatcgaacgtcagttaaagaagtataagaataagattgttgacaagcagcagaacgcagcagcatttgcacaggaatttgtagagaaagattatgatgacgatgaggttaagattatcagaaccaagagattcggaatcaagccaatggatcctgaagaagcatgtgttcagatggagcttcttggacataatttctatgtgttctttaattcagagacagaggaagttaatgttgtttacaagagaaaaggcaacacatatggtttgattgaaccagaacttgattagtatgcttttttacgtcatatgggtttatcctcttttttagagtaccgtctgccggttagtgctggcaggcggtatttctttatatgtataagaaatctatttatagaattttaatggtttaactttacttgatagaatatctaaatagtggtacaattacaacataaataggcttttataaggagatatataaagtaatgggattagctcagaaattatttggaacacacagcgaacatgaattgaaaagaatatatccaattgctgataagattgaaggctacagagaatcttatagcaagttaagcgacgaagaacttaaaggaaagactaaagagtttaaggacagattagctaagggagagactcttgatgatattctgccggaagcatttgcaacagtaagggaagcgggcaggagagttcttggtatggaacattatcgtgttcagcttatcggaggaattattcttcatcagggaagaattgccgagatgaagactggtgaaggtaagacacttgtgtgtacacttccagcatatcttaatgcacttactgaagagggcgtaatcgtagttactgttaatgattaccttgctaagcgagatgctgagcagatgggtatgatacatgaattcttaggccttaaggttggcgttgtattacacgactcaacaagagaagagaggcaggctgcatatggaagtgatattacatatgtaacgaacaacgaacttggttttgattatcttcgtgataacatggctatatataagagtgaacttgtattaagaaatcttaagtactgtattatagatgaggtcgattctgttcttattgatgaggcacgtacacctcttattatctcaggacagagcggaaaatctactaaattatatgaactctgtgatatacttgcaaggcaattacagcgaggcgaatataagggtgagagaactaagatgcaggcaatcatgaacgaggaagttgaagaagatggagacttcatcgttaatgagaaggataaggtagttaaccttactgaacagggtattcacaaggttgagcagttcttccatatagataattatgcggatcctgagaatcttgaaattcagcataatgttacacttgcacttcgcgctcataatcttatgttcagggataaggattatgttgttaaagatgatgaggtacttatagtagatgaatttacaggccgtattatgccaggacgtcgttattcagatggtcttcatcaggcgatagaagccaaagagcatgttaaggttaagagagagagtaagactcttgcaactattacattccagaacttctttaataagtttgagaagaaggctggtatgacaggtacagctcttacagaagagaaggaattccgtgaaatctataacatggacgttgttgaagtgccaactaacaagcctgttataagagttgattataatgatgctgtatttaagactaagaaaggcaaatttaatgctgttgtacagtctgttattgaatctcatgaaaaaggacagcctgttcttgtcggtacaataacaattgagacgtctgagcttcttagtgagatgttaagaaagaagggcatacctcataatgtacttaatgcgaagtatcatgagttagaggcacagatagtatcagaggcaggacgtcatggtgcagttactattgctactaacatggctggtcgaggaactgatattaagcttgatgatgaggctgttgctgcaggtggtcttaagattattggtacagaaagacatgaaagccgtcgtattgataaccagttacgtggacgttctggacgacagggagatcctggtgaatcaagattctacatttctcttgaagatgatcttatgaggctgtttgcacaggaaagacttatgaatatattcaacagtcttggggtatctgaggatgaacagattgagcataagatgttaagcaaggctatagagacagctcagaagaagattgagactaataactttggtatcagaagccatcttcttgaatatgatcaggttatgaatgagcagagagagattatgtacgcagaacgtagaagagttcttgatggagaaagcatgcgtaattctatcatgaagatgataactgattatgtagagaatgtagttaaccgctgtgtaagtgaagataaagatgctaacgaatgggattatgatgagattaatgagcttcttcttccaactattcctattgagagagtggaatacagagagaatattaagaataagaatgaattaatacatgatcttaaggaaaaggctgttaaactctatgaggataaagaggcactcttcccagaggctgagcagataagagaaatcgagcgagtaatccttctcaaggtaattgacagaaagtggatggatcatatcgatgatatggatcagttaaagcagggtatcggtcttcaggcacttggacagagagatcctgttgtccagtataagatgatgggttatgacatgtttgatgagatgactgcaggaattacagaggataccgtaagacttcttatgcatattcaggttgagcagaaggttgaaagagaacaggttgccaaggtaacaggtactaataaggacgaaggaccatctgttaagggaccagcgagaagaacagagaagaagatatatcctaatgatccatgcccatgcggaagtggcaagaaatataagaattgctgcggaagacaggcataagtttataagagacatcagggcgcggaatgcttgaaatatcagcgtccgcgcctattattttggaggacatatggtagagttagaccagtttagatacagaatttcaggatacgataagcctatggctcagattaagaattctctggatcttgacaataagcagaaaaggattgaagaattagaggctgatatggaatctccgggattctgggataatccggataaatcacagaatgcaatgaaagaacttaaaggcttaaaggatgcatttgaaagatacaatgagctagaaacaggacttgatgatgttaagacacttattgagatggcagaagaatctaatgatcagtcgcttattccagagatagaagaagagataacgggtcttgaagacaagatggaaagtttaaggattgagacattgctttctggagaacatgatgcatgtgatgccattcttacacttcatgcaggagcaggtggaacagaaagctgtgactggtgtcagatgcttttcagaatgtatactagatgggcggaaagtcacggatatacaacagaaacacttgattatcttgaaggtgaagaagcaggaattaagtcggttactatagagataagaggagagaatgcatatggacatctgaaatctgaacatggtgttcacagacttgtaagaatatctccattcaatgcggcaggtaagagacagacttctttcgtatcatgtgacgtaatgcctgatattaatcaggatatagatattgagattaatgatgatgatttaagaattgatacatatcgttcaagtggtgcaggtggacagcacattaataaaacgtcatcagcaatcagaattacacatcttccaacaggaattgttgtacagtgtcagaatgaaagatctcagcaccagaataaagataaagctatgcagatgttaaaggctaagctctatcttttaaaggaggctgagaatgcagagaatctatctggaatcagaggagatgtcaaggatattaatttcggaagccagataagaagttacgttcttcagccatatacaatggttaaggataacagaactaataaggaagttgctaatgcgggcagcgtacttgatggcaatatcgatccgtttatcaacgcgtatcttacatggataagcacaggaaagactgaagaataatgaaaggtggtatatcagtatggcagattacataaaaccagtaattttcagattagggaatcagcagtttggagtggatattaatcttgttcagtctatagaaagagagattaatattgtaagagttcccaatgcaatgaaatatataagtggaattgttaatctgagaggggaggttattcctgcattcagtttaagaaagaagtttggcacagatgacaatgttggtgtgattggagaagacagtacagtaattgtaaatatacctggtgttgtaaagcttgctcttgaggttgatgaggtgcttgaaataggtgatattgatgctcagagcattgtacagatgccggcgcttgcgaagactgttgatacagaatatcttgacagggttgccaatgttaatggacagcttgttattcttcttgatgttgaaaaattacttacgcagtcagaagcagagagtgttaagaaattcacagaagatatgaatgataatgacggaggtgctgctaatgtctgatactaagtttgagagaaatgcaggcatacttatgcctgtaagttcattaccatcaccatatggtataggaacatttggcaaggatgcatatgattttgttacatttgttaaagaatgtaatcataagtactggcaggtacttccgttaggaccaactacctatggtgacagcccatatcagtcatattctgcatttgcaggtaatccgtactttgttgatcttgatatgcttattgaggctggattcttgttaaagtcagaggttatttcaagagactggggtgatggaattgtgcctgtaaatgtttctgaagatgacgctgttaatggaagattcggaacctacagaaatggaaatattggtgacgaaagatatgtcagttatgaaaagatatataataacagatttgacatattaagaattgcttataacagatttaaggctgcatgtgcagaaagcaagaagacgcttgccaaggggcttcctctttataagcagtttgataattttgttaaagataatgtagactggcttgaggattatgctctgtttatggcattgaagtcccattttaacaatgtctcatggggtgaatgggaaactgacataaagttcagaaagcctgaggcaatgagccgatatgaagagcagctttctgatgatataggatactggaaattcatacagtttgaattctacttacagtggaatgcgcttaaacaatatgctaatagtaatggtatagagattataggcgatatacctatttatatgggatatgacagcgtagatgtatgggctaatcagggagaattccagctggatgagaatctaacaccaataaaggttgcaggtgtaccacctgatgcattctctgatgcgggacagaaatggggaaatcctctttatgattatgataaaatggaagcaaatggattcagctggtggagaaagagaatggcagcttcagcaaaactatatgatgtcataagaattgatcattttataggaattgtgaagtactatacaattccagcagacatgcctgatgcaagacagggtgagtacagacagggaccaggacagaagctgcttgatgttattaatgaatctatcggtgataagaagattattgctgaggacttaggtgttgaagttcctgaagtagcaaagattcttaaagaaaatggatatccgggaatgaaggttcttgaatttgcatttggtggagacagaaagaatccgcatctgccatataattatacacagaatcttgtatgctatggtggaactcatgataacgaaacgctacttggtttctttgaggacagaggcgactgggagttaggatatgcttatgactatcttgatacaagagataagggaagaatggttgatcaggtattcagggctgcgtattcaagtgttgctgttcttacagtatttgcagttcaggacattctcaaacttggaaattgggcaagaatgaatttgccatcaagcatgggtaataactggaaatggcgaatgcagaaaggacagttaggccagcacgaactggaatgcatgagatatcttgcaagtgtatttgatagagaaagaaagtaatattagacggggcagggaattatcaacatatttcctaccccccctttttaaagaaaaaacaaaaaatagtataatagtactatttacatattcctgattagtggtattatattcatataaagagacaagttaatatattggcaaagtagtcgaaaggctatgacgcaaagccaagggtcttaactgattttatcagaatgacagccggttgcattacaatcaacgcaaatgattcgtattattcaggcatccggtaatcggatgtttttttattatatggttcaacgggggaactgattatgaaaaagaataattctaaaaagtggatcaaaacaataacaataacaacagcggtacttgtatttgcagctggtgcggtatttgcattaaagtcagcaggtacagctaatacagataaagatagtgctgatacagtagttgcggcagctaatgaagcaacagatttagtggttaaagaaacagtttcagagaaagaaacagaagttattacagagacagccgctacagaggcaacaacagaagaagccacagaggcagtaacagaacagagcagtacaattgcagagattcagccacagacagaggttgcaacagaagcagttcaggagccagaagttacagagttacctgttgtacagactccatcagatgcaagagttgcacaggttatagcaggaattaatgctgagcgtgaggcagctggtgtggcagcggttacatatgatgtgacactcacagatatggcacaggtaagagcatcagagaatgcagctaatgattactttgttatagagaatggtaagcataaaagaccagatggaagaaatgcttcttcaatatgtgaagattatggacagagaggaagcttcggcgaggttatgggaagatatcaggaaactcctgatgagatagtaactggctggcataattcagcaacacattatgcatgcatgacaagcagtaagtataacagagttggtgtgggtattgcagcagattcagaaggatatctttactgggtagcaatcttcatggattaattttaaatagacaatagattacataatatagatacaacttaatatggtaagaacaatgtatttgcggcgttgtttttataaagcttcattagaagcgaaaaccctcacattcctctcccgttgtgtgagggtttctttttgtgctgtaattaaagaaaagacatgcaacccttatttgttatatatctgggaaatgggatgaaccacggcaatgctgcaacatggttatagtatctgtgttgcttatgaaaagcagaaatgccagaagttagatgcaaaagtttatgtttggatagtatgtgatacctataggtagtcgtatttttgaaacttttataggcagaaagccacaatgactataataatagacgagaaataaacctatatatgaatgataatgaagacttttataggaaaatttctataaaaacaggattttaggacgaaaaaacttatgaatatgcctataaagtacaaaatttctacggatttataggacaatgcttcctgagacaattaccaaactggaaactgccaaactggaaactatcaaaccagaaactgctaaattagaagcaagaaaggaaatcagaaaaaatttgataagatatctggcaagatgttcaattgagcatttaaagagaaagacacttgcaatgtgtatacatatatgataatattctttgtgcggtagacagttgtttatcagagaaagacatcgaagaacaattgtctttgtaaaacggacaatagaaaggtacagacgcagtatggcagataatattaagtattatgtcgttaagcaaaaggctctgcctgaggttctgcttaaggtagcagagacgaacagaattattgagactgaaaatatatctgttgcagatgctacagagaaagttggaataagcagaagttcttattacaagtataaggatgatatttttccgtttagagagaatgtaaagggtaaaaccattacatttgtattgtctatggacgatgaaccagggctgctttccctggtattgaagaaggttgcagaattcaaggcgaatattcttactattcatcagacaattcctgttaatggaattgcttcgctgacgctcagcgtggatattcttccaactacaggagattcttcagaaatgatagagcagatagaaagacttaaaggagtaagatatcttaagatattaagcagtgatgcatctatctgatatataagcaattaaagaaaacggaggcagatatggcaaagattgcagtgttaggttatggaacagtaggatcaggagtggttgaggtattaaataccaatggtgcttcaattgcaaagagagcaggagatactattgaggttaagagtgtacttgatttaagagattttcctggagatccaattcaggataaaatcgttcatgatatagatcttataattaatgaccctgagatagaggttgttgttgaggttatgggtggcgtagagccggcatttacatttgttaagaaggcacttgaagcaggaaagagtgtgtgtacatctaataaggcacttgttgctgcacacggtccggagcttcttgagatggctaaagaaagaagacttaatttcatgtttgaggcatcagtaggcggtggaattccaattatcagaccacttaaccagtctcttacagcagatgagattactaagattacaggtattcttaatggaacaactaactatattcttactaaaatgagcagagaaggaatctcatatcaggaggttcttaaagaggcacaggcactcggatatgcagaaagaaatcctgaggctgatgttgaaggctacgatgcatgcagaaaaatagcaattctcacatcgcttgcatttggaaatacagtgaaattcgaggaagtgtatacagagggaataacaaagatttctaatgaagattttgcatatgctaaagagcttggaagtgttatcaagcttcttgcaacaagctacagtaaggatggcaaggtatatgcaatcacagcaccatttatgattgacagcacacatccattatataatgttaatgacgttcttaacggaatctatgtacacggcaatgtattaggggatgtaatgttcttcggagcaggagccggaaagcttccaacagcaagtgctgtagtatcagatgtagttgactgtgttaagcataagggtaaaaatgttatgacaatctggagttcagtaaagcaggagcttggtgatacatttgacgagacaagaagattctttgtaagaattaagggcgatgatgtccaggcagctaaggcagcatttggtgaaggacaggttgttaaggttgatggaattaacggagagttcggatttgttacagaacctatgacagagagagcatttgaagatgctaaggataaggtttctgttataagcagaatcagaatagatgatactaaattacagtaataatataagggagaaaagtaatggttaaagtagttaaatttggtggaagttcacttgcaagcgcagagcagtttaagaaggttggcaatattatccgtgctgatgaggacagaaagtatgtggttccttcagcacctggaaagagatttccagaggatactaaggttactgatatgctttacaaatgttatgcagaggcagaagctggtaagaatattgagaagagtcttaaagcaattgaggaaagatacaatgaaattatcaagggacttggacttaagctttcattaaaggaacagttcgagacaattaagaagaattttgaggcacttgcaggaaaggattatgcagcttcaagaggagagtatcttaatggtattatcatggctaactatcttggatatgagttcatagatgctgctacagttatctgcttcgataaggatggagagtttgattcagaaaagactaatgcagtgtgtgaagcaaagtttgctaatattgaaagagcagttgtacctggtttttacggagcaatgcctaacggaaaggttaagacattttcaagaggcggttctgatgtaacaggatcaatcgttgcaagagcacttaaggctgatatgtatgagaactggacagatgtatcaggcttccttgcagcagatccaagaattgtaaataatgcaaagccaatcaacgttattacatataaggaattaagagagctttcatacatgggtgcatcagtgcttcatgaatcagctatcttccctgtaagaaagggtggaattcctatcaatattaagaatactaatgctccggaagataagggaacaatgattgttgagacaacatgtaatatgccggaatacacaattactggtattgcaggtaagaagggattcgttgcaatcagcattgataaggatatgatgaattcagaaatcggattctgtagaaaggttctttcagtattcgaggataacggaatctcaatcgaacatatgccttcaggaattgatactatgacagtatttgttcaccaggatgaatttgtagagaaggaacagaaggttcttgcacagattcataaggcagttaatcctgactctgttgaacttgaagctaaccttgcacttattgcagtagttggacgtggaatgaagaacagtactggtatagcaggtaatatcttctcagcacttgcaaaagctaagattaatgttaaaatgatagatcagggatcttcagagcttaacatcatcattggtgtaagaaacagatactttgaggatgctattaagactatctatggagtatttgttccagaagaatagttgagtagataaacagggggataaggaatatgaaagaagctaagaatgagctgttacagtttgttggcggcgtaataatgcttgttgtgggactgtacatattgtcacagaaagttatggtatcatcttcatatgggttcttctcattatggggtggcaggttctcatcaggtcttattatggtaccattaataattggagttgtatggatgtttgcttcaggtggctcatttgtatctaaagtatttaccgtactatcagtgatacttataattgcggcaattgttgcgtcaacaagaatctggcttgtaactattacaatgtatgaatgggttcttatacttgttcttatatttggcggcgccggattggttgcaaaggtattgtttgctaacaataagtcagaaaagtccaagaaagataagtcagagcagacaggcggcagttatacatcaagtgtagatgatgaacttgataagatgaaaaagaatatgaagtaaatttcattccccgcacatggagtgcggggattcttgcgtttatgcaactgttgataaactttgatgaaattgatataattaaatgtaatatgcgtatgaaaacggaggaagattaatggatatcgcaaagaagatagcggaagagctggaaattaaagtaacacaggtagaagctgctgttaaacttatagatgaggggtgtacaatcccttttattgcaagatacagaaaggaagttacaggggcgttaaatgatgaacagctccgtaatcttgatgagagattaaagtatttaagaaatcttgaagacagaaaggctcaggttctcgcaagcattgaagaacagggaaagcttacagaagaacttaaggctgctattacagcagcagaaacaatggttcttgtagaagatctttacagaccatataagcagaagagaagaacaagagcaacaattgcgaaagagaaaggtcttgaaccacttgcacagttcatatatgcacaggaagctacagaagatgtagaagtcaaggcagcagaatttatcagtgatgaagagggtaaggaagttgctacagcacaggatgcaatagcaggtgcattagatataattgcagaacagatatcagatgttgcagattacagaacatatatcagagacatcacaatgaaagaaggaaagcttgttgtaacagctaaagatgaaaaggctgagtctgtatacgagaattattatgattatagcgaggcactttcaacaattccgggacacagaattcttgcaattaacagaggagaggatgagaagtttcttactgttaaggtagaagcaccggaagagagaatattaagatatctcgagaagaatattcttaaagacaatgcatttacagcagaataccttaagaactgcatagcagatgcatatggaagacttattgcaccagctatcgaaagagagataagaagcagccttacagagacggcagaggatggggcaatcaaagtgtttggaaagaatcttgaacagcttctccttcagccacctatcgcaggcaaggttgttcttggatgggatccggctttcagaacaggctgtaagcttgcagttgtagaccctacaggtaaggtgcttgcaactaaagttatataccctacagaaccacacaataaggtggcggaatctaaggctgaggttaagaagcttatagataagtaccacgttaatcttatttcgtgtggtaacggaacagcttcaagagaatcagagaagattatttcagatatgatacatgagatgaatcttcctgttgattatgtaatcactaacgaggcgggggcttctgtatattcagcaagtaaacttgcaacagaggaattccctgactttgatgtggcacagagaagtgcagtttcaatagcaagacgagttcaggatccattggcagagcttgtaaagattgatccgaaatcaatcggagtaggtcagtatcagcatgatatgaaccagaagaagttagagaacacacttacaggagttgttgaggacagcgttaataaggttggagtagacttaaatactgcatcggcctcacttcttgagtatatttcaggtatatctaaggcagtagctaagaatatagttgagtacagagagactaacggaagattcacgaacagaaagcagcttttaaaggttgcaaagcttggacctaaggcatttgaacagtgtgccggattcatgagaatatcaggaggcgataatccgttagacgcaacaagcgtacatcctgaaagttatgaggcagcaacaaagcttcttgcacttttaggttatgatattaattcaataacatcaggagaacttataggacttaagagcaaagttaaagattttaccaagatggcggatgaacttggaataggaacaatgacacttgaagatatcgttaaagaacttgagaagccgggaagagacccaagagatgagatgcctaagcctatattaagaaaagatgttcttgatatgaaggatttaacaccgggcatgatacttaagggaacagtcagaaatgttattgatttcggagcatttgttgatatcggagtgcatcaggacggacttgtacacatttcccagatgagcagcacaaagagagttgagcaccctcttgatgttgtaagtgtaggagatatcgtagatgtaagagttatagatgttgatatccctaaggcaagaatttcgctttcaatgatacttgatgaaaaagaggcagctaacagaaagtacactaaggataattccaataataagaataacagaaacaacggcaaaggaaacagacatgacagaaagcctaagaaggaaggccttaacctttcaggtcttgccaagttcatgcattaataggagtattgtatggaagatagaattgaattcgacagcgtaattacagagaaagcacttaatgatttcaagatgtatcatgtttttcacaatgttgggggagtgttcggatatgtatttgcagcatttgcaatagttatgtgcgtgcttggagtaatattcaaaatgtctcctaaatatatagtcatgatgggactttttggagtgtttttcttcttttatccaattgttaatatgaggcttggaactaagaagcagatgaaaacagttgcagcatttaaaaagcctatgcattatagtgccggggaagacaagataattgtaagccagggtgatatgtcagaagaacttgcatgggagcagatatacaagataagattcacaggaagcaatcttattctgtatctttcatctgtcagagccaatgtgcttacagttaacagtatgggtgaggcagcagttccttttgttaaaatgtgtcagaagaaattaaagccttttcaggttaaggttaatatggataagcttgctaaggctgtggcttaagtaagcagataggaataatatggttaaagaaacatttaacgctaaagaaacatttgaagcaggatatgagatgggtaagaaggctcttccggggcagatatactgtctaaatggagatttaggtgtcggaaaaacagtatttacgcagggctttgcgaaaggtcttggaatagaagagcctgtcaacagccctacatttacaattattcaggaataccatgagggcagactgccattgtatcattttgatgtatacagaattggcgatgttgaagagatggatgagcttggatatgaggaatatttttattcagacggggtgtgccttattgaatggagcactcttatacaggagataattccagataatgcgatagagatagttatagaaaaagaccttgagaaaggctttgactacagaaaaataactatcgggcaggaggcagtatgagaatattagcgatagaaagttcggcagttacagcatcagttgcgattcttgaagatgatacacttgttgctgaatacacaattaatcataagatgacacattcacagacacttcttccaatgatagatgagatattttcaatggttcagttaaagcctgatgatgttgatgttatagcggtatcaaagggaccgggttcattcacgggtctaagaattggtgcggctacaggcaagggaattgcacttgctcttgacaagaagatggtggcagtaccaacacttgcggctatggcatataatctgtatggagacagcagatacatatgtcctgtaatggacgcaagaagaaaacatctgtacagcggaatatatacatttgacggcgacaggcttattacagtaagagatgttaatcttgagtcatatgatgagcttgctgaagagcttgtgggacttgatggacaggttgtattagtaggtgatggcgtagatgtcgcaggtgaagtccttaaagagcagcttggtgacaaatgtgttcttgcaccggctcatatcaagacacagagagccggttcagtagcacttttagcaaagcagatggcagataatggcgaatatacagatgctgatgagttaaagcctgattatctgcgcccttcacaggcagaaagagagaaagcacagcatgagtcttaaatatgtgataagaccgatgacggaagacgatacatttgcagtggaactgatagaacagggaatattctcgcttccatggtcgcagaaatcatttgcagatgcgtgcaggaatcagggcaatgtgtatctggtatgcgaggcagacggagtaatagcaggatattgtggtatgtggactgtgcttggagaaggcaatataaccaacatggcggtatcaccggattacaggcggtgtggcatagcacagatgcttatgcaatcaatggaaaagtatggtaatgacaagaatgtcacatcatattttcttgaagtcagacagagcaatctgccagcaatagccctttatgaaaaaatggggtataagaatataggtattagaaaaggattttacgaaaagccagttgaagacgcagtaataatgtctaaaattattgggtgaaataatagactgcataatatatattgatgtataataacagaaggaggtgcgattaatgcttgatgtatgtttactgggaaccagtggcatgcttcccctgccgggaagatggctgacatcgcttatgacacgttacaacggaagcagcctgatgatagattgcggagagggaacacagatagctgttaagcagaaaggatggagttttaatcctatagatgttatctgtttcacacattatcatgctgatcatataagtggtttgccggggcttttgctcacaataggtaattctgacagaaagaagcccttaactcttgtaggacccaaggggcttggcagggtagtttcttcactcagggtaattgcaccagagctgccatttgaacttaagctgatagaacttacgaatcagcaggagcatttgtcaatatgcggatatgagatagatgcattcagggttaatcatgctgttatatgttatgggtattcgattagtattccaagaataggcaagtttgatgtagagaaggcgaaagaacttggtattccgtgtagcatgtggaataaactgcagcatggaacagcggttacaatagatgataaagaatatacgccggatatggttatgggggcggcaagaaaagggcttaaagtaacatattgtacagatagcaggcctgttcagattatatcagataatgctaaggaatcagatcttttcatatgtgagggcatgtatggagaggatggtaaggaagctaaggcaaaggaatataagcatatgacctttacagaagcggcacagcttgcaaagaatgcggatgtcagggaaatgtggctgacacattatagtccttcacttgtaagaccacaggattatgttgataaggcaagaaagatattccctgctacaatagcagctaatgatggaagaacagttgagttgaagtttgacgatgagggttagattatgaaaaaatacggaaggacgataattgtaatagcagtattggttgcgttggggctgggatattactattaccttgctaataaggatacaggtaaagatgctactgatattgcagcagataccagtgaggtttctgtgcttatttcaaaagatattatggctaattatccggaatcaccaaaggatgtagttaatctgtatgcaagaataacgaaggcatattatgatacatcacttactaatgagcagattgaagctttaggaaagcaggcacgtctgatgtttgatgatgaattaaagaatacgcagacagatgcggatttctatgagaaacttaaggaagatataggcaattataattcaaccaaaacacgtataagttcatatgttatacagagtgctgccaagactaaatattcaacatttaaagacaggcagtatgcatcaatcgcattagtgtattatctgagacagggtgacaagcttatagattcaccaacaaaatttaccttaagaaaagatgatgatggacactggaagattcttttctgggagctaactgaaatagacagcgatacataataataggagatataaaatgagcgaaaaagatgatgttcttattcttgcaatagaaagttcatgtgacgagacagcagcagcagtagtaaagaatggaagagaggtattgtcaaatgtgattaatacccagatagccatacatacagagtatggtggtgtagttcctgaaattgcgtcaagaaaacatatagaaaatattaatcctgtaataaggaaagcacttgaagatgcgggagtaacacttgatgatatagatgcaataggtgttacatatggtcctgggcttgtgggagcacttcttgtcggagttgcggaggctaaagcaatagcatttgcaaagaataaaccattagtaggggtacatcacatagaaggtcatattagtgccaactatgttgagaataaagaactcgaacctccttttgttgcgcttgttgtttcgggaggacatacacaccttgttaaggtcaacgactatggcgagtatgaaatagttggaagaacaagagatgatgcggcaggagaagcgtttgacaaggttgcaagggcaataggattgggatatccgggaggacctaagatagataagcttgcaaaggaaggtaatccggatgcaatagaatttccaagagcacatgttgatgatgctccttatgatttttcgtttagtggaataaaatcagcagtacttaattatattaattctgccaatatgcagggaaaagagataaacagggctgatgtagcagcgtcattccagaaggcggtagtagatgctcttgtttcacgggcagtaaggctggcaaaagaatgtggaatggataagcttgcaatagctggaggagttgcgtctaattcagcgcttcgggcagcaatacaggaagagtgtacaaagaataacatcagattctattcgccatcacctatattatgtacagataacgcagctatgataggagcggcggcatattatgaatatattaaaggagttcgtcatggctatgatttaaacgctatcccgaaccttaaattaggagaacgcatataatgaatacggctatagttcttgcgggtggaagtggcaggagaatgaatagtgatattccaaagcaatatatgatgcttaaaggaaaaccagtaatatactattcactgaaagcatttcaggataacctgcatatagatgatataatactggtaacatctgatcattacatagaatatgtaaaaaaaaatattttagatgatacacttgataaggtttcaaaagttatacagggcggcgtggaacgatatgattcagtatgggaaggactgaaatgtatcaaggaatccggatatgtattcatacatgatggtgcaagaccgtgtataagccagaagcttattaatgattgctatgaagctgttgttgaagatggggcgtgtatagcagcagtacctgttaaagatactattaagatagcagattcagaaggctatgcagcaaaaacaccggacaggaatacattgtggcagattcagacaccacaagtatttgagtatgatataataaaatctgcatatagtagtctgtatagaagtggcagatttaatggggtaacagatgatgcgatggtacttgaaagatttggggaacatcatataaaactggtgtacagtgattatagaaatattaagatcacaacaccagaagatttgaacacagcagaaatgtttatagagaatatattttaataaataattatattagatgcagtataaggagacaggtatgagtggtttttcagttaaaagagttaatgttgttggtgcatttgcatcattatgggcgtttatatttgcattttttccgttttatagaatagaaccgatggaagtacttatacagcaggcagggaagcaggctgaatcatatgctttaactaaaaatctggtgtcatataatttttttggtgtattgtgccttatgttgtctatagttgcatttggattatacatatggaatagttcgcagcttgtaagagctgctgcgataatagtttcggtagtagattttataagccttatgcttgcacttatagtgggcaattctaatataaaagatatcaaatcaataattacatatgctgttcagtacagtggttctggaatgaagaccagtatgtttgtaaagacatctgtagcatatggatttgtgcttgaactgataatggtgttaataatgataggctcatactggattaatgaaatgttattcagaccatatgtattaggaaacaagtcagaagcagcattaaaccctctggaaggacttgtaggaacggccaaagctagctatacaaagcagatggcggctcatatgcacatgaaaaatacggtgtcatcagagaggcctgaacaatcatcagaaacatctgatgaaaaaatttaaaaaactttaaaaaagctgttgacaaagttacactgtgatgataatataatcaagtcgctggtgcgacacaataaaatagctatggagaggtaccgaagtggtcataacggggcggtcttgaaaaccgtttgtcttcacgggcgcatgggttcgaatcccatcctctccgcttaagccgttcattaaacatgaatggctttttatttgccagaggtgcttgtgagcatattgcacaaaaagatgatgcaagtagtgctggttaaagaacttgacatacaagatattgtcactttgaaaaaatatgacaaaaaagtaaaaaagttcttgacaaacaagaatggcaatgatatcctaattaagctgtcggcgagaaaagctgataacacttaatgaagttctttgataactgaatagaaagacaaccttgaaattctttgagaattttaaaatgagtgtaagtataaaaatattttagaaaaagttgtaaaaaaagcttgcaattttcaaatattgaatttaagtgaatttgttgttgacaaagacagggagcatgcgtataattgacaaggtgtggattagcgcatgcttttcctgtgcataatagtatgaattggagacaattatgctaattgatttaagagagcttttatccggttcacaggatgaaagaatagaaaaggtttcaattgaatcagaaagctttgacactggaatcgctaagtatagtatacttgagaagccagagtttgaattaagcattaccagaattggtaagaataagcttgagattaaagctgagagctttgttgttcttgatattccatgtgacagatgtttagagtctgttcctacgaaagtagagtacagtgttgatgaaatcgttgatttctcagacaatgctgccggggaagaagcaaaggaagaaaaagactatattggtggatacgaactcgacgtggacagattagttttcggcgaaatactgatatccatgccgggtaagacattatgtacccctgattgcaaggggctatgttctatatgcggacacaacctgaatgtttcagagtgtggctgtgaccgagagtccctggatccaagaatgtctgttttcaaagatattttaaagaattttaaggaggtgtaacatatgtcaatttgtccaaagaataaatcttcaaaggcaagaagagataagagaagagcaaactggaagatggctgctccaaatcttgtaaagtgctcaaagtgtggcgctttaatgatgcctcatagagtatgcaagtcttgtggttcttataacaagaaagaaatcatctctgttgactaattgtttattaaaatgtattttaacaggctgtcccattggggcagcttgttttgttttataaagaaatgtgttataatatgtgggattttgataaagggaaggcttttgattatgaaagtgaataaaatactcgcatttatgtttatattagaattatgtattatcccattacaggggtgcggtgcaaaaagtacaactgtagattcaacagaaactcaggagactcaggcacagatagatgatgcttatggcaaaggtcttagttttacatacaatgattatgctgataatgtgttatctttaagttataatcttaagcagaatgcggatggaagctggcaactgtctgtcagcggacagaatgcccatgtaaatggaacaaaagtgatatctgataataatgccaatggatttttctattatcttttgcatgaaactaatatagtcacttataaagattataataaaacagatgattcaataacttctgatgttgcgtggtggtttaatcttaatatatattatgacaaggattctatcgttgcatatggttatatgatgcatccgtctgattatgatgatatcagagttcagattactgaatatcttaatgatttatttaaaaatgcttaaggttgcgttaatttgatattcgtagtatattttacaatagtattttaatgattaatatgaaatggagtttaatttatggtaaaaatcgcacttgacgctatgggtggagataatgcaccagcagagattgtcaaaggagcagtacaggctattgctgttgataaggactgctttgtatatcttgtaggtaaggaagataagattaaagaatgtcttaatggacagcagtatgattcatcaagaatagagattgttaatgcagatgatgtaattgaaacaggtgaacctcctgttatggctataagaagaaagaaagagtcatctcttgttaaagcaatgtatatggttaagaataaagaagctgatgcattcgtatctgccggaagttcaggagcaatccttgttggtggtcagactatcgttggaagacttcgtggagttgacagaccaccaatggcagcacttatccctaccaaggatggtgtttcactgcttgttgacagtggtgctaatgtagatgcaagagcaactatgcttgtacagtgggctgttatgggttctatatatatggagaatgttgttggaattaagaatccaagagttgcaattgtcaatgtcggacttgaggaagaaaaggggaattcacttgtcaaagaaacatatccaatgcttaaagagtgtcctaacattaactttataggaagtattgaagcaagagagattcctaacagctatgcagacatcattgtatgcgatgcatttgttggaaactgtatcttaaagctttacgaaggtgaagccaagatgatacttggcaagattaagggtgttatgatgtcatctttaaagactaagattggagcacttcttattaagaaagcattaaagacacagctcaagtcaatggatgcttcagaacatggaggagctcctcttatcggtcttaacggtcttgttgtaaagactcatggcaatgccaaagctaaagaggttaagaattcattaattcagtgtgtaacatttacaaaaatgaatataaatgataaaattattgaggcgctcggtcagattccagagcagcataattaaagattgaaaggatagatattatggaattcgagaagttacagaatattattgcagatgtacttaacattgataaatcaaagattactccagagacaacatttgttgatgatcttggagcagattcattagatgtatttcagattatcatgggaattgaagatgaattcgatatccagattcctgatgatgcagctgaatcaattgtaacagttaatgatgcggttgttcagattcagaacgcaactaataaataaaccatacagattgtgatgaaaactaagagcataaggagcaaatattcttgcataatttgttccttatgctcttgttttcaaaagttcgcagaaaggtgtattatgcataataaaaatttatctgtgtttatgcagactattggttatgatttcaaagatataagtctgcttgaagttgctcttactcacagttcttatgccaatgagcagaaaaaagtaaattgctgtgataatgaaagaatggaatttttaggtgatgctgttcttgagctttcatcaagtgattatatatataagaatcactctgagatggctgaaggaaagatgacaagacttcgtgccagcattgtatgtgagcctacacttgctttatgtgcaagagctattaagcttgatacatttataagactcggtaaaggagaagagctcaccggaggaagaagcagggattctatcgtatcagatgcctgtgaagctgttataggagccatctatcttgatggtggttttgctaatgcaaaagaatttgttaataagttcattcttaatgaccttgacaataagaaactcttttttgatagcaagactatattacaggaagttattcagggacttggaaaagaagttgattatgaattcatcggtgaagaaggtcctgaacataacaaacaattcgttgtagctgctgtagttgacgggctttttaatattaaaggaacaggccacactaagaaatcagcatctcagaatgcagcatatgctgcacttatcgagcttaagaataaaggctacgatatcaactctgataagaaataataagtgaggggttatgtatttaaaaagtatagaagtacagggatttaagtcatttgctaataagatagtatttgattttcataatggtattacaggtattgtagggcctaatggttcaggtaaaagtaatgtcgccgatgctgtgcgctgggttttaggcgaacagagtgccaagcagcttcgtggttctaagatggaagatgttatatttgcaggaactgagaacagaaagccggttggtttcgcatttgtatctataacacttgataacagcgaccatgcacttccggttgattacgatgaagttacagtatcaagaagagtataccgttcaggtgagagtgaatatcttatcaatggtaactcatgccgattaaaagatgtaacagaaatgttttatgataccggtattggtaaggaaggatattctattatcggacagggacagattgataagattctttctggaaagcctgatgaaaggcgagagctttttgatgaagccgctggaattgttaagttcaaaagaagaaaagctactgcaatcaagaaacttgaaaatgagcgggctaatcttgtccgtgttaatgatattttatcagagcttgaaaaacaggtcggaccattacaggtccagtctgaaaaggccaaggaatatcttgactataaagctgatttaaagaaatatgatgttaatgcatttcttttggaatcagacaggataagcaaagatcttgaagaactgacaggaaagattggcattgctgataacgaccttgctaattcaagagctgagtatgagagtaccaaggctgaatatgaagaggcagaggaacagttatctaaggttaattctgacattgagaatgttaattcacttttatcaaacactgagcttgaaagtcagagacttaacggtgagattaatgttatcacagagcagattaacagattcactgataatgaaaaacattacagtgacagaattgcagctattgataaagataaagctgcaaagcagaccaatgtagctgattttaagaaacagctcaatgagctttcaacatctgtagaagagttcgagaataatcttaaagctaaacaggatactgctgatgttataaagcaggatattgacggagtgtcagatcagattgagagccgtcagaacgatatatacgacagacttaatgccaagtcatctattaatgctgagaatcagaagtttgcgactatgttggaacagcttaatataagaaaggctgagcttaacagtcatcttattaaagataagagtgatgaagctgaacaaaatatcaagattaatgatatcagtgcaagattagaagctgcacagaaaaatgctttggaaatagctgaaagaattgcaaccaataatgatgaagttacggctattaagaacgaaaatgctgaccttaatgtgcagcatgataagattgttcagagttatcacagagagaagtcaagactggaatctctcgttaacattactgaaagatatgacgggtatggcaacagtatccgtaagattatggaattaaaggacagcaatccgggaattcttggtgttattgcggatattgtcaaggttgagagaaagtatgaaacagccattgagacagccttaggcggaacaatccagaacattgttactgataaagaatctacagccaaggaactgattgcatatcttaagcagaataagcttggacgagctacatttttacctcttaatgcaatatcaggaagaaatactcttgagaaagagccatgtattaaagaaaatggtgttatcggaattgcaagcaaccttgtaagagtttctttcgaatatgagaacttagctaagtatcttcttggaagaattcttgttgttgataatattgataatgcgctacttattgccaagaaatacaagtacagcttaaggattgtaactcttgagggtgaacagcttaatccgggcggttctatgaccggtggtgcttttaagaattcaagtaatcttctcggtagaagaagagagattgaagagcttaagaaatctgtatcagaactcagcaaatcatcaactgagcttaaaactaagattgcagataacagagctaagatagcgtctataagagagcttattgacgcagataacaaagctaacagagaggtgtctttagctgttaacacagagcagatgaatcttaatcaggcaaagcagaagttatctgaaatcagaattatatatgataaagataaggctgaaactactgagattgacagacagattaaggagattgatgagaataagaatcaggtaagcggcagtcttagtgcgcttgatatacagaatgaaagctcaagaaaagaaattgagaatcttaacaaacagcttgaagcaaagaaggctgaacttgataaggctaatgatgatattgagaatcttaagataagattcagttcggtagaacagaagacagcatttattcaggaaaatattataagaatcaattctgaaattgctgctcttgaatcagaagaagctgatataagacagagaaaagaatctttatcatcagaagttgaagataagaatgcacagattgaaaagttaagaagtgatattcataaagctaagaatcagatagaagactgcaatactaagattacagctctccgcaaggatagagatattattaatgcaagccataagacattctttgataaacgtgaaaagattaatgaacagattgttcttcttgaaaaagaaagtatgcgtctgcataaccagcaggaaaagttagaagaagagaatgactctatagtagattacatgtggaatgaatatgagcttacatacagctatgctgctgaattaagaagtgaagagcttactgatatatctgatattaagaagcagattaatattctcaaagctaatattaaaaagcttggtgttgttaatgtcaatgctattgaagaatataaggaagtaagcgaacgatacaacttcttaaagacacagcatgatgatatgattaaggctgaagaggctcttgtactggttattgatgagcttgataatggtatgagaattcagtttaaagagaagtttgaggaaattaaggttgaattcgataaggtattcaaggaattgttcggtggtggacgaggaacaatagagctagttgaaggtgaagatattcttgaggcaggaattgttattatttcacagccgccaggaaagaagcttcagaacatgatgcagttatccggtggtgaaaaggcacttactgcaatcgcacttctttttgcaatccagaaccttaaaccttcaccattctgtctgcttgatgaaattgaggccgcacttgatgattctaatgtaggaagatatgctaattatcttcacaagcttacaaagcatacacagtttattgttatcactcacagacgaggaacaatggctgcagctgacagactgtatggtataactatgcaggaaaagggtgtatctgcacttgtttcagtagatcttatagctaatgaccttgacaagaagaaggagtaaatatgggattttttagtaaattaaaagaaggtttaaccaagaccagagataatattgtttccggaattgattctgttttctcaggattttcgtcaattgatgacgatttctatgatgagcttgaagaaacccttattatgggtgatataggtgttgttgcaactgaagagattcttgacgaccttaagaataaggttaaagagaataagattaagaatcctgctgactgcaagcagcttcttattgacagcattaaggaaaagatgaatctcggcgagaatgcatatgaatttgagaaccgccaatccattgttatgcttatcggcgttaatggtgtaggaaaaactacatctgtaggcaagcttgccggccttcttaaagcacagaacaagaaggttattatggctgcagccgatactttcagagctgcggctatagagcagcttacagaatggtctaacagaactggtgctgatattattgcacagagtgagggttctgatccagctgccgttatatatgattcaatcgctgcatgtaaagcaagaaaggcagatgttcttttatgtgatacagctggacgtcttcagaataagaagaatcttatggaagagcttcgtaagattgacagagttatagaaagagagtattctgatgcatacagggaaaatcttattgttcttgacgcaacaactggtcagaacgccctttctcagcttagagagtttaatgatgtaactaatatcacaggtattattcttactaagatggatggaactgccaaagggggaattgccgttgctatacaggcagaatttggtattcctgttaaatatattggagttggtgagaaagtcgaagatttacagaagtttgattcagacacatttgttaatgcattattcgatgtagataacggctctgatgaagattgataagttaataaattaagatgggagattaagtgtaatggaagaattaacattgaaaagtttcgaggaagctgccgagaaggttaaggaagcaacacttcctactaatctggtatatagtgagtatttcagcagccagactggtaacagagtataccttaagccagagaatatgcagtacacaggtgcttataaggtaagaggtgcatattacaagattagtacgatgtcagaggaagcaagacagaagggacttattacagcttctgccggaaatcatgcacagggtgttgcatttgcagctaagaaatatggggttaaggcaacagtagttatgcctacaacaacaccacttatcaaggtaaacagaactaagggatacggtgcagaggttattctttacggtaatgtttatgatgaagcatgcgaatatgcaatgaagcttgccaaggagaaaggacttacatttgttcacccatttgatgatttagatgttgcaacaggtcagggttctatcgcaatggagattattaaagagcttccaactgttgattatattcttgttcctattggtggtggcggacttgcaacaggtgtatctacacttgcaaaactccttaatcctaatatcaaggttattggtgttgagcctgccggtgctaactgtcttcaggaatctcttaaggctggaaaggttgttactcttcctactgtaagtacaattgcagacggtacagctgttaagactccaggaagcaagttattcccataccttcagaagaatcttgatgatattattacagttcctgatgaagatttaatagttgcattccttgatatggtagagaatcataagatgattgttgagaattcaggtcttcttacagttgcagcattaaagcagcttgatgttaaggataagaagattgtttcaattctttctggtggtaatatggatgttattacaatgtcatctgttgttcagcagggacttgtacagagaagcagaatcttcactgtttctgtacttcttccagataagccaggtgaacttgtaagagtagcttctattattgcagaagctaacggtaatgtaatcaagcttgagcataaccagtttgtaagcattaacagaaaagcaactgttgagcttagaattactattgaagctttcggacatgaacataaggatgagattgttgacaagcttgaagcagcaggtttaagacctagaattgttaaggtaaacatttaatcactatctgcagagggaaatctatgaagaaatattctttcaaaagatatgcaggagttacaatggcattatttggggcagctgcgctgtccctattgcttttttttgcattgttcagaattgatgctatccacaaagcattttcacatatatgcaaaactcttatgccttttataattggcggggtattagcatatgtaatatgtccaatatgtaatttcttcgataatatatataataaggtatttaagtttattaagaatgagaagaaaaagaaaagcctgtccaataatcttagtgtgtttacagggcttcttatagcaattctgttcatatattttatgattattgttattattcctaatcttgtaaatagtgttgtacgtcttattcagattattcctgataatgtcaataaagttattgattttgtacagaagtttcttaacgaaaatgaaactcttatgaaatattcagagaatattattgataaaacatatacatttattaacgactggctcggtaacgagttccttggatatgcacagggaattgcttccggtgtttcaaccggtgtatttaatatcattgttgtactttttaatgttcttatcggattcattgttgcagcatatcttcttacagcaagaaaaaagcttgcaaagcagggagagatggttgtctatagtatattcaagaaagaacgtgctgccagcgttatggaagagattaagtatactgataaggtgttcagcggctttgttaatggcaaaatccttgatgctcttgtaatagcacttatatgttttatatcacttaagatatttacaatatgtaatcctggcaaagagatgatgagtgagattcttattgcattcattgttggaatatttaatgttattcctttctttggctggtacatagcatggtttattggagctttattatgtcttattgtcaatcctgcacagtgcctgttctttgtaatatttaattttatattacagcagattgacggtaatattatcggacctaaaattcttggtaatactacaggaatctcaagtttctgggtattgtttgcaatactcctctttggtgatatatggggatttgcaggaatgcttttaggtgttcctatatttgcagttatatatcatcttattaagaaatgggtgtttaagagactacagattaacggaatggagaatttaagcgaagaatatgaagttgaatatcctcctaatgagcgtgaaaagaagcttgaaagctgatttgataaattttttaaaagtgtcaagtaaaaatgcttgacactttttttgatatctgatattatactcaaggcttatgagtcaatcatggcttatgtaatatttaagtttgtggcaggtgttatggaaagaattgttgaacagaatcttttatatgatttttatggagagttacttaacgaccaccagaagaagatatatgaagatgctatatacaatgatttatctctcagcgagattgccgatgaatacggtatatcaaggcagggagtacatgatctgattaagagagttacgaagacacttgatggatacgaggctaagcttcatcttatacagaagttccttgaaaccaaggacaaggtatctaagattgattctttagttgatgattacatggaaagtcaggatatatctgatattcatgaaatcaagaagttatccaatgagattcttgaagaattttaaggagagatattatggcattcgatagtttatcagagaaattgcagaatatttttaagaatcttcgtggtaagggtcgtttatcagaagctgatgttaaggctgctcttaaggaagttaagcttgccctgcttgaagctgatgttaactttaaggttgttaagcagtttatcaagtctgtagaagaaagagcaattggtcaggatgttatgtcaagtcttacacctggtcagatggttatcaagattgttaatgaagagatggtatctcttatgggatctgagacaactgagattgccttgaaacctggctctgagattactgttatcatgatggcaggtcttcagggtgctggtaagacaactactacagcaaagcttgctggtaagttcaaggcgaagggaagaaaacctcttttagttgcctgtgatgtatacagaccggcagccattgaacagcttactattaatggtaataaacagggcgttgaagtattctctatgggaactaaccagaagcctgttgatattgccaaagctgctatagcccatgctaagaataatgattttaataccgttattcttgatacagcaggacgacttcatgttgatgaagacatgatgaatgagcttatagagattaaagctaatgtatcagttgaccagacaattcttgtagttgactctatgacaggtcaggatgctgttaatgttgcttcatcatttaacgagaaggttggcattgacggagttatccttactaagttagatggtgatacaagaggaggtgctgcactttcaattaaggcagttaccggaaagccaattctttatgttggtatgggggaaaaactttcagatcttgaacagttttatccagaccgtatggcatcaagaatacttggtatgggagatgtccttacccttattgagaaggctgaagcacagcttgacgctgataaggcaaaagctatggaagaaaagcttaagaaagcagaatttgattttaatgactttcttgagtatatgggacagattaagaatatgggtggtatcagttcaattatgagcatgatgccaggactgtcaggtcagatgaagaatgtttcaatcgatgatgatgaagcagagaagaatatgagaagaaccgaatctatcatatattcaatgactaaggcagaaagaagtaatccggacatacttaatccttcaagaaagaacagaattgcaagaggtgcaggtgttgatattgctgatgttaacagacttgtaaagcagttcgaacagatgaagaagatgatgaagcagatgccgggaatgatgaaaggtgctaaaaagggacgtttcaagttacctttttaacatagattaatttttaagaataatacaggaggtgaatgtaatggcagtaaagattagattaaagagattaggtgagaagaaaaatcctttctatagaattatcgtagcagactcaagatctccaagaaatggtagatttatcgatgaaatcggtacttatgatcctaattacgatccatgcaagttaagcattgatgctgaggctgctaagaagtggttatcaaacggagctcagcctacagaggttgttggaaagcttttcaagatggctggtatcgaaaaataagactagtggaggtgtaattgactatgaaagaattagtggaaattatcgctaaggcactagttgataatccggatgaggttgtagtaacagaaactgaaaaagataaggctcttgtagtcaatcttaaggttgctccttcggatatgggcaaggttatcggcaagtctggtagaattgccaagtcaataagagcagttgtttcagctgcagcttctaagagcgacaagaaagtgattgttgaaatagataattaagcaaacactactgtctaaggcagcctttcggggctgtctgttttgttatttatatatacatttatgccagaatggagaatttaagtggaagatatgttaagggtaggggtcataacatcgacccacggaatcagaggtgaagttaaggtttttcctacaacagatgatcctcttcgttttaagaaacttaagaaatgtgttatcgatggaaaaagagaacaggtagctgtcactgtatcttcagttaaattctttaagcagttcgtaatacttaagtttaaagaatttgatgacatcaatgatatagagaaatacacaaaatgcgacttgctcgtttcaagagaagatgctgttaaacttgagccgggagagtattttatatgcgatcttatcggacttgatgtaataacagatgaaggaaaacatttgggcgtactaaaagatgtattagagacaggcgctaacaatgtatatgaagtagaggcagataatggcgaaagctatttaataccggttattgaccagtgtatattagatcatgaccttgataagaagactataacagtccatatcttaccagggcttctggatattaataaataataaagaaaatgtatttttagtcttgcattatttgcttgattatgataatctaaacaagttgtgagaaaaagggatggtcctctgttacagaacctgtattaagaacatcataatattaaggaggtcacacatgaatacaattattaagaacatcgaagatgctcagcttaaggctcaggctcctgagttcagagttggtgatactgtaagagtatcagctaagattaaggaaggaaaccgtgaaagaatccaggttttcgagggaacagtattaaagaagcagggaactggcgttagagctacatttacagtaagaaagatttctaacggcgttggcgttgagaagacatggccattacattcacctatcgttgagaaggttgaagttgtaagacgcggtaaggctagaagagctaagcttaactacttaagacagagaacaggtaaggctgctaaggttaaggaattagttagataattttgttattcacggtaagggacatttgaaaaaatgtccctttacttatatataagcgacaggaaaggtcggaatattatgagattttttcagagaagatatcaggaaaatactacattgcttaatatatgcaaatatgtagcagatgtatgtgttgtaatagtacttgcttatgttctggttacattcatatgctgccgttctacagttgttggtaattctatggaggaaacgctgtctaatgataacactgttcttataaacagaatatcatatgcatttaatggacctaagcgatttgactgtatagctttcgaacaggattctgttgattcctctaagatatacataaagagagtagttggtcttccaggggaaacagtccagataaaggatggcagggtatatattaatgatgtacagcttgatgattatgttgatacgacaatacttactccaggtgtagctgccaatccttataaacttgctgatgatgaatactttgtacttggagataatcgtaataatagtgaggatagccgttttgccagtgttggaatggttaaacgtaagaatgttgtaggaaaagtatggatggtaatagaaccgtttgattcatttggttttgttaaataatggagagatatatggaagagaagaaaagagccattaactggtatcctggtcatatgactaaggccagaagaatgatggaagaagatataaagcttgttgaccttgttattgagattgtggatgcaagaataccgttaagcagccggaatccggatattgataagctggctaaaaataaggcacgtattgtattattgaataaatcggaccttgcagatgacacagtaacggatgaatggataacatattttaaagatagaggcttttactgcctcaagcttaactcaagactcaatgtaagcaatcgtgcagttaataatcttataactgctgcatgttctgctaagattgaaagagacagagcaagaggaattaagaaccgttccatcaaagctatgattgttggaatacctaatgttggtaaatcaacatttattaattcattcaccggaagaaagagtgccaagacaggtaataagccgggtgttacaaaaggaaagcaatggataagaattaatggaagtgttgagctgcttgacacaccgggtatactctggcctaagatagaagacagaaatgtcggtgaaagacttgcgatgattggttcaattaatgaccagattcttaatattgaggagcttgcattagaaactataaagtttcttaagaagaattatcagccgcagctttatagccgttatgatataacagaagatatatttgataatgttgatactgaaacaatgatgaatcctgaaaatgctgctgcactctgtattatggaacatattgccagaaaacgtggctgtattaagaaaggttccgatattgattatgaaaaatgtgctgcatgtattcttgatgatttcagagaaggaaagattggtacaatctctcttgaaagaccttaattaagataccggaaaggaaagctatgacacttaaagaagaacgtgaacttaaaaaagcagcaaagctggagactgagaaacagcgtattgaagctatgcgtgaatacgaagaaatgtatgatacattttcttatatatgtggaatagatgaagctggaagaggaccgcttgcaggtcctgttgttgcaggcgcagtaattcttcctaaaggaaaaaggattctttatgtaaatgattccaagaaattaagtgagaaaaaaagagatgagctttttgatgttataaaagaagaagcactttcatatggaatcggaattgtatctcctgaaaggattgatgagattaatatattacaggcaacttatgaagcaatgcgcgaagcagttaataaattatctgtaaaacccgatatacttcttaatgatgcagttacaattccgggaattgatgttaaacagattccgattattaaaggtgatgccaagagtctgtcaattgcatctgcaagtattcttgcgaaagtaacaagggacagacttatgaccgaatatgattctttgtatccggaatatggatttgccaggcacaaaggttatggaactaaagttcatattgaagcaataaaagagtacggtccatgtcctatacacagaagaacatttattaagaattttatataggtgaacgtatatgaatattaatatgtccgattttttcaaaaataatatatcatcaggcagccagaccacagatgttaatgtgtcggaaaatgtatcacatgaatcatctggaaacaataatgctgtacaggctgctggcatgaaaatattaaattctcttatgtcaggtgacacgtttacagggtatgtcagccagttaaatggtgataatgcatatattacaatgaacaatggagcacagattcaggctaagcttatgcagggtgctttaattaatatcggacagaatgtgacttttatggtggaggataactctgataataaaatttcaatcaaaccggttttagctaatgaacagcaggcagttcttattgataaagcattggaggctgcaggtcttggagctacggatgataatattaatattgtcaaagaacttttaggactgggcatgccggttgatgcacagacattaggaaatatggttaaatattccatgaaatttcccgaagcctcacttaataccattgccaatctaatgagacttgagattcctgtcaatgaacagaatatccgtgagttccagatgtatggtcagtttaacggacatattgagaatcttttatcagatatggagaatggtatagttaatgatctgttaaagaacaatcaggatattatggatttcaaaaatgttattacaggcatgtatgaggggcttgatggggaaactgtaagctcatcatccgcctgcgatgtcctatcgcagcagacaattgatgaattaaataatatgctgtctgattcaggagtgaaacttaataatgatatctcagaaacttctgtgaaggaacttattaaccagcttgctgaaaataatagtcttaattctgataattttcagaaaattatcaattcaggaagcttcagagagattcttcatgctgtaattaatgatacaatgaagcttactcctaaggatatacaggaaggggaggaagctgtaagctcatattataagcgtataagaaaaaatgtagagaatattgaaaattcactgaaatccgcaggcaattcagctcctgaactttcgaagagtctttctgatataaaaagtaatattgatttcatgaatgatcttaataagaatatgacatattttcagatgccggttaaattctcgaaaagtgaaggtaatggggaactgtatgtattcactaataaaaagaatcttgccggaaaaacagataatataagtgcaatgcttcatctggatatggataatcttaaatcaatggatatatatgttaatctgtctggaggtaacaatgtttcaactaattttgttctcgagacagaagaactgcttgattttgtgtatcagcatatagacagacttaatgccaggcttgaaaaacttggatataatacacattttgaaatgaaggtagcagctgattcttcagatcgtcttgattttgttaaggattttatagaagcagaggcaagaccagctgcaggtggacaatacatattcgatgcaaaagcatgacagctttatctaaagaaggagcagcatatggagaaaaagaataatgatgataagcctaaaatagcagttgcacttgaatacactccgggggaacaggcaccaaagatacttgcaacaggacgtggatatattgctgaatcaattattgaaaaggccggagaggctgatgttcctgtatatgcagattctaagcttgctgatactttatcaaaacttgaaataggagaaatgattcctccagaactatataccgtagttgcagaaattcttgtatttgtagatgaatgcgataagattaaagggaaagtgggtaaataatggctgttaataaaagagctgccggcgcagataaagaacagcttgctgccagatatcttgttgataatgggtatactgttcttgaacggaatttccgcaataaaacaggtgagatagatattatcgcaaagaaagataattatattgtatttgttgaggtcaaatacagaagtaataacaaatacggatatgcagttgaagctgtaaattacagaaaaaagcagataataaggcatgttgcacaattctatatggcaacaagatataaaagctgtgatataccatgccgttttgatgtcataggaatagatggagaaacagtaacacatattaaaaatgcattttaacaaggattataatcatgaatattaaatatattgatacaggaacactttatgaaggattaaaaggagctgtggttaataattccacaagaatatcacagaagaatggaattccttatattgagtttacaccatttgatgaatttgactgggtcactctttatttttcaacaagagatggtggagtgagcaaaggaatatattcaagcatgaatttttcttttgacaggggcgatgattatgaaaatgtatataagaattatgaactgtttcttgatacaatgaatattaagcctgaaaactgtgtttgtacaaaacagacacatactaccaatgtgattgctgttgattataatatggcaggaatgggacttacaagagcaagaaattttgataatgttgacggacttgtaactaatgaacccggtctgtgtcttattacatattttgcagactgtgtacctgtatattttattgatcctgtaaacagatgcataggtgcatcacattcaggatggcgtggaacggttgcagatataacacatgaaacggtacagcttatgaacagaacttatgggtcaaagccagaggatattcatgcattcataggaccatcaatatgtcaggactgttatgaggttgatgaagcagttgcagaaaagttcagaagtgcttacagccagaatgaaatcggtatgatactttatcatacgacaggagataaataccagcttaatcttcaggcggctaattattttaatatgattcatgccggaataaaacctgataacataggtatatctgatatatgcacaagctgtaacagtgactggctcttttcgcacagggcttcgcatggaaaacgtggcgttttgtgtggattcatgagtatatgcagataataaaaaaagccagaacagatgttttgttgataatctgttctggctttttttattttttgttgtgttcctgtttgtatctggctcttaattcagcttcctcagaagaaagctttgcccggttttttctgccaactctggttataagcagatatattgctgcaagtatagcaataggaatagctgctgtaagtattgtcgataaagtctctgtaaacacaccgttttcaaatattgatttcttcacatctgtatactgggctgaattgattatgtatctgatgtcattaatcatctcatcagtgatttcattatccttcgactgaagagaatacatatatatatatccgcgtgctacagtgtagtattttcttgtataaattgtctgcttttcgtctgatacagatgtaacctctgtcctgaaatatggacggtcgttaattatatctatagccttgcctgtcattgtctctgtcaggccatcttcctgtttggcattctctgagtcaatatactgcaggaacatgccgcttaactgattctcatccagttcatcaaggttggaaagtgatgagcctgctttcattccgacaacagcaatttcataagaaatgtcttttgaaaatgcttcgagatatatattagatgctttcattgagttctgtacttcattggaatcctgcgcgccaatatccttaagatatgcattattgcctgttgttgtctgcgtaaagcatatcagttcctcaggaacttttaattttaaatcaattgcagagaacttataagatgcatctgctgccagtgcagtaaaagatggaaaaataattgccgatataagaaccaataccggaataaatgttaattttttgcgggaaaatttcacaaaaacacctcctaaagtgcttaaaatcaatattttgtatgatatcacagtgctttacaaaaagcaattaaactgatattatattatagattgcgtgtattaattttttgtaaatttgctataagagcaaggaggaattatgagtaaaccaatagttactgttgtcggaagacctaatgttggtaaatcaacattattcaacagtctgtgcggacaacagatttcaatagttaaagatacaccgggtgttacaagagacagaatctatgcagaggtaagctggctaaaccacaatttcacacttatagatacagggggtatagagccggatacaggtgatattattctttcacagatgcgtgaacaggcagaaattgccattgaaactgcggatgtaattatatttatgactgatgttaagcagggacttgtagattcagattctaaggttgctgatatgttaagacgttcacacaagcctgttattcttgttgtcaataaagtagacagctttgaaaagatgatgcctgatgtatatgaattctataatcttggaattggagaaccatttcctatatcagccgttaataagttaggttttggtgaagtgcttgatgaagtggtgagtcatttcccagagggttcagatactgatgaagaagatgaaagacctaaggtagctataataggtaagcctaatgttggtaagtcatcaatcatcaataagcttgtaggcaagaacagagttattgtatctgatattgccggtacaacaagagatgctattgacacagctatcaagtataatggcaaagaatatgtatttattgatacagcgggactacgccgtaagagcaagattaaagaagatctggagcgtttcagtatcataagaactgttgcagcagttgaaagagctgatattgcaattcttgttattgatgctacggaaggtgttacagagcaggatgccaagatagccggaatagcgcatgaaagaggcaagggtattattattgctgttaacaaatgggatgacatagagaagaatgacaagactatctatgagtttacgaataagattaaagatactcttgcatttatgtcatatgctgagattatatttgtttctgccaagacaggtcagagacttaataaaatatatgaattagttgatcacattgttgatgcacagactatgcgtattcctaccggtgtgcttaatgaaattcttacagaagcagttgcaatgaagcagccaccttcagataagggtaagagacttaaaatctattacatgactcaggtttcggtaaaaccaccgacatttgttatgtttgttaatgatgtagcactcacacatttttcttatacaagatatatagaaaacagaataagagaatcctttggattcagaggtacatctatcagattcatcaacagagaacgtaaggagaaagagtaatgttatttaaaataggtgttcttatatatggatattttgccggagcactcattcaggcaggatactggatgggaaagttcaataagattgacatcagggattatggcagtggcaatgcgggaactactaatgttatgagaactcttggcaagaaagctggaattgcaacttatctgttagatgcatttaaagctgtaattgctgatatattgatacattttcttatagtaccacatactgcaattccggaaatgcttctgtttctgtattgtggccttggaattgtgcttggacataattttccgttctaccttaagtttaaggggggaaagggaatagcagcatcttcaggtgttgttataagtcttatgctttttcctaagtactgttttatgtttacagtttttggtattttcttttttgcacttgtagccaggataagccgttatgtttcactggcctcacttataggtatggcaatgttttttgttgaatttcttatatggggattcttaggctggcttccattaaatggaacagaccttgttgaaggtactgttattgttttcgctcttgcagcacttgcatttatcagacaccgcagtaatattgtaagactggttcagggaacagaacggaaaatcggtgaaaaaaagaattaatttttgatgcgcttatgcgcagattggagtataattatggcaaatgtaagtgttttaggagcaggaagctggggcttaggtcttgctttacttcttaataacaacggacacaatgtaacagtatggtcagtattaaaggatgaagttgctatgcttcagactgaaagagaacataaaagatgccttcctggtgtaaagattcctgacagtattactgtttcaggagatacagagaatgtaattggcagtgcagatgtacttgtacttgcagttgcatctccttatacacgttctactgcaaagatgattgcacctttcgtaaaggaaggacagattattgtaaatgtggcaaaaggggttgaggaacatactttattaacactctgccagattgtagaagaggagattccttgtgccaaggttgcagttttatcaggaccaagccatgctgaagaggtaagccgtggcattcctacaacatgtgtcataggtgcacatgaaaaggcaacagctgaatatttacagaatatttttatgagtgatgtattcagggtatatacaagtccggatatgctgggaatatgtataggtggtgcattaaagaatgttatcgcgcttgccgcaggtattgcagatgggcttggttatggtgataatactaaagctgctcttataacaagaggtaatgctgagataacaagacttggtgttgcgatgggagctaatcctcatacttttgctggcctttcaggtattggtgacttaatcgttacatgtgcaagtatgcacagccgtaacagacgtgcaggaattctcataggtaaaggatacaccaaagacgaggctatgaaagaagtgcagatggtagtagaaggtgtgttctctgcaaaggcagcgttagaactttctaagaaatataatattgagatgccgattgtagagcaggttaataaggtgctttttgaagacaaacctgctgctgaagctgttaaggaacttatgttaagagataaaaaaatagagattgataattctgaatggaagtaatcagtctgtattaacagagggggaaaactgatggctcatattaaaaatctatcgaacagagcatacatttcgggcagtcttaaagacaaactttcaagatttgagatgtatagatacagctttatttatgcgcctacaggatatggtaaatccaaagtaataagaactttttttaagaattacccagggtatactgttttatggatagatgcagaaagttccagagagattttttgggataatttctgcaatgctgtcaaaatgtttgataatacattggctgcagcttttaagaaaattggatttcctgattcggattatgctattaatgaagttattaatcttttatctattatgaattcagaggaattctctgctctgcttgtgattgataactttgatgatatatttgatgacaatatgtgcagaatatttgctgcatcatatttatcaaccgcagtaggattgagatatgcatttatattaaaaaaattaactaatcagagtattattaatcttataactaaggatgatgcgttgggaatcacaaaaaaggattttgcattttcacaggaagatattgaagattatttcaggcttaatgaaattattcttgataaagaaacttctaaagatatatttaataaaactctgggatggccatatgtagtacatctatacatggaagcctataagaataaacataccgatgcagataagactgtgcttgataaagcgtatacatttattgaaaataatgtgtggctggagttatctgatgatgaaagacaatttcttgctaccatgagcgtattttcaagctttaatcttaaccagtgcatgaagcagacttttttagaagaaaaaatgtgtcttaaacttcttaattcaattccgttaattaattatgatgagcatacaagaaggtacagctttaatcctatgtttgacggattcattcttcaggttcttgacgaaatgcctgttgatgaagttactaagattacactcagagctgctgatacgaatcttgatgatggtaattactttgaagcgatgaagctttacagccactcaaaggaatataggaaaatatatcagcataacattaattttatagatatatatccttatgtaattaagcagaataaagatgtatttacggacattgccaatcactactgggatatagaaaaagaggggcattatgaattttctttgattatatgtttctcactgcttatgtttaatgagaagcatatggttgaaactcttcttacggatataacatcagatatctgtaaggattcagttttaagtgacaacaaaaagaattcttacatggcggagatacagtttataaaggcatttacagaatataatgattttggaaagatgagagaaggttttaatattattctttctatttctaaatcacctgtaaatataattgccgatggttttccatttaattatgaatgcccttcaattatgatgctatatcacagacagtctggagcacttgataaggaacttgaaacgcttgaacagtgtgctcctgattattacagaataacgaatggtcatggaaaaggttttgaagctctgatgcgtgctgatgttttatataacagaggtgaccttgacggagctgagattctctgtcagaaagcaatatatatggcagacagccgtaatcagtatgctatatatattgctgcatattatattcttgcaaatatagcactctacagaggatttaatgatcagtataaggaaaatatgcacaaaattgaagctgtggcaagaagggatacccgaaaatccaaatcgcttgaaaagctttcggatatatgccatgcatgtatgtattctgatatagaacagcaggataaaattgctgcatggattaaagaccagaaaaagattgaagattccgttaatttcttctctcttagttttgttaacattgtgtttggaaaatatcttatacttaatcgtgagtatcatcattttcttggtataagcggtcagcttttaggacttaacaatcttttttcttatatccttccacagatatatacatatatatatcttgcaattgcgaataaagaaacaggtgagacaattaaagcccataagtttcttaaagaggccataaagcttgctgaaccagacagaatatatatgccttttgtacataattacagcagtatatctgagcttatggcagaaactgttgtaggtcatgataatcaaggctttatcagaaatgttataaagatttcaaagggttatgaaaaaggggttaaatcaataaaaaaagctggacatgcccttgcagattatggacttactgtacgtgagtcagatgttgcaaagcttgcagcacagagattttctaataaagaaattgctgaacagctctttattgctgagagtactgtaaagtccaatatgaaagttatatttaataaactgcagattaattctcgtgcagaattaaagaatttttttgaataaaatataaaggaactgatatttatgagagtaatagctggaattgccagaagcatgcctttaaaggctgctgaaggtgacaacacaagaccaactactgacagaattaaagaaacattgttcaatatgttacaatcagatattgcaggatgcaggtttcttgatttatattcaggaagtggtgcgataggtattgaggcgttaagccgtggtgcaaaagaagccgttcttgtagaaaatgcaagacaggcaatagctgttattaaagataatcttacatttacaaaactttcccctaaggctgttgtaatggaacaggatgttttgtctgcaataaacagattatcaggcagcggagtatttgatattatatttatggatccaccttatggaaaagactatgaatatgatgtattacttgcattatcacattcggatattgtagacagatatacaattattgtaattgaggaggctcttaatgtgcctttggattatattgatgaatgtggatttgagactgtaaaggttaagaattataaaactaataagcatatttttatacgattaaaggagagtgaataactgtgaaaaaagcgatttatccaggaagttttgacccggtgacattaggacatttggatataatcaggcgttcagcaagtcttgttgatcatctgatagttggcgttttaaataacagtaccaaaacaccattgttttcagtggaagagcgtgttaatatgttaagagaagtgacaaaggatctgcctaatgttgaagtattaagctttagtggattactggtggattttgctgcagaacataacgtttctgtgataataaggggattaagagctgtcactgattttgaatatgagcttgcaatgtcgcagactaacagagttgcggctcctgggattgatacggtatttcttacaacaagcctgaagtatgcatatttaagttccagcatcgttaaagagatggctatgtatggcggggatattaaaaagttcgttccggaagagattatagacagagtctatgagaagtatggaatcacaaaataatcaaaatactattaaaggagtaaaacgatgagcagaattgagcagttaataagtgatattgaaagttatattgatacctgtaaatattatccattatctaatgttaagattattgttaataaagagcagttagaggatatgcttacagaattaagattaaaaactcctgatgaagttaagaaatatcagaagattttaagcaataaagatgctattcttgcagatgccaaggaacaggctgatgctattattaatgcagcacaagttcagactgaagaacttattaatgagcatgaaattatgcagagagcttatgcacaggctaatgagcttattgaacaggctacagcacaggcacaggctatcctggataatgcaacagaggaagcaaacagcataaggtatggtgcaatgcagtacacagatgatatgcttgcaaaacttcagtatattattgaacattcaattaaggataataaagaaaaatatgattcgttattatcaggtctagaaaatgtattatctgttgtcaataataataggaatgagcttagtggtattgaagaaggagaaactgaagaaactgtgcaaaacaattcggaagattcggattccacagatacagacaataatgaataacaattaataatcttatagtatatttaatacatatatcagcagataagtcattgcaagtgttactatacacagtacaagtttctgatatatgtatttttttatgcttatataactgctgcatatgctttttgtctgcataataatgcatactccgccaaatgcatcaagtaatactgtcaataatactgttgtattcataggaattccggcatttttaattatggcaagaccatttgatatttcaaataaatatgatattaacaaaccagcggtattgctttgtgaaaaatgcattataatatttacaatgacagagaaaataataacgtaagctcccaacgtcagagcagtattaattgaactgtctacagcttcttcaaagaaatggaatatcagttttttgtcattttttatatgtggagcattgtcttttttattatctttatccctaaaaaacagaattgccatatatgaacataatattaccggtgtatatgtcagtgcaagaaacattggcagactgatacatttttcgaggatattaatatatacatagcttataagaaatgccggactgggaatattgattatgccggcaagcatgtccccgagtctgttttcaggattatttttattgtaccatgagcagatataggctccgtttggaaagcctgtcataagacctgttattacaagtatccatggattattaatatttttttgctgcagaattcttacaagaatattagtgagaataaaagatataaataatcccggaaatattttcatgccataaagatatagtccggaaatcactccgtgacacacaggaaccgataataccgacaacacaaataaaagaataagtattatgcttatcatacagcctctttaataatagatatttaataatattctcaaaaatatgtttttatgtgttataatgaaacataattatgcaataaaagctgaaatggagactacaatggaaattcagatgtggaaggaaattcttacaccttatgatctagcggtggaagaacttcagataaaattcaaccatataattaaagaatatcgtcaggcaggtgtctattcacccatagaacaggttttaggacgtgtaaaaagtatttctagtataatagaaaaagcacagcgcagagggattgaaatcgataaaattcaggaaaaactttttgatattgcaggcataagacttatatgtcagtttacggaagatatatatacagttgtgaaacttatcaagaaacgaaaagacatgactgtaataagtgagaaagattatattaaaaatattaaagagagtggttatagaagttatcatcttatagttcattatgaagttgagacagtgaaaggaactactattatacccgtagagattcagataagaactcttggcatgaatttctgggcaattattgaacattcactgcaatacaaatataatggtgaaattcctgcacatgtgaaagaaagactaaatgcggcatcagatgcacttataacacttgataacgaaatgtcatctatccatgatgaaattattaattcccagacctactttatggttaaggcaaatattgtttcagatatattaagtacaatccagaatctgtacaaggttgccaataagcaggttgttataaaaattcaggatgaattctatgaaatatttgaaaaaggcgatgttaatgaactttcaagattttcacgccagttggatataattgctgaggattaccgggcacagtcagtgcagtaactcattacagaaactatacagaattgaggtatacaaagtgaatttaccagagaaatatacagaatcaatgaaaatgatgttaggtgatgaatatgacagctatatagaaagctttaatgataagagattatatggactgcgtgtcaataaccttaaaatttcaacagaggatttccttaagatatgtccgtttaagttagaacctgttccttggattgagaacggattctattattcagaagatgacaagcctgctaaacacccatattattttgcaggcttatattatattcaggagcctagtgccatgacacctgccaatgttcttccgattgaggaaggagatgttgtatttgatatgtgtgcagctcccggtggaaaatcaacagagcttgcagccaaattaaacaaaacaggactaattataaccaatgatataagcaattcgcgtgccaaagcacttcttaagaatgttgaagtattcggtgttcctaatctgtgcgtccttaatgaagaccctgtgggtatagcttcaagattctcaggattctttgacaaagtacttattgatgctccttgctcaggtgaaggaatgttcagaaaagacaataagcttatcaaagcatgggaaaagaacggtccggagttctattcacagattcagaggaatatcattcttgccggtgctgacatgttaaaaccgggcggtaaattattatattctacatgcacattttcaaagctggaggatgaagattcagtaatacatcttcttaccaacagacctgatatgcaccttatagatatcaagccatatgaaggcttctcacacggctttgatactgatgaaggatatcatcttgagaaggctgtcagaatatttcctcataagatgcctggagaaggacattttgtggcattatttgagaaagacggcgaagattatacatcttctaaaagacctgtatcaggaaagacaaagcttcctgatgaattaaaggagttcatggacagcaccacatttgaatatgaccctgcttatatcaatataagagatacaagggtctttcttacatctccttatatggcagaggaacgcggtttaagaattataagaaacggtctgctgctaggtgagcttaagaagaaccgttttgaaccgagtcaggcatttgcaatggcacttactaaggatcagtttaataactgtcttgacctttctgtttcagatgacagagtaatcagatatcttaaaggagagactatcgatattgatgattttaatgtcaaatctggctggacacttgtatgtgttgatggctatccacttggatggggcaagaacgctaacggacagttaaaaaataaatatcttgcaggctggagatggatgtaaatgtttataagacttgataaatatcttgcagacatgcaggttggtacacgcagtgaagttaaagaactgataagaaaaaagagagtcactgttaatgacaatattgtgacaaagcctgaatcaaagattaatacagatggtgattctgtaaatgtagatggtaatgctgtgggctatcatgaatatgagtattttatgcttaacaagcctgctggtgttgtttcggcaactgatgacaatacatgtacaacagtgattgaccttattaaaactaataacagaaaagacctttttccggtaggaagacttgataaggacaccgaagggcttcttataattacgaatgatggtgctatggcacatgatctgctatcacctaaaaagcatgttgataagacttattatgccaaagttaaaggtaagataagtgatatggaagttaagcagtttgctgatggactattcgttgatgaagagctgacagcacttcctgccatattaaaggtattaagctataattctgataaggattattctgagattcatgtaacaatacatgaagggaagtttcatcaggtaaagagaatgtttactgccataggttcagaggttctgttccttaagcgtataacatttggtgcattaccacttgatgaaagcctaaaaacaggtgaatacagagcacttaccaaaaaagagatatcaatattacaacgaaaccagattaaaagataaggagaattccatggttaaggattttcttccaattagcagagaagatatgaaaaaaaggggctggcagcagtgcgacttcgtgtatatatgcggagatgcctatgttgaccattcttcttttggaatggctattataacaaggctattagaaagccgtggttataaggttggcattattgcacagcctgactggaaaaagaaagaatcaattacaatcctcggagaaccaagattaggatttcttgtttctgcaggtaatatggattcaatggttaatcattatacagtcaataaaaagcacagaaagaatgacgcatattcgcctgggggcaaaatgggcatgcgtcccgattatgcaactattgtatattgtaatcttataagacagacatataagaaaacacctattattattggtggcattgaggcttcattaagaagaatgtcgcactatgattactggtctgataagatgaaacattcaatccttattgattcgggtgcagatattatctcttacggaatgggcgaacattctattgtagagatagcagaggcgcttgaagccggaattgatgttaaagacatcacatatataagaggcactgtatataaagcaaaaagccttgatcacatatatgatgattatatagagcttccaagctatgatgagattgcagctgataagaagaaatatgctgagagcttctatacacagtacattaatactgatgctttcagcgccaggattcttgttgaaaaggttaaggaaaaaatgtatgtcgtacagaaccctccggcgatgccgcttacacagatggagatggacgatgtatattcactgccttatatgagagattatcaccctgtatataagaaaatgggtggtattcctgcattatcagagattaaattctctcttacaagcaacagaggatgcttcggcggatgttcattctgtgcgcttaccttccatcagggacgtatcatacagacaagaagccatgaaaatataatagaagaagccgaattgatgacacatgaccccgattttaagggatatattcatgatgttggcggccctacagctaatttcagaagaacagcctgtgacaagcagttaagtaagggagcatgtgtcaataaacagtgtctttttcctaagccatgtaagaatcttgtcgtggaacacaaggattatataagccttttaagaaagcttcgtaagattccttctgttaagaaagtatttataaggtcaggcatacgatttgattattgtatggaagattctgatgatacatttttaagagaattgtgtgagaatcatattagcggacagctccgtgttgcaccagagcatatatcagataaggttttatcaagaatgggtaaaccttcaagagcggtatatgacagctttattaaacgctataaaagaattaatgataagacaggaaaagagcagtttgtagtgccatatcttatgtccagccatccgggttcaaccatgaaagaggctattgagcttgctgaatatgtgcgtgacttaggctatatgccagaacaggtacaggatttttatcccacaccatcaacactttcaacatgtatgtattatacaggttatgacccaagaacaatggaaaaggtatatacacctgtatcccatcatgaaaaagagatgcagagagcacttatccagtacaagaagcctgagaattacgatcttgtaaaagaagcacttcttgctaacaacagaaatgacctgattggatttggtccaaaatgtcttattccacctagaaaaataaggagcagaagtaatgaaaaaagtagaaaaaggtgagttcggttatcttgcctataaaaaaagccgcaatatgattaaaacaattattgcatttgctgttgtactcgtaatatttatcattggtttcataatatggaaatcaaagaataactaccttacaatgcttgctgttgtacttgttctgcctgctgccaaattcgcagtatcatactttgttcttattccacataagaactgtgatgaagaattaaagagtgctattgaagaacgtaaaggcgaattaaacagcgtctatgaccttgttgtatccaataagcagaagcctgttggtattatggcagcagttatcagtgataaccagatacttgcctatacaagtgctgctaaagctgacaagaaccttttcgagacaagtgttaaggagttcttgaagaatgagaagcttacatgtgctgtccttctttataaggataaggatacatatcttgaaaaagttaagaatgcagccttgaattttgatgtgagcaaagaaaacagccttgacagaaaaaagtatataacagacgcattactaagaatgagtatgtaattaagcaggtattatatgaaagaaattaacattgatgaaaagctcgcaggtcagaagatgatgcgctgtcttgagcgttatttatccaacgcccctaagagctttctttacaaaatgctgagaaaaaagaatattacactcaataattccaaagcaacaggtgatgagaagttaaaatgtggtgatataatcaagattttcttttctgatgagacatttgaaaaattctcagctgataataaccgaacagttaatgacgactactacaacagaatatacaggccacttgatataatctatgagaattctgatgttatattcattaataagccttctggcatgctttcacagaaggcaaagcctgaagatgtgtcacttgttgaatatttaattgcacaccttatacataagggagaacttaacgccggtgatttagcgtcgttcaagcctggcatatgcaacagattagaccgtaatacaagtggaattgtagcagctggaaagactactaaaggattacagcagttatcggaagcatttaaacagagaacccttggaaagtactatctgtgcattgtaaagggaaacgttgataagcgtgctttaataaaaggatatctgtataaagataacaaaactaataaagtgactataagcaggactgaaactaaagattcacttccgattgagacagagtatattccggtatgttctaatggtaatgtgactctgctaaagattcatcttcttacaggacgaagccatcagataagagctcatcttgcaagtatcggacatcctcttataggtgattataaatacggtcagaaatctgttaatgatacatttaacggacaatacaaagtaaaagaccagatgcttcattcatatgaattagatattccagatatggacattcatatatacgctgcaatacctgattcttttaaaaatatcatgaaaggagaacagttatgccgacctggaattcaagaggacttagaggctctacattagaagaccttattaatatgtctaatgataaatacaggacttcacatcttgcacttgtccaaaagattccaacacccataaaaccaattaatatagaccaaagcacaagacatattacactggcatattttgaccagaaaagtacggttgactatattggtgttgttcagggaattcctgtatgttttgatgcaaaagaatgtgcaacagatacatttccaattcagaacatccatgaacatcagattgaattcatgcgtgaatttgagaaacaggacggtatctccttcataattatatatttttcttcaagagatgagttctattatgtaccattttctgatataatcagtttttgggaaagaagtgaaaatggtggtcggaaaagcttcacatataaagaaataaatcagaatttccgtatatatgcaaatcagggaattcctgttcattatctggaaacaatccagaaggatatagaattacgatagaaaggcagggggttagatgattagtgataatcataatgcttataataactataataattatattgatgaatatgaacttactaatggatatgctgtagttgacagaaatttctcaatagtaactgcaaatgagcctatgtatctgttccttggaatgtcaaaacattattcaattatggatgctattcatcaggttgacattgacgattttattgatgttgccaacagtttaagacctgaaatcaagaaatccatgtgtatacggatgcgaagaatagataattcataccgatgggtaattgttgatatagaaaagaaagttatacctaatactgattcatctgaataccttgaattacatatatctgatgttttagttatccgtgagcttaataaaaaattacagcagcagattaaagcatttaaaaatgaaactgctgaaaatagaaatttactaattatgaagcctgaacctgctataaaagaattctgtataaaaaacatagaatctgataataactgccagctttcgcttatatatcttgaagttgacaatattgagcagtttaaggctacacatactgatgacgaatgccacagaataacatatgtaattgaagataccatattaaaagcaattgatgaccgtggtgtattaggtcgtctgaatgattttaagtacattattgctattaaaaacatcaataaagaagttaaattgcgtgcatttttggagcatattaggacccagatttcatggcattgtaaatttattgattcatcatataatatagaattttctattggcataggaagatatcctgataatggaaaggatttagaccttattaagaaaaaaatccaaaaagcaattaatatggcacgttctaaaggaggcaacagatatataatctataaggagttcctgcacggagaaatcgaagattctgataaatagtttgttgacaataactacatatttatgtataattcatacaaatttagtgtgttagtatagtatcacttcaacgcattaaagcattcaatataacgaaaggatatacatttatgaagaaagatttactacatacaccagagggtgtgcgcgatatatacagtacagaatgtgcagaaaagaaggtcattgagaatcgtcttcatgatgtctgtgcatcatatggatataatgatatacagacaccttctattgaattctttgatgtattcaataaagaacgtggaagtgtaccgtctaatgaaatgttcaagctttttgacagatacggaaacactttagtattaagaccggatatgacaccatctatagcaagagctacagcaaaatattttgaagacagagttcttccagtcaagctctgttatcttggcaatacatttatcaatgtaagcaagtattatcagggaagacttaaagaaaatacaatgcttggtgcagagcttatcaatgataactctctggcagcagattatgagattatctctatggttattgactgcatgttatcagcaggtcttacagagtttcaggttgagcttggtaacgttgctttctttaatggtcttttacataaagctggcattacaggagattcttcagaagaattattaagacttatcaaggataagaattacttcggtgttgaagaactcttagatagtcttaatattgatgatgcagttgccaaagcattgcttgaacttcctcagttatttggtggtacagaggtgcttgaaaaggctaaatctttaacagatgaagaagagtgcatacaggctgttaacagacttgaggagttatatgagcttcttaagaataacaattacgataaatatatctcttttgatttaggagatttatctgagcatgcatactatactggaattatattccatgcatatacatttggaacaggggagcctgttgtgaatggcggacgttatgacaagctgctcggtcagtttggctgtgacaaggcatctattggtttctctatcacaattgacagacttatagccgcacttaacagacagaatatccatatcccacacgacgctaatggaacacttcttgtatacaatgctgacaggcttggtgatgctataaatgtatctaagaaattaagaagtactggtgttaatgtctgcatgattgaatataaagacagcaagtctgattctcaatatattgaatatgctaaagaatcttcattagtaaatgtagcatttattgatgatgaatacgcttctgattcaacaataagagttattgatgaatcaggaaaaaatgaaagagcagctgtaaaaagccttgtaggaggtacattttaatgagatatataactattgcattagcaaaaggccgtcttgcaaagaaggcaatggagatatttgaacagattggtattccttgcgaagagatgaaggatgaaaagacaagaaagcttatcttcactaatgaggaattaggattccgtttctttttatcaaagccatctgatgttcctacatatgtagaatatggtgcggccgatatcggtattgtaggtaaggatacaattcttgaagaaggaagaagtctttatgaagtatatgaccttcagatgggcaaatgcagaatgtgtgtatgtggtcctgaatcagcaagagaaaagttacagcatcatgagcttataagagttgcttctaagtatcctaacattgcaaaggattattttaataatataaagcatcagactgtagagattatcaagcttaacggttctgtagaattagcacctattgtaggtcttgcagaggttatcgttgatatcgttgagacaggtgcaactttaagagaaaatggtcttgaagtcctcgaagaggtgtgtcctctttctgcgagaatggttgtaaaccaggtaagcatgaagatggagcaggagcgaattaacaagcttattaatgatgtcaagaaatatatagaaacacaggggatataacaaggaggaaaattcctctcctcactatggagttcggattttgcttcgcaaaacaaggaggaaatataatgcgtatcgttgaattaacagatgaaagtaagaataatattttagagaatcttttaaagagaagtcctaacagctatggaaagttcgaatcggcagttgctgagattcttcttaatatcaagacaaagggcgatgaggctttatttgaatatactaagaattttgataaggctgatatcaatgctgacaatattgtcgtaacagaggcagagattgaagaagcatactctttagttgaccctgaacttattgaggttataagaaaggctatcgttaatattcgttctttccatgagaagcagaaacagtacagctggtttgattctaagcctgacggaactatattaggccagaaggttactgcacttgcaagagtcggtgtgtatgtaccaggaggaaaggctgcctatccttcatcagttcttatgaacgttcttccagcaaaggttgcaggtgttgagcagattataatgtgtactccacctgataaagaaggaaaggtatatcctacaacacttgttgcagctaaagaggctggagttgatgttatatataaagctggcggagcacaggctgttgcagctatggcatatggtacaaaatcaattcctaaggttgataagatatgtggacctggtaacatatatgttgcccttgctaaaaaggccgtatttggttatgtaagcattgattctgtggctggtcctagtgaaattcttgtaattgccgatgagactgctaatcctcgttatgttgcagcagatcttttatcacaggctgaacatgatgagatggcatctgcaattcttgtaactacaagtgaagaccttgcacataaggtatctgcagaggttgataagtttgtagctgaattatcaagaaaggaaatcatccagaaatcacttgataattacggatatattcttgttgctaaggatattgacgaggctgtagatgttgctaacgagattgcatcagaacatatggaaattgttactaagaatccttttgatgttatgactaaggttaagaacgcaggtgctatcttccttggagaatatagttcagagcctcttggtgattactttgcaggtcctaaccacgttcttcctactaatggaacagctaagttcttctcgcctttaagtgttgatgacttcattaagaaatcaagcattatttcatattctagaaatgctcttgaagctatccacacagatattgagaaatttgctacagcagagcatcttacagctcatgctaattcaattaaggtaagatttgaaaattaattagcgcactggcgcggaaacggggattatatggctgtatctgaaatcagacaggcaactgtaaaaagaaaaacaagtgaaactgatattgctttatttttaagaattgatggttcgggagaagcagaggtcgatacaggaatcggctttttcgaccatatgttaaaaagttttgcaaagcatggtctttttgaccttaagttaaaggtaactggtgacctaatagttgactgccaccatactatcgaagatgttggaattgtacttggtgaagctatcaaagaagctataggagataagatgtccataaaaagatatggcgacattattcttcctatggatgaaacacttatcatgtgtgccatagacctttcaggaagaccgtatcttggttttgaatctacatttacagcagacagcgttggatactttgatacacagatggttaaagaattcttctatgcaatatcctacagtgcaggcatgaatcttcatataagaaagattgcaggtgagaacgatcatcacattattgaaggcatgtttaaagcatttgcaaaggcattggatgaggcaactgttaaagatacaagaatcaagacaattctctctactaagggaagtctctaaatatacttaaggagttacatatatgcgattatatccagcaattgatgttaaagacgggcagtgtgtccgcttaaagaagggactttttaatgaagttactgtatattctgaaagaccttacgagatcgctaaaggctttgaagaggcaggagcacagtttatacatactgttgaccttgatggcgctttgaagggacacggcgttaatgcagaaactattaagaagatatgttcaagtgttaatgttcctgtacagatgggcggtggaatccgtactcttgagaacattcaggaggttcttgacctcggcgtatacagagttattatcggtactaaggctgttgagaatcctgattttattaaggctgccattgacagattcggtgctgaacatattgttgtaggtgttgatgcaaaagatggtcttgtggctatcgagggctgggaaaaggtcagtgataagaccgcactttcacttgcacttgcaatgaaggatatcggcgtacagactattgtgtacactgatatatcaaaggatggtatgcttgctggtcctaatgttgaacagactaagattctttctgataaaacaggcattgatattattgcttcaggcggcatgagctgcatggatgatcttacacatattaatgatgccggtatccatggtgcaattatcggtaaggcaatctatgaaaaacgtattgaccttaaggaggctgttaatctttttgaatccggagcatcttacagcaaggcatcagcaatgcttaaggctgatatttcgtttaaggatttaaagcttgacgccaatggtcttattcctgttgttgtacaggattatgtcaatggtgaagtccttatgcttgcatacatgaatgaggaagccttcaataatacgctggaaactggcattatgacttattacagccgaagtcgtcaggagctctgggttaaaggtcttacatcaggtcatttccagtatgtaggttctcttgacatcgactgtgacaatgatactattcttgcaaaggttcgtcaggttggtgctgcatgccacactggaaacagaacatgcttctatagaaatattaaaacatggaacagataatttatggaatataaatatataatcacagatattaacaataaaatcttctgttgcatatatacttctgataatacctgccactatcttaagcctttagatagtggcagtgttgttggtaacatatatgttggaagagttgaaaatgtagttaagaatattaatgctgcatttattgagatagaggataagcagaaatgttattactctataccagacaacaaagcaccaatattttttaatgagaaaaacaatcctgaaatatgtcagggcgacagaattctcgtaaaagttataactgagccgcttaaaaccaaacctgcaaaggtatcttcaaagatagagcttaccggcaattattcagttgtttccaacgatgtaaaaggtgttcacatttcaaaaaagataaaatctaatgaaacaattacagagataaaaaaacgtgttgctgacattctcattcagaagcagcaggaagccatagaaaaaacaggctatgattatctttcaaatttcggaataatattaagaagcggctgtgctgatgctgatactaatgacattattaaagatgtaaatgcattgtgtgacgaatacactgatatgctccgaaaagctgttttttcaaagttctatacacttgtacataaagacagacctggatatattgaggaaattgttcatctgtctggaaaagacagtgttgagattatcacagatattccggctatatataatgaattagaaacatatctgcctcgtagcagtaatataagtatccgtatgtataaagatgaattatggcctttatacaagctctattctatagaaaaagagatagataccgctctttccaagaaggtctggttaaaatcaggtggatatcttattatcgaacagactgaagcactttctgtcattgatgttaattctggtaagaatgtaactaaggcaaagagcatggaagcaatcgaggcttctgcattaaaaactaatcttgaagccgcagacaagctgtgccagcagattaaggtgagaaatctctcaggaattattatcgttgattttattaatatgaatcagagaaattgcgatattctgatggaacatttgaaatttctggcaaaaaaggatatagtaaacactacaatcgttgacatcaccaagcttggtcttgttgagattacacgaaagaaaatcggaaaaagtctgtctgaaagtcttaataaagcctgaaaatgcatggaggatttatggataatactgaagtaaatatttcacaggaaattcctgcatacgaaagaagatatagaaagatatcagaatggtttcttaattgtaagccggcttatgcaattcttaaattcatatacaaatatatgacttatataatagcatttgcatacattcttcttataataatgagttttcatgggactttcttttctgagataactccgattatgttaagaaacagcggtatagttgttgaaactgataaatttttacttacatccaagcttattctgacaccttttacatcatttattcttgtatcagttataagaaaatgtattgatgcgaaaagaccctatgaaaaatacaatataaagcccttgtttgttaaagatactaaaggggaatcaatgccaagcagacatgttttttccattacaattattgcgatgtgctggctttatgtttctgttccagtagggattataatgcttatgcttgtagcaattatggcagcaagcagagtgcttgcaggagtacattttgtaagagatgttgttgccggattcgcagtaggaattatatgtggaattgccggcttatggattatctgaaaatttttaaaatatttctaaaaaacatttgacaaatagtaactgaatgtatattatatattttgtgtgccgctcagttagggtataagtgtatctgatgtatgtcggattccccaaaactggcgagtatttaattaaggaggataccatatgtacgcaattatagcaacaggtggtaagcagtacacagtttctgaaggcgatactatcagagttgagaagcttgcagttaatgctggtgacactgttacatttgatcaggttctttttgtaaacaacggcgaggctaaggttggtgagccaacagttgccggtgctacagttacagctagcgttgtaggcgaaggcagagataagaaggttatcgtttacaagtacaagagaaagactggatatcacaagaagaatggtcatagacaggcttacacagaagttaagattgaaaagattaatgcttaatttttgtatggatgtttgtgaggtgtgttattcatgactcatataactttttttaagaactctgaaaaagagatcacaggtttttattctgcaggtcatgcaggatatgctgaatccggcagtgatattatatgttctgctatttcagttctgacaatcaatactattaattcgatagaggcttttaccgatgataagtttgatgtgtcagttaatgaggatgaaggaattgttatctttaagatggctatgcctgttagtccggaaacttcgattttacttaagtcatatgaattaggtgttagttctgtggctgaggataatccgaaatacttatcaattagtgttaaggaggtgtaaccttatgttaaatatgaatcttcagttattcgctcataaaaagggtgtaggttctacaaagaatggtagagattcagagtctaagagattaggcgctaagagagctgacggacagtttgttttagctggtaatattctttacagacagcgtggaacaaagattcatccaggtgttaatgttggtcgtggtggcgatgatacattattcgcacttgttgatggaactgttaagttcgaaagaaagggcaaggatagaaagcaggtttctgtttatcctgttgtttcaaacgactaatttgttttttagctccaagtcttcggatttggagcttttttcttaatttgtaaatgttaattctaaacagttaacataatttaaatatagaatggaggaaaggttatgtttgcagacagagtccgcatttttattaaatccggcaagggtggagatggtcatgtaagcttccgtagagagctttatgttcctgctggcggtcctgatggcggcaatggcggtcatggcggagatattatttttatggtcgataaagggcttaatacactcggtgatttcagacataacagcaaatatattgctgaaagcggcgaagaaggcggcaagagaagatgcacaggtaaagatggtgaagaccttataattaaagtgcctgaaggaactgttatatatgatgatgaatccggtaaagttattgcagatatgtctggagataaccttcaggaaactattcttaaaggtggccgtggtggtaaaggtaacatgaactatgctacatctaccatgcaggctccacagtatgcacagccgggacaggatgcgcaggaattatgggttcgtcttgaacttaaggttattgctgatgttggtcttgtaggattccctaatgttggtaaatcaacatttttatcaagagtaactaatgcaagacctaagattgccaattatcatttcacaacacttaatcctaaccttggtgttgttgatcttgatggtggtaaaggtttcgttattgctgatattcctggtcttattgagggtgcatcagaaggtgttggtcttggacaccagttcttacgtcatattgagagaactaaagtcattattcatattgttgatgcagcttcaactgaaggccgtgatcctatagctgatattaaggctattaacaaagagcttgagaattataatcctaagcttcttgaaagaccacaggttatagcagctaataagattgatgttatatatgatgatggcagtgaccctgtacaggctataagagatgcatttgagccggaaggtattaaggtatatcctatatcagctgttacaggacagggcgttaaagagctgttatacgcagtcagaacactgcttgataacttcaaggacgaacctgtattatttgaaaaagaatttgactacgacgagcttatggataatcctaacgaaagctttgaagtttctattaacgaagatggcgtatacgttgtcaacggaccaaagattgataaaatgcttggttatactaaccttgaatctgaaaagggatttgatttcttccagaaattcatgaagcgctcaggtgttcttgatgaacttgagaagcttggaattgaggaaggcgatacagttatcgttggtgattaccttgagtttgattactataaagcataattaataggagagaatatatgacaagcaaacagagagcttatttaaagggtcttgcaatgacaatggatccaatatttcagtttggaaagaacagtcttactcctgagaacactgcagctattgcagaagctcttgaggcaagagaacttatcaaaataagtgttcttaataactgtgccgatgaccctagagaaatcgcacagatggttgcagaaagaacacgctcacaggttgttcaggttattggaaagaaaatcgttctttacaaggaatctaaggacaacaaaaaaatcattttaccatgattaattcagacaaaataataggtattatgggtgggacatttaatccaatccacaaaggacatacaggtattgccagatgtgcctacgagcagtctgatattgatgaaatattattcatgccttcaggaacacctgcttacaaagataattctcccattgtaagtgcaactgaccgttgtaatatggtaaagcttgcaattaaaccttttgattacatgtcactttctacgattgaaactgaccgtcccggtaatacctacacagccgatacacttgcacagatatatgattcatataagaaaatatattttataataggtgcagattcgcttctttatattcaggactggtatcatcctgagtatatatgcagccattgtcatcttttatgtgctaacagagacaataattcagccagtgtacttatagatcagaaacattttcttgctgataaatatggtgcggttattgattttattgatgttccggaacttccttacagttcaactgatatacgaaagaaggttgcaatgggtctgtcagtaaaagaagatgtcggcgaagaagtagaagagtatataaagtccagaaaactttatgtttaagaggttttattatggataacaaatatattgaacaattaagaacacatgtaaaagacgcactccgtacagacaacatgcgataccagcatacacttggtgttgctaatacaagtgcctgtcttgccatgtgtcatggtgcagatatgaacaaggcgtatattgcaggtcttcttcatgattgtgccaaatgtgttcctgatgatgtaaagattgctgaatgtgaacaatttggacttccaatatcagatattgagtttgaaagtccttatctgcttcattcaaagcttggtgcatattatgcagcacacaagtacaatgttgaagatgatgaaatatgttctgccatccagtggcatacaacaggaaagcctgcaatgactttattagaaaagattgtattcattgcagattatattgaaccctacagaaataaagctgccaatcttgatgacataagacatatggcattcactgatattgatatggcggcttatgtaatattagacgacaccctttcgtatataagaaaaactggtcgtaatatcgatacacagaccgttgatacctacgaatactacaaagggattattaaagaaagagagaattaagatatggcagattctaaggatatgttaaaggttatcatagatgccttacaggataagaaggctgaagatatcagagttattgatatcagcaatgtatctgttattgcagattatttcgttattgctagtggtagtaatactaaccagattcaggctatggtagataatgtagaagaagaaatgttcaaggctggcttcgatgatcctaaggttgagggttataatacagcttcatggattcttcttgattacaaggatgttattgttcatgtattctctgaggatgacagagcgttctataatattgaacgtatatggcgtgatggtaaagaggttgatattaacagcctgtaatgtttaggctggcttcccggagagggactctgccggaggtatatagataatcagaacccgctttcgctcggtctcggacgcagcggtactaggttcgctgcctgcagcagcttaccaagtgccggcgtcctcaaacggttctgattatctatatacctccggcttcgtatgccaccgggaggcttcagcgcattatcggttgttaattgtgggataataaaaatatatccagctatagatatatttaaatccggacgccgtgagagcttgttttgctgctttggcagctcaccaagctctcacggctggttatcggattacttatatatctatggctggattttttcaatcaataataataattcttattagttgatacctaatcttattaaaccgattacttttcctaatatctcgcagtcatctacgatgattgggtccatgaaatcgttctctggctggagtcttatgtgtccgttctccttgtaaaaacgcttgactgttgctgaatcatctactagtgcaacaattacttctccattagaagctgtattctgctttcttactattatctgatcgccttcgtagattcccatattaatcatgctgtcacccttgacctttaacatgaatacttctccacctggcatgtattctgatgggataggaaagtactctgttatattctcaacggcaagaagtggctgtcctgcggcaacctgacctaataacgggatattaacaacctctctccttgaaagattaaagttatcatcaattatctctattgtacgcgacttagtcgggtctcttcttatatatccattcttctccaaagactcaagatgtgcatgaacagatgatgtagacttaagattaactgcctgacatatatcccttactgatggtggatatcctttgttaagaatctgtgatttaatatattcaagaatctcagactgtttctgagttattctgccatatgccatattacgaacctccattaaattcttttagataattttaccacatttatacattatgtgcaaacataatttctgaaaagatgttcggaaaatttgttcgatttttattgacaaacgcatgttctgattatataatcaactcataacagcagaacacttgtttgattggaggttttacgtatgaataattcagaatacacatatagaagagcagcagctaagaaaagaagcgacagacgcagaagaaacagacagatgactgtcaagtcattaagaatggttattatatgttcaattcttatatttgccgtttctattggaggcattattgtcaaggcttctgatgactcgaacagaacacgaacatataagtattacacaacagtatctgtagaagataatgatacattatggtcacttgctgacagatataataatggggatgaagatacagcttcatatattaacaatataatgcagatgaatgatttatcatctgacacaatccattcaggtaagaatcttgtaatatattattattcaactgagataagataatatctaattgcatatacatttcccgcatgcagtgaaaagctacttaatattggacttttcactgcatttttgttaaaatttattgatagcgaaatggctgtagatataacttaatatttaataatttatttataaggagattaaccatgaaatttagcgatatagagactatctctcagggtgtatcagattatctttcagataataaaatcgtcgatatgaccgaaatacagcgtcagacgtataagcatataatggacaaccgcgatattatagcttgttcatcaaccggaacaggtaagacacttgcatatcttatcccgattattaacagattaaagagtaatactcataatattcaggccgttgttcttgttccaacagcagagcttgcaatacaggtcaataatacgcttaaagatatctttgcacatatggataatacattttcatctgttgcattaataggagatgtgaatatatcaagacagattgattctattaaatctaataagcctgcaataattatcggaacacctaaccgcatacatcagcttataagtaacaagaagattaaagtacatgaggttaagactcttgttctagatgaggcagacaagctctttgataagacatttattcaggatgtagaagcaattagaaagtctttaatgaagttcacacaggttcttttattctctgcaagcgtagataagaagacaaggactaatactttgtgtttcaaaccaatattcattgatattaacagtaatactggtaatacaagtcagattccttctacaatcaagcatataagcgttatttctgacagaagggaacgaattgaaactttaagaaagattattaaagctgttaaaccagagaaagcaattatatttgttaattccaagtatgatctggaagaatcccttcagaagcttgaatatcatcattacaatgtagcttcaattgccggtaataaagataattcagccaagaaagctgcaatagagaatttcagaagtggaaagattcagcttcttattgcaacagatatagcagccagaggacttcagattgataatattgatacagtaatcaatgtaaaccttcctgaggacaataaggaatatattcacagatgcggacgatgtggacgtaatgggaacacaggaacgtgtatatcaattataactgataatgagcttaacaagattaaatcataccagaaagcatttcacatcaatatagtcactaagaagctctatcagggaaaattagttgcaaaataacagatagaagaatataattatccatacagtaatcacttcgctaaagtcaggtttaacgaagtgattagtaattttttatatatggaggtattcttaatggctgaaaaaacatacaccgaacaacaaaacatcaagtacaaaaaaaagcttaatgaattacttgatatattaccagatttctgtacacagtattttgacagtcttgaatttaataagcagccaagaactaagattgcctatgcaatggatattaaaggtttctttgaatttctcattgaatgcatacctaagttcagttcatatgcaatgaaagactttaaaccacaggatttagaaaaaatagatggtacagatataaccagatacttacgacatgtaaagttatataagaagaacggtcgtgatataacgaactcagaaagtgctgccaagcgtaaattatgtgctctaagacgtttttatgaatattactgccgttatgaaataatcagtttgaatccgactataaaagttgatatgcctaaaattcatgaaaaagctattataagaatggagcctaatgaagttgctgaatttcttgataatgtggaatctggcaataagcttaccaaaacacagctccaaagccatgaaaagcttaagacacgtgatctggctctccttacacttatgcttggaacaggtatacgagtgtctgaatgcgttggattagatattaatgatgtggattttgataatgacagaatcagagttataagaaaaggtggttctgaaagctttgtatactttggcgatgaggtaagggaagcacttcttaattatcttgaagaaagaaagaatttaacgcctgatgtaggacatgagaatgctctattcatatcagccaaaaagaagcgcctatgtgtgcgatccgttgaacttctagttaaaaaatatgcccagacagttacaactgtaaagcatattaccccgcataagcttcgaagtacttatggtactaatctatatcaggaaagccaggatatatatcttgttgctgatgttttaggacataaagatgttaatactacacggaagcattatgcagagattgtagaagaaaacaagcgttctgcaagaaacattgtcaagttaagaaaagattgacaatgtataaaaggtgatactcttccactattattatgtggcagaatatcaccttttattattttaattattctactgataaatttcacgccattccatatcgcctctctcaagagatttaacaagcaattccgctgttgcaaggttagtggccaatggaatattatacatatcgcaaagtttgcatatattatcagaatccggttcatgtgctaaaggattctctgcctctctaagaaaaataacaagatctatctggttatgttcaatctgtgcacataactgctggtcaccaccaagatgtccggcaagaaacttatgtatcgataaattagtaacctcttcaataagccttcctgttgtacctgtagcaaaaagctgattcttattaagaatacccttatatgctatacagaaattctgcattaattttttcttagaatcatgtgctattaaaccaatgttcatttaagcttccccctaatgtataaattaaaatgtataaaagctatcctctgaaatcatctgcaaacatatcatcatctctttcaacatttctttgcagacttacattgagtacaatgcccatagctatgaataatgtaagtaaagatgtgataccacaactaaagaaaggtaatggaactccagtattaggaagtatccatgaaacaacacctatattaataaatgtctgaaatccaatatatattgctacaccacaacatatcagccttccttcaaaatttcttgctctcacagctgttattatacactccagaacaatcagaaacaataaaaaaattgtaatacaacttccggtaaagcctaattcttcacctattactgcaaatataaagtcattctgggcttctgcaatatatccggcattctttaaagaagaagtatcattattattaagacctttaccataaagctgaccagaaccaatagcctgaacagcatatgcctgctgatatgttccagcatcagtcatatctacttcttctgacttattaccttcaataaagtcaacaatacgctttcgctgataatcttctataaggattggatgttcaactgatacaacatatatcaaaaatgctgatataaccggaactgcaattaatatcgcaattccaaatatcttataacttaccccggcacaataaagcattgcaataataataagacataaaagtattgtcgttgaaaggttaggctgcatagcaactaacaatattggaaataatgttaaacacgctattaatgcaagaaacttaattgaattaagcctctctttattagcagcaacaagctttgcaactaacaaaataagtgccagctttaaaaattcagatggctgcaactgtaccggtcctatcttaaaccatctggtagctccatgtgaaccatgtccaaacactgtaagaacacctataagcataatagtaactattgcataccatatccagtaatactttaatatccaattataatcaataaatgaaacaataatcattattataaacgatattgcaatacctgccccctgctttactgtatatgcactgttggcactattaaccacagcaagagcaaatactgatgttacaatcagaataaataccaatataaagttgtatgaacgcaatttatatttttttaacataataaaacccttattacttttcgctgtttctcatatccttaattggaatattagcgaaaattgctggtacagagccattgttagtatcagattccgttgatgtaatctgaatatcaagaccatctgtatcaatttccatatactttgaaatgactttaataatatcattcttaatcatttccataacctctggtgaacagttagctctgtcagaaacaagcaaaagctttaatctgtccttagctacatcacttgaaccttttttcttaaataaatcaagtaatcccatatttaatccctccctgaataagccatatgtgacttattataatacatattaattcttcttatcactcttaaaaagtgaagaaagcttcttaaagaaacctcccttaccattaagatcaaggaatggaatctcctcaccggtaattctacggcagatattcatgtatgcctgtcctgcaagagaatcatctcctacaagtggctgtcccttattagttgccacaacgatattttcatcatctggaacagctccaataacattaagctgtaaaatatcattaacatcatcaatagacatcatctcgcctctgtttaccatatccattctgattctgtttacaattaaatcttcatgattctgaagtccgtgagcgtcaaggagtcctacaattctgtcagcgtccctgatagcagaaacctctggtgtagtaacaactaaagctctgtctgcaccagcaattgcattctggaatccctgctcaatacctgcaggacaatcaagaattatgtagtcaaatccttcaggatcattcttaatttcatcaataaccttaatcatctgttcaggtgtcacagctgacttatctcttgtctgtgctgttggtaaaagaaacagattaggacatctcttgtcagcaatcatagcctgctttaatcggcagttaccttcaacgacatcaacaagattatatacaatacggttttcgagtcctaatacaacatcaagatttctaaggcctgtatctgtgtcaatcataacaaccttctttccaagtttagcaaggcccgtaccaatattagctgtggttgtagtcttacctactccgccctttcctgatgttacaactataacttcactcatattaaacctccattaataattcttaataaatcgcaatatattaattatgcgagatttttattcttaaatcaactattttttaaaaatataacaaattaatctaaacatatgtcatctaaagcattctgctctaaatcttcaatataaatattctgatcatatacataggcaatctttggttcaataactttagttttatttctgccttttgttatcttggttcctacatctgagcttctggcaattatttcgcctatcttaatctgcataggactcatctcaagtgcaacaacaaatgcattctcattaccatctacacctgcaaatatattgcccttaagacttccaagtacaataacgctgccttttgcaacaaccttgcctccaggattgacatctcctaataccacaacgcttccgtcagattcaaatacctgacctgagcgaagcgttcctttataaaacatacacgctgttttaggatcagatgccatatcatttacaggctgtacaaccggctctgatacatcaacacttgcaatagctttcttaacagcatcttcatatatttccttcatattgttattttcatcaagaacacatacaatattaaggtcagatacatctgatataatattaagtattttcttttcttcttctgcagataaatctcttccatcaaaagaaattgccatattagcattattaaagaactttgatgcatttttaaacttatctgaaacactttcaagtaactcttcaaaaggcatctcattgtcaagaaatactgttattccacttttacttcctttgattatgactgaattatccaaagcactcacctcacattttatattattatttctttagtatatatcaataaatattattcattaatattaaaaagcattttatatatctctgcgcctaatgttactgcattagaagctgcataaccattctgaatacgcacagccatacaatattcaggattatcataaggtgcatatgatattaatgtagcatggtcaggatctgttgtcctttcctgtgcagttcctgtcttagcagcaatcgacatatgcaatgatgataatgctgtatatgttcctgcagccatattcataccagaatgaactgtattccatatatcagaacttaattctacctgattattaacttctgcgtggttttccttaatgatatttccatcataatcagtaatcttatcaataagagtaagattataacatgtacctgatgttgcaagcgttgtaacataacgggcaagattaagtgtactgtatctgtggttaccctgtccgattgctgatgcaatggcattctgtgaagatgcaccaggtgttccttcctcaatctctatgccagttttgttagataaccccaacatatcagaatagttctttaatatattagttccataagtactattatatgaaccattcttactacatgcaagattataaccaacattatacatataaacattacatgaatctcttatcgcagtagcagccgattcacttccatgaccccatctctgccagcatcttggtgaaggcgttaccttgtcaaagactcctgaacagttaaatacagtagatgatgatattatacctgtatccatgccggcaataattgtacatggtttataagtagaacctggagcaataaatgactgtgtcgccctgttaagcagaggacttgcattatcagtaacaagtgaactgtaatactttgcatctactgttcctgacaacttgttattatcataacttggatatgaaacaagtgccagaatatcgccattattaggattagtaacaactgctgagcctgagcatggtttcagtgcaagctgcccaacagtaataatcttattagagataacatatgacataaattcatatgctcccatgcttcctgatgaaagagattgataacgtgaatcatctgcattcatatcaagaacgccctgttcataaagaagcatacacacctgtcttcctgaaatacttccagcattaatcatatatttgtacattttcttaaaaaatgctgtatcagaatcaagtgctgaaataatataatcaacaagtgcatcatatgactcctgaagacttgtatacttctctgatgtaagcgatgacatatctatccagttcttagatataccatacgttaaaagctgtgagagacttgtcgaatccccgtatacccagtcataataaacactgtcgcttgtatcaacattagccagactgaatatattctcacttcttaaaaggtcatatatataccagatatacaactgctgttcctctgaaagttttccataagcagtgttaccagatttaagctcactatccaaccatgataaagtctgtgccttttttgtctcaaactgactgtaaatctcagcttcattaggtgtattctgttcttcaatttcttttaatgaaaccagattattatcaataagtgcaaaatatacttcctgtgctgttatatatatagtatcaacatcaccagaaccattataagttatcttattgcttccaggtgtgaaatatttcatgaatatatcggttatctcatcttctattgcattatatattgatttctgaaggttaatatctattgtaagatatacatcatgtccagcctgtggatcttcctgatcaagcacctctgtaactcttcctacagtatcaacatataccgatttctcaccctttactccggataactcattctccatgctcttttcaattcctgatttaccaacaacatcattactttcatatccatcgccaagctcctctaattctgaattagagactgttccagtatatccaagtatttgtgagcaatatacactatcaacatatcttcttatatactgctcttccacagtaacgccaacaagaccatcactgttttccagtatagctgcaacagtttcatccgatacttcatttgcaataataaatgtaagatatctgttatacgaattggcagccatatatcttcttagattaacaatcataagagaatgttctattccaaattcatcataattaacctcataagtcttgcaaaggtacttgaacatattctctgctgatgtagccttctgttcgtcagaaagtgctgctatcgactcagttccataagaatctcttaaaaatcttaaaagcgatgtaccctcaacattatatgagaactgtccattattatagataataggaaaatcattagaatatgtatctccatgatcttcgataatctgtaatgttttgtttatagaattattaattgttgcattcttagttgcattatctgaatatcttccagagtcgcttatcttgactgcatatgacaaatcattatatgcaagaagtacaccattacggtcatatatacgacctcttgcagccgcaacactcatatctttctgtatagaacttgataagtcttcgacatatgaatctccatttattatctgaagaacaaacaatctgtgaacaagaacagaaatcagaacaataaatacaagaatcataggaaaaattctggatttaagaagacttataatgtactcaaacacttctttcatcaatcttacccttcttctttctctcttttccttgctccgttataacacaaaaataatgtatcggatgatatatcagtaatgaaacaagagctgtataaacaacctccggcaatataaagcgtgacataaaaaatccaacattaagtctgttttgaagcagaaaattaccaatatatgatatgaatccatatccaaaatcagctgtaatcacaagtgcaagagggataagaacttcccttacctcgtacttctgataaaaaaatcccgaaaaatatcctatgtaaataaaaataagtgctgtaaatccgaacaaaccggaatagaacaaatcatacataattccagcaaaaaatcctgcaaacattccatcattcttaccacagaagaagccaaaaaatacaggcataataataagccagtttggtgaaatattagcaattgatattactcttgctgcagaaacctgcatgatatagaaaaacaatataataattaattctgttatctttcttttcataataaattgtcctaaacacttattctttaagctgtgttataaccagaacctcctgtaaattattaaaattcacagcaggaacaatatatcctgactgggtaagattattagaatccagcttaacatccttaatatacccaatcagaattccttgcagatacctatcactaatattagaagtaactactttatcgccatttctgacaacaacatcacttttaaaatgtgaaacgcgtatcatgcctgtatccatcagttcaacatctccctgaacaatacatgtttcattagtatctataagcattccacttacattgctgttattctctgtaattgtcttaacaatagaataattacttcctgtttcagaaataattcctaccagccctccgctggcaataacattcatattaactttaagaccatcgtcagttcctttgtcaatcttgaatgacgaatgccagttatctgtagtaacttcaataactctggctccaactttcgaataacctgcatactgctggtctagctcatataaatcacgaagtctgttaagttcataagaatcctgttttaactgattattctcttctgtaagatcatcaacctgactctgaagcttcttattctcatcaagaacaactgatatctcctgaagtgtctggtatttatcataaacccagaatccaatattgttcatacccttctgtaccggaactacaaccattgaaacgcactttttaagaggcttggtaagcgtatctgtaaaaaagctcgtaccaataaagaaacagcacaaaaccgtaagtgcaatgagaatattcttcgaagtcataagtgaagaaatattctttctcatcttaaaacctgccctttaatcaaaatttttctctgtaggagtatatgcaaccttagcaaattccggattagatacaactcccataagacctcttacaacactctctgcaggatgttcaacaatattgacattaagattagtttcatctttgataaacttttcaagattgttaatctgtgcagttcctcctgtaaaataaacaccatccttgattatgtcagctgcaagttccggtggtgttctctcaagtataaccttaatagcatccataatagaatgtaatgaatcaattatagcctgatatacaacatcggaagaaatatcaacacttacaggaagacctgataaaacatttcttccaaagccaggtgcaaatgtttctgaaacaggaacagcacttcctaactgcttctttaaattttcagcagttttacttcctataacaagattataagcctttcttacattacttataatacagtcatcaagcttattaccaccaatcttaacagccttgcttataacaattccgcctaaagaaagaactgaaatctcagttgtctctgctccgatattaacaatcataatacccttagacttagttacatcaaggcctgcacctatagcatctgcaacaggtttatcaactacataaacattctttgcctttacttttgaatcaacaactaattcataaaaagctctcttctctacttctgttacatctgttggtacagcaatatagaaatctgatccggtaatcttctttccttcattaatcttattaaagaagttaaaaagaagtgtctgcatattctcaatatcagctatcacaccaaacttaaccgggaaagaaacctcaatatgctctggagctttctcatacatttcatatgcttcatctccaaaagctaaaatctctgttttattagctatagctataatattcttttcattaagtatcttatccttatcactgcagcacattttaaaattacttgtgcctatatcaattccgtatgcattacccatgtcttaattcctttcttaattgttaattaatgtattgcatttgtttaaagctgaaataagaattatctcctataacaatatgatctaacagctcaacaccaataattctgccggcttccataatattcttagtaaccttcatatcctctctgctaggagatggattgcctgatggatgattatgcaggataactatcgaagctgccatgctgtcaagtgcctccttaaatatttcccttacagaaaccattgaaccagtagaagttccaacagacatcaccttatctctaataaggcggcacctgttatcaagcattacaagaaccagatgttctctctttagatgtctcatatcttccatataatattctgcaatagtttcagcattcgaaaagtcaagtctttctctagccttctgctttgcaattcttcttgaaagttcaagaatgcagcatatctggacagcctttgcctttcctatacccttaatctgcataagttctgaaacggacataccataaagaccgttaagattgccggcattctccagtaacttctctgcaagctggatagaacttaaaccattggttcctgttcttataatcgctgccagaagttcagcattatcaagtgatgatgcaccatactcaagacatttttcgtaaggaagcagtttttcttcctccacacctgttattatattctcatagaccataaattaaacagcagtcagattaaataaatctgtaaataataattgcgagtataactcctattatactggcaatagtaatcttaatctggagtgcaaatgttattacaagtactcccagatttaataccagcggattgtcaagcccgaaactctgtccataagacagccagctaagtgcatgcacactggcagtaagttctgcaataagaccgccaagcacaatgcctatcagaatgaatagccataaaagccagccgttcttatatttagaaatattactcatagattttcatcctttaaccataaattggagtacggaaaaatccatactccaatacattataacacaaatattaattcaatcaaagctttataaggtctttttcaaacattttctgaacactcatcataattccaagtttggcatgataccatgtaagtcccccctggaagaataccgaataaggttcttttaacggaccatcagcagaaagctctattgatgagccttgaacgaaggctccggcagccattataacgtctgaatcgtatcctggcatcggccatggttctggtgtaacaaagctgtcaacaggtgctgcagcctgaattcctttacagaaagcaagaagcccgtctgcacttccaagttcaactgcctgaataatatcatatcttggctcacttccatcaggtcttactacaaaacctgccttttcgtatacatttgcagcaaatatagcacctttaagcgcacctgcaacaactacaggtgataagaaaagtccctgataaaagctctggtttacaccgagtgttgcaccaacttcttttcccagccccggtgaagacaatctgtaagctgcctgctcaacacactccttctttcctgcaatatagcctccgcatggagcaagtccgccaccaggattctttataagtgaaccgactatcatatcagccccaacctctgaaggctcaattctttcaacaaattcaccgtaacagttatcaaccatgcatataacatccggcttgatacctttaataaagcttataagttctccaattctttcaactgaaagtgtaggtcttgaagcatatcccttggaacgctggattgtaacaagctttgttctttcattgactgcattcttaattccatcataatcaaagccgccgtctggcaacaggtcaacctgtgcatatgtaattccatattctgcaagacttcccttagaaggtctgataccgataatttcatccattgtatcatatggctttccaaccggtgataaaagctcatcacctggtcttaaattagatgataaagctacatttaacgcatgagttccgcagataatctgtggtcgtacaagtgcatcctctgtcttaaatatatctgaatatattttctcaagagtatctctgccgtcatcattataaccataacctgttgttcctgataaatgcatttcggcaaccttttcatcctgcatcgcctttataaccttcatctggttatattctgcattcttatctatctcttcaaatctgtcatgaagcgacttaattatattgtcgcaataatcatacacctcatcacagattcccatatttttatacatttctctcataattaaataatttccttttcttttagttgttcaagcatatacgaaagtgcatcttctcttcgtatctgggaaaaatccacccatgtaactgatggttctcttctaaaccatgtaagctgcctttttgcaaaatgtcttgtatcctgcttaatcatttctctaagatttgtctcgtcacatctgccttcaagataatcaaatacctctttatatccaatcccctgcatggcaacatcgtcctttacaagccccatatccgacaaatgttttacctcattaagcagtccattgtcaaacattatatcaacacgcctgtttattctgtcatataaaatttctcttttatcattaagaacaaagtagcagaaattataaggtgaatctttagctctctgctcattattatgttctgatatcttcctgccagtcgtcttataaaactcaagtgcacggataactcttttgacattattggcatgaattgcctctgcagattcagggtcagcttcctttaacatatcatgaagcacctctgcacccttagtatcagcaatcccctgaaggtaattcctatattcataatcactttcatcatcttcaaatgtagaatcatataaaagtgcctgaatataaaatcccgtaccaccaacaactacaggaatatgaccgttctcacggattttttgtattgcatttgttgccatagacttaaatcttgccacatcaaagccctctgaaggctcaatctcatcaacaagataatgcttaaccccctgcatctcttcttttgttatcttggcagttccgatatccatatatctgtatacctgcatggaatcggcacttattatctcaccatttaccgcctttgcaagtgcaatggaaagttcagtctttccaactgctgtcggacctgtaagtattattaaaggttctttcttcatatcagcctctatactattcgtttaaatttcttttctatctcatatctgctcatcataataagtgttggtctgccgtgtggacagttatatggattctctgccttcataagctcgtccatcagttcaaatgcctcattaaatgacagtctgttattaccctttacagccgctttacatgacatgcttgcaaccttttcagtaataatatcaggatctttgccggcactttcttcagaaagtccatccagaacatcaataaggagctgtttgtaatccatcttaggaagtccggcaggaattcctgtaaccttatattcattgccgccaaactcttcaatctcataccctaatcttttaaatatatcctgattagtcttgtatatttcttcctcatgcatgttaagtgacagtacaataggtggaagaatcatctgagttccaattgtcttatcatgaagcttattcatcgttctttcataaagcaccttctcgtgcgctgcgtgctgatccatcatatagaacttatcttcaaattcaataagccagtaagtatcaaacaactgccctatgattctgtatttgttacggctgttcatatcaagaagcttattctcaaaaaggttcatctgctttggtggttcagattttgtcacagcttcatatcttactttatcttctttaaccatctgcagagaacccttaatttcaaatggctccggaagtcttttcggcttaatttctgcttttgcagactctgcagattttgtctctgtcttacatggcatattatccgaaacattcttctctggcagcttaacatccggcataacatttcttacaacaggttcttcctgcattttaactgcaacaggatcaggcacagaaacttctgcaataagttcttttgaattaagagcttttaaacatgtatcatatacaaaattatatatatattcattgttcgagaatcgcagttccatcttggttggatgcacatttacatcaataattgcaggattaatcttaaaatgtatcgcactgaacggataattgtgtggcattataaagcccttataggcatcctctatagccttagttataatactgctcttgatatatctgccgttgatataataattctcatatgtcctgtttccgcggacaaccataggcttgccaataaaaccagaagcctcaatatcctgcgacttgccgctgatttcatacagattattagttatatccctgccatacacattatatattatatctttaagattcatattacccgatgtatgcagcttattctggttattacttatgaacctgaacgaaatatcaggatgcgaaagtgccagatattccacaagcgaaccaatatatcctccctcggtagtcgctgtctttaagaactttcttctaacaggagtattatagaaaagatttcttacaataaatgtagttccctccggagcgcctatttctgccacttcacctggtactccgccatcaattgtataacgcacaccactcagactgtcagcagtcttggtaataagttcaacctgtgatacagcagctatactcgctagtgcctcacctctgaagcccagagacgaaacagccataagatcttcaattgatttaattttacttgtggcatgtcttttaaatgctatctcaatctcatctttattgataccacttccattatcagtaaccctgataaatgaaattccaccttcctttatctcaactgtaatcgcagttgctccggcatctatagcattttcaacaagttctttaactacagaagaaggtctttcgacgacctctcctgcagcaatcttattaatcgtattctggtctaaaagtgttattgacatataattctccttgttttaccagcggttcttagcttttccctgcagcttataaagcgtattcagtgcatcaataggtgtcatattgcttatatcaagattcattatatcagtcactatatcatcatccttaacagtatcaaaaagagacatctgcttgacttcaaggtcattaacctttctgtacttgtcattcatcttgtcaagcttcttggaatactgtgcaatatccttagctttctgtgatatatcagcatcacttaagtccacaacaagctccttagccctgttaagaaccacatcaggtactcctgcaagcttggcaacctgaataccataactcttatcagcaccgccttttacaatctttcttaagaaaacaatatcatcaccattttccttgacagcaatacagtaattattaactccgtcaagagttccttctaattcagtaagttcatgataatgtgttgcaaaaagtgtcttggctcctaagtatttagtattggcaatatactcaacaacagcccatgcaatactcaatccgtcaaatgtgcttgttcctcttcctatttcatcaagaattataagactcttaggagttgcatttcttaagatattggcaacctctgtcatctcaaccatgaaagttgactgaccggaagctaagtcatcagacgctccgactcgtgtaaatatacggtcaacaatacatatatttgctgaatcagctggaacgaaagagcctgtctgtgccataagcacaataagtgccgtctgtctcatatatgtagatttaccagccatattaggacctgtaataattgaaattctgttcattccattgtcaagataagtatcattggcaatgaacatatcattagaaatcatcttctcaactacagggtgtctgccgttcttaatatctataatacctttttcattaatcttaggtcttacgaaattattctgtgttgcaacaacagaaagtgaagcatacacatcaatcattgcaacagccttggcagtgttctgtattcttacaacctctgccgctatgcgctccctgacttcacagaataaatcatattcaagtgagtacagcttatcctctgcgccaagaataatatcttcaagatgctttaactcatctgtagtgtatctttcagaaccggtaagagtctgctttcgtacccattcagcaggaacaaggtttttaaatgaattagtaacctccaggtaatatccgaataccttgttatacttaactttgagattcttaattcctgtcttttctttctccctgctttcaagctctgcaagccattcttttcctttaatcttggcattacgaagctcatcagcctctgctgaaaagccgtcctttatcattccgccatcacgcattgtaatcggaggatcatctataattgcagtgtcaacaagattatataagtcttttaagtcgtccatctgctcaaagcactgtctgaatacatcacacttaaaatgtcctatctgattcttaatgtgaggtatcatctctagggaattcttaaatgcaattaaatcccttggattagccgacttacaactaatcttagtcatgattcgctcaaggtcatatatagggccaagatattcacgaatctcttccctgtcaattgcattatcagaaagctcctctatagcgtcctgtcttcttataatctcgtctctgttaataagcggctgcagaacgagatttcttaacgctcttgcgcccattgcagtcttggtcttatcaagtacccacagaagcgagccttttttctgcttttcacgcatagtctcaacaagctcaagatttcgtcttgatgaactgtctataagcatgtatttgcctgttgtgtaaggcacaatgcttgtaatatgcgacatatcgcttttctgtgtctgggtaagatatataagaagtgctcccgcagcatcaattcctaccggataatccttgattccaagtccgtccagcatatttacatgaaaatgttcttttaactttgccttgcaggaatcatcatcaaagtaccagttttcaagtgttgacactgatatggaaagcttctctgatataaatgtaaggtctattccgctcattgcaaaatactcattaagtattatctctgacggaacaaacttattaatttcatcaataagctccgcacctgtctcaatctcagttacaaagaagtcacctgttgaataatctgcaatagcaacaccaagcacatctccaagataaacaatactcataagataattattcttggtttcatcaagtgcctgactgtttaagttagttcccggtgttacaacctttataacctctcttttgacaatgccttttgcctgcttagggtcttccatctgctcgcatattgcgaccttgtgtccattagaaacaagcctgttaatataagtttctgccgcatgaaaaggaacgccgcacataggcgcacgttcctcctgtccacagtcttttcctgttaatgtaagttccagttccttagagacaactaaagcgtcatcaaaaaacatttcatagaaatctccaagtctgtaaaaaagtatgcagtccttgtactctgctttagtagcaagataatgctgcatcattggtgaatactctgccattatattactccctgattaatcctcgataagtctgcccatatagtaaaatcctttacattcgtcaagatgtactgtaacaatctgtccgataagtgattcatcccctgcaaaatgtacaagaatattattagtcattctgcctgtaacaaaaccttcttcatggtcatctttaccctcaacaagcaccttcatatccatgccttcatatcttctgatatgttcatgtgatacttcattgacagttgcaagcagtctgttaaatctgtccttaacaacatcctcaggcacctgattttccattctggcagcaggcgtacccgttctttttgaatatataaatgtatatgcactatcaaactttgctttctttacaacatcgatagtatcctcgaaatcttcctctgtctcaccaggaaaaccaacaataatatcagttgtaatagaaacatcgggcaggattcttcttatcatctcaacctgctctaagtaatgttctttagtatactttctattcatcagcttaagaagccttgaacttcctgactgaagtggaaaatgtatatgattacatattttcttggaatctcttataacttcaagagtttcttcctcaatatccttaggatgaggtgtcatgaatctgattctttcaagtccctctatcttatcaatctctcttagaagctgcgcaaatgatacaggattgtcaaatgtctttccataagaatcaacattttgaccaagaagcataacttccttgacgccatcctttacaagcctttcaatctccataatgatatccttaggctcacggcttatctctcttcctcgtacataaggcacaatacagtaagtacagaaattattacagccgtacataatattaacacctgatttgaatgggaactttctttctgtaggaagctcctcaacaatatcctttgtcttttcccatatatcaataacctggcttcctgatgtaattctgttatatataagctttgccattgcatatatattaaatgtaccaaaaacaatatcaacaaacttataagaatctcttatcttctcgaccacatcaggttcctgcatcatacagccacacattgcaataagcatatgtggattttttcttttgacattcttaagatgaccaagacgtccataaaccttgagattagcattctctcttacagtacatgtattatatataacaaaatctgacttatcctcatcctctgtctcaagatatccaatctctttaagtaccccgagaagcttctcagaatccctcgcattcatctggcagccaaatgtgtgtacacatgcatataacggtctgcctatttcttttgttttcttttccaggaacttcttacattctccaatataataaagctgttcttcaagtgcactggtgttattaacttcctgcattgtctacaattctccattctatacttatcctaatacaaatcttttcaagtgctgttcttcaaaatcttgtaagcataccggtttaccataatagtatccctgaatataatctgcaccaagtttcttaacacatgaaagttcttcctttgtttcaacaccctcaatacacacatgcaaccccatctcatgtgccatcttaattataaaacttaccataagataattatctttaagcttatctatatcagttacaaacgacctgtcaaccttaactatatcaaatgttctgtcacgcatatatccataatttgaatatcctgttccaaaatcatcaattgcgaatctgaattcattctttacaaattctttaaatacgttctgaacagctggtatctggtccatctctatagtttctgttatttcaaatacataatgattattagctgcactgtatctttcgatattctctaatacatctttaactatattacttttgacaatctgtacaaaagacagattaatatgcataacaaaatccggaatactggtaatccatctgttgcatgccttagcagcagtattaattatccatcttccaagtggaataataagtgcactgtcctctagaagcggtatgaatgtgttaggacctataaatccatattttctgctattccatcttataagagcctctgctcctgacaaactgtcatcgtcggtattatatattggctgaaaatataattcaaatccttcaaagccttcacttatacatctgcgtaattcatcctgaacactaagtttttctatatactctgtatactcagtttcagcaaatatttcacatctgttcttaccattgagtttggcagcatggagagcaaatttggcattttttaacaactcattaaaactgtctttctctgtatcaaattcagcaactcctgctgatattgtaaaaaatatgtcatactttcttttttcaatcgttctgtcaatacgatttcttattctcttataaagaatcttagcctgccctatatcattttccatggaatatggcataaatatggcacattcatcaccaggcattctgaatattctaagtggtgtgtcaatatatttcttaattgaatcagtaagaatattcaatacttcatcacctgtttttgcaccatatttttcattaatttctttaaaattatctacaccaacaagcataagaaaacctgacgcatttctggttttagcatattcattatatacattttcaagaacaatttccctgtaaagtcctgtattattatcaaatctgctctgtttcccaatctccgatattcttccaataaggtaaatagctccatggcttattatatactgtcctctacaatttattgcaacatattctccatccacagttttccatctatactctaaattatgactgctctttcttccattcattccatcctgtatatcattcatcagcatatcaatatcgtccggatgaacaactttaaccaattcctgcgtagcattggaaaattcctctgaatcaagtgcaaacacattagttattgattttgaataaacagctttatcattagttaaatccagtatataaagataatcatctgtactctgtccgacaagatgaagaaaatacttcatttcttctaaatcaaaatctcttctaatcataaaaacaccccatacttataaaacatcttactgtcttatctgcccctctccgtatataacatacttagtagttgtaagtgctttaagccccataggacctcttgcatgaagcttctgtgtgcttattccaatctcagcaccgaatccgaattcaaatccatcagaaaatcttgtggaagcatttacatatacacatgcagcatctatttcatcaagaaatctgttggcattattgtaatctttagtaattattgactctgaatggcctgtgttatatgtattaatatgttctattgcttcgtcaacagagtcaacagtcttaacagatataatataatcaagatattccattccccagtcatcatcacttgccggaacaattcttgaatcacactgcattgcatattcatcaccacgcacttcaacattcttttctttaagtgcatttacaataagtggaattgcctgctttgcaacagccttgtgaataaccagtgattcacacgcattacatactccaattcttgaagtcttggcattatatataactttgacagccatatcaatatcagcatattcatcaacatatacatgacagttccctgtaccagtttcaattacaggtactgtactgttgttgacaacattcttaataagccctgctccacctcttggtataattacatcaatgtaatcattcatcttcataagctggttaacaagtgctctgtctgtatcttttataaggttaataacatcaggattaattccgttgtcagaaagtgcctttgcaataacatctgcaatagcaatattagaattaatagaatcacttccgcctcttaagatgcaggcattaccagacttgaaagtaagtccgaatgcatcagcagtaacattaggtcttgactcatatataattgcaacaacgccaagaggtactctcttcgttccgataacaagtccattgggtctttttttcatgcctgttacttcgccaaccggatcttcaagacctgtaagaactcttattccatctgccattgcattgattctcttaacatcaagcgtaagtctgtcaataagagcaggcttcattccgttggctttggcattaacaaggtctttttcattggctgcaattatactctctgcattagctgtaagtgcatcagcaaccgcttcaagtgccttattcttctcatctattccaagcttagcaagatatcttgatgccttcttagccttaattccaatctgttcaagtgattccatcaattctccctccttataaactgtgtctgtgtaataatataatccggttttaaatcatgttcctcataaggaatactctctaaaagctggaaatcaaaagcaagtgccgcttttataaatgtattatcttccgatagatatctgtcataaaagcctccgccataacctattctgtgaaaatcataatcaaacgcaagccccggcataataaaaagtccatctctgatcttagctttatcgcagatgtcagacggttccataattcccatataaccacttacaagatcattctcatcagataagcaataaaactccatctgtgtctttgataaaacttttggagcatatactttcttgccatccataaagcactgcgaaagaagcatatatgtatcaacttccctgttatagctcatatacagaaatacattttccgatgtcttatatatgtccgattttttcaatctgtcaattataagttcgctctgcatttcaatatcttcatctgacaattcatgtctgcggttcataataagctgacgcacttcattcttatccatctagttacctttctctgcctgttcctctgccaatcttttcatcttctcatcatgtcttgccttgacatctattaaagaaccatcaggattcttaatcttaatagattctaactgtcctcttaagttttctctgaaagctttaacataatcagctcttaactgcttctgttcagcaagttctgcatctgtaagtccctctgctttagatttatgataaagctcgttaattctttctaatgttttctctgtaaccatacaaacctctgtcactaattagtaaatataatcaaatcatctccgctttctgcacaactgttatacacagcctttgtagaaagcacaggatgatgaagatccaaaattctatatgcttcaatatattcagaagctttcttaataaagaaaaatcgatgtctcatacgggttataacgacaatatcatttttcatatatctgaatttcatatcagaatgaagcctgtattctggcttctgtgtattaagattaacaaagcatgtacttttatccacttttttaagtaaatatgggatatcattgataatataagtaaaacttaaatccattgcatgttcaacattattattaagtcttacctgcttaacctttgttatagcatcatatataatgatttcttctgactgactattaaaattatatttcgaataaataatctttccagaacctgcttttatatatggaaatgtagtcgattcatctgacacatcaagttcttccatagttatcatctgaccattaaacgatatctcagaaacaaactgtttagcattaagtacagctattttttcttcaccgcctgttccatctgatacaagtctgtctgccccgaattttatgacacaattgtttccacctattggaagtaccttatatatacctgtatttttcacaaatgtatcactcatgtcattatctgtttcagaattaatatcatagagaaatatatctttaagttttcctttcttttcaagcttttcaacaaaaaaataattagaatccataacaaatatataatatctcaatccatcagatatatcagtattatctatctccatactgaatactgcctcattctcattagtatcgaacataaacctgtatacagtaagaagtgtacggctttcagtcactgattccagtgatgtgaagaacatataatttctttcaaggcatgcatatttcaccttacagaaattatacttcttaatctgcgatgccacttcaaatttttcattagttgctgcattcagaataaaatatttctttccctgaagaccctgatactgataattatcatctgttatctgcattaaaagcctgtcattaatagaatagaatattcccttctccgaattcctcatcagcttaatatccatgtatgacctcccgttgtcgtccaagtaatcttcaatcagccttaatctataagagacatcaggtcaaaatcagatgctctgtggtctaagaacaatgttccaacattctctcctgccataaccctgataatattgtcaacatcattaccattagtaataatcatatccgcccccgacagtgttgcaatctttcctgcaataagcttggttgtcataccgccagtccccatattactgccggatgagcctttgcccattcccataagcttatcatcaatctcgtatacagtttcaacaaattttgcattaggattagtgtttggatcatctgtatacagaccatcaatatcagataacagaataagaaggtctgctccgataattgaagcaacaattgctgaaagtctgtcattatctccaaaagcctgcagctgttcaatctcataagttgatacggtatcattctcattaacgattggcactgcaccaagctttaagatttcgttaaatgtattctgtgcgttagttctgttaacatcattaactattgtgttcttggtaagaagaacctgtgatgcaactgcaccatattctgcaaatatcttctggtaaaccatcattaacttagcctgtcctatggatgcacatgcctgttttacaggaagttctgtaggtctgtcacaaagtcctataacagcccttccaacagctattgcaccagaagaaactaaaacaacatcttttcctgaattcttaatatcaataagaatccttaccagcttttcaatctttaaaaggtccaatctgcctgtctgctcatgcataagtgaagatgaacctatctttataacaattcttttcttatcttttataaactctctataattccccatattttaatatctccagtaaaaaatcgaatgctggtctattttactatatttttattaaaaagtccatattatcccatacaagcagctgttactgccatatattccgcaaccttaacaccatcaactgcagcagatgttatgcctcctgcataccctgcaccttcaccgcacggatacaatccacatactgatgtacttacaagttcatcgtttcttattattcttacaggacttgatgttctgctctcaacacccgaaagtacggcatctttcctgtcaaagtcatgtataaatcttgaaaaaccatgcacaccttcaacaaccgaatctgtcacataagaaggtaatacattcctaagattagcaaatgtatattcaccctttatgcaaggctcaacctctcccaattccgttgttgttatatttttttcaaaatcgccaaataactgtaccggaacgtttccatttccttcagcataagcgtttgcttctaactgtctctgaaattttattccgtcaagtactccatgtccgaaatcatccggtccgactgtaacaattattgctgaattagcattgcgggaatcacggcctgaataactcattccattaacacatgtcctgccgttctctgatgaagcattaacaacataacctcctggacacatgcagaaagaatacacacctcgttctttatctgtattctttgtcttgtaagtaactttataatcagcagccggaagctcatatgcagcatcagcataagcattataattaatcatttcctgaggatgttctattcttactccaacagcaaaaggcttcggctccatatctatattctcactgtgaagatattcaaatgtatctcttgagctgtgacctattgcaaggcacactttactgcattttcttgcatactcgccatctttgtcagctatgacaacgccacacacttttccgtctttaatctcaatctttttaagacagcttccaaaattaacttcaccgccaagcgcggtaatatgctgtcttatattcttaattacaatcgcaagcacgtctgttcctatatgcggcttattggcgtacagaatctcttctgatgcaccgaattcaacaaaactctgcagaacatatcttattcttccaaatgtatctgaaatctgtgtgttaagctttccatcagaaaatgtgcctgctccgccttcaccaaactgcacattacattctgtatcaagctcacccgtctcccagaactgtgcaaccttcttagttcttgtatcaacatcctgtccacgctcatatacaacaggtctaagccccgctttggcaagctcaagagcacagaatattcctgctggtccaaacccgataactacaggtctttcatcttcattaacattttctgtcgcattaacaggaaacttatagataacccttttagacataacagcatttttacagcctgatttcttaattatattctcaagcttttcttccctgccagaacgcaccaccttatacacttcgacactgtatatatgcataacctgaggcttgtgtctgcagtcaagtgacctttttgctatttcataatcaatctgtgcatcttttccaagtcttaattcttttcttataattccttctaaaaatgctgtatctttatcaggagatatctttatattactaatcttaatacatttcttttccattattctcattcctgtctgttacaataatcaaacactgacttagcagcaaccacgccgctgctccatgcccactgaaggttataacctccacatttgccatctatatccacaagctcccctgcaaagaatatcctaggattattaactgattcaagattatcattcaattctgatacattgacaccaccctgacagacctgtgcataatcatttcccttatatcctgttatatggtagcggagggatttcatatgtctggcaagtttctggcatatgtcgtcatctatatcggaagctgatgaattaccctcaattccgatatccttacatatcatcattacaagctttttattaaacagtcctgacaggctttcacttactgactgatgttttcttgtattaacagcacattttagcattgataaaaggtcatcttctttaatatctgctgccacatcaacaagtgcttcaaccctctgaccttcgtccatcgccctgacagcaaaacggctcacctgaaaaacagggattcctgatattccataatcagtaaactgaatctcgccagtatcctcagcaaccactctgcctgctgccataatcttaacattaccatatgctcttacacccgttgcaagcctcatattcttcttgtccgattcaagtgccgtaagagccggaagaggcttaacaaccttaatcccaagcttcttaacaagcttataaccgcttccatcagaaccagaagacggtgaagctgccgaaccgcatgcaagtatcactgtcttagtcttaattgtattagtcttcgctccttcaagctgtaacacatattcgctgcctgccctgtcaatttttttaacagatgtctcaaaaaaaaccggaatatcaagtgcctgtatctttcctgtaagcgccagagccacagaaaccgccatctctgacctcggatacagataaccattacgttccttcttatatacacttaagttctcaaaaaaatgtattgtatcatcaacattaaacctgttaataatcctcatcgcataatctgcgttattgttctgatacatttccttagtcataaatgtattagaaaaattacatttgccattgccagtctttaatatcttagttccaagctttgctgtgtgttctataatcacagtctgcatattattctctttacattgtatggcagccatcattccggctgcacctccgcctataaccacacaatcaaaactcataaaatctagtcctcatattcaaaataatcaaaatctgccggaatcctgcttccgcagccaccattattggcatatattccaacaagcgttcctgtatgacgctttctgtcatcaggcacaccctcatcgcacagatatatgcaattttcaagcactcctgctggttcccattgttcaccatcatagctgtagaaaaagcttcttgtcagtttatcaactacaacctttaagtatatgctctgctcctttatattgtccacctgtgagataagctcttcgccatggtttctgttaatcacaagctgcaattttcttccattctcataacacaatgacaatcttgcatatgtcgcagtactgtaataacaggtaagacctgcctgttctccgtccttttcaggatagaagtcaacctttgtatgtgctgtatacgataattcctgttctcttcttacaagagtattcttagcccttatctcattaagagttccgtccattgtccagagccttaagtatccttttctttctgtaagagaataattacccttaacaggatttcttacaaactcccagttaagattaagtgtatcatcatcaaaatcatctcttgtccatttttcaaatgtgcattcaggtaattcaggtgctttctgtgtaaggcttggtccttttctgtcattaatcacgaaccagccgtctgaaagccatgtaacagggtcaagtgctgtctctcttcctattgttgtatagttgccctgattaggtcttccacacagataatagcaccaccagcttccgtcctgtgtctcaattatattgccatgtcctgttctctgaatcggtgcatctggattaaactgtctcaatacaggattgtatggtgattcctcatatggtccatacaggttctttgaacgggcaacattgattccatgtccatagcctgtaccgccttccgcaagcattgcataataatactcacccttcttaaaaatgtgtggtccttccggacatttctctccagttcctggccatacacacacactttcacctataaccttagtgcagtcatcactgagtggtaaaagattgattcccggacttataagaagatacttcttaccgtcatcatcaacaaataaagatgggtcaatattatcaacctcaagccaagctggctttgaatatggtccttgtggcttatctgatgttacaacaagctggcgtcttaatacattattatctcttttgccatctccgttaagccttaaagttgccattataatgaatttaccatcaacataattaatatccggtgcccatatgccatgtgagtctttaatatctcttaaatcaagttcttctgaatctgtaattgcatgtccaattacatgccagtgaatcatatccttggaatggctgattgcaattgcagggaaatactgaaatgttgaattagccatataatagtcatctccaactcttactaccgaaggatctggaaagaatcctctctgtaccggattgttatacatatcactcatatcgtaaactccttttctttaatatattttctgaattttgcaggtgtcatgttgtatttctcagtaaatatcctgtaaaaatatcctttgtttctatatccgactccctttataatctcatcaacatccattgaatcttcttttaaaagaatggccgatttgttcaatctgcaatcctgcagatattccgtgaaagtcatacctgtctgtgcctttaaaaacctgttgaaataatcctcctgataaccgaatctttcaacaagcatatctattgtaacatctttcatattatcttcaataaaatctgtaatttcctgatgcaaaagccagttaattttctttcttatgtatcttgactgtgcatactcatatactgttcctagccgccacagaatcctaagcataagcccctgacatatatatgcagacgccatatccgccacaccacactcgcttatcagggcagtaagcatatccttaagctcattatcataatcatctttatagtcaaaatgtatatatccgctgttctttaacgctttaacaagctctttaatataatccaccgcctgtttatccgccatagcattacttataaccgcattaataatctcatctgacacttcgagtcttattacaaatgcgtcatcttcctcaaagctttccttatgtacacaccccgaatcaataaagcatacatcgcctttctttatatgcaccttatccccacatacatgctcagtaaggcttccatcagacacatataaaagctccgcatatccatgtttatacatgtcagtttcactacctgccatatacctgttcacatgaaacaaaaagctggttcctttatcaactacattccccatatctgacacctccaacttgtatagaaacattctatcacaaaaagtcgttgtaggaaacttttatttcaagaagtcgttgcaggtaacttttgatatattatcactctctttcgataaaacatttgtaatataaacccttaaatgatataataattatgttagttatgcctaacttgcatagaaaggagcttttatgtcagaatttataatattagcaattccttttatcggaacatctcttggctctgccatggtgttcttcttaaaaaaacggattgctccaaagtttgagaaaatgcttttaggattcgcggcaggagttatgattgccgcatcagtatggtctttgctgataccatctatagatatgtcaaaaggaagcagtgctccggaatggctggctgcactggttggttttctcgcaggaatattctttcttctgtttcttgatactgtcattccacatatgcatattgaaagcagaaatcaggaaggtattagaaccaattccatatccaaaactacaatgatgctttttgctgtgacattacataatattcctgagggtatgtcagtcggtgttgcattcgccggtgcaatgatgaaagattcaggaataactgctactgctgcaatggctcttgcaattggtattgcaatacagaattttccagaaggagcaattatatcaatgccattatgtggtgaaggcatgagtaagaagaaagcattcatatgcggagtgctttctggtgttgttgaacctgtcggcggattcataacaattcttattgctggtattatcacgcccgttcttccttatctgctttctttcgcagcaggagctatgatgtatgttgtaatagaggaacttattcctgaatcacagaacggcgaacacagcaatataggaactataggtgccgctgtaggatttgcacttatgatggttcttgatatagcattgggatagtgattactcaatcactatcccacaatcctcacctatatttcttaatataaatgccatatcagactctggtactgatacacagcctgccgttggtcttccattagagcaatgtaagaaaaaacagcttccttttcccggaacaccttctatgttatatccaataaacagacagtacccataagctgtcggataatcaattattctttcagacttgctcttgtcccagtctgtatcagaatcagctcttgcatactgattatataaaggagaagacgaatctcctacccagtaatcatattcatctacctgaagataaggaactttcgttcccggatccggattaattccaaatgcaaaatacaacggaaatgttccctgtggtgtagctgatgtaaactcactcgcctcaccaactccattagaacctacaaatccatctgtccttaaaatctcagtccatacgccatcctgcagttcatgcatagttacagttgcatttgttccattcgactggacaattacaagctgggaatactgtgatgctgctgcataacccgctgcaaagctgttattatctggctctgctgcctgtggtgctgtctcatatacagtctgtgaagaatccgtaacctccattgccacaactgtcttgttttcttcttctattgtctcttcctgctgtgtttcagaatccattgtcagtccagtagttgtctcctgtgtgcttaactgtgttgtttcctgttgtatctctgagacattagtttctttatctttcatgtctgttacatttttcttattgccgcatccttttgcaaccagagctgttatcaataacaaagttaatattatagtcttcctcacttttatctcctgatgtattatttccctgcaaaaagggataccagccataagtttaactggtatcccttcatgtttcaacacatttcagctaatatttcaactaatatttcatataatctttaattacatcatggtcttttagcactttttcaataacagttccttttatcttctttaagacaaccttcttgataacattaagcggtcctaaatcaatctctaatggtgatttgccatccataagcttaacagatgaatcaagcaggtctcttacatcatatacactaccccagacctcaggaacacctctgtctacgccaagcagtccatatacagcctccattgcagttctgactgaatactctgtcgtaaatattgtgtccctcggagtctcagcaaactgtccaagaaatgcaaaattaacgcagccatcaggaataacatcaggtctgtcaccttttcttcttggcatgaaaaatgcagtaataaatggcatcattgttggtgtagtgttacagtggttcttagcaagctcatcaatctcttcaacaggaacgccaagatgatacagccattctgctgtaatctcttcacctgtacactctttcataggcttcttgatataatcaccatcaacatcagtaaacaggctgtatacccatacacacacctcatccttcttctgttccttaaactgtccctgtctgttaattgtccagcttaaaagccagcttgaatccttacagctgacaattccacctgtaacaacatttccagttcttgggtccctcttacatatcttcttaatgtaagaaataatcttctcatcgcttgttgtaacagttgcagactcccagttagactttgatatatcaccacagaacttctctgggtgtccaaatgaactatcctgtgctgcaatattcttccacagactccagcagccgctttttcttacctctgcattgccaacaggtgcatgtgtatggtcaccgtatatagtaccttctgtacagcttccattagtaacgaacaccaaatcattctcagtaagatcaattgacttagtctcaccttttacagtacattcaatagtctttgcaatcttctttccattcctgaaatcaaagattacattatcaactcttgtgttaaacctgaactcaacacctgcatcttcaaggtatttctgcataggcaagataagtgattcatactggttatacttggtaaacttcaatgctgagaaatcaggaagtccgcctatatgatggataaatctttgaatataaagtttcatctcaagcgcactgtgccagttttcaaatgcgaacatcgtacgccagtacagccagaaatctgaatcaaaaacttcctcatcaaagaaatcttcaattgtcttatcatacaaatcctcatctttagtgaagaacagtttcattatttccatacagcccttctggcttaaattaaatttgccatctgtatgtgcatcttcacctctgtttacagttgccctgcaaagagaataattaggatcatgcttgttaagccagtaatattcatcaagtacagaaactcccggagtctcaatagacggaatacttctgaacagatcccacagacattcgaagtgattctccatctctcgtccgccacgcattacataacctcttgtaggatcattaattccatcacatgcaccgcctgcaatatccatagcctcaagtatatgaatattcttacccttcatctgtccatctcttacaagaaagcacgctgcagctaatgcaccaagaccacttcctacaatataagctgatttatcatcaactccttctggtttttccggtcttgcaaatgcttcatagttaccattagagtaatatattcccttactattcttagtatatttccctctttcagtatttcggaactcctcatgtgctctttcctgaatgtctttagttaccttcctctgttcatcccttttgttcttttttgatacaactgccgcacctgcccccagtgcaagaatagaagctgctcctagttttaacgcctttttgctcataatcttttccacctttctatgctttcttatttatttttgccgttttttattatatttagcatacattttttctccaaataaaaaaacaggcaaagcatgtactttgtcccaaaatcgaacactttacatgttttgtctgtttttaataactaattattagcttcacatagattaatcattgtatcaatcgttgcatcaaatgattcagaaaaacgcttaataagatctttatcatatggcggcattccatcgcctatccatcttgacacaattccaactattgaatagctgtaaaagcttgttatatactctctgtcatcttctgtaagcttatggtctttagaatatttcttaacaaaaagtccaacaagatattctgttgtattatgcagatatttctcaataatatctctgtttctggaattatacacatgaataactgctgcacgatactcaataataacagaagctgccttactatatgtctcataaaaagttgcatcttccgtaatatcaatattcttttctgtctcttctataagaacactgtcaagcacatcatatatatcactgaaataataataaaatgtattcctgttaattccacattcctcacatatatctgtaaccgttaccctgtcaatattcttacgctttagcatattaagaaaacagtccattatcgcttttttcgtaaatttagccatacatttctcctgaaattattctccggcaataaaaagaactcctaatgttcccggaccacaatgagaagatataacgccgcctgcccttgtttcatatatttcatcaaacacatcaagttgtttaagataattctttacttcatcaactatctctttatcacagccagagtgtgtaatgaatacacggtctttcttagccttcttaaggtcttcttccatatccttaacataatccagtacaacattcttcatgcgtcctctgtacttctttccaggattcatctttccattattaacttcaattcttggatgaagtttaagtacaccgccagccatggcagccagtccgctgcatcttcctcctctgtgaaggtaagtaagcgtatcaacaacaaagcttgccctgactctcggtcttaattctaatatattcttctcaatgtcagctgcagacatgccttttcctgccataacagcagcctcgacaacaagatgtcctattcctgtagacagattctcagagtcaattacatgaatcctgtcctctgcctcaagctctcttgccgcaagtctgaacacattagctgtagttgacatatcctctgatattgcaaatgcgacaatatccctatcctcttctagaacacatttaaacatctctattgtatcatcaatagacaccgccgacgtcttaggtgttgtcttattctcatctgcccattcatatatcttatctggcgtaatatcaattccatccctgtattcatcattgcctagcagaatgtgaagcggaataaccgatatatcaagcttgtctataagttccttagtcaaatcacttgtactgtccgaaataatcttaaccatgtaaatgtatatcctttctagctgctatatgtctgcagaaaatcatacagctgtgcttctccttcaaaatatatccctttagtcagtctttctcttatatcatctggaagtgaatccatattaatatctgcataatcatagaacacttcgcgtccttcgttcacaatatttctgtatattcttaaagtatctctttcgtacttaagcacatactggtactcttcactttcagttactttagtcacttgcgagcttacttcttctttaaaatgctgattagaaggcttcttattatctgttactacaagtataaatattgcaagtactacagctattacagccatagtcataatcacaacataaagccagaatgatttcttattcatcaatactccctcctgtaagttgtccttactgggaagtattaacatttataagcaatattatactataacgaaaagctgtctggcaaaatttcactcattgtataagtcttaagcccgctgcattcttcaataataattcttgtatcaggattgaaaaattcggacatgacctgtctgcatattccacacggataggcaggctggtctcctgaacatacaatagcaatcgccttaaaatcctttacaccctcactgaccgccttaaatattgcagttctttctgcacagttagtagccccgaaagaagaattttcaatattacagcctgtaaatacctgtccatcagtacttaaaagtgccgcaccaactgcaaaatgcgaatacggtgaatatgagtactcaagtgcctctttagctttagcaacaagttcattatctgtcatatatgtcacctcttaacgggtaattccaagtctttcaagtacttcattctgctttgcttccataactgcactttcttctggtgtcatgtggtcataaccaaaaaggtgcatcatactgtgtgctgtaagaaatgccaactcccttttttcagaatgaccatacttgtccgcctgttccttaatcttctgaacgcacagaacaatatctccaagaagaagctctcctgtatcaggattgaaataatcctcagcattgttttctaactcgtcctcaattgcatcaaaatccgaaggtgtaacataattaactcccggaaatgaaagtacatctgtcggagaatcaatatttctgtattccttattaatctcgtggatagattcactgtcaacaattgttacattaacctctgcttcataaggacatttttcataatcaaccgcctcattgacaacatcagtaattatcttctcataatctaagtcaagtttttcctcggcttcgtactctatattaatagtcatatcaatcttttctccttcctgtctgacttccctttcttgcttctcttctcttggcagccttagcctgattctcctcgtaatcctcgtatgccttgacaatcttctgtacaagaggatgtcttacaacgtctttattagtaagctttataaatgctatctcttcaacctttgataaaaccttagtcgcaacctcaagacctgacacggtatcccttggcagatccttctgtgtcatatcacctgtaacaacaacctttgagccgaatcctattcgtgtaagaaacatcttcatctgtgcaggtgttgtattttgtgcctcatcaagaataataaatgcattgtcaagtgtacgacctctcatatatgcaagcggtgcaacctcgataagacctttttccatattggcattaaagctctctgcacccataatctggaaaagtgcatcatacagaggtctgagatacggatcaaccttgctctgcaaatctcccggcaggaatccaagcttttcacctgcctcaatcgccggtcttgtaagaataatcttattgacctcattattcttaaatgcattaatagccatcgccattgcaagatatgtcttacctgttcctgccggtcctactccgaacacaatcatcttatccctaatggcatcaacatactccttctgtccgaatgtcttaggcttgataggccttcctgcaatcgtcctgcacactgtatcagaatcaatctcaatcagcgaatcagccttttcttcaaatgactgtgcaatggaataatcaacattctgtcttgtaatctggttgcctctcttagacagctcatacagataattaagtactcctgatgctctctgcactgctgcctctgcacctataaccttcacagagctgtctcttacaataatcgtaactttaagtgttttctctataaccttcgcatattcatcaaactgtccaaatatattggagcagtgttctaccggtatattaataagactctctacctcactcatcagatgtctccacctttctaacatcaaaatccgcaggaacagttgcatcaatatcagcatgtgcaatatacttatccccgcttctttctatattaacatgataatcatttatttgcacttcattttctttcaaatgttttataaatctctcagctttttcattaagaatagccgctgcttcctcctcactgtactcagcctcattttccttatactcattaagagtaatcttctgtacagatacaggaagtgcaatcagattaccaatctttatattcccctcattaacaaccttgtcatactcttttaaatgtcgtggaaagccgagagaaatttcatatttatctatgcttatagcatatgtcgtcatctttcgtccagtatatattttatcggcatataccgcatttatctcattatcccatgataactgcgttcttatcagaatatccgcctgagcctgcgtctgaaattgctgtatattctcctcgtaatcatcaggaacatacaatgtattctcaacaagtatgtcgccttctgatacctcgtcaccaacagtgaccttcggtgttccgcttctggttataatgtattcaataacaccggaatatcctgatattatattgccatcattagtggtgctgtgtagctcatcagctttagattcatcaatactgactttcagaatatttccctcaatccgtacattaacccatgtaacctgcgacagttcatttttaattgccttctcgatattttctgtatctatattcttaactttatcacctgtgttgatgccatgctctttaagaaacctacgcattgaatcatctgtatatatgtaatttccgtcaaattcaatactccacacgaatctgctggcaatgaacatcaatacaaatgcagtggcaaagccagcaattatcgaataatttcttctgtatcttgcaaaaagaaactctatatcatgtttctttaaaactttaatatgaacatgacattttcttcgcatttccttagtcttgaaataatcctgtcttgttattctcgctcttattgtctctttcacacactggcagttatataatgtaatcccgcgcctgcagcacagattaacgaacctttcccgctcccatccggatatttcaataacaatataattatgtatccttttcatcagcctctccttttagagaaactttgccaatgcgtcccctaagaaggatttcgtcctgattcatatggtatatcacaagattgctcccgctcactcttatattacctattttcgtagaaaccttaagatattcgcttgaatactcaagtatccccctgtaattctctataaaaacctcgcagtcacccagcattgatataacaggaagtcctgcaacaacatctctgctaagatcacacatctgtccgagccttataccgctgctgataaaatcgaccatataagcagacttccaaaatctttttatattctatgctgttatcctttaaagtatgattttagtctgtcattatatttcctatttctaattctttaataagactctctttaatatccgttatatgttgtctgaaatagttgtgatttgttgcttcaaaattaagtatcctgttaagtttataattgagactttccagcaaaaccggattttttattataaatccaaaaagagcgatgcctaagcaccgctctctcatgtcaaaaatattaattattagttgaacttacgttttctagctgcttctgacttcttcttacgtcttacgcttggcttctcgtaatgttctctcttacgaatttcctgctgaatgcctgccttagcacagtttctcttgaatctgcgtaatgcgctatctaaagactcgttttctttaacgatgacatttgacatactacttcctgaccacccttctgttgcaaattgtgcgccaaactacataaatagggtatttactaatcgcacaaaaaacattatatcacatttttgcaaatcgtcaagccccaattatccaatctgtgcaagaattgtatcaggtactttagcaataagctcatcaataccggcagggttcttaccaccagcctgagccatattaggacggccgccaccgccaccgccaacaataggagcaagagccttgataaggttaccagcatgagcacctttggcaataacatcatctgttgccattgcaataacgcttaccttatcagcaccctgtgcgctgacgataacaacaacacctgaaccaatctcaccctttaacttatcaccaaggtttcttaattcattcatatcaacaccgtcaaccttagttgcgatatacttaacgccgttaacttccttgatatctcctgctgtatctccaagtgcattattagcaagctcggccttgagcttctcattctcgctcataagtgacttaatctcatcattcatagctgcaatcttcttaacaagctgtacgggctctgccttggctgccttagctgcctcttcaatagtcttctcaagttcagcgtagtacttcataacacccttatctgtaagagcctcaattcttcttacgcctgcagcaacacctgcctcagatacaatcttgaaaagtctgatattagctgtattagcaacatgggtaccaccacagaattccttagagaagtctcccatagcaactactcttaccttctcgccatacttctcaccgaaaagtgccatagctcctgtcttcttagcttcctcaattgtcattacatcagtaacaacaggaatagcctctgcaatcttttcattaacaatatcttcaaccttagcaatctcttccttagtcatgctctggaaatgtgtaaagtcaaatcttaatctgtcaggatcaacgtatgaacccttctgctcaacatgatcaccaagaacagttcttaaagccttctgaagaaggtgtgttgcactgtggttcttgcatgtatctgctctgtaagcaggggaaacttccattgttgcagtatctccaaccttcatcatgcccttagtcatagttccgacatgaccaatcttgccaccctttaacttgatagtagtctcaacagtgaattctccttcagatgtcttaataacacccttatcgccttcctgaccacccatagtagcatagaatacagtttcatctacaataacagttcccttatcaccctcagataaagcgtcaacaacttcttcctctgttgtaagaactgtaatctcagattcattagtaagcttgtcatatccgacaaatgtgcttgttatagcagggtcaatctcatcatatacagttgcatcagcacccatatagttagttaccttacgtgcatttcttgccttaactctctgctcttccatagctgcattaaatccagcttcatcaattgtaatattcttctcttcaaggatttccttagtaagatcaatagggaatccgtaagtatcatagagcttaaatgcgtctgctcctgataatacattctcacccttagaagcaagttcagcttccatatcattaaggatgcttaatccctggtcgatagtcttattaaacttatcttcttcttcagagataaccttagtaataaatgttctcttttcctctaattcaggataaccatccttagagccttcaattacagtttcacaaagcttagataagaactttccttcaatacctagaagtcttccatgtcttgcagctcttcttaaaagtcttcttaagacatatcctcttccttcgttagatggcataattccatcacttaccataaatgttactgaacggatatggtctgtgataacacggatagagacatcctgcttctcatcttccttatacttaactccagccatctcacaaaccttgttgcgaagtgcctgtaatgtatcaacatcaaatatagaatcaacatcctgcacaacaactgcaagtctttcaagtcccatacctgtatcaatgttcttctggataaggtctgtgtaattgccatgtccgtcattgttaaactgtgagaatacattgttccatacttccatatatctgtcacagtcacagcctactgtacagcctggcttaccacagccatatttctcaccacggtcataatatatctcagaacatggaccgcaaggaccagcgccatgctcccagaagttatcctccttaccaaatctgaatattctttcaggtgcaataccgatttccttattccatatattaaatgcttcatcatcatcctgatatatggatggatataatctgtctggatcaagtcctacagtctctgttaagaactcccatgaccagtgaatagcttcatccttgaaataatcaccaaatgagaagttaccgagcatctcgaagaatgtaccatgtcttgctgtcttacctacattctcgatatcacctgttcttatacacttctgacaagttgtaactcttcttcttggtggaatctcctgtcctgtaaaatatggcttaagtggagccatacctgaattaatgataagcagactgttatcattatgtggaactaaagaaaagctcttcattttcaaatgtcccttgctctcaaagaaatcaaggtataatcttcttaattcattcacacctctgtactgcactttaacttcctcctgattattcagtaatctctttctctttattctccgatgcagccatcttagctgccttcttggcatctgctgcctttcggagtttaccacccacgaatactgcaagtaccagtaacgcaagcattataacaaatcttaccacttcataagctatctcgcccacgagcgcgctgactaacccaaccatattattacctccacgaattataataaaagccttcgcaataatttataatatcacaagaaacaacatttatcaagatttccagtttccatctgtcaggaaatgcattgcacgctgttctgctcccttaattatattcttatcataccctataacattaagaagcttgattgcattccttgttgttgcaggtccggcatacagcttataatcaaacttaacctcatcctcagtaacttcctcctgaaaatgatagttgctgtaacagtccttaagtattgttgtaagctcaatatcatgtgttgctgcaaagcacaacgccctgcctgtattaagattctttaatatctctgatgatgctgcaattctctcaacagtgttagttccacgaagtacctcatcaataaagcatagaaccgttctgccttttttaccaactgcatcaagaattctctttaatgacttaatctcaacaatatagtaactgtccgaattagcaaggtcatcccttaatgccattgaagaatatatcctatatactggagcaatgtattctttggaaagacttgttcctatagtctgtgccagaatactgttgattgctattgtctttaaaaatgttgatttacctgaagcattagaacctgtaagaagaacatttcctttagttgttattgaattacacacaggattatctataagcggatgatacacttctttcacactaaggttattagtattttccacaaattcaggcttacagtaaaatggcaggctttccctgaatgatgcaacagcaattgatgtctctatgaatccaagtgtatctacaaggttatatgcatcctcacttttggcagttataagctttgtcatcttattaaacttcacaatatccatgtgcgttatcattcttagataatcaagtacaacctctccgattgaaccatcaacattgcctgattcaatcatccatgagccttttgttactttagaaaagctctttaatatctctttaagcctgttacactctggttcaagaaaacttatattgctttcacatatatcttcagatgccgatgccattttcacaataacattaatacatttgaaataattctcaatcttagccttatacttgtaataagtaattattgaaaatgctaccgatgcaattataagccatattccaagcaccggagttacaagaaccgtaacaagtattgaagcaataagaaatacccacgcaagataatgcacaatattacttccctgctctatatccattatataaccgatataatctgtaactgcaatcttacggctttttcccatattcataaatatcttctgaattgtgattctttctttttcattagctgtgaattcatctgcaagcctgtccagttcgtgaagcttttctgcatctgcaaccggttctcttaacatcttatatagatattcctgtccaacagatgaattagtattattaatacatttaaatacttcatccatgccaagatcattccatgttatatcatcaatcatagattcactcggattacctttggcataatgcgatatatattcaaagctctcatctgttcccttgtatacaacacgtttgccccacgctttctttatggcattctccgctgccttcttccgcttaatactgctgcttacacatacatacacgccgattgcaacagccagcagtacaaaaacaataatctctaaatctgtatctgtcataaatcctccatctgcctgttattctgcaatctgactgcagtttcaagagctgtctccatcatattagtaaatcctgtctgtctctcctgtgctgacagcttctcacccctgtagagatggtcacttattgtaagaatagtaagtgcatgttttctgcatctggcagcagtcatatacaacgctgctgactccatatcaactgcaagcacacccatcttcttccatctgtcattaactgttgtatcatcattataaaacacatctgatgccagtacattgccaactttaaccgaaaaatgtttttcttctgcaacatcatatgcagtctttaaaagcgtaaaatcagctatcggcgcatatatgcccggaagattgtactgtgccgcaaagttagaatcagtgcatgagcccattccaagtacaatatccataagattaaggtcatcatcaaatgctcccgctgaaccaatccttataatattatccacatcatatacattatataattcatatgaatatattcccattgaaggcattcccataccacttcccataacagataccctgcatccgttataaattcctgtgaatcctgacatattgcggaccgtattaaagcagattacatctgtaagataattatctgctatatactttgcccttaaaggatctcccggcataagaactgtctttgctatatctcctgtctgtgcttcattatgtggtgtccccatatctgcctcctgtcatcaatcttaaaaaggctgctttatataataaagcagcccgaataattatttacctgggtatttaattactgactcaacatcatatcctgcaatcttatctcttcctttaaggccttcaagctccataagaaaaagaactttcactacttctcctccaagctcttctacaagcttgataatagcttctgttgttccacctgtagcaatcagatcatcaacaataataaccttctgtcccggagtaatcgcatccttatgcatctctatagtagctgtaccatattcaagttcataatctgctgatatagtctcacacggaagtttacccttctttcttacaggaacaaatcccttaccggtattatatgcaacaggaacgccaaatataaaccctcttgattctggtcctactacaacatcaaattctgtatcccctataagatctgtaagaccgtctattgcaagctttaatccctcaggactctggataacacttgtaacatccctgaatataatccccggttctgggaaatcaggtatacttcttacataatcttcaactttcttgttcatctaatataaatcctccttggttatctgttaacctgcatgtctcgtaatttcagatcattatagtacgttatctggttccttccatgctctttagaataataaagtgcttcatctgcacattttatgaagccttccacatccatatttttattatcaagatatgtaaagcctgcactgaatgttattataacatcttcaggcaagaaatcatactcctgatttctaaaattagtaagcattccttccagtatctttcctgcctgctttctcgtatatcctgaaaaaagaatcagaaactcctctcccccgtatctgcctgcatgaatcgtatcatcagtgtactggcttataacccgtgataatgtccttaataccatatcacctttgtcatgaccatatgtgtcattaaccttcttaaagaagtcaatgtcaagcatcgcaacacatacatctttccctgaaaagtaataatcatgcattgcctgcttgatgttctcatatatagaaaaccttgtatgaagctgtgtcagataatctgttgaaagcttctcctgaagctttttctcgccatcataatattcaacaacatcttccacctgcagcttattgaaattatacaatataaccgatattgcaaatacacagcttatcagtaaaaatgtagctgtaaaatctcttacatcaagtgccttcactgcactggtgacaccgtaattatacataaatgctgatgcaatccatacagctattgatgtagcatatataacaaaaatggtctttctgtcattaaaaaatgaacttatcaccattacaactgctgttccaacccacaagggttcacaaaaataaaataaaagttcctcagcagcaaacagccctaccagtgatatacaacacatcctgtttttagtttcattagaaaaattatctctggaattaatcattctgaatgaacagcagcttataatctggaccaccgtaacggatattaatcttattatatcttctgtcattatagccggcagattcttatcagcaaacgacactataatatataagatattaaccgataccattatgataaataatattttctcaaagccaagcattttgtttctgaacacattatgtctgtaacttacatgttcagctccagttcctttcttttccattgcaaacctcttgtcgttcaattataattgaatttatattatcataacttttcagttaaataaagtattttttacacaataagacacacaagtcctgaattctcattcattactttttcaattgtatcgccaatctttcccatgctctcagttgtcatattatgtgttttttcatatattccgtctgatacaatctgttctattgtctttccaaatatattggtatcccagattccgtccggattatctttcatatttccttttatatattcaatcagatcttctgcctgattcctatttccaacaatcggggcaatttcaaccattatttctgtcttaagcaggttaatagacggaactttagcttttatcttaactccatatttattgccattcttaatcactaccggctcatccagttgtatattttcttttgaaggtgtaacaactccgaagccattaagattaacttcgcttattgcatcaccaaagcttcccagttcattcttcttgtctgaaagagatttaatcatatctataagctcatgctcattattaatctgcgttcctgtaagttcacttaatattttataatacagatctttcgaaagcttaaattcaatttcaaccctccctgttgacatatcaacatttttcacatcaatcttttctatgtattcgcatgtattattcaactcaagatacgcatccttcataacatttatattatcaagaatcgaaagtgccacatctactatatgcatcttaagccagtgtgatgactcaagtacttcaacccatgcaggtgcataaaaatcaagctgtgataccggaaattctttaagcacacctgatataaccctgtcaacatcttcttttcttagctggtcacaattaagagcatagacatttacaccatatttttctttcatagcttctgcaagctgcacagattctttagcataaggcttcacacagtttaatatcacaacaaacggttttgaaatctttttcagcttatctatagccatctgctccgcgttgacataattatcccgttctattcctgtaaatgagccatctgttgtaataacgattccaatagtagaatgctcctctatcaccttttcagtaccaatctgtgctgccattgaaaatggaaccggttcttttgaccatggagtattaaccattctctctttgccattctcctctgctcccattgcgccatcaaccataaatccaacacagtcaattgcacgcactttaatcttaatatcatcagccatgcagattgctgcactctcaccaggtataaacttaggttcagtagtcataatcgtacttccagcactactctgtggcagttcgtcaattgtgcgttgtttctcgttagcatctgcaatctcaggaattacacatagatccataaatctttttacaaatgtcgactttcctgtccgtacaggacctaccacaccaagatatatctccccattagtgcgtttctttatatcctcgtacagattaaagtttatattttcctttctgtctgacatactttcctccctgtaattaaagcggtacataaaaaattatgccttccgcatatacttgtaaaaaatatatgtgaaaagcataatttttattctgcatttaattgtaattttgcttaattccgaatagtcgcaattattcatcaaattccgcaagcacataataacccctgcttgtctctccaacctctttaacaattccatgtcttgactttaacctgtcaggtgttgaatagtttcctgacattgcaactgccggctctatcgtataataataactgctaggaagcttaccctccgtaatatctacctcatctcctggcttgacaagattaggtctgctcattgtgaattccatctgtctcatgtgcatacatctcctttacagattaatcttttctaaacatttaatcgtatactctgcaaccttctgctttagatatacattattctcaagctttaactcaggatctttctttagcatatctttcgctgcatctgacgcttcctttaatgtctttgcatcagtaaatacatctgctattccgaaatcaaaatcaccgctctgccttaccccgaagaaatctcccggtccacgcagtcttaaatcttcatcagctatcttgaatccatcgttggatttattaagaatttccagtctttttcttatcttctctgatttattgcctgtaacaaatatacaatatgactgatattctcctcgcccaacacggcctcttaactgatgaagctgtgcaagtccaaatctttccgaattctctaccatcataacagtgctgttaggcacatttacaccaacctcgataactgtagttgataccagcacatccgtttcatgtgctgcaaatctttccatcacctcattctttaacgatggacgcatcttgccatgaagatattctatccttatatccggaagttctttcttaagcattgccgtgtaatcaacaacattttcagcctctacagcctcactgtcctcaaccattggacatattacatagcattgtctgccggaagcaacctgcttgtgtataaatgcatacgccttcggtctgtagctttcatccacaacacaattctttataggaagtctgttcgcaggcatctcatcaattattgatatatcaaggtctccgtacagtataattgccagagttcttggtattggcgttgcactcattacaagaatatgcgggcttttccctttctgtgaaaagtcacggcgctggtttactccgaatctgtgctgctcatctgttataacaagtgccagttctttatattcaaccttttcctgtatcaacgcatgcgttcctactattattccggcagttccatctgcaatccttgcatatgcttcctttttctgtttcgctgtcattgaaccaacaagaagttcaactctgatatcaagtcccgccttttcaaagtctttaacaaacgattcataatgctgtcttgcaagaacctctgttggtgccatcaatgctccctgatatcctgcaataaccgtattgataagtgcaattgttgcaacaactgtctttcctgagcctacatctccctgtatcagacggctgcacaggtgttcacctgacatatcttgtgcaacctctgacacagtccttaactgtgcattagtaagtgaatatgacagactttcaaggaattgatccttttctttgctttctggtattacatagctgttcggtatgcgttcatttgcactctttaatgaaagagttgctagcgtgaataaaaaaaactcttcaaacgcaagtctgtgtctcgcctgaacatattcttccattgtcttaggaaaatgtatattaacaacactgaaattatgctcagcaagcgaatatctctttcttatataatcaggtatatattccttttcaagtcccgcgctgtatttttcaagtgcctgtgcaactgccttagtaacagtattgttagtaagacctttagtcagaggatatattggctgcagtgttccctgaagttccttatactgggcaagtgtatacattttcggctgttctaataaccagcctcttttattaaccagccttcccctgaatacatatcttgttccaagccttaatgtattctttaaaaatggcatgttataccagctgcattttatggaatcgccattataatcctttatagtcacagttaatatcttaagcctgccgctcccatatatatccgggcttttgcatacctgtccttcaacagctacctctgtatgctctgattcatggcttatatctttaacaaaaacaggctcatggtatacatcgtaatcccgtgggtataaccccacgagatccgatactgtgtataccgaaagcctgttaaaattctcagctgtcttagcgccgattccctttaattctgttatattcataattcttactcaacagatacaatataataataaaccggctgtccaccaaactgaagttcaacatctacatcagggaacttttcttcaatcttagaaacaactgcctcggcagcagcttcttcaatatcagctccatagtaaacacttataagttcagcttcatccgacatcattgactcaatcatctcaagaagagtctcatccatatcagtaccaactgcagcaagtcccttatcacctaatccaagataattatccttcttaatctccttgccgtcaattgatgtatctcttacagcataagtaagctgtccagacttaactgttgaaagactgtctgtcatcgcatcgccgttatccttagcactgcgtgttgtctcaaagttaatcatagctgtaattccctgtggtactgtcttagtagggataacaataagttccttgtcttcaacaattgatgctgcctggttagctgcaagaataatattgctgttattaggaagaacatatattgtcttggcattaatcttatctgctgcattaaggatatcctctgtcgaagggttcattgtctggccgccttcaataacttcatcaacaccaagtcccttaaaaatctctgcgattccgcttcccggtgcaattgtgataaatccaaaatccttagctggctcagcttttttctgttcagcttcagaatttttctccatagcctgcttagctgctgccgcctgcagttctgactgtgcaacaaccttctggttatgctcctctcgcatattatcaactttcatcttagtaagctgaccatattccaatgccttctcaaatgcctgacccggatggttagtatgcacatgaaccttaacgatatcatcaagagcaacacatactatagaatcacctatcgatgtaaggaatgctttgaagtctgcttcagtcttctcatcaaactccttatcaagcataattatgaactcggtgcaataaccgaactttatatctacattctctacagcagctccctttcctgcgcccggaactgtctgttcattggatggcttactctctgttatagaaaaatctgtaacctttcctgtaagtgcatcatacattcccttaagaacaacaacaagtccctgtccgcctgaatccacaactcctgcttctttaaggacaggaagcatatcaggtgtcttggaaagtacatattcagcatgttcaataattatacgcatagcctcttcaatatcatctgtctgtgatgcaatctcagcagccttatcagaaattcccttagcaactgtaaggattgttccttcctttggcttcataactgccttatatgctgtctctgtagctctgcttgttgcaagcgcaagtgtctcaactgtaatctcagaaacacccttcatctctttagtaaatcctcttaagagctgtgataatataacaccagagttacctcttgctcctcttaaagagcctgatgaaatagccttagaaagattctccatattaggattagcaatagcacttacttccttagctgctgacataattgtaagagtcatgttagtacctgtatcaccatctggtacagggaaaacattaaggtcattaatccattccttcttagactcaaggtttttagctcctgcaagaaacatcttctgcacaagtgctgcatctattgtattagttgccacgattatcctccattctgcaattaagcattataacaatattcctattaatcaattactcttacgccttcaacataaatgttgattttcttaatctcaaggccggtaaattctgacactttatacttaacattctcaataagattatctgctactgcagcaatgcttacaccataagaaataataacatgaaaatcaatctcaataagattgttctcatctataactacactgattcctcttgtaaggctgtctcctttaagaagcttaacaagtccgtctttcatgctgacagcagccatacccacaattccaaagcactcaaccgctgtagaacctgcgtactgtgcaataacttctgaatcaatcgaaacttttccaagtttattctccaaagttcccttcatagatagtcctccaatactgcggcttgtatttgttaacacccataatccggatgcaagtttcgcgcagtcaaactttacataaaaatatgtatataaatagcacaaatattatactatctttctaaagaaaaataaacacattttcgaattctttattaaactgtaaattattaaactttgattatcaaatgaatgttcaaaaaataaagtgaatcgcgttttgcgcaattcaccttaatatactggtattaactttaaagctcatagattatgcacgctcaactaaaccagaacgtaagcatgaagtacaaacatacatcttcttagcatttccgttaacctttactttaacagacttaacattagcattccaaactttattagatcttctatgagaatgactcactgcattaccaaagtgaggacctttttcgcaaattgcacacttagccatttcaataacacctccttaccggtattgggtaatttacccacaacagaaattattgtatcagataaaaaaatattttgcaacacatttttcaagaattttcttcaaaattctctcaaaaacacaacatattgttctgattactggcagaacatgttataacccacaacaatcaatgtaattattatgcatacgcacaagaatacattatccattataaacagtgttattatcattccaacagcaatccagaagaatataaatccaagcagtctgcacatatatatacttccttaataagtatgttatataatatgcacattacatatgtttatgaaaaactactctgctgcatcttcaatagcttcatcaatatctgcatcagttacaaccttttcatccttacccttgaatttatcaataacatcaggaatcatatcaagaatcttagttacagtatcctgattcttaatattaacaagcttggttgcaccattctgaataactaaaaccgcgctcggtgtaacctttccggtcattccaccaccggcattattcttcttatcccctgcaaacgctcctgctccaactccaaacgaaacatcaacaagcggaaggataattgtatccttaaccgtaaccgcatcaccaacaacagtcttagctgatataaatgcatccattcccttaaaaagtgatgcaactgttgaatcaaaattattctctgccataaaatccctccttgttttgcgaagcaaaatccgaatcctatgatgaggagagggattttgacctccttgttttgtgaagtactgttaacattataacataaccttctctatctggaaataaactttttaaactgttcatttctatacactcttaacgctatcacaagcactgaaaatatacgtatatttcctttcaggaatatactgccctctttaatattctcaccaaataccggttctaaagaaaggtcaactcctgacataccataaaagattgatatataagcaagcactttgcccattgtcgccgggtcttcaaatccaagtcttgcattaattctgtatttcttaggtctaataaccttaataagtgtctttaactgttccacaaaaaaatgaaaaagtgccttattatcctcatctgtcacaaattcttttgctttcttcactttttctttaagcttgtcagccgctccggaaaccttttttactgtatcctttacaaggtttattatctctttaatctttgtatatattacaaagcatttatccttaactttatcaaagaagttcttattctgtgtggtcttaaattcatcttttgatacagtctctttaagactctctgcagactctttaatatcttccacattattcttaacagcctgtgtatcttctttagtgtcactcacagcctcagccatcttaatctgtggtttttcctcattttccgtaagcttcttggcttcatcgtcgtttacagaaaaaatattttcttctgagtgttttgtttttttcttctttgatgtcctatgttttgaaattttttcttttttttgattattactgtaaattgtaataaaaagtgccttggctttaattgcaagttcttcatcatacgaaacaagcacccttaatattccaagccataacaatttcgcatgtgccttgaacttaccatgataatcagcatcagccttatatcttaccggcacaaaaagaactgctgccacaacaattattacaagtcctaaaatacacgcgataactatgcctgttatcttaagtataagcaataaaacatgcagcatagccccacctttccagcagcatgtcagctgcccttccttaattctgtgccaaacctaagataaccagcgacatcaacgcctcctgtatgggaatatgtgtcgtcaactatgcatcttaccagttcaagtgcctcatccctgcccttcgcaagtcctacaacatacactttatctctgtatgatttattcttaaaatgcggctgtttcagcatattagctgaataaacatcaagaatattatcaggattgacagaaattgcaacaatataagtatctatggtaaatctgttctttctgataagaccaaatgttttgtattttgcttttcttgcgttatccccaagataaagatatctataccacttcaacttaacatcccccaaaaaccttaaacttctcatatgcacatcagcacatttgcattagttatcacttatcattgtcttaataatctcaacaactgccttctgctctgcatcatcattgcactgcataagagaattattaatataagcctgtatctcttccgtattgttaaagaataccggaagacttgaaagcactgatgccataacagctctcttaaccattacattcatgtttttaaaactgtcgtcaagttccataataagcttttctgccgtctcatcagcataagaattatcaggaatctcagcaaatacctctgattcaagtttaacaaaatcactgcctgactgtaacttaagtgttttagacaaagcattatatgcagataaaagctcatattccttaagctcatccacaaagttagcaaggctgtattctattgcataatcaccagatgatactgcctcgagaattctttcctgttttccttcaaatgcagcaaaatcttctgaaatatcttcaaatctttcacctgtaacataagcatttctcgtcttacttaaaacattcttggcattctcaatctcttctattctgtcaagtgtatttcttcttgtaaggacaactgtgagtgcatcattaacaacctgtgtaagaagcacatatacatcagcataatctgtcatcttctcagttgcaatatcaagtgctcctttgagtctcacatattcgtctttatcaatatttctgtaatcagcccctgcaagtgtgttatatatatcatagacatccgggaacttatcaaatcccgcctcacctgagagcatcgcacttgtgcttaaggtgtaatagaaatcatctatcgaatcctttccagcaccatgatacagtgtaaatgcatctctgatatgctcaaagaatctgtcctttaacattcttacaggaagctgtcctactatctctgaaatcttgccattaataacaacattatccttgtcagacaatatataatgcataatctcattagtcatgtaggtattatagtagtcgtaatccagttcaccttcgttaaatctgtactcaactctgttaagtacatgctcatatattcttaatctgtcaacataagctgttataacttccataatctcaataatctgttcacggaatgaattgagttcgttgaatgcctcataatcatcacattcatcattctccacgaaacgctccacaagctcattaagtctgttaatcatgttaagaaggtctttatcattctgtaaatctcttgcaatatcaagtacagtataataattcatggacattttgataaatccaagcccattatacatggaacacattccattaccatactttaaaagattttctgaaagattctttccctttgtaatttcgcctgctatataacctaaattcttcaatatatcaaacctcgtttattttaaattcaacttatccaacgcatcacagaaatcaaatgtagcatagtaatcctttattgtctctgctcgtctgatcatctgaacactgccatcttccttaagaagaagctctgctgatcttaactttccattatactggtatcccatagaaaaaccatgtgctcctgtatcatggataataagataatcacccatatcaatcttaggaagcattctgtcaattgcgaacttatcactgttctcacataaagaacctgtgacatcatacttgtggtcgcaaggtgcatcctctttacccgcaacagtaatatgatgatatgcaccatagatcgccggacgcataaggttagatgcacatgcatcaactccgatgtattccttatagatatgcttctcatgaattgccttagttacaagacagccatatggagcaagcataaatcttccaagctctgtatagattgcaacatcacccattccggccgcaccaagaacctcatcatataccttgtgtactccttcaccgataactgcaatatcgttaggctcctgatctggcttgtaagcaacaccaacaccgcctgaaagatttacaaatttaatatctgcacctgttttgtctcttaactcaactgcaagctcgaataaaatcttagcaagtgttggataatattcattagatactgtattacttgcaaggaatgaatggataccaaaatgcttaacccccttgctctttaatatcttaaatgcttcaataatctggtcatgtgtcataccatatttggcatcacccggattatccataatagatgttccaagctggaaatatccgcccggattgtaacggcagctcattgtttcaggaaacttaccgtctaatatcttatcaagaaactcaatatgagtaatatcatcaagattgattgtagcacctatctcattagcatatgcatactcttctgctggagtatcattagatgagaacataatctcttccggcttataatcaagcgcatagcccatcataagctctgccatagatgcacagtcaacaccgcagccataatcctttaatatctttaaaatatatggattaggagtagccttcacagcaaaatactctctataacctttattccatgagaatgcttcctttaatctcttagcgttctctctgattcccttctcatcatagagatgataaggagtcggatatgttttgtcgatttccttaagctgttcaagtgtaacaaatgtctttttcttactcattatcttcctcgtttctgtgctgaatttctaaaaatctttcgcaagcccacgtatacagcaccaacgcatagtcaggccactgtaagaaatcctatattatgcagaaatatttgtcaagtttttagtatgatatgtctgcaaaaaataagaagccactaaaggcttcttatcaattaatgaaattataaattaatacatcccttaaatgcatcaggtgcaactgttacattctttccatagtccgcttctttaagactaaggcaattaatgaacgcttcattttcaattgatttaagggactttggaaactcaactttctcaagtctcctgcagttttcaaaagcattaggtgctattacctctaccccttccggaaatgcaacctctacaatatcatctctgttagaaaaaatcccttctgttattcttgtaaaatctgacatatcaatctctttaaatgttctgttgtacaatgtcactttaattcggctaccactcatatcattcccctctttcctgttagtccggattactgttccaaaagcttaataacaagtggacttatcatagatgcctgtgcctgatatactgactgtggatcattcttatatacattatcataaggcattctgttaataagctgaacatttgcctctatctgtccataatatgttccagtctttatgtactgctgttcatcactgctattattaataatatccgttcctgttacaccaattctttctgaaccggttcctgtgactatattatacaattctgcagctaaattgtcacctttatctgcagatattgccgaaaataatttagcaaggatatccttatatgtttcacatacatacagatactcctcataacttataagcgaactgttatcctgttccttataactgcttcctgtcctttcagtcgctgtatgtttactggcataattccctgtaattgtatcaggagcattcacatcagaagctgcagtaaaatctgtagcatatgcaccatcaacggttgttgagtcattagcaagtgcaccacctaatatatcattaatcttgctgatataattaagcgtttcttcatacggaggcactcctccatacttctgtactgaaccactgccagcattatatgctgcaagagcaagcgtagcattaccatcataactgtctaacagctctgataacatctgtgcaccggcatatacattctgtctggcatcaaaaggatccgtaacaccatagctttctgccgtatatggcataagctgcattattccctgtgctccgcaatacgatacagcatccggatcaaaccctgattctgcctgtgctacagctttaagaaaattctcattgattccaaattcttttgctgctccggcaaaaatattctcaagagaatcatccacagtaatattattatatattttatcaaaatcagtcccaccagaattaacatatgtctggttattaacaagatatatgtcaccatctgacggagtgatatagttaacagtattcatcatcattcctcataatcatgcaattaatcactaaacaatattatacattctcacgacttcaatatcaatagccgaaatatgtatcaaacacagcttttgctactacctgtgcacttgacacaccagaataacccccttccagaatcacacatactgctatctggggattatcataaggtgcaaagcccgtaaaccagctatgatatctgtcagagtcatcatactgtgccgaaccggtctttcctgctgcttcatatgatgaatatttcatagaatttcctgtaccagaagttattacctctctcatgcattctgtaaggtattctgcctcttctgctgacatcacagttcctgcctctgttggcttattcttaacaaccgttcttccctcactgtcacttatactgtcaacaatataaggagtcatcataacgccatcattagcaacactagctgctatcatcatattgtgaagcggtgtcatcatcgtccttccctgaccgataccggtctcctgcatctcacttatcgaagaatcctgtgttacagccattgtactcttagaatactcaaaccctacaggaagattagaattaaataataatgtactgcacagattcatgaaagatgtcttattaagtcctgctccaatcgtagaaaatgcagaattacaggaattagcaaatgcttttcttaaatcctgatatccatgtgccgtatgatcaaagcatgcaatagtagttccaccagatatatatgcctgtccatcacaattatatgaataattataataatcattctgattctgccttatatatgcaagagcagtaattatcttgaatgttgaaccaggtggatatagcccttgcgttgccctgtttaaaagcaccgaatccgcactatcataagtaatccactcatcataatcggtatttactgcatttgcatcaaatgatggattcgataccattgcaagaatcttacccgtagcaggttccatcgctataactgcacctttattattaccaagtgctttatatgccgctttagtaagttcaacattaagtgttgttgtaacattatgcccctttgcttttcctccagacaggtcattaccaatctgatcaagcacattatctgtctcacttaaaagaaaataattctgagactgttctattcctgtcttcatccctgtaagagaagtaaatccaaccgaatgacagaacagattatcataaggataataacgtgtttcattaccatcctcatccgtaagcgttgttgcaagtacatctccgtcatctgctaatatatcacctcttacaaccttgctttcctgattgtctactcttttattgtaaggattattcacaattgttcctgcatcttttacattaaatatacacagatacacaatagttgcaagaaaaagtcctacaaaaaagaatgcaattatattagtctctttatttcgcagattcttcttttcattatcaactatatcactttgtatgttttgtttttttcttcgtctgtcctgttttttgttttctgccatctttcctgtcaccttcatcctgtctcatattgtacattccattaataagagcaaacattataagcgagcttaatatagagcttccaccgtaacttacaaaaggaagtgtaacacctgtcatcggtataaacttaattgcacctcccacagttaagaacacctgaaccccatatgtaaccccaagtcctacagctacaagacgataaaaaagtgtcttacatcttgaagctatattcatcataagaataagattattaaggcacactaagaatagagctattgaaaatatgagtccaaattcttcagatatagcagaaaacataaaatctttctctgctacaggtatcttatcaggcataccctgacataatccatatccaaaccacgatcccataccaattgcaaaaagagactgacatatctgatatccgcttgtatcaatatattcccacggattacgccatacaataactctcgctctcacatgtgcaaaaagcttatatgcaataacagatgcacctgctccggcaatcagtcctgccccggcataggccagttttcttgttgctatataaagcattgcaatatacaccacaaagaatataagtgcagcaccaaggtcagttgaaagcacaagaataataacatgaagtgctgcaaacgctgtaacaatacatgtctgtttaaatgtcgttgacttattaaacatcgaagcaacaaacataacatacaaaatcttaacaaactctgccggctgtacagaaaatgctcctatgcttaatgtaagattggctccatacaccttatttcctaataaaacagcacataaaagcacaagtcccgaaatgcaatatatccatccaaagtttctgaagctcttaacagtttttaaaagccatggaacaagaaacataataaccgttccaaacacagcaataacaaactgtttaacacatttgtcaaaattaagccttgctatcatgataaatccaactgacatcagcatacacatattattaacaagaagccttgaagcctttggatacaatatgtaataaaacgcaatgaatactataagatatataagctgtacaaaataaaagcctatatatctagtctcacctttcataagatacaacacataatatccaagaaaatgtatcgcgaatattataatatactgctggatatatattccttttctcttttcttccttatggattattgctcctctgtaagcagaaagaacataaaacgccatcagaaacgcaaatatgtattttgtaagttcaataaaaactgactgcatagcaatctcctttattcaagtcacttaatcttagtcgattgcctgatgaaaatgtcctgtagtaccaccactcactccatcagtcataactaattgtatatcatctgattcactttcgtcaaattcataacgaattacacacacaccgcattcttcgggattttcttttgtaagattgagtttttctcccttcattacagaataacagaattcacacatactttccactgtataagagctgcccttcggccctgtaatattaatgctgtcccagcatccgtcacattttccgtaagttcttctcacacactgttcagataccataagaggcacattcccatatactacaagttccgtgtcacttccaattacaggcttcatctccttatctgtaagttcaagcggcagtgtcattctgtcaagaataaccccggcattactgcacatccttcttaattcatcttttgcaaatgtattaaatatatatatgctgctgtccgtaataatatgcaccttgtcagataattttttccagttgtcacttccaagaaaaccaatctgctcaatattacggcatacaaacctgtctataccacaatcagaagctttctcacataagtacttaaacttatcatatttctctgccttaagaatatgtggaaggaacatatatacatatattccatgtgactgacagtgctttacagcctcttttaatgaattctcatcattcatataaaacatcttataatcaagataaatgctttcaacacctgaaactgatgctgctttctttacctgcgctatatcatgaaggtatgcagcttttcttacctgataattattatcatcagcttctttcttgtcgtcagtctctgcacattcaggcttattataagttcttacaagactgtgctttaaatgtgtctcaagctgttcaagtacatttcttcttaattccttaatccagccgacaggcacaaacacaccatcatcaagctgcacttctgcatcttccaccacaaaacatgtatcgccggttttctttaaattcttaaccagttcctcctctgaggccggacggctctgtgcttcggtaactatctctcctgtacatgtcttttcaattccatcatacattactgtaagtgatatattttcattctttcttacactaagcttcatatctacatgaagcttaggtgttgttccgacataattatccgctacatatgccttaatcttagcattattcattctgttgacaattcttccctcatacagcgggtatttcttaggaagattgacaacgaaggtctgtcctgctgccacatcagctccgctctcaaatgaatgttccttatcaatctcaaagacatcacctctgtttacattctttaatgctttaaatgtaattcttcctgccttgttagatactaccttaaggcactccgttcccatatggttaggacgccccagtgacatcatcttctttcccttgacgctgtcataatagcctgtagtaaatgcacctctgttatatatatctgaaaggtcatcaatatcctgcttatctaccttgaagccttttcgtcctctctcaagatacatatcaacatatttacggtaaatatgcgttaccatagccgcatatgtgacattcttcatacggccttcaattttcagagaatacactccactttctataacatcaggaagtatctgtaatgcacacatatccttagggcttaatgcgtaactgttgtttctgttattaatcttttcgccgttatcatacacatcataaggcatcctgcacggctgggcacaccttcccctgttgccgcttcttcctccgttaaagcttgaaagcaggcattgtcccgaataacagtaacataatgctccatgcacaaagctttctatctccacatctaatctctcatgaagctgctttatttcctgcagattcatctctcttgaagtgactattcttgttgcaccaagttcctttaaaagcctgctgccatacactccggtctgtgtcatctgtgtgcttgcatgtatatccatatcaggaaaatgttttcttataaggttaagcacacccatatcctgtacaatcactgcatcaagacctgtctcatagaatggtataagatattctataagactgttctctatctctcttgacttaagaagagtattaactgtcaggtaaacctttctaccgaataaatgtgcatattcaatagcacagataagctcttcatcattaaaattattggcaaatgcccttgctccaaacatattgcctcccaggtatattgcatctgcccctgccgccacaacagctttcataatatcaagtgaacctgctggtgctaaaacctccacctgtgtttttctcttatcaacattcatagttgtaaccgcctttaaattaaatggctgctgcaaatgcatttgcaacagccgttattattaataccagataatcttatgtaaatcacttcttagagtcattcagttctgtctctaacttgacaatattcttctgatacttgttaatctcactctttaattccttaatctcttttgctgaactttctgccttaatctgtgctgcaataagctcatgcttaaggtcatatatttccttatccttgttctcaatatctaatgaaatactgtctgccatcttcttagccttgaagtaatcatctgcaatattaagatacatcatatcagttctgagctctgctgacattcgtctgtaactctcttctttattaaattcagttatcttgttattaatgtatgatgcaactctctgaagatactcctcgctttcatatccaccaagcttgattaccttacctccaagaattacttctgctgtattctttgatgacataagtcccctccatatatgtagaaataaacatattaagtatataataaatacacttactattcaactcataaaacacattctttagaatattttatgttatttttgtttaaatggcctgccaagattatcataagctgctttagttgcaactcttcctcttggagttctgttaatatacccgttctgtataagatatggctcataaacatcttcaagagttcctgaatcctcgcctattgaagctgccagtgtctcaataccgacaggtccgccatcaaacttatcaactattgtagtaagtataacacgatcgttacggtccaatccatctctgtcaacatctaacagattaagtgcataatcagcaacatccttattgatatgtccgttatatttaacctgtgcaaaatcccttactcttttcaaaagtctgttggcaagtctcggtgttccccttgaccttcttgcaagctcatgtgctccgtctgagtcaatatcaacattaagcacattggctgaacggataatgattttctcaagctccggaactgtatagaattccatatggcttacaacaccgaatctgtctcttaaaggtgctgataaaagtcccgctcttgttgttgcacctatcagagtgaactgtggcagatcaagtcttatagaccttgctgttgcaccctttccgatcataatatcaatcttataatcctccattgccggatacagcacttcttcaacctgtctgttaagtctgtgaatctcatcaacaaagagaatatcaccctcactcaagttgttaagtatagctgccatatctcccggcttctcgattgcaggaccggatgtaaccttgatattaacccccatttcattagcaataattcctgccagagttgtctttccaagtcccggaggtccatagaaaagcacatggtcaagtgcctctcctctttcctttgctgcctcaatatatactttaagattactcttaaccttattctgtccaacatagtcatcaagagataatggtcttaaggaattctcaataccataatcttcttcagttatctgtgttgatataatcctcttttccatatagcccctcatttctcaaatactattctgctctagaatttagccagcttctttaacgcttccttaagaaccgtctcagaatccttattctctatatcttccacttccttgacagcaacaagtgcatctttgcttgaatatccaagtgatacaagtgcctcaacagcgtcatttcttatcatcatgacattacttacattactgttattgtctgcctttttattcttagaaagtgctgattcaaatacttcatcaagctttaacttatccttaagctcaattataatcttctgtgctgtcttaggtccgataccaggaagtgccttgattgctgccacatcatcagcaagaactgcaaatcttaaatcatctgctgtgatattagataatgcaccaagcgctgccttagggccaataccattgacacagataagcattttaaacatgcttaaatcatctcttgtaaggaatccgaacagactgcattcatcttccttgacattcatatatgtatatatcttaacctcactgccaactgatggaagctcaccaagaactgaacccggaacatatatattatatccgattccattggcttccacaacgattacatctggcaggatttcggcaagctcacctttaatgtatgaaatcattctctacccccaagacagtaattgataaactgctgtgctgttcttcctgatattccaccatgtgaaagttcccacttgttagcctctgccataagctcttcatctgtcatcttaacattattcttccttgcaaggccaataacaatatcaaagaattctttctgtgatggcttagagtagcttatctggcatccaaatctgttcactaatgaaagcttctcctcaatagtatcagatctgtgaagaccgttattgctttccatatcatttctgtcattccatgtttccttgataagatgtcttctgttagatgttgcatagataagaatattatcaggcttagtctcaacaccgccttcaattacagcctttaagaacttgtattcaatctcgaattcctcgaaagataaatcatccatatatattatgaacttgtaatttctgttcttaatgcttgctataacattagataaatccttgaactgatgtttgtatatctctatcattctaagaccctggtcataatattcattgacaatagccttgatagaagttgacttacctgttccgctgtcaccaaaaagaagcgcattattagcttttcttccctgaacaaaggcctctgtattctcaacaagcttcttcttctggatttcataacctataaggtcatctaacataaccttatccatattgttaattggtgtaaatgtaacgccattatcaccgcctattactctgaatgctttattaagtccgaacattcctacaccatatgctttatagaaatcagtaacataattaaagaactcattctcgtcctttgctgtctcaagcttaaggcttaaagcctgtaccttctcacttacattcttattgtacataagctctttcttaacaattgccttgtaatcagatataagtgaaaaacagttaattccaagtgcagcctcaataggtctgaaatcataattaaacagattcataaacaccttgaagtcgtttttagcaaattcattaacacttccatcattagcacctaccttttcacatgtaaggctgaatggattctcattagttataagatagaatgtaaggtaattatgccataaattcttatcaaagccataatctgtggcaacctccaatattctcttaatctgctcatatatatcacttataagcttgtcaggagtctcctcatccctatcaaattttttgaaaatatcggacattttcataagaatagtgtcctcatgattaccatatataataagtttcgcaacttctctgtacattattactccctcttctttctcttattaattacaagctgcatggcaaagatggccacacctgcaagtgacaccaacgctccctctttaagaagcggcgtagaatacttaagtgttacattatgcgttccactcgtaagatatacagccatatactgaccattagcattatatagcttttgtctttctccgtctacatataccttccagccctttgaataagggattgtaagacacagatatttattacggtcaagtgttatctgacctgtaaccttattatttccaagctctacgtctgttaatacattttctttaagtgcattaatctcgtcagtgtaaccatccatcggctggcatacaatctgtatatcatcataagaatacacaccaatcttctggaaagtcactgtaactgatgtcacattttcttccgaatagcccatattcacactgaaatcatgctggttactataatagctgtaatcagatgtgaagtaattcattgacttggttactcctgtatcagtcgtaattccaagcttaacactgcttgtagactgtgtccaatatatgaaattcttaaatatcttcttcttttcattatgtgaaagctctttccagtctgccttagagtataagtctaatgggtcgaacttcctctttccaaaatacaactggaactgtgctgcaccttcataatcaagaccattaatattaaagtaagtctcgcctgcgccactgcctgtaaagttaaatgttactctggcacctgccttagttactgcaaatgtattatccgtacactgtacttctttggcatcataatccattgtataatctttaatctggctgtcataacttaaatctttaacagataccctgtcaggaagcgcctccctcgtatatttcccacttctgtcaataacaacagcctgaagcatagccttctgcttatctactgcacttaagccttcccattccctcttattaacagctttgtcataggtaaagcctaatggaagttcattgtcgttattatacattacataatcatcattttctgattcataagtaaatccatatggaacaagtccgccggtcttacttaccagatactttgaggcagatgacaatgttataagagatgacctgtcatcatagcctgtgtatttgtgcggaagcagcgtatcaagcctgattgcacaatcatatctgaacttcgatacatacggattagtaagtgtccagtacagattagaggacgatattccagtaatgcaattcatattgtatgaaagtcccgagcctgaatatctgataaaatctgtatcttcagcatctttacttataagctccttctcgcttccaaacacatcttcctgtgccattttaacgcttatgcactgtgccgcataattttccccaaatgaagcatttttccatataccattagctaatgccgccagcataaccgctactgtcaccatcatgcatctgttatattcattaacattctttatgctaagtccaattagcaatattactccaattgcaactgcacttataagcttgccatttcttgaatactttacgcacatacataccacaaaatatattgtaagtgcaattccaataaagcggatttcttttctttccagtgttataagacgcggcatcatgcacacaagtatatatgcacataataatgcaaatgaatatatccacctgttacacatatatgaaaatccgttcattgcctgtccgaagaacggtatacatatcatcacagcacttataataaaataagtcttaagcattgtgtacttacgtctgctcttaaacattaaaagcactgcaagtaacaccggcactgcaaatcccatgcatgtccagaagttatcaccctcaacgataaaaagtcccggaagctttgcatagtatgaaaaaggatataccagtcccattttgttaggtgtattaaatctgctgtcacttaagaaaacgtgaagcacagggagaaacactattgccgccatacacagtcctgtaaccgatgaaactgcaagtcttaatattcctttgccccacatttttacattctttccataacagaatatgaatcttacaataacatatataattgttgtgaacacaagcatgtagaagaaataaaaattactcattgcagcaacagctactgttattgtaaagagccacattttcttctctctgattatcttctcaacacccaatataagcagcggataatacagaagcgggttaagaaagaacggatgtcttaccgcattgtatattgcccagtagcagaatgcataagctactgctcctggaaggacatatcttttcttatgtcctgtataaaaacacagcattgaaaatgctatacctgacagatatattcttaaaagaatcattgcttcatagaatatatacatgtattttgctggaaagagaaagcagaaaaatgtaaatgggtcgcctatcacataatagtgaaatgttcctataacatcactcccctcacctattgcaaaatcccactgtggtattacaaactgatgattgataaatatatttttaaagaaatcccttaaatactgtgaataatatatgagtgacttataatgctgttcccagccatcaacctcccatatgaatgtctttctagtgaaaaaataaaaagaaaacacacctatggcaaggattgcaaaaataactgaataagccagaaaatatgttgattttctggaatcaagtcttttataaaaatcttgtaacttcgatttcatctctgccataggtgtatcttctcttttcttaaactaggaaactgccataagcataagcctacggcagtttcttattataacttattgtgattaaattatcaatgaagatgtattatcttcttagggcacttctcagcacactttccacaacctgtacactttgaataatcaatatgtgcaatgttgttttctactgtaatagcaccaaactcacactgctttgtacataacatacatccgatacatccaacagagcatactgacataacatctttacccttatcattagatgaacagttaactgtatagttactcttgtatggtatgatttcaataaggtgtcttggacatacagcaacacatttaccacatgctttacatttgcccttatctactacagcaataccattaacaatatgaattgcatcaaaaggacatgccttaacacatgaaccatatcccatacatccgtatgtacatgccttagaaccgccgttaggaacgacgttcattgctgtacaatccattgcacctgagtacacataattttcttttgctttgtcgcagtcaccagcacatttaacaaatgctgtcattcttactgattctccaacttcctcacccatgattgcaccaatctttgatgcaaccggtgcgccaccaactggacatgcgttagctggagcttctcctgcggcaattgccttagcaagtgcatcacatcctgcatatccacaaccaccacagttgtttccaggaagctctgctcttacatctatctctttctgatctacttcaacatagaacttcttacccattactccgaggaaaagtccgagaagaagaccagtgcagcttacaacaactgcagcaataattatacctgacatcttgtcgtcctcctcttaaataatacctgaaaatccaaagaatgcgatagccataagtcctgcagtaagtaatacaataggcattcccttaaagctttccggaacatcattgaattcgtttctttcacgtataccagccatgattatgattgctattgtaaaaccaacagctgttcctaatccactgactacagaatctaaaagcttctgaccaatattaagtcctgctgctgtgttatagttctgtacgttagtaagtgcaataccaagtactgcacagttagttgtaataagtggaaggtatacaccaagtgcttcataaagagatggtgatgtcttctttaaaaacatttcaacaaactgaacaagtgccgcaattacaaggatgaatacaattgtattcagatatgtaagcttaagcggtgtaagtatacagtcatatataagactgcagacagctgatgaaatagtgataacgccgataacagcgccacccattcctgctgctgtgtttatcttcttagaaactccaaggaaaggacacaaaccgaggaactggcttaaaactacattattgacaattgctgtacttacagctatcaataataactgtgaaaaatatcccatatttacctcccttagttattcttagcctcagccttagcttcttctatctcttctgtgtagtcaggaacttctgcaggcttcatgcctttatttctcttaattctgttcataatagcaatcatgaatgcaagaacaaaaaatgctcctggtgcaaggataaagatacttgctggtgtgtaaccgattgttgagagatcaaataatgcgttagtaccatctgagaaaattgtaccaccaccgataagctctcttattgctccaaggattgtgatagcaattgtgaatccaagtcccatacctattccatcaaagaatgaaggaattggaggattcttagaagcataggcttccgcacgtccaaggataatacagttaacaactataagaggaatatatattccaagtgagtcgtacagacttggcaggaagccctgcataaggaactgtaccattgtaacaaatgatgcaacgacaacgatgaacgctggcattcttacaccatctggaatagccttacgaagtaatgaaatcataaggtttgataatgcaagtactactgtagaagaaagtcccatacctataccattgattgctgatgtagtaaccgcaagtgtaggacacataccaagtgtaagtaccagggtaggattctctttaataataccattataaagtctttctatacatttattcaaagtccgcacctccctagtttcctgccacaagcttgtaaactgcaagcgcataatttacaccctttgtgactgatttagaagtaattgtagaaccaccgattgcatcaacattagcattgctttctgatgctgaaccatctgttactactgaaaatgatgcaactgcatcagacttagctgtaaactgtgatgtaaatgatggatcctgtttagctctcataccaagaccggcagtttcgctgattgaaaggaatgatacaccaagtacctttccatctgttgaaataccaactgtaaacttgatatctccgccgtaaccgtcactatctgtaactgttacaacataacctgctgtctcgctgcctttctttcctatagcaacttcattgaccttatccttagagaaatcaatgtctgatgaagcattaatatcatcatcagaaggaagggcatctattgtctcaaagctgtctgcttctgcaagaactgctttgtaagccttttccttagcattctcattagcctttgcaataggatcaagtgttatctgatatacaacaccaagaagaattccggctacaagtgttatagcaaataaaactaatgcatctttaactattttcttcatcttatgcagcctcctttgctttcttctctggcttcttcttaccaaatgacttaggaactgttactctctcaataagaggaactaagaggttacagaagataattgcatatgaaacgccttctgctgaaccaccatacattctgaaaatgaatgtaagaagacctaagcagcagccaaatacaattttaccattaggtgtaattggtgaagttacataatctgtcgccatgaagatggcaccaagtaaaagtccaccaccacatacttcctcaagcatgtagattacatcgaaatgatgtcctggtgcaaaaaggaatataagcactgcaaatacacctacatatgttacaggtattctccagttaataacctttcttgcaaggagatagataccacctaaaagaaggcagattgctgaagtctcaccgataacaccacctgttgtaccaataaacatctttgctaatgaaacaacgcctgttgattctgctcccggcttaaggagtgcaagaggtgtcgctcctgaatatgcatctaaaaatccgttagatgtaacaaaattagtcatcgggcctgtatatgcaataagaaggaaacatcttgctgcaagagcagggttcatgaagttctgtccaagtcctccaaaaagctgcttaactacgataattgcaaatacacatcctacgatttcaaaaccaacatttaatgttgatggaatatttaatgcaataagaagacctgttactgctgcacttaaatctgtaacagtaactttcttatgcatgaaatactgatataatgcctcacatgctacacaagtaacaataccgattactatacgaagcagtgcatcgaggccaaaattaactataccaaatatgctggcaggagttaaagcaataagaacatctctcattattgtctgagtagtattcccgcttcgcacatgaggattagtcgatacattaaaaatctcactcactttgattgcccacctttctacttctttcttctgttagcaagtactgtacttctcatagccttaatctgctgtgttaatggtctcttggctggacagacatatgaacagcttccgcacattacacattccataccatcgaacttagtaaagccttcttcatcattacgtgatgcaaaaccggcaagctttgctggaagaaggtgttccggacatgcctcaccacatttaccacatcttatacatgcagaagactctatcttagatacgatatcattctggaatacaagaagtgatgaacttcccttaacaacaggtacatcaagactgtacatggcaaatcccatcataggaccaccggaaatatatttctctggttctcctacaggaccaccggcagcatcaagaagctgtctgtaattagttcctaaccatacatagaagttgccaggctctttaactccgtcacctgttacagtacatattctcttagtaagaggcttaccttctataactgaaagatagattgagaatattgtatcaacattatgtacgatacagcctgcatcagctggaagcatgcttgaattaatagctcttcctgttgttgcatatataagactacgctctcctccctgtggatacttagtctttaatggcttaacttcaatatcaggctcagaagctgtagcttcctgcatgattcttattgcctcaggcttattatcttcaataccgataattcccttagcatggtcaaatatcttaagagcaatcttaagacccataacaaccttgtctgattcttctaataatcttctgtaatcagatgtaaggtaaggctcacactctgctccattaacgataatgtaatctatggcttcaggattctttggagagagcttaacattagttgggaaaccagctcctcccatacctacaacaccagcagccttgattctttctaagataacgtccttagtaagatcctcgaacttcataggtgtatattcaacttctttgaattcgccatcattctcgataatgatagaattgcacttaccgcctgtagccaatgttcttggctcaatagctttaacagtacctgatacagatgaatgaatgttcgcagaaacaaatccacctgcctcggctatcagctggcctgcaaggacatagtcgcccttggcaacaactggcttagcaggtgcgccgatgtgctgtgaaagcgggaacaccatctctcctacggctggaaagagttctttgattggtttatccttagaaaactctttaccgtcataaggatgacatccacctttaaatgtacactttcccatgacatatttctccttataaagtttttattaaatagtattttatctcaataaatagcaaaaatctacttttttttgtgtatatattcctatataataagagaaaatgagtacttttttaacaatcggtttgcctaatcaaacctaaaaacgaggattttttatgataactattaatgataccctgcacacaaatgcagacaccgcaatgcttaaagcaatatgcccggatactgacagcatctgcttttttgatatagaaaccacaggattttcaagaaattataacatagtatatctcataggcgctgtatatttccgtaacggaataacacattatttacagtggcttgcagaatccgattccgatgaagcttatattttatctgcatttaatgattttttaaaagattttcatacattaatacattttaatggggatgccttcgatattccctttattactgagcgtgcagcacatcttaatgttgcacttgacctttcgcatcttgaaagccttgacttatataaaactgcaagaaaatgtaaatctattctgtcactttctgactataagcagaaaactattgaacattttcttggaatagaacgtgaagatatgtattcaggcggtgaacttattgatatatacaggaaatttgcagcaaaaccttctgatacagcacataacgaatacaggaagcttctccttcttcacaaccatgacgatatagaaggaatgctaagcctgcttccacttgtttcctattatgcaataattatgaattcttacactgttgacaatactgtcattgataaagatgctgattccgatggaaatgtgagccttcggctgattgctgaatgttctctgcccgtaggcgtacccgtggacaggcatatatgtcttgacaatatacatattctgattaagaaccgtacattaactcttgtaatcccggttatatcagatactttgaaatacttttttaaagactataagaattattattatctgacatcagaagacgaagccattcacaaaagcattgcacaatatgtagacagtaataaccgtgttaaatgctctgcttctaactgttacaccaaaaagacgggcatctttcttccactctatgacaattgtgatttaaacatatttaaaaaagattattctgacccggaaaaatactgcagcgcagatgatatactgttaaaaagcactgacaatacagaaaaatatatacattccgttataaatcatatattttcataattaaaaatgcgtaaccagactgatattattccggttacgcattttattaattagtctttctgtagaagaaaagatggtcatagctgtatcccatatccttataaccgattatctgttcagtattacctacaaacaggcatccatcagtaactaaagatttattaaacttctcatatacatctttcttggcttcttccgtaaaatatataagaacattcctgcacacaataagatgacagcctgttggatatggatcctttagaagattactcttcttaaactcaacacatctttttatatcatcagatattttataaaacctgtcgcccatcttttcaaagtacttatcctggaattccttaggaagtccctttatgctgttttcaccataaacaccatctttagccttctcaagaacctgttcatcaagatctgtcgcaataatcttaatatccctcataggtactttctttgcaagcaccatagcaagtgaatatggttcatcaccagtagaacatgccgcactccataccttaagtcttggtccgaacttacttatcagatccggcagtataacatcctccagtgtcttccacagattcggatttctataaaattcagatacattaatcgtaatataattaacaaattcttctcttaaccctgtatcttcctttattgccttgcaataactatcgtaaccatcatacttatgtcttgcaataagtgtatctatacgcctcttcatctgtttttccttatatgcattaaggtcaatagttgtaagacttaggataaatttcttaaaatcctcataatctttaatcataattcctcttttctacatcgttccacgaaacaaatgttatgtaaattattcttaattctgttataattctatcatattttcaaaaaacctgaaaggattatttataaactaatggataatgaatcgcttttaaaaaataaaataatggacgcagccaatcgttccttccgccagaatatatatacttataccaatttcctggatatcaatgagcagtcagtattctcacagatgagaaacgcacttaatttcgtagcttttaaaacatacggtggcaatgatgcatgtgaaagacagatgatacagtttggttcttacgaaactcttggctatgaagaagaatttcctataactcttataaagatatctcctcttatagaaaaatatgctgaatcactgtcacacagagattaccttggtgctcttatgaatcttggaattaaaagagaaatgcttggagacataaatataaaaggcaaggacgcctatctttactgtgtttcacatattgctgatttcataattgacaacctgtctacagtaaagcatacacatatccagtgtacaaagactgatattaacgatatcgaatgttcacctgagcttgaagatattgaagttttatctgcaagtgaacggattgacgctgccgttgccagcctcacaaaactaagccgaagtcagacagtagaattattcagggcaagaaaaatattcattaacagccgtcagatggaaaacaacagctatcagttaaaagctaatgatatacttgtcatccgcggaacaggcaaattcatctatcaggggtgcggtagagaaacaaaaaaaggccgtatctatcttttattcaaaaaatatatttaaaaaaggggctgtttttctacagccccgaatttctatgtttttttatcttaaaatatatcaaatgaaacacaatacataacattccaaaaacaacaatggcaggaactccataaaacatatattccattccatttaaataaatgccatcacccctgtatttttgtttaataagcagtccattattaacaagtataaaaacaattactccagataccagaaatgctgcactataaccgccaaaccatgcaagaagctttttccggtccggcttgtatgcaatgtaattataaatataacagcagactaatattataggcacaatcatgtatataatcaaaccaataaaaaagcctttatctaataccgtttcatcaatataatctgaaatcagtaaaataatccagactaatacaccagcacataaaccattcacaattgacggcttgtttttcgaatacataacaatacctccgattaccagcatattaaatgaggcatctgcccactgatgtgaacaaatgcctcaacatagagcttttcacagcccttataatatctttattactcttctgttgctggagcttcttcctgagcttcgttgtcgttaagtaatgccttaatgcttaagctgatcttcttatcagcttcgttaaggtcaacaaccttagcttcaatttcctgaccgattgaaagtgcgtcagatggcttttcaatacgatctcttgaaatctgtgaaacatgaagtaatgcatcgatgccatcttctaactggacgaatgcaccgaaatctgtcattcttgcaactgttcccttaacaacattacctacagcatacttctctgctgcgttattccatggattaaggtctggatacttaactgaaagtgcaatcttatctccgttaatctctttgataaagcacttaactgaatcaccaatcttgtaaaccttcttaggattctctgttcttccccaagacatctctgagatgtgaagaagaccatctacaccgcctaagtcaatgaatgcaccgaaatctgtaacattcttaactgttccttcgattgtatcgccttccttaatcttagaaagaactgcctctgctgctgccttcttagctgcaacaataagctgcttgcaatcaccgataatctttctgttcttaggatcatattcagtgataacaaatgtaacttccttaccgttatatacagataaatccttaacaaatgtatctgaaataaggcttgcaggaataaatactcttgcttcatcaacgataacctcaagaccacccttgatgttcttagctacacctgtaattggctcctgattattaaatgcatcttcaagtttcttattgccattatctgcaacaagctttctatatgtaagagcaacctgtccctcaccatcgtttgatttaagaaccttagccttcatctcatctccaactgagactacagtagtaagatccacatcaggagctgatgtatactctgaacgagtaatgattccatcagatttgccacctatattaagtacaattctatctggcttaactgcaataactcttccgtctaccacctctcctgtacggatttccttccattcttcgttatctaacatctgtgcaaagctttcttctgacattagtataaacctcctcaatgatattgtttggggttgatgccccggctgtaatacctatgcagtctgatgattcaagcttatcaagctcaaggccgctaagagtctgaatgtaaaaggtttcctgacattccgtcttgcaaatttcatacagtttacgagtatttgaactactgctgtcccctataacaatcatagcatcagctcttcgagcaatccgtcttgcctcgttctgacgctcctcagttgcattacatatcgtattactaatgcaaatattgtactcttttttctttataatttcaactaaatcttgaaatttcttgtaattaaatgtcgtctgggatacaacacgcacatttttactcttgtcaagtttcaacttttcagctttttcaactgtatcaacaacatgtacaggtgtctctgaccaccccataatgccttcaacttcaggatgcttctcattgccaataattacaatctggtcaccttcagcacttgcatcctttacaatcttgtgaatctttaatacaaacggacatgttgcatccacaatctttgccccgctgttctttattgattcatatactgcctttgatactccatgtgatctgattataacagttgacttttcaggttctggaatctcagatatatcattaacagcctttacacccttgctctcaagttcattgacaacctcagtattatgaattatcggaccataagtatatacatttttcttgtctgcctcagcatacacagtatccattgccctctgaacaccaaaacagaagcctgctgactttgcaagtattacttctttcaattatctgcccgccttcttttcatctattatcttacttaaagcagctacaacctgttctatattcatatctgatgtatcaacaagcacagcatcatccgcctgttttaaaggagatattgctctgtgcatatcttcatagtctcttttttcaatatcttccttgatagcatcaaaactacagttttcacctttttccttaagttcatcatatcttctcttagctctcgcatcagaacttgcagtaagatatatctttgcaaatgcatctgggagtactgttgttcctatatctcttccatccatgataacatctgttttctttgcaagtcctctctgaagtgcaaccagcttagtccttactgctgcatacttagatgtctttgatgccatctttcctgtttcttctgttcttaaaagtgatgtcacattctcaccattaagtatcacctgctgtacgccgtcttcgtactcaatactaatatcaatattatctacagcaccattaattgcattctcatcatctggattaatgtcgttctgtgaaaaatatacagccattgccctgtacattgcacctgtatcaacatacacatatcctaactgctttgctaaaagctttgctattgtactttttcctgctcctgcaggtccatcgattgctattgcactcattttctctgctcctttaaataaattattgtatatgacttgcagcagcgtatgctgttgaccatgctacctgtaaattaaatcctccggtcactgcatcaacatctataacctctcctgcaaaatatatattcttgacaagctttgattccattgtcgaaggattaatctctttaacattaaccccaccctgtgtaattatcgcttcattaaaacctctcgtagaagttactgtcatgtcaaaactcttaagaagcttcacaagtctctgtctttcttcccttgtaacctcattaaccttcttttcaggcttaattccggactgcattacaatcacaggaataagcttcttaggaagcagctcatctaatgaattcttaaacgccttgttctgttcctttgagaaatcccttaatattctctcatcaagctgttcatcagtaattgcaggctttaagtctatgcttaatcttacaggtctttccttaactattccagtaataacgctgcttgcgcttaatattacaggaccgctcacaccaaaatgtgtaaaaagcatttctccaaaatcagtaaataccttcttatctccatcgtaaaatgtaacctctatattcttaaggcttagtcccataagaagttcttcccactcttctcttacattaagaggtacaagtgccggaagtattggtgtaacgctgtgtccaatactttttgcaaatctgtaaccatcccctgtagagcctgtggatgaatatgaattaccgcctgttgcaataacgcacgcatcacctttaatctccttctgtcctgatgcatcttttacaacaacacctgcaaattcgccattttcctcattcacagctacaacctgtgtattaagaagcacatttacaccaagttttttcatctgccttgaaagcgcacctataacatcagacgagtggtctgactccgggaataccctgttacctcgctcaatcttgaatttaagtcccagctcatcaaaaaatcccatacagtcatagttagaaaatcctcttaaactgctgtacatgaactttttattggtaactatgctgttaaatatatcttcttcatccccggcattggtaaaattacatctgccttttcctgtaataaaaagcttctttccaagcttttcattcttttcaataagtgtaaccttattattgtttctggcagcagttatcgcagccatcattcctgctgctccaccgccaattattataacattgctcattatcgctctctcttacttttcttcatcaatagctgtattatccatacattttcttaattcattgacaacattttcatctaacatattaatctcatcattgcctgaatactcgaaattatcaacaaatgtgttaatcttctcaatattctctactacctgttcactattcttaaggcatattgatactattaaagcattaataagactcattggtgcaacaagtgaatcaactattgacgccatatcacttcttgcaaacaggttacatgatgaatacatattcattggtgagtgtactgaatctgttatggcaataactctcgccttcctgttattggcaaattccattgctttaagcgttcgcattgaatatctgggaaagctgatacctattgcaacatcaccttcacctatgtacatcatctgttcaaataattcgttggtattgccagtctttaccacctgtacatttttcttgaccaacctaagataatacccaaagaattctgctagtggttcgcacgacctcgctccaattatatacacgctttctgcagccattatatcctcaacagccatatcaaacgatgctgtatcaaatgactttaatgtatgctctatctttcttgcatccattgacataacattattcacgaccatattggttgtcatttgtgaattaagtacatctattctgtcgaatgagtgaattttttcttgcaaaatgtcttctaacgctttctggaactccgggtaccctgaaaatcccaatgctgccggaaatctcactgccgtagactcacttactccaacaacttctcccagctttgccgcagtaaggaatgcacatttttcataattagccagaatatactctgctattcttttatgtcccttgctaagtcctgacattctcactcttatgagacttaatatatctgtatgttgttctaaatcattcattatctataaaaagctcttcaaaatatggcagttcttttacccagtcacagaaggtatgccactctgcaagcttatgaccctttctagaataatatattccaacaagattctcataattgagagtacatgttctcatctggttataactttcagggagaagctgtatcatgctgtaccataatgctttatccttagtctctacaaactgtgttctgattccttccagaaaatcaatattcttctgcatcatatcaagtgtggcatcagtcatatggtctgtactgaaatcagacatctcaaaaggcttgctgtgaatcttgtgcattgtacttgttgaattggcaactgttccaaccttatatgtatcgtattccttccaccaatatagtggtgctgttatatcgactgtaacaaatatctgtcttatgaactttctgtggtctgagcctgccttacataatctcttggcaaggtcaagatcattaggaccaaaaataaattttccttcctcatcaaagtaactgtccattcttgcccagctgttcaatggatttcttgcacctctgatggcattattcatattcatgacttcaaatcgttctaacttaatcacaatcgtgctccttttgcttaattatactgtttaattttacatgcaaaatgaatttatatcaagagaaacattctggattgcaggcttgctgcctgcaaaaaaagaccgccacatacgcttttgcgcacatgacggtctattatattaattattagactggataagccttattagctgtatctgcctttgtaggatcaacctttgtctgctgagcttctctatacttgaagaactctgtcgcaacctgtgggaataatgcatatgaaagcacatcctcatcctgctgcttgtactgctgtacaattggatcattcttgaatttctcaagctgtggttcaatcaagtcagctggacggcatgtaataggctttgtatcaccgatagccttcttctgaacttctggattgaatggcttgattgtctgaccaaattcaccagcaagaaccttcttagattccttagtaatcatcttgtatctctcaccctgtaatacattaagaacagcctgagtaccaacaatctgtgatgaaggagtaacaagaggtggttcaccataatctttacgaactcttgggatttcctctaatacatctctgtacttgtcctctgcaccagcttccttaagctgtgatacaaggttagaaagcattccacctggaacctgataaagtaatgtcttaatattaactccaagaaccttagtattcataagtccactctttaatgcttcctcacgcattggctggaagtaatcagctatctcagcaagaagattctggtcaagtcctgtatcatactgtgtacccttaaatgtctctaccataacctctgtagctggctgtgatgttcccattgagaatggtgacatagctgtatcaataatatcagcacctgcttctactgcttttaagtatgtcattgaagctacaccagatgtataatgtgtatgcatctgaataggaagagatgaaccatcctttaatgcctgtacaagctctgtagccttgtatggaagcaaaagtccagccatatccttgatacagatagaatctgcacccatgtcttcaattctcttagctgtctctttccagtaatcaagtgtataagcatcacctaatgtataagaaagagcaatctgagcatgtcctttttccttcttggcagccttaacagctgtctctaagtttcttaaatcattaaagcaatcgaaaatacggataatatcaataccgttagcaattgacttctgaacaaagtactcaactacatcatctgcgtaatgattgtaacctaatatattctgtcctctgaaaagcatctgaagcttagtattcttgaatccatctctaagcttacgaagtctttcccatggatcttccttaaggaatctgagtgaagcatcaaatgtagctcctccccagcactctactgaatgataaccaaccttatccatcttatctacgataggaagcatctgctctgttgtcattcttgtagctataagagactgatgtgcatcacgcaatactgtctcagtaatctttaaaggttttttaacctgttctgccataatatcctccttttacataacgccaaacatggccataaatgtaccggctgcaaccgctgtaccaataacaccggcaacgttaggtcccatagcatgcatcagaaggaagttagaaggatctgcctcagaaccaaccttctgcgaaactctggctgccataggaaccgcagatacacctgctgaaccaataagcggattaaccttaccatgtgtaacaagacacataatcttaccaaataacacacctgctgcagtaccaaatgcaaatgcaataagtcctaatgcaacaatctttaatgtatcaaagttaagaaatgcttctgcacttgttgtagcaccaactgatgttccaaggataataacaactatgtacataagtgcattagaagctgtctctgcaagctgcttaacaactccactttccttgaaaaggttacctaacatgagcataccaacaagtggtgctgttgtaggaagaataagtactactactacagtaactactatagggaaaagaatcttctcaagcttagaaacaggtcttaactgttccatcttaacttctctttccttcttagttgttaaaagcttcataattggtggctggataataggaaccagtgacatatatgaatatgctgctactgcaataggtcccatatatttagtctgaccaagcttacctgcaaggaatattgaagtaggaccatctgcaccaccaataattgatatagctgctgctgccttatctgggaatcccataagaatagccataagatatgctgcaaagataccaaactgtgctgctgcaccaagcaggaaacttgccgggttagcaatcaatgggccaaaatcagtcatagcaccaacacctaagaaaataagtgatggtaaaatactccattcatcaagtaaatagaaataatgtaacaaaccacctacaccgttacttgaatcctctattgctaacataatgtcaggataaaggtttacaagaagcataccaaaagaaataggtactaagagcagaggttcatatccttttttaattgcaagataaaggaaaacaaacgcaaccagaaccataaggtaattaccccatgtaagtccgaagaatgcactctggtgaacgaggtttcctaaagttgttataatataactcatcttatacctccgtaagtcactttatatcagtatcataattaatttaatgaaactaataccttacctgactctacagaatcaccagctgcacactcaacagttgcaattgtgccatcctgaggagcacagatttcattctccatcttcatagcttcaaggacaaccaatacatcgcccttctttacagcagcacctgctgttgcattaaccttaagaatctttcctggcattggagcgttaactttaactgctccctgagcacctgctggtgctgctgccttagctgcagcctttggagctactttaggagcggctgccttagctgctggagctgcactgcctgttccttcttctacagtaacatcatatacgttaccattaactgtaattgtatagttcttcatgattatttcctcctattattaacctttctaattgagcggacaacaagaccatccgtagatgttccttctgatgctgcaattgctgcagtaataactgcaataagttcaagatcgtcctcaacattttcttcttcattagaaacaatctgtgctatagcattatcaacaccaacagaagctgtgtcttctttctgttctttctttctgttctcatatacgcttatatacttgaacagagaaataatgaatgaaatgaatataagaactacaaatacagttcccataccaataagtgtattcattccggccttacccatcttctcacctgttgtgtatgatggattaatagctccactttcaagtgtgtaatctgtattgattacgaattcgaatgtacatactctcttttcgaatttaagtttaactgaaatagtacataattcacttgtttcatcactgacctttacattaatgttgttgacatcaacagactctttgagttcaccaagttcatctttagtgctgttccagctattgtataatcctattgttttaacattcattccctgctggttaacaatatacatcttactgttaacatcattaagggttattcctgcttctgcatctgcaataagagcatctgttcctgcttcaccctgattgctgtcaaggtaaagaatcatatcctttgcccagtccttgaggtaattctcaacataagcaacctcgttatctttaacggattctttagctgtattagtatcaatctgtgcattaccacaagctgtcatactgaatacgcaggctaacatgcagaataacaataagaatcttttcaaattagtcttcttcatattgtcacctcttaattaaactgttccatgcttcttatcaggacgaacctctctctttgaaaataacatttcaaatgcagcggctacatactgtcttgtattctccgggtcaataacagcatcaacatatcctcttgctgctgctgactcaacacttgactgtaacttagcatattcagctgctttctctgaaacagttgctgccacatcagaagcggctgctatctcatcagcatacataatctttgctgcaagctgtgaatccatcattccgatagaagctgttggccatgcgtagacaaggtctgcacctaaagacttagagttcatagaaacatatgcgcttccataagcctcacctgtaataacattaaccttaggtacatctgcgttagcaaatgcatatgtaagcttggcacttgcaattgcaattcccttctcagctgccactgtagcttcgaatcccttaacattagtaagtgtaagtacaggaatttcaaatgcattacagaaattaacaaaattctctgccttgtaagcgcccttaactgtaagaaccggttcaaacttctcagccacttcgccctcttcatcataaagagctgttctgttagctacagcaccaatagtaattccatctacctgaataaatcctgtaaccatttctttagcatatgaagccttaacttcaacaaatacattatcatcagcaatatctgaaagagctaatgcaggatcagcaatctctgctgccatatccgggcatgctctgttaagatcatctgttgttgcagaaactgcagcatcctcttcgttgttagcaggaagcatagaaactaactgtcttacaccattagcaatagtctcctcatctcctgtaaaatcaacaactcctgcttctgcctggaacttagctgacgctgtgtcaagctttgattcattattgccatctaatgcattagggctgttaacaaaaagcttagccttgctatcttccataaatgtaaaatcagataatgaagaaagaattgcaagtccaccgccacagttaccgtaaactgctgtaatctgtggaataacacctgatgcaatagacatcttcttataaattgtaccgaaaccttcaagagcatctgttgcttcctgaagtcttaaacctgcgcagtcaataagacctatcacaggagctcccatcttcatagcataatcataaagtgctgaaatcttcttagcatgcatctcaccgatagaaccattaagaacagttgcatcctggctgtatacatacacaagattaccattaataactccgtatcctgtaataacaccatcggatggagccttcttttcctgaatgttaaaatctgtagatctggcagtcacaccagcaccgatttcaacaaagctgctatcatcaagtattgcttcaatccttgataatgcctgtgttgtattactcattacgagacctcccttgttttttacgttgctattgcgcaactctttgttaattttattacaatctgccaataattacaagtatttttagtcctttgtttcaaatacaatcacaagtcctttttttatatttataaccgccacattttctttaatttcattactctggcatatgcttaaaccctgatgaagtatataatcatcaagcacatatttaaaccctgcaagacttataattgtttcttcagatagtggaacaaatgatacataatcaccatactgtcctgttttggacactttcacttctcccatcttgtcatttataagatatattttattgtgactgtcacatataaaacatggtacgtcactgtcaagtgcagccttcatattgcatatattggtaaatgtgtgatccatccttgtacctgtcgccccaagtatatatattactgacgctccggctttcaatgcatttataatagcaatatgcgtatctgtataatccttttctttaggataagtcttaatatctatacttttatacttatcaagcagtccatcttctactgagtcataatcccccagtatcatatccggcacaagtccgagttcatcaatatatttaagaccactgtcagctgcaattatgtattcagcatttattgtcctgacaaaatcctttgcccagcttatatcaagacttccccctgtcactataagtgttttcatatcaatctccttaatcttattaatctgtaatatctttctttcgtattttaccacattaatccagatgttctttattttttcacaattatattttataatatctgaacaataaaggacttatggttaagttctataacaaggaggaatattatgtctgaaaacgcaactgacataactaatgacaacattcaggataataacgggaatgactctcttcttacaggtggaagcctgtatgaaagcagcactgacaagtacaaggataacttatcttctgccatcacattctttgtatgtggaggaatcggaatcattcttatgattcttaatgatatcggtatcattaagatagtaactaaagatgcaccttcattcctttttattaatattgttcttggtctgttatttatcggattcattgcaatcggtgtctggtctttgaaatactctaacaaaattaaagccaaggctgaaactgaggataagaaagccgccgatgtacttaactggctggaagacaacataactaaagaagatattgagaattcttacactggagatattcaggaagaaatgaaatattttaaccgtacagcttatgttaaagaacagttaaccgtacaatttactgaactctcagatgaagaagccgagaatttttcagaacagttcgttgaaaaaatgtttaattaattcttataatcaataaaacccgctgtgtaattaacagacacagcgggtttactatattctgattagttgttagaaaggaattcatcaattcccttagctccagcttttcctgctcccatggcaagaataactgtagctgcacctgtaacagcatctccaccggcatatacaccttccttagatgttttaccagtttcttcttctgctacgatacattttctcttgttgatgtcaagtcccttagttgttgaagatataagtgggttaggtgaagtaccaagtgacatgataactgcatctaattccataacaaactctgaaccaggaatctctacaggctttcttcttcctgaagcatcaggttcaccaagttccatcttaatacacttcatacctgtaacattacccttgtcatctgtaagaatctctgtcggattagtaagaaggtcaaatataattccttcttccttagcgtgatgtacttcctcagctcttgctggaagctcctcctcacttcttctgtatacgatatgagtttctgctccaagtcttaatgctgttcttgcagcatccatagcaacattaccaccaccaacgatagcaaccttcttaaatcttgctattggagtatcatactcatccttgaaagctttcataagattacttcttgtaaggtactcattagctgagaatacttcgttagcattctcgcccggaatacccatgaatcttggaagacctgcaccagaacctatgaatactgcatcaaagccttcatcttcaagtaactggtcaattgtcattgacttaccaataacaacgttagtctcaatcttaacgcctaacttcttaacattctcaacttcgtgggcaactactgttgacttaggaagacggaattcaggaataccatatactaatacaccaccagcctcatgtaaagcctcgaatatagttacgtcatatcccatttttgcaaggtctccggcacatgtaagtcctgaaggacctgaaccgataacagcaactttcttgcctttcttctctgttggcttctctggctcaacattattctctcttgcccagtcagcaacaaatctttcaagcttaccaattgatactgattcacccttgattcctctaatacactgaccttcacactgtgtctcctgtggacatacacggccacatacagcaggaagtgcacttgacttaccaataatcttatatgcttcctcaatatttccttcttttacctgatgaataaatgctgggatatcgatagatacaggacagccctgaacacatcttgcattcttacagttaaggcatcttgttgcctcttccatagcttcttccttgttatatccaagacatacttcatcaaaattcttatttcttacgtcaggagcctgctctctgactggcactttcttcattacgtccattttgaaacccatcctttctaattacactgtccacaaccgccgtgatgtgtatcgccttcctgaagcttgagcattgctcttccctcttcagttctgtacatagcacttctcttcatagcctggtcaaagtctacaagatgaccgtcaaactcaggtccgtcaacacatgcaaacttaatctcatcgccaaccttaagacgacatgcaccacacataccagttccatcaaccataatcggattcatgctgacaattgtaggaattccaagttccttagtaagaagacaggcgaatttcatcataatcataggtccgattgctacacataaatcataatgttttccttctgcaacaaggtccttaagcacatctgtacccatgccctttcttacatagcttccatcatcagttgttatgtaaagattaccagcaacagccttcatctcttcctctaaaattataagttccttattcttagcaccaacgataacatcaacatctactccatgctcatgcatccatttaacctgtggatatacaggtgctgttccaagacctcctgcaatgaatacaatattcatcttcttgagttgttcaatatccttgctgataagctctgatggacatccaagaggtccaacaaaatcttcaaatgcatctcctgctttaagatgtgacatcttctcagtagacgctccaactatctgaacaactattgttatagttcctgcttctctgtcataatcacaaatagtaagtggaattctttcgcccaaatcatccatctttacaataacgaactggccaggttcacaatgtttagcaactctaggagcttcaacatccataaggaagatcttctctgctaacttctcagccttaagaattttatacattacaattctcctttcaaaaagtaatattatgaagtgcattacgcacaatcaacctttagtattctttggcagaataactgccttctgtacctgtcacagtatacaccttaccgcttgatgtatcaacgccatataatccagcagttgttgtagaaccaccctttattacatcatatctgataatatacatttcattgttgccaacctttgtctttgaaatatagacaaaattaacacctgaaccatctgaagctacgctgtctgacttaagcaccttctttgatataaggacatttttcagttggctttcagcctggctgtatgtatatgtattctttacttcaacattataatttctcttaactactgtactgctctgctcatgatcgttaattattacaaatgcgattacagtattaccggttggcatatcgaattcacctgtatactctgttgatgaagatgtaggagttgtaccatctgttgtataatatgccttacatttatcagggatattattaatcttaatcttctctccatctgaatattttcctgacgcaggagttacatctggtgctgcaggagcaccatattcaacaacatattcaaatccaactactttactatataccccaatagaattaacagaaactgcttttatcttagttgtgcctgtttctaacttaattgctgttccatcatatagtgtactcttaatatcaggttcttttccatcagttgtataataaacaacacaaccagaatcacatgtaaatttaagttcaacatcatcatcatacgaacccggctctttagaagctgatggttcttttacaatataattcttaactgcattgctgcattttccatcctgatactttcttataagctttgttaaattatctgcatcctctttcttataataaatatctgcaagagctttaaccgcatcttcataattctcatcatatgaaagtatatccttcagcacattaacagcttcatcctcatttcctgagctttcatagcatctatacaatgtatacttaagattcagattcttcttcccctcattttctttagaagccttgctaagatatgatgatgcatcaccataattaccctcttcgtacagtttcattcctgtctgataataataattataattattcttactcttcttgttaagtgatacagcaactataattattataattaaaactaatgcaactccagcagcaacccctgctataataagctttgtcttcttatccagtggtttcttagtggtgtctttcaaaatctctttatcttcatcttctggttcttcatcgtcatcatcatcaagtaaaatatctctatcagttaattcttcttgtgttggttgagatgatttattaattacctgctgttccttaagaatttcatctgttatcttaggaacaactctcgtccttccatcattaatatctgatggctgctctgctttataatcatcagcctttcctacataagctttggcaactgtagtttcttcttctaccattttctgcaacgacttttgaatttcgtcttctatgcttgtattcttattaaaatcgtctggcatatatagacctccatacacttaaataacattttgatattaacatattagagaatattaatcaataaaatacattttatgatttttatttttgtttaactaattgtacacattttgctcacatttatcatgtatattctatattagatagcaaagaaaattctttctatctccccctcatattttgaaaaaggagatgtttgaccgcatctcctttttttatccaaaaaattatgaccatcagtacaacactgatggtcataatttttttcattacctgaattatcttatgcttgtaactcttactgtgcagcttaatgtcttattattaacaacagctgttattgttgctattcctgcttttcgtccaataacttctcctgaagaagaaactgtacatacccttggattactgcttctccatgtaattttactatctgttcctattacatctaatgtatatctgtcatactgctcaagagtaatattagacctgcttattgcaagtgaatgaactatacagcttgattcaacacctgcaccatcacttatgacataaacctctgcttcaccaggacctacagttgtaataacaccattaccatcaaccgtaactattcctgtatctgatgagtaccattcatatgaatcattattaacagccggccttactattaccgataactgtcttgttctgcctgtaagcatatatatttcttttgaattaattctaagtgaggatatattaactcttggagttacataaacccagcagattcctttgatattattaccatcctgagatgttgctgtaatcttaactttaccggaactgattgcaaacacctcgccatcctcatcaaccactgcgattgattcattagctgatttccatacaacatctttaattgttgcattatccggatatacgttaacaccaagtttctgtgaatctccaacaaacaatctcaatgaatccggcacaacttctattcccgtaaccggattaacaactcttatgatacatgaatctgtaactccgcttccatctgctgctgtagctgtaataacagcattaccaactgattcagcactaagattaccttcctggtctactgaacatatactgttatctgatgatgaccacactatattcttattagttgctgtatctgtgccaaccgttgcaataagctttcctgttgcacccacattcatgaatttattattttcactcaatgtaatagttgaaacatattccttaacaacaattgtacaagctgctgtgagatgacactcatctgttgtaacttcaattacacagttaccaccctttaaggctgttacaacaccattttcatcaactgttgcaactgatgtatcacttgaaagatatgtgactttcttattctctgcatctatcggctcaattgaaggtataatagcatattttgctccaacccataattcctgataatcagaattaagtgttattcctgttacaggctgtgtaacagtaacaatacaatatgctgtaagtcccgtgtcaacattagtacatattatagatgttgttcctgcacctgtagctgtaactttaccatcgctttctactttacatacgttttcatcacggctttcccatgtaacaagcttattatctgcattctctggaagacatgtggcattaagccagaacacctgtccttttctcactgtaatgtctgtcgtattaaggacaattgatgtaacaggctgcttaacatatatattacacattgctgtaacaccaccatcaagtgacttacaaagtattgtcgcactacctgttccgacagcttcaaccagaccattagaatcaactatacatacattagtattagatgattcccaacttacagtcctgttcgtagccgttatagggagaacttctgctgtgattcttaatgtctgtcctattgacataatctcatctttataatccagtttaatagtctcaactggtatgcttataataaaattacatgttgcaataaatgcaccatcttctgttttacagacaattgtacagtatcctggcttaatatatgttacaagaccattctcatcaactgttgcaactgattcatctgaggatgaccatgtaacatttctgttcacaccgtctcctgatggctttacagttgctacaagctgatattttccaattgccatagtagactcaactgttgtcgcgttaagtgtaactcctgttactggctctcttacatagacatcacaggttgcaaccttaagtccgtcttcagttattactgtaatcgttgcattaccgccagataatcccttaatagtagctgtgtaactgtctcctgttaccgtagctaccgttgtatctgatgatgaccataaaacattgctgttagtaggtcctgccggattgaataacacctgtactgttccagtgcttcctctgtcaattgatattgaagaaggattaatacttacatctcctacaggagtggtaacatatattacacaagtctcagacttgataactccattaatattctgtgaaacagtaagatgtgtcacacccgacgcaacacctgttattgtaaatactgtaccatcatctgactggtttacctctataagatcatatgtaggaataactcctgcttcattagcctgattagttacagtatatgtaatctgtgatttacttggctgattagtaacaagagccttaatgtctattgaacttccaatattaactgttgtgcttactgtactaagtccaaaaccatctataactgtaatcttatatgccagctgatatggcatattatacacagtgtataattcatcctgtactcttgttgcatatattgtagctgtacccgcgccaactgccttaacaagaccagttgcagaatccacctgaagtaccttgttatcagaagttgaccatgttacttctgattcaattgctgatgttgacaactgaagttcatcaccaacattcatattgctcacttcatttcccatcttcttaaatggaactacaacattaacagcatctcttgtaaaccatgattcattgcctccaacatcaatagtagtaagtcctgcactcacctttgtaactcctgcatgtactccacatactgttccaactgcaactgatgctacatttgaattatctgtcttatatattacgttagacttaacaggattaactacattagaaggaatgtcctcatatgtaaatgcttcataatccttatctgaaagaaccatatatctgttagatgcatcgctaggaagatgtgttataaaatgtccctgtgaattagatatactctccttaaacttaacctctgcccttactgtaaatgtatatgtaagaggattaattccgcttccgtctgcagttcttgccgtaataacagttgaaccaccgccaataaccttaagtactactttagaagaatccctataatacatctctacgattccatctgaactaacctcacctgttgaatcattagatgtttcaataaaaagcttattactctcacaggtattggctgttatggtaattaaatctccttctttcagaagatctgcctcttcaagaacagtattacctcttttcctttcaacattaacattaataggaacatatactgctgctgttgatgtagcaagtacattatcatatacaacagctcctgtatctgaaaacttcttagaatgatatgctgctgttattgtagctgctcctgccctgttaccatatactgtaggattagttgttcctgatacagtctgcagataagcatctccgcctgaacttggattaacaaactttacaacatcataatcttcatccgatattgtccattcaagtcttacaggacttgcaataccattgttcgaaggattgctcgcgtcataaaattcatcatccgtacctgaaagattggcatgaataactgtagatgtagatccctgtattacacttgactgtgccggtgtcagagaaagagaaacacttgagtcagcgttagcaaatataagtactccaccgcatgccacaccagaaacaagaacacctataagaatcttccattgcattttaagacgcattgtcagctgtctgatttttttaacattcttcatatatataaccctcgctttgcataagtatatctgtgcttatattaaaatcaaataataactattatattatatcgaaacctttatttattaatattacatcttgtacatacttttttcaatatgcctgcatacaatatttttcgctaatgttgtcagctgctgttgcaatttatcatatttcttataaaacatataaaagtttgggtaaaatgatggaattaatcagattattatgttaaaatattgtagcaataaaatatttttggaggtatctaaaaaatgaaattaaatttaagaccagctgaagagtgtacttttgacgctgtatcattaggtgaagttatgcttcgtcttgatccaggtgaaggcagaatccgtacagcaagaagctttagagcatgggaaggtggcggagaatataacgttatccgtggtcttcacaagtgcttcggtatgagaactgctgttatcacatcatttgctgataacgaagtaggtcttcttatgaaggacttcatcgagcagggtggcgttgatacatcacttatctgctggaagaagacagatggtatcggacgtctttgcagaaacggtctcaacttcacagaaagaggatttggtatccgtggtgctaagggttgctctgatagagctaacacagctatttctcaggctactccagaagatttcgattttgattacatcttcaagaacaagagcgatggtggtttaggtgttcgttggttacatacaggcggtatctacgctgctctttctgagcaggcttgcgagactgttattgcagcttgtaaggcagctaagaagtacggtacaatcgtatcttacgatcttaactacagaccatctatgtgggaagctatcggcggtttagctaaggctcaggaagttaataaggaagttgctaagtatgttgacgttatgattggtaacgaagaagacttcacagcatgccttggtttcgaaatcgaaggtaacgatgagaaccttaagactcttaaccttgatggttataagaagatgattaacgaagctgctgctacataccctaacttcaaggctgttgctacaacacttcgtcaggttaagacagctacagttaatgactggtcagcaatctgctgggctgatggagaaatctacaaggctgctcagtatgatggacttgagatcatggatagagttggtggcggagattcattcgcttcaggtcttgtatatggtcttatgacatttgaagatgctgagaaggctgttaactacggtgcagctcacggtgcattagctatgacaactcctggtgatacaacaatggcttctcttaaggaagttgaaggtatcgttggtggtgctggcgcaagagttcagagataattaatttaattcatatttggattcagaccaaataaagagttgcccgggaaaccggacaactctttttcatttaataatatattaatcttccgcttcactatctgtaagagattgtaaacacaagtgtatctgaatatgaacccgcatatgctttatcccattcagacttatctattgaaagtgtcagattagtactgtttccactctctgcatatgtagctatactgaattctttgttaccatccataatcttatacgcaattgttttactctcatttttactgttcttaagttttccacttgcacttacagatacatttacagtcttgtctggctctaatcttgcattatcaagagaaacacttccaagcttaacagactgttctcctctttcaattgttgtatttgccggaatagtcactgtatagaccggatcaattgatacagatattgttgactgtcttatctgtgtttcttcagctcctacaggaataacacttcccaatataaacatcatactcaatgccatagctgtcaatttcctcataatagcctccattctttcatccattaatgactgtttatttattttgcaactaaaactgtctcaacattagcaccattcattgtctttccatctgtaagcgatgctgtgctaatcttaataacagcattatgttctcctgttgcaagcggatgctgcagttttacattagttatagcttttccaggttcaaccatatctgacttgtatatagtctcgcccgtatcagataaaacaatttcaaatgtaaagtagcatggatttccttcagggttaaacagattcattgtaacattatcttttcctgcatctacagttatagatggatatcctggtatccttattccctgctgtccgccactgtaattacttcctgtaccaatttcaccagaatcagaatcaatcgttggtgtaaatttatcatcattatctttattcttatcttttctgataacaagcactgcagccagaacagcaactgctacgcacagtactattattgctgttatcataattttgttttttgaaatcttcattccaatccctcctgacattccgtacagaccggttataaaaccagtctgtacgaattactaattaatcaaaccttacactgaccttaatattgctcaaatcatatttatcagaaaatgaaccacttgcatcaaatctgtagcatatagcatctatatctttgcatcctatgctgtatgtgtgcgtgattgtctgtttatttttcttcttgagatcaagcttctctccatgccatccattccatgacttgttagaatcttttctatatgtagtgtctacctctgcatatccgtcatctaccattttaatataataactgattgtaacagtcatcgtattgcaatgcttctttatctcattcagagatataccttccatatagatggaattagttcttgtataaccacttgttgaagttcctgatgctccatctatgaagaaatgcagcttgactggttcttcctttgaatcatcagttacacgatatgaatatgggtggctgtaagtaaatgtcttattaagactccagcttgcatataatgtaaccgttccttcacccgcaagattatcagcagaagctcccggtttatatgtaaccgttccgccatcttctacacaccagccaaggaatgtatatccatatcttgaagtctttggaagttcgtatttcttgtcatatgtaaatacaaggtcgtttattgcatctccatcctttgtatcaaaatgtactgtatactcattagcagtccaagctggatacaaggtaattatttcattatctgctgttccaagtccactgataatttcattatcatcatataacttgtctgctcctgccttttttgtccatcctgcaaatgtataacctgttctcttaaactgattagcacttaatgctgctttatctgtatacataagctgcatatcctgcatagaaccagttgttccgtcaccatatggaataaaccggataacataactgttttccttccagtttgctgtgtagcttctgttacctgtagaacctgttgtaattactggatccatagccgttccatctataccagttccgctccagcctgtaaatgtataacctgtacgctgtggtctcttaagagttataacgctagtatcaacctcatatgtttcaggattgtctgcctttcctccatcaagattataacttatagtatatacatctttcttccactgtgctgttataacaatattgccagcaggcattacatctggaacagctttatcccagcctgtgaatgtatatcccttctttaccggaatctcattaaaactaacctcagtattataattctgtgttatagaagcaatttcactgccaccatctgtattaaaactgattgtgtactggtttatcttccagcttgcagtataagtgacgtctctgtctggcattgtacctgcaacatcttcatcccagcctgtaaatgtataaccggttctttccggattaataatattaatcttagtgccatatttataatcgtattcaacatctggctgtccattattcagcttgagaacaaatctgtgtacatttctcttgtagaaatatcttataacagtcgaaccatctccttttacaatggcagtttctgtctctggtgaactgaatccttccatatgcttaacttctggcgttacctggctgtcagtatcagatgtaaatgcctgcctgtcatacaattcatatgaaccatcaagcttttcaacaagatgttcaacagtataattaaccttatctgcatcccactttgcatataaagtaatatcatatgccggcattgtaccgtcaaatgcttctgtacatgccctgtcaacataccagcctgcaaatgcatatcctgctcttacaggaaccggtgcaataacattgcttccccatctggctgttttcttttcgatacttacagttccacccatagaattaaatgatacgctgtatgaatttctatcataatgcacccggaatataagacttccgtctgccgcaacagtaccagatggcagatcatccgtaagatgataaagtctgctgtcatactgttccttatctgcagttacactctgtcctgttgttgctttattaattctggttttatcaagttcatattctcctgattcattttcaagataatattttgttgtgtatacaacatcatctgcttctttccatactgctgtataagttgtatcctttgcaggaactgtctgtgtaacagctggttcccagccttcaaatacatatcctgccctatatgcaaccggtgtcggcataagagttccatatgtatatcttccttctgaaacaacactgccttctgaaacaaatttaatattatatttatttcttgcataataataattaattgttgtgcttccatcagcacttactctctgtgataaagctgccggagtcataaatccgtttcttatgtcaggctttggtgatatctctgtatcagtcttagctgtctcctgctttgaagaagctgctgtatacacaccatccgttccttccacataatcaacaacattataagtcatatcagctgcttcccacttcgcatatacaattctgtcctcattaggcattactgacggaatagtatatttctttgtaagtgcttcatctgtataccagcctgcaaatgtatagccctgtttaacaggattttcaggctttgtaattactttattgtatttagatattatagcatctacaactgaaccgccgttagtctggaatgctatataatatccatctcttaaattatcccagtgcagagatatctttcttgttatcggcttagtattaaaagaacccttctgactcttccatgttattatcatctcaccatcctgctgaggttcactaccaggattaacctcaactatattagtttcaggatcatatgagaacgccggattagtcattgttatagaaaaatatctgtcactgtcatcataaaccttagtaaaatactcattattatcgtcaagaccttctttcatatcaagatactgcatttcaaaatatgtatccggaagtcttacagtcttaacatctctcttcatcttgatatctttaacagaatcctgaccatatgcataatcgcacacattttcaactacaccaacactatacaacggccattgcttctcaaaaagtgtaggattataactaaatgttcctgaaagtgcctgtgccaggaaattaacctccatatacacgcctatttccatgtatatagctcccattgagcttgctgttctgccctgcgaagctgcgtatttcaactgatagtacagatatccccatacctgggcgtatccaccaacctctgctgtaaatccaacacttgcaagttttgttgatataagacctacagccacgctcagtcttattcctgcccgtattcctattgttcctattgcatataccgagaactcatactgttcttcgcttaaatcaatcgaatcacttgtaacctttctgtcaaataccataatgctgtaaacatatctcttggcattcttataccagtaagtcatgcccattgatatattaacattggcagaaacaacgaattcaaccttaaactcgatatcaataattccaataacccttacatgtgactctgttaaagacttactgtataattcaacccagtcagcctcatcgtcaagcatatcagagtatctttcagccagactcttcgcaacagataactcactgtcatcatcggaatccttaatatcttcaagtcttgtagataaatccgacttgtcagatatatatgtagttccgatttccatcatattcttaagttcttctgctattctattaatcacttcgtcgagtttagaagaacttttgtcatcatcatcttcttcagcagttcttacattaacattaaaattaattccagtataatcatacagatctaatgaaaccgcaacacggtagtcatcaatatatgggaatatgccccatactttccatatagccttaccacttacattaatattaatcttaacttcctgctcaaatgttgctgatacaataaccttcatattagagaatgaaatctcaacgccaatatcaagagcaagtcttaatccacttacattctcaaaatgttttaaatcagttgaaagattagctcttacgtggtcaagctttacttccggtttcttgctgctatataatgcaacattgccctgagccttatcctgaagataagttatatcctgcggtacaatgctgatatcggcgtccatagtatcagacagatattcctgaagttcctgataagaattcgttcttacaacagcctgtgcaacctcatctacaacactctgtgcaaatccactgtcaacagcctgctgctcaacgctctgttcaatgccactgatatcctgattctgtaatatactttcaccactcacattatcagtctgatatacatccatggctgcctgaacttcatcccacgtcacattcttatatgtgattacataatcagcattattagttgaaacatttgttataacagcatactgtatatcatcatttccagttgcatacaaagcaagataatcgcctgtatcaactgttgtatcttcatcaagtccaagtcctgctccaagactgtcactgccatatgacattttattctttgtaattgttatactgtcattatcaggattattatccttatcatcagctacattaacaggaagcacatcaggaacaaagagtatctcctctgctgccatacccctgtaggaatattcattccccttagctgatgtaatctcaaagaacgaaacatcatcatcagatataacactgccatctaactgtggcacaacatctccgtcatatactgcaatcttgtctcctacattaagtgtactgtccgaatatgtaaagcttcctgtagttttaacagcttcctgactttatgtacttaatgtcatccctaagattcacattagttacatccggcttataaactgtaaaatcatattctcttattgtctggtcatagcctgtgaaatacagcctgtcatctgaaagttcaagacgatatccacagccttcctgccatgtgccattgcattttattataaatgtatacgctccatcatctaatacacttccggctgtaatatctattgaagtattctcagaagaatcgcttacattcttaactgatactttattctttatttcttctttagttagccttccgctcttatcagttaccgtaattgtaaaatcatttgcatcaacatcatagcttcttgcgtatgtatctatgctgactgtcttaagctcctgaccatcaacccatgatgcatataatacaacatcacttaaaagtctgtctgtacttgcaacataatctgtgcagtccgcatcataacaccatcccaaaaatgtcgagcctgccttgcctggaaccggaagatctgaaagctttgttcctgcctcatataccgaattatcaagctctgctgcacgcccctgttcatcatcatcagtataaagtgttccgccattagtttcatacttaatgttatattttgttgtttcaaatgaaatatcaaaagtaagattatctgtatatattcctgcatatttaggaatttcctgtaatcttgtcatatattttcttgtcttatcacttcctgttgctgtaagctctgttattactgaattattagtaagagacagtttattctcttcattatataattcatattccagctttacatctccattcagaagattccattcattcttagaataaacagatacacttactttatctttctcatacagtcctcctgcatgtcccgatactgtaagattcgtcttatcagcatctacgctttcaggtatgtcaatgtaataataacgttcaatccattttgcataaagaactacaactcctgtataattctcttctgaaatctccgttacaggactacctgtcagttctttattatcataccatcccccaaactcatacccctgattgacaatatcattcttatccggtaattgctctgccggatatttgtctggtgcattatagccactgacataatgaccaccgttaagctgataatcaatctcctttaactgggacagctcatcatatgatgactgattcccttctgcgtaatacatgcccggtatagctgcagcaagaattgcagaacataaaagtatactcaaaaacctcttcatccgaacgcctcctttatgttataaccacatatactgatatttagttttccgtcttctatatattgtagttataatacctgattaaaagacatttgtgaggttatctgcgtgaattacaagttttttgacatgaacgattagatttatatatggaaatttagtctcatgcaatatataattaatcaagagataatttacatactaagctataatgaggaaaatactatgaaaattgctatatgtgacgataatgaagctgaattaaacagaattagagaactgttagaaatatacgcctgtgataaaggtcagaaattctttataaaatgtttctcaagcagtgttgagctggcatcaactgctgaatttgagaaatatgacatatattttcttgatataattatgccagtaatggacggcattaatctggcaagagaaatccgtgcctttgacagattttcacctataatctttctgacatcatcacctgaatttgctgtagaaagctacacagtcaaagcatttaattatcttcttaaacccataattaaagaagctttatatgatacgctggatgatatccttgatacatttcataaagaacgcaatgatacatatattataaagaataattcaggtatacataaaatatacttatcagatattatgtacgctgaagctcttaaccggaaagtaatattatacctttcaaacaacgagcaggtaatgtcgacagacgtattctcatctatatgtgatacacttatgacacataaagaatttgcactgccacaccgttctttcattgttaatatgaattacatcaagacaatagatgcagtcaggattgaattaactaacagcaaaactatcccggttgcacaaagacgcgtttcggacataaagaaacaatatctggatttccagatggaagaataatctataatatacatttggaggagaatttaatgacagacatagtctcagtactaaaccttattaattatggttttgttttaatattcggaattattgtatctttctattttgccggaatacaatgggaggacaataagcgcctttttatacttactactgtattatttgttctgtttcaggcattattctacgtgcttttaggcgaaaatgtcctttttaaatgttatcctgtactgatacatattcctttaattcttattatcagatatatatgtcaccagaatatatatatatcatttattgccgttatgtccgcttatctgatgtgtacacccagaaaatggtttggaactctggcaaaatatatatttcctgaaatccctataatttcagatgttgtaacaattgtaatcactattccgcttctgattgtggtaattaaatacatttcgccttacataataaagctcaaagaagaatcaaaaaacattatttccatgtttttccttctccctcttacatattatatacttgaatatgctctaaccgtatatactaaccttctatataccggcaaagccgtaataattgaattcatggacagttttattgttgtattatattttttcttgtcaatagtgacactcagtatgtccaacaaaaaaaatacagcagagcgtgaaaacatcatactttccgcagctgcagctcaggctgaaaaagaaatatctcagcttacagattatca

SEQ ID NO: 44 - DNA, 3033595 bp, Eubacterium eligens (residues 1,516,799-3,033,595 of 3,033,595)
  modified_base (52138)..(52234): a, c, t, g, unknown or other
  modified_base (154217)..(154316): a, c, t, g, unknown or other
  modified_base (491158)..(491253): a, c, t, g, unknown or other
  modified_base (492085)..(492182): a, c, t, g, unknown or other
  modified_base (832041)..(832139): a, c, t, g, unknown or other
  modified_base (1110974)..(1111612): a, c, t, g, unknown or other
  modified_base (1187661)..(1187759): a, c, t, g, unknown or other
  modified_base (1805690)..(1805719): a, c, t, g, unknown or other
  modified_base (2330364)..(2330459): a, c, t, g, unknown or other
  modified_base (2464060)..(2464158): a, c, t, g, unknown or other
  modified_base (2677466)..(2677560): a, c, t, g, unknown or other
  modified_base (2838522)..(2838619): a, c, t, g, unknown or other
  modified_base (2860968)..(2861065): a, c, t, g, unknown or other
  modified_base (3000458)..(3000722): a, c, t, g, unknown or other
  modified_base (3012722)..(3013224): a, c, t, g, unknown or other
gaaacaggctgcgatatacagacatgacttaagacaccatataaatttcatacaaagctgccttgctggtaacaatacgcagcaagctcttgaatatataaatgaaattaataataatctggataacacaagaataacaagatactgcagcaacgaagcaattaacctaatattatcttcatatataaataaagcccatgacgcagacatttccacacagatatcagtaactgccactgatttttcaagttacagaattactgatttgtgcagtctccttgcaaatgctttagaaaatgcaataaattcctgtacaaagcagtgtgataacgctgtctcaaaagacaataagcgtcttataacaattaaattgtttgaaaaaaataacaaaatatgcatcaatatagccaatacatactttaaggaaccccgattccacaaccagattcctgttactgatgaacctgaccatggcattggtgtccgcagcataatttcagtaatagaaaaatataacggcatatatgcattttttaccaaagacggtacattctattttcaggcttgtatataaaaaatggggactgcacatacagtccccatcttttatattattgtattaattataatgttacaccctgcttaaagattgcaagatcatggaatcctgctatctcggccttaaccttcttaccagaagcaacatctaatacgagctggaagagctccttagctgcatcttcaagtggaagatcatctgtaacaattcttcctgcattaaagtcaatccagttacccttatttcctgcaagtcttgagttagttgcaatcttaactgtaggaaccggtgatgcaaatggtgttccacgtccagttgtgaaaagaaccatctgtgcacctgaagctgcacaagctgtagcagcaacaaggtcattaccaggtgcgctgagaagattaagtcccttagtattaactggctctgcatatgcaagaacaccctttactaatgagcttcctgacttctgtgtacatcctaaagacttgtcttcaagagttgtaataccgccatccttgtttcctggagaaggattctcgtaaatctcctgaccattcttaatgaagtattccttaaagtcattaataagatgaactgtcttctcgaaaagttccttgttagcacatctattcataagaattgtctctgcaccaaacatctctggaacttctgtaagaatagttgtaccacccttagatacaagcatatctgagaaaagaccaactgttggattagctgtgatacctgataatccatcagaaccaccacacttcataccaatgataagttcctttgcattaaccttttcacgcttaaatgtagcagcataagccataagctcgttcataagcttctctgcttcttcctgctcgttctcaacatcctgaacctgaaggaacttaactctgtctggattaacctctccgatataatccttaagaacttcaatacggctgttctcacatccaagaccaagtacaagaactgcacctgcattaggatgattaattaaatcagcaagaatctttcttgtattctcctgatcttctgttgtctgtgaacatccatatggatgagtaaatgcaactacttcatctactccttctggcttgttagctcttgctgttgcttcaattgctcttgcaattgagttaacgcatccaactgtaggaacaatccatacttcgttacggacaccaaccttgccgttctctctcatatatccatcgaaataagctggctcagtaggctcaacatccttatgtccctctggttcataagtatattcaagtaattcgccaagaccagtctttaagttatgagtatgaacccatgctccaaccggaatatcagcctgtgcaaatccaattctgaaaccatatttgataaccggatcaccattcttgatagccttaattacaaacttgtgtccctgtggaatatcttctacagttgtcacatcaattcctgcaacattaagagttgtgcctttagcaataggctttaatgctacagcaacattatcatctttattaatcttaataaaatcctgcatatattctccttgtaattctaattattatattaaataagagcggatgaatataaaaacatccgctctataatcattcaaagagctattaattagtcagctaaatcattaactactgctctcatacctctttctctgatatctgtgatgtactcagtaataacttcttcaaggttaagaaccttagaaagatcctcgccaccaaagaacttagtattgcttaagtaagcatgtgtgaattccttagcagactttcctgaattatctctgaagaaatcaagaacagccttgtcatctgtgatgttgtactcttcaccgtttctgttaccctttaatacaataccgccgttaaattcagcttctgtctgtgatgtatagaagctcataagtgcagcgatagagaatgtaaggtacttaggaagcttgttaaacttgttaacatatcctaagaatgaaggtaaacatctagcttcccacttagatactgagttaagtgaaatgcttaataatctatgatctacgaatgggttaaggaatctgtcaataacagccttagcaaactcttcgcaatcttccttagaaagtgaaagtgtaggaataacttcattgtaaagtgtctcttccatgtactttctgattacaggatccttcatagaattctctacattgtcattaccagcaaggaatgaagctaatacaaatgatgtatgagatccgttaaggattcttacctttctttccttgtatggatgatgatccttagtaaatactacattaagtccagcttccttgaatggaagttccttctcaagctgctcaagtggaagattagaatcactctctacaacccagagaccgaatacttcagctctgtcgataagctgatcctcatatccccattcctcgcaaagcttagctgcgtcttctcttggatatcctggaacaattctatctacgagtgttgggcagaatgagcagtaattgttaacccaatccttgaatccatcttcaagtccccaaagctcgatgaacttcatgatgcacttctttaattcaataccattatcagcgataagctcacatggaagtaagataagtcccttatcagctgctccgttgaacttctgatatctcttgtaaaggagctgtgtaagctttcctgggtatgtcttaggaggacgtgcattaggatcgttatctgtctcgtcaaatacgataccagcctctgttgtattagaaacgatgaatctaagagtctcgcttgtaccatactcaatgtacttgtcataatcctcaatagctgcaactgcatctactactgatgtaatctgacgtgtgatttccttaggctctccatcaacaaaacctcttaactgaagtgtgtactggcattcctggtcatggaatctctcaagtgtaccgaactcgataggcttaacgataacaacaccaccgttgaaatctgtcttctcattagttacatcgaagatataatcaacgaatgctctaaggaagttaccctcaccgaactgcataaccttaacaggtctgtcaactgcatgtgtaatactcttgtttaatctctgcatcttaaatctccttttttcattgggaataatccgttttacgataacggtccctaattattaaccagtaaatggtatgtaaataagtgcatgtaagcgctttcataaataaaatatacttaaaaatgctctaagtcaatacatttttctgctttttaaaaaattcttacattacacttgtttttataataataccattgtataattcatttatcaatatgtaagcgcttacatttattcattttttatcaatttttgttaagcgatacatttacattcgtcaagagatgaggtcgcacatgaatattaatatatatgatgtttctaaaaaagctggtgtatccatagcaacagtttcaagggttcttaacggcaacaccagagtttctgaaaagacaagagacaaagttattaatgcaatgaaagaattagactacactcctaatgtatttgcaagaggattaggtcttaatactatgaagacaattggcattatgtgcatagattcatctgatatataccttgccaacgctgtttactatcttgaacaggagcttcgcaaatacaactacgactctattctttgctgcactggtaaagattataataataagaagaattatctcgagcttcttttgagtaaaagagttgacggaattattcttgcaggttcacagtttgtagaaaataccagtgagcataataacgactacattattaatgcagctaaagatgtccccatagtgttggtcaacggctatctggatgctgccaacatttattcagtaatgtgcaatgatgaagaagctgtatacaatgcgacaaaactcttgataaataattcacatcgtaatatagtttacttatatacgagtacttcatacagtggcatgaataagtaccacggctatcttaaagcaattaatgaagctggtattactctcccggatgaattccatcatctgtgtggtaagaacatttctcatgccagggattatcttacatatctatatgataaaggtatgaagtttgatgccgttatgacatctgatgactctatcgctgccggtgctgtcaagtttgcacatactcacggaatcagaattcctgaggatttagaggttattggatacaataactctgttctttcattatgtacagaacctgagcttacctctattgacagtaaggttgaggaactatcctcatgcgcggtaagcgtgctaatgaaggttttatccggtgaagatgctgacaatcacagtatcatcgccgctgatataataaaacgcaacacaacaatattttaattcacaggaggattatgaatcatgaaacagttcatggacaaagactttttactttcaactccaacagctcagcatttattccacgattatgcagctaagatgccaatacttgactatcactgccatatcaaccctaaggaaatcgctgaagacagaaagttcgagaacatcacacaggtatggcttggtggcgatcattacaagtggcgtcagatgagaactaacggtgttgatgagaagtacatcacaggtgatgcttctgaccgcgagaagttccagaaatgggctgagactcttgagatggctatcggtaacccactttatcactggagccaccttgaacttcagagatacttcggatacaacggtattctcaacggcgatacagctgaggaagtatggaatctctgtaatgcaaagctacaggaagattctatgtcagttcgtaaccttatcaagcagtcaaatgttacattagtttgtacaacagatgatcctgttgactcacttgagtggcatcaggttcttaaggatgataagacatttgacgtacaggtacttcctgcatggagacctgacaaggctatgaacatcgaaaagcctgaatatcttgattaccttgagacattatctaatgtaagcggaattaaagttaattcattcgcttcattaatagatgctcttagaaaccgtatggatttctttgcttctatgggatgctcagtatctgatcacgctcttgagtatgtaatgtacaagccatacacagaagaagaaatcgaagcaatctttgctaagagattttctggttctgctatcactacagaagagatgaacaagttcaagacagcattcatggtatctgtaggtaaagaatacaacaagcgtaactgggtaatgcagttacattatggtacaatccgtgataataacagattccgttatgaccagttaggtccagatactggatttgactgcatcaacacatatgactgctctgctgagatggctcagttccttaacgcacttaatgctacagatgagcttcctaagacaatcatttactcacttaacccttcagttaacgctgctatcggaacagttatcggatgcttccaggattctaaggctgttggcaagattcagcagggttcagcttggtggttcaacgatcataaggttggtatgactaaccagatgacaagccttgctaacttaagtcttcttggtaacttcatcggaatgcttacagattcaagaagcttcctctcatacacaagacatgagtacttcagaagaatcatgtgcgagcttatcggtggatgggtagagaatggtgaatacccagcagatgagaaggcattgaagaagattgttgaaggtatctcatacaacaatgctgtaagatactttggatttgatctttaattcatattcttaacgagaaaaagcagttatcacaattaatgtggtaactgcttttttatgcgatgtcataattacttatcaattttacttataagactgctactgttctcaaacagaatatttttcatttcattttcaagctttctcaatgtcagtcttcttaaaacctaccaaatctccaaatttcatctgtttcgtatgtctttttcaccccacatacttgttttctccgccaaaaagcccactaaatgatcaaaagatgcagccaccacacatcatgataactgcatccataataattatatataactacttattctgttcctctaacagcttctttaatctgtctatttctgcatccttttcttctaaacgtgccctattttcttctaactgtgagtctttttcttctaactgtgccctattttcttctgcctgcaccttcagttcatcaatctcatccttcatcctgtcaaccatcagctctgccgtattcctgtctaatatcctcaacgcttcagaaaacatactgagcacctcctttggtctctccaaatactcattaatatccagacgtactgattccaagtcaggaaatatctctatcaactgctctatctcctccggtgtctcggctacaaatagcgacagatactttaagcggtcaagcttcatcttctcggttacctgcttttcactgtactgcgttctgtcataatcgtattccgtcacctcggtacgcccttttctaatatcagaatatcggtatttcttaaatgtgtcaaggcttaccagtacaaaatcctgcaaaagatttatcttaattccagtattaaactttgttttgccgacatgaaaatataatgcctcatcaatctcgctgataaggctgctgctactgttctcaaacagaataatagtatgaactggtcgcatatccttatacgaaggttttgacgagccattcatcgaactcctaaggctcccagcacctcctatctcacggtttccagtaatcatcttatactggcgcagcacaaggtctgctgagtaacacgatattctctctgcctgaaaatcataagaaatcttctgaatctcaatattagcgatacttccatcagacatcatcacaaccatatccataataatcatcacaccaaggaactgtgaatcctcattaggaaatacttcaagaacagtaaccttctgccccagcagacaactcaccagctctgaaagcctgtctcttctctcaaccggattaaatatcttcttaaagaatggatcatataataacggaagtgacttccttccctttagaaaatcctcatatcttccaatccattcttcattactcttaagatatccatatgcactcaggctccatgaatctcctttaatctgacgcatggctgcatcataataatccttcttctcactaaactccataatacatttacaacaccagtgttacttcctcctcttaattaataaacatgcacatttatatatgtacagtatcatatatatagagaagtgtaaatatacttgtcgtattctgtagtctttgcatcgtcatctgttgttttttcgtcgtattaggttatctcttaatatccaatcataaattcatataaatcttccaatgcttcctgcaaatcagcattttttctctctggaaatcaattgtgacaactgcatcatctgcatatccgttggtatacaacaaacatcataagacatcctaaccagctttaacaaaagtgctgctttcttggttttaggatatttcatgcagtattcttcaattataattcttgagtattcatccatttgtatccaccattatctttcatattatttattaaataatactctaaatcaaagccaaacaccagctaataatccgctcatcatattaatactttagattattacaaatgtttatttatatctaatcatacttacatatgaagtgaacagtatcatttagcgaacagaagatatcttgttgcggatagacggtacgctgtggtggttgtattagtgataattcggtaattataactttcaaaaagtgtgtaatagttgtacaattcgttaaaatcgtacaaattgttatagtagattttctgttgtcgtttgcatgtacagagcttaaactgccgactttgccagctgtaacaattaatatctaagtcgtctacgtcctctgtgactgattttggtctctccgtcatacttacctgaacagcaggctatcaaaacacccatcagcctgtctgctagcatccaatccttccttgattcctatgcttttctttgcatattccaaagtagatggtgcattgacttagcctcatccacgtagcttcgcttcatgccatatctgtttcattcactccaatccaagatcaaccaattcatttagaaatggtgccaccttaagcaactctaaataaaatgctccgttctttcatgataactgcacctatagtaactgcttattccgtgcttctaataacttttaatcttgctatttcaaagttttttcactaataataattcatttaatttatacattttacattgattgatacattgaaatactacttttttttatctttatgtgcattcccttctctaaatctgctctaaaataaaatatataaaaacaatatataaaaattgcagttataatataatactttgaaatatactgtccaaataaatttgcatagtaagacattgctgggaggtaaaataaaaagccataaaaaatatacgataattcattgtttaaaataggtttacctttaacttttcttaaataaatatttgataaaataaaatataaccccaaaataaataccatcattccaagtaaaccaaaatcaatcatcaatcctccaaatattgtatctacattcgctgtaaccgaatctgatttactaatataaacatttgtagaaagtatttgcatataatctttagatataaatcccatacctgctaaatcctgccaaaaagcatttagcgttatttcaccaaatagttttcttttaaagaaattaaacccttttacttctttaataccaaacactaaaataggtgaaccaatataatatgatatgtattctattgtagaaaatgctgaattaattggtaaatctgaacttttaaccaaattctttacacctgaaaatactaatgcaagtacaatgattattggtaaaaattttttaaaaagttttatatgtatgtctatgcttgattttttatttttatcttttaaattaagatagtacaatgaaaaaaaagcaaatataattctcaatgcctccgttcttacacttgtaaataatgaacatatcatcgcacaaattacgggaataaaatgtacagcatcttttttcttccatccaaaaaccatgtttcttgatataacatagcattcaataaaactagctgccattataactttaataccttgtcgtaatattgaattcgtttgaaccgaatcagaatatttaactgcagctattgctgctaatccattgcttccaatacttgcaccagactttaaaatatcatacatatataataaagttaatactagtacaacaacattgactataaaagtcttatattcttttatatcaattctacctatatgttgtcctatctttttcgtacaatcatcattttttatatttttatttatcaataaggaaaacgcctgagctactaccatcattaacaaccccaatgatatatatgtaaatgaattaaatgaaaaatttatattccacatatttgaacctgctattgcaaatatggtagcaaaaataaatataaatatagaaaaatttgttggtgatataaaatcattattactcattttataagctataaaatatagaaatatttcaactatcaatagtgtaaataaaaacattttactatctccattctaatagttttctaaaaattcacaaaatggaattttacatttaggctgtaattcttcatttatactatgtaaattatctgatattttattttcattttttattaaatcatccataaggtcatatatattgttattagtatcaattttatgtaagtctattaaatattttcccatattggtatagttagaaacttctctcatcttattttcataacaaattgatataaatggtctgcaatttttagccgataagacaatcgcatgatatcttaatcctaaacaaaatctactagttccaatagcttgatcatattcccatacatcattaatatcttctcttattattactttctctacgcctaattctaccagcttatcttttattaacaaattaaatttatgttcctcttcagttttcaaatgtggtaatatttccaaattaaaattattattaatcatccattttgcaatctcaggaataacaagatttataatttttttatctatcggattctttttaaattctggatgccatccatcaaaagaggaaggtacaaaactaactacattttttcttataccatcatttataggttttaatgcaaatgcagtatctggcccccattgagcatttatgcctattgttttaagataatctaaagattttttttctcttacataaactgatgatctttttaaaatatattcagcaattttatcaaacaaaaaattcccactctttcctatagtattatattgaaaaataaacttctttttttctataattaccataagaattcttatcaaagaagcccaatccttatatattcctatattagctccgcaaggcgacataactgctacatcacaatttttaattaactcaatccattcatgcatcaatctattttttgaagctttttttattggtctttcaaaaagataatatttaataaaatctttgtgacctactttcccaaatgaaatgtctaaatgatgtctgactttatcattttcgactggtatctttttattcgaattatatataatatcaattttatcaacttctgaaaatgttaataaaatatcaacaaacgcacatccagcagcatcatctccaaaattattcgaatgctgattcactattaaaacattcatttatctatcctttctttttaacctgctaattatctttttcatctctttaatgtttaatataaagaaaaataatattgatataattgccaaaaggcaatttattaatgtatttgatttataattcaaaattaatattgtaaaaacaataaatattactgtatagttaataatatataaaaccagatttttcgaatagaaaaaatttttatttgaatataatctaattacaaacattaaaaaataactaaacattgttgctattgaagcccctagaattccagcatatggtattattataatattaactataacattacatattgctgcacaaattgtagatccaccaatccataatgttttcttttttaccagtaatatatcccctacatattgagctaaacttaaataaactgccccacataacaaaactggcacacagtcaattcctttccaataatcgttttttaaaaataatctatatataataggagtaaaagaaacgattattatactacctaaaaataatatcttaactaccttttttattaattcattataatattttttttgattatgaatatctgtttcttccatagcaatctgttgaaaagataaattaaacacaccaaatattattgataacattgttggaattttacaacaaattgcatatatgccattataataactgcctataattatattaataattgttctatctgaaacattcgttatccaccatgatatattgttaggaattaacgggattgaatattttaataaagacttaatatctttattatctttttgagttattttaaaaggtttaaaatataactgaaataaaatgaaggttaaaccataagaaagtgcaaaagatattaataatccagcaacacctaacataaattttttaactaatatcacactaaatattatcagtaaaacccctgtagtaatactcagcaaagaatatgctattagtttattttttcctcttatatactcagaaaatacactataaaacgataatgaaataaaatacattaaaaaacccagtattattccattttgaaatccattaaaatacattaaaaaataaactacaaaagcaactacaataactaccggaatcataaactgaattactttcttataataataattcccgcattcttttctttccatcgaaaatctataaacagcctgatctaattgtaatgtaacaaatggaacacataaagaaacatatgtagcaattaaatcatatataccatactgactaggagaaagccaagatgaaaaaaatggtgtcataataaaagatatcattttagaaaatacagttcctattccgattattaatacattacgaatcaatttaaaatttttttcattcattcttattttatatgataaaaattcatacgttcctttcttgtaaaaattatatacttataaaaccatccactaagatttatgtaaatttattaaaagctttgaaagcctttcttgtttttttgaaatagtgaatacaatcagttttaaatataaatacttctttaagcctataccttttaatattattttttttgatttagaattgtctgatgagcatttataaatgcaaattaaatcatttaaaaaaaacttttcattacattgatattgacataaaagatttaatcctaatcttatataatatgtaaaaatcatattttgttcttctaaagaatctgtaattatgtattcgcttgatttcttacaatattcagcaaaatcttttaaatatcctgtatttgattttaatgaagtactaaccgaatatcttcggtaataattataaacaataccactattcactttaatatttttacatttggttgcatatttcacattaaacaatgaatcttcatgtccatacttaaagttttcatcaaaagacagattattattttttataatttcttttttatacaaacaattccataaatgcataagcgaaccttttccattaatattgcaaatcaaattaatgatttcttccctagactttatggtctcattttcatactcaaaattttcttctttaataactttatctttttcatctaataacaaaagtcttttaccagatataaccatgtcagtgtcaactgttatgtttttaaccaaatttatatatatatctttttcaattaaatcatcttgatctataaaagaaatccattgtccctttgctttttctatacctaaatttcgacttgaagatattccaccattaggtttatctattaatactactctgttatctctattttcatattttttacatatacttaaactgtcatctttggatccatcatttactaaaatcaattcgatatctttataaggttgagataataaattttgtattgacttctccaaaaacttttctccgttataaatcggcataataatacttatcataactttttcccttttaaacactgaatatttgtagcaaccaatttttcaatgaatatttttcatacaagcttttaggtaattctctataatcgctttcaacaaattgttttgttataactggattaactctatcaactattaaaatattattttcatcataaaagtcatagttttttacatttttatttgtggttattaattttttatgcataccatgtgtttcgatggtacgcatagtcaatccactttgtgtactcaactctaaatctacaattatattagatttatcagtaatttcactcatttctgttatagataactgtttatatataaaatctgtttttttcgcatttgggaaattttttttaatatatttacctctcaaaaagtgaatgtaagatggcaaatataatttaaaacaatatgtataactattctcagatgcaaattgttttattttgtttataaacttatatctctcagtatgtgcaaacccaacaaatgaaaaatcatattttatttctttactatagccctgcttttctttgcaataaaaaagaggtagaaatttcatataattatatttttttacatcgtcagaatcaaagctataaatttcatcaaaatacttatgcatatttattgcttgagggtaaacctttattgaatcccatgaatacaaaatatatcttttacaaatttgcaattcctttatttcttttataaaatattctggaaaaatggcagcatttataacaaataaataatcatattctttatcctttacattttttattattccttcgaaataatttttctttaagaatgaatatttttctaaaaatcttgtttttaaaaaatttgttgttggggaagagtaatacatatcaacatctgcccccattttttctagttcattctttatatattcaggatattctcctgatctccatgttaaaaataaaattttcttttccaatatagattccataattattcgctttcttccattatcttgttaattttgctattatctccccaaatagctttagaatcatatggtctgtctggaaatgctccatattttagttttatattaaagttattttcttttataaatctttcaactctatcagccaatttttcgggatgtccagaacatatatttattattccatttattctgctttgacatattgatgcggcaacttgttttacaaaacaattataatctataaaatcatattgattttgtcccattgtaaaaggaaattcttcttttccttccttattggcaagtacaatcttagaaaatatagaatttccaaattctaaatttccaacgatataaaatcctcttaaccattgaaatataacattgttttttttacataacatctgtgttaattctctcaaagcatttttccctataccatatggagttattggattacatggagtattctcgtttataggtccctcaaaaaatccaatctcatgcatgctgcccaaaacagcaacttgctttatccctgattcaattaaagatttaataaaaaaataatgcttaaacaagtcttcaatatgtgatgatgcgtaatgtaaaaatccatctctccatgctaaatgtaataaaatatctggtttatcaaaaaattcatatggattttcaatctcaaataaattgcattcaattttttttgccctatcatcgatattatttgttttaaaatctacagcaataacatcatgaccactatttaagatttcttttactattccttgtccaagatatccatttgctcctgtaaccaaaatcttcatatattttttttacctttgtatgtagtacatgcaccacaacatatcctttcttaatatttaataatcctttcaatatcctcaagtattaaatcaactcttaatctgttcttttccatcacttcatttacattgtatctatctaggaattctttttttaatccataatttaataccttgacatcatccgctccgtagaaacgcgcaattttttctccaaagcctccatcaagtattccatcttctaatgtaataatcagtttatgatttttcttcaagtcattaagtaattcagtatctacacctgttatatacataggattaatgagtgttggtaaattgaatttttctgcaatttctccgcataatttttcaccaagctgataaaaatcacccaaagcaagaactgcaatatccgaaccttcttgagttactttatatttgtttaaatcatcatattttgatttaacatcatattcagactcaaacactccatttcttggtgctcttattgcaacaggatacaaattctgattaaggctccagtctatcattgccagatattcctgtttatttgttggagcaagatatacaagctctggaatatttgacatcattggaatatcaaatattccaatatgcgttacatcattagttgcataaacagaagcatttacaacaatcatcgttactggagatttatttatacatagctcttgtgatatctggtcataggttctctgataaaatgtagacattgttacaaacacaggtttacatccgttttttgctaaacctgctgccatacttattgcatgttcctcacatattccaacatctataaattgttttccagcttcacgtctgtattcttctgaaaatgataatgaatccggtacagctgctatcattgtcacaactttagaatctcttttcattttttcaataagataatctcttactattctgtcatagcgttcgccattaaatggatttttttcttgcccactagatatttcaaatggtcttacccaatgtgtcgactctttatgcttctcagaatatttatatccctttcctttagtagtgcatatatgtacaacaaccggtctgtcaatatcctttacacttttaaatgcttctataagctgtggtatatcatttccattttcaacaaaaacatattcatatccgaatgccttgaataaattattttctgatttaccatgtgattttcttaattcatacagattcttatatataccgccatgatcttctgcaattgacatctgattatcattaaacactattataaaattgctgtttaaatctgaaccggcataatctaatccttcaaaagcttctccaccgcttaatgaaccatctccaataaaggcaataacattttcttttccgccattcaaatctcttgcctttgcaagcccgcatgccaaacttattgatgttgccgtgtgtcccaccctgaataaatcatgttcactttctagcggattagtatatccattaaactcacgatatttttctggacaaataaatccttcttttctgccagttaatattttatgtgtataacactgatgtgaaacatcaaacacaaatttatctttaggcgaattaaacacataatgcagtgctattgttgcctcaacaactccaagatttgatgataaatgtcccccgcaggaactcatctttataattaatgcatttcttatttcttctgctaattcatcaagatttttgatattgattttcttcaaatcatctggtccattaatttgttccaaaaacattggttatcctttctaattatttaaataataattaatagtttctttaatcccctgctctattgaatactctatattccagcctaattgcttcaatttattattatccatgcatattcctggttttctattttcagatttttctgataaatatttcacctgagttttaaaatttaaagtttcattaatttgatgtgaaataatttgtgccatttcatccacagctttaaaattacccaaatctccgtttgaagaaacattatatgattcacctgaaattcccttttctgcaatcaataccacacctcttactgcatcttccacatagatgttgtctcttcttgctatgtcagaattatttaatgttatatcttctcctcgttcagctttatttataaattcataaaatgccgtattaggcatatatggaaccggtccgtatatgtaactaaatcttgcaataatcgtttcaattccatattgcctgctgtaagctttagcaagcacttctataaaacgctttgattctgaataaggtgaatttactgcatctaaactgtctgctatagatgtctcatcttcttttactgtaatattttcagatgtattatttgcatatactgttgctgatgaaaataatattaatcttccttttttccctgttttttgagcctgatttttaagaaaatccaataaatattttgttccaagtacattcggctcaataacatcaacaggagattcttttataaccgctcctgaaataggacttgcagcatgaaaaatataatcaatgcatccaatatcatcatttataggcttagaagcatcctgagcaattattttgacacgtccagctttgatatattctttgtatatacgttctaacttttctttgttacggcttaatgcagcaatttttacgttattttcttttaaaagaaaacttgcaatatgactgcccattaatcccgttgcacctgttatcaaaactgttttatttgaaaaagcactcatctttattctctcctatcagtgtcttatatcatctaatatatatttatctaattcaggaaccatatcatacatttttctacctcttggtaaagatggttctaatgtcaattgactatcagcgcaaaaatcaattataaacggattattatctggtatatccttcaagttattaaatgaatctgctttaacatatccaatatcataagctgctgctatcagcttaaaatcaggggaactataccctgaatcatatgtagtatgaactgcataaccttctcttttttccctatctttaatcattcctgaaattctattatttattatgagcattaaaacgggtatcttctctctcgaaataaactgcaattcctgcatatttaactgaaatccctgatcgccaattacacatacaatatgctttttgtttttataaaaaacacctatgctctttgctaaactgcatcctaaggccccaaaagattttgaataatatgttctcgcttttactccgcttaattcatatgcttttgatgcccaaaactcattatttccaacatccattactaaatcagaatctttatactctttaaaaatctgacataaaaaatcaaccgtactattacaatcgcaatacataagtttcttttttactaagcagcataaatttgtccaattgctgctgcaattaattttaaaatcgaattcttcaacgaatctttttaaatcattttttatcgtgtatgtatttaaaattgacctctgaatttccctgctgtcacattcaattctaactatttttttattttctaaagcttttttatagctttccgaatttaatggaaatgccattctatttcccaaagcaattaccaaatcagcttctgaaaaaatataattactgtatcttaatccatggcttcctatatatccatagtaattatcaaacaatcttccagaatcctgtgaaccacgactcgacaaaaccggaatatttgttttattgataatttttgaaagctgtatctcaactcctgcctgccttattccatctcctattaatacaactggtttatgagcttcttttaacatctcatacacagaatcataattaaccgtatctttttttaattcacattcattaatatgtccacttatatcaatttcttttttccatatagatgagcaaaaatctaataacacaggaccttttctgcctgataaagcctcttgaaatgctttatttattatcttttctgcttcatattcattctctactacaactgcatacttagttatattttttacaatatctacagtgttcatttcttgttcttgttcaaaacgctgcttattttgtgatgcatttccagcatgagctgtaataaatactacgggcagagaatctgcatatgcatctgctattcctgttacgaggttagtaaatcccggtcctcttgttgcatatgcacatgctaatccatgctctgcctgtgaatatccattcgcctcaaaagcagaacactgctcatgataacttaaatgaggatatataccatcttccttatctaatgcatataaaaaatctattattactccgcctggaattccaaacgcatgatttaccccattattcttaagtttttttactaagtattctgcaacattcatattatttccaacctaaaattctgctattttaatcaatttttctacattatcagttgtatatctttgtcttaaatcttctggcatgtgtgataatatctcatttatttctgcatatgattttttatatttatttctcaatgcaatagaatatttatatgctgttctatgtaatgctggtaataaacgtgtaacagagtatccccataaagcatcagtatagtatttttcaattatttcacatgcatttaatacctctgaaaaattgtacttattatctaccttgttaagatatcctattatcaattcagtttggagatttccagccccctgccccatccccataacacatgaatcaattattatatctcttgcagaattcatatctataaaagtctgaacattactaaatgcaagattcatattattgtgtgcatggaatcctattttaatctgtggctttaatccctcatcatatacattatataaatcaactacatctttattttccatatagccatagctatcaacaaaatataaggcatacgcattcatctcatttgatttttcaatcaacaatttaatttcttcttttgtatatctcattgtaagcattggttgtacaaatactttatatcctttagttgataaggctgcacaaaaatctaaagacttctgcagttcggaatatcttataatcactcttactgcttcacataatgaagaattccattccggaatatcctcaataggagtatctggtcccctatataatgctgcaaacatctgattctgttttttctttaagggcatttgttttgaaacatcctcaatattttgatatatacagaatcctgttctatcatcacttgtaatttctattgaccccaattctataatatcaatagctgaatcagctaaataaccggctgtcattctagaatcattttccgagaatctcacatgagataaatcattcttttcagcatcttctaatccaagtccgccatctctaagcgtacaatctagaatttgaatatttttactcactcttaattactccgtttctatgatattctttgattgtgcatctataattgttcttttaatcttcttaactctataattgttgtataattttgaggcaataactaatacaatctttttaggaagatgattaacaaaaaactgtactattttatcttttctttttcttgtatctttaaatccaggttcatccttccatggtgtcagcattttatatttttcatacaatgcctttcttggatgattagagtttgcataccatgctctatttgtaatcaagaatgaattagtcaaatgtactattgctggatttttcacagcttcttctatttcatttctttgatagtatcttttaacatgtcttaatttcataacttcatcatatgttaatatttccatcatgctatacatattgtatttaggattaagaataaggatatctccctgtaaagctgcattgaatgctgtctgttccatgaaaaatacatatccgccattttcctcacaatatttccttaccttgtcacctatccgtttttgtttccatgctttcaaatcttcaagaatcataccgctgttacagtaaaatgcatctttatttaaccctaataactcataatatttttctccaagacaatctattacaccagctgcacaatgacctttcaaatctatattccaaagttcagttaaatcatcagttactaatatgtcactatcaagatacaaaatcctttcaacatcatctggaagtaagtcatccaaatataatttcatatatgaattgaaaaaccatcctgctcttacatcctttaaaccaagattttctactttattaacatctggcataggaataaaatgaagtgttctattatatttacctgccaattgattcaatttatctttattttcatctgacaatggattttcaaatatgtatacatgtatttcatcaaagcttttattattttcaaataaagaagccatggacgttgccagtaccggggcaaaaagatcactgctgtgatatgttacattcattatattgctcatctatttaccaactttcataaattcttcaatctgtttattcatacatttttcgatatctccattagtcagccagcatttactccattcaacaaccttttcaattgctatattcaaatcccaatgtggctgccagccaaatgtttttttcaatttagaacaatctaatttcaggaaattagcttcatgtggaccgccatcatatttatcaatccacttcatgccttctccccaatgtttaacaaataaatcaaccaatgctcctgtctgaaaacaatccctgtcatctggtccgacattgtaatatcctgcatactttatatcttcatattgtttctgtgctatcatcaaatatgcatatattggttctaaaacatgctgatatggtcttgttgaaaatggatttctcactacaatatcttcatgtttaatagctgctcttatacaatctggtataattctgtcacttgcaaagtctcctccaccaataacatttccagctcttgcagttgatactgctatattcatatttttaaaaaatgaattaatatatgaatgtgtaaccaattccgaacacgactttgaattagaataagggtcatatccatctaattcctcattttcacggtatccccattcccattctttattaagataaaccttatctgttgttacatttaaaaatgactttactgaatcacttgttctaacacattcacatatattcactgttcccataacatttgtctcatatgtataaacaggattcttataactctctctgactattggctgtgctgctaaatgaaaaactatttccggctgtgtttttataaatgtttcttttaattttgataaatctcttatatctccaataacagaattcatttttccgcttatattagcaatttcaaaaagtgaaggttttgtaggcggatttaatgcataacctgttacttctgctcctgcattaattaacatctggcaaagccatgcccctttaaatcccgtatgacctgttattaatactcttttccctttataaaaatccatactcactattacttatcccacactttccatggagcatttcctatctcccacaaattttccagcatatctttttctctcttggtatccatacactgccaaaagccatcatgatagaaaccttttaattctcctttacttgccaggttcttcataggctcttgttcaaatactgtcgtatcatccttcaaatattcaaatatttccggattgcacaccatatatccgccatttataactgcaccatctgtatcttctttttctctaaatgctgtaatattattatcagaatcaatatctaatacgcctttttgctgagcaatactaactgatgttaatgtacatatcttcccatggcttttatgaaattctaacagcttattaatatttacatctgaaacagcatcaccatatgtaagatagaatgtctcattctcaacatatttttttattcttttaactcttccacctgtcatagtatttaatccagtgtctacaacagtaactttccatggttctgcatgctgtttatgcacaataatgttattaccatttgtaaaatcaaatgtaatatcagatgtatgaaggaaataatctgcaaaccactctttaataacatgttgcttatatccagcacatattacaaattcatttactccgtaatatgaatacaatttcatgatatgccataaaataggcatctcacctatttctatcattggctttggttttaaatgtgattcctcagaaattcttgttccgaatcctcctgctaatataactgctttcataatttctcctcataatgcttatataaattcacgctatccttcccgcatcatactcactggcggttaattttgctcttacttccagccctgcctttatactgcgtggttctttccaaagttcaattccaagttcagcgattcgcttgtgtctgtcgattcgagttatataggtctggcagttgttaagtggacctttttcgactataagcctgttatctacaattattccgcatgacattctgatgcagttgttttcatctatcagcatcttaaggattgctctttcttcttcatatataggattaaagcctcctccaatacgcacaggaacaaccgtagttggtattctcttaagctgtttttccagttcattgggtaaattactttcgataaacacataacctggaaacaaccagtcttcttcaagattccactttcctgaatatcttttaagatactgatatgtaggcgcaaaaatattgactgcagcatctgtactcaatgcattcctgcatttttcgatggcaatcttctctctgccttttccagccattactacataccacatacatcctcctaccagaactgattgactttggatataatggcacgcactatctgcaacataataaatattatgttgtaaatattacaaaccatctcatgtactttaccacaattaaaataaaaatacaacagttgttgtatctaattttatcgaatttacaattgaattgtcgaaaaatcaattgtaaacattttctattatcttgtctgatttttataaaacacagtaaataagtctgtttacaccagctaatatatccagaaaattcatttacaacataatatttattatgttgtactttttacaaaatattttctattcaccactttttaattatataatcactttttacaaccatcttcatgctgtctagcagccttgtatgttcttcccctgatgttttcacatatatacgggtttgtctcaatactgctgtgaccaagcacgtctgcaagacgggctatgtcctttttaatattgtagaagcttctggcaaacagatgtctcatattacgtgggaatactttcgattggtctattcctgctgacacacttaactgcttcaacattttccagatgttgcacctgtttaaagggcttccggttcttgttatgaatatactgccctgcactatttcatgtctctccgcatatcttaagagtgcatttcttaattctgactgatataatattcttcttaatttccctttattatgaatatctgccatgccctggattacagattccaaagttactgatttaagttcacttatccttattcctatactcccaagtgtctggataataagagcaagctgctcattgcccattgaagcagctgtatcaataagacattcatattcacctttcgtaagttcgcgtttctctgagacaaacatatttttctgtacttttatcatcttcactttcatatctgcacaattcataacttcaagataatgattaacagatgcaagaaatgaattaatacttgatattttataatcccctgtgctttcaatataatatttatagtcaataacgagctgcttactgatacattttcccttagcatattcataaatctttttcatatctcttacatacttttcaacagtaatcctgcccttttcttcctttataagtattttcctttattcttctatgcttctctctgtaataaacattttcttcattttattctccttatttatccttattatatgtatctatagaaaaagcccgctggttaatctcttaaccaacgggctgttactgttctttcattattatattgttcttatcttttattccttgtcttttccattacatcaagagtatgcatcttaccatatgcatctctcttatgctttggaacttctcctgcttcagaattaaatataccgacattctgacctttgttatgctttgctgcacatgccggacaatatcttccgtatcttatctctgctccacagtcctcacatttgatataactgtctgaaccgtcaggaatctctattcttccctctcgcagatatctgttaattgttgatacaggaacccctgttccatctgatatattagctgcattagaagggccatggtcttctatatattttctcaccttgccaaaagatgtcagttcctctgctccacagttgtcacacttaaacacttctccaaatgcataacgcataagttccccacactttggacatatcttggcacggtcatatttaatcagcgtatcaatctggcgcttttcctttttctgcttttctctttcctcaatctgccttaaagtaggtttcataatcataccttctttctttcaagtgtatctctgaatatatctcttcgttcagttttaccaactttattaatatctctttctttatatgttccgtcattcttaatctgctttttcttataattcttatcatccggttcgtcttcctgtgttgtcctgtctgccctgcccggttctttaagagccttctccagcatctccttattctgaaatgcagaattgccacggttcattgataacatctgtctctgcttctgacttatatactgttcaaggttagcattacgcacgcctaacctgcatccgtatactatcttgttctcaccgataacaaccttcctcacaataattcccataaggctgtaattctgattaaagtcagcaaacacaagtcttaccggcatattaatgacattgtccatatcctccgtgccaacaaaagagaatccactctcactcacatctttaacaataacatcaactgccttacggttagttcctaactgtgcaacaccggagatacctataaacagcctgaaagcccctcgtctgttaacttcaaagccttctccattagctgtaatcttataaaatgttccattatcttctcttattgaattaaccgcaacgcccttccataacattggtggcttactgtcccttatcatatatacacttaccataataccgccacctgaagaattaaagcttaatatcttaccattaattcttattggctcaaccaatacgccctgattaacttttctgataaccttagatggaaactcatatttctgtccattcatgcttaattcaattatcaggttattatcctcggtcatctcctgtaaaagcatagtttttctccattacacgcaattaatgatataatgataacacatttacagcaataaaaaaagactctcataccaaactcgcatgagaatcttctttcataattaattattcttcatcttcttctggttcattccagttatgatatacattctgaacatcatcatcttcatctaagagtcctaagattctgttcatcttcttaatgtcatcctctgatgtaaggtctacagttgtctgtggaatcatagtaacctctgctgaagcaaatgttactccggcatcagctaatgcctgattaacagcatcaaactcctctggtgaagtaaggatttcatagcaatcatcttcttcattgaagtcatctgctccagcatcaagagctaacatcataagctcatcagcatctccggtatattcttccttgtctacaatcatctgtcccttgttgtcaaacatgaatgatacacatcccggagtaccaacattaccgccacccttagtgaaagcactacggatattagaagcagctctgtttctgttatcagtaagagcctctacgataatagctgttccgttaggaccatatccttcatatgtaactgattcgtagttagacatatcattacttgcagccttcttaatagctctgtcaattgtatcattaggcatattagctgctttacacttagcaacaacctgtcttaacttactgttattattaacatccggaccgccttctttaacagctatcataagctccttaccaagtcttgtaaagattttacccttagctgcatcattggctgccttcttatgcgcgatattcgcaaattttgaatgtcctgacataaaaatacctcatttccaattattactgtaaatgttctttaatcttctcaatcatctctgcatattcagcatctgtaagatacttcttatctgggttcataaggaatacgccaccccattcgaactcgtccttatacttagggcagagatgaaaatgaaggtgatgacctgtatcaccatatgcaccatagttaaccttatctgggtggaaagcagccatgatagctcttgctactcttgcaacatcctcaaagtaagcagctctctcttctgcagttaactcgttcatatcaccaacatgcttcttatgtgctacgatacatcttccaggatgactctgctccttgaacagatatacctttgatgtctcaagctcacatatcttaataccaaacttagctacgaggtcaccctctacacaatatgcacaattctgatctaccataatcgtatcctcttttctataaccaaatataactcatgcttctatattgccgggtttgaacagatacaatctgttcaaacccgtatttaattaatatgctctcatattaattaaattgcatccttgatagagaagctgattcttcccatcttatccttacccatacacttgcactttacatgatcgccaagtgtaagaacatcttcaacatggttgattctctcattagaaatcttagaaatgtgaaccattccttccttgccaggagcaaactctacgaatgcaccgaattccttaatgcttacaaccttaccttcatatatcttgccttcttcgaagtcttctacaatagtcttgatatacttcatagccttatccattcctgcctgctcaacaccacatacagaaacgaatccatcatcagtaatatcaatcttgacaccgcactcatcaatgattgcgttgattgtcttaccacgctgtccaactacttcgccaatcttagcagggtcaatagatgtctggataatcttaggtgcatactcaccaacagtctttctaggctcagcaatagcaggcttcatacatgtatccatgatgaaaagtcttgcttctcttgttcttcttatagcctcttcaacgattggtcttgtaagaccgtgaatcttaatatccatctggatagcagtaataccttctgttgtacctgttaccttgaaatccatatctccaaagaaatcttcaagtccctggatatcagtaagtacaatataatcatcatctgtctcgcctgtaacaagaccacatgaaataccggctaccattctcttaataggaacacctgctgccataagtgacatacaagatgcacatgttgaagccattgatgtagaaccattagattcaaatgtctcagaaacggcacggattgcatatgggaactcttcctctgatggaagaacaggaacaagtgccttctcagctaatgctccatgtccaatttcacgacgtcctggtcctcttgatggcttagtctcacctacagagtatgaagggaaattatagtgatgtatgtatctcttagtagttacattctcatcaagaccatcaaccttctgtgcctctgataaaggtgcaagagtaacaacatcacagatctgtgtctgtcctcttgtaaacattgcagaaccatgaactctaggaataatatcaacctcagctgcaagtggtctgatctggttaatggctcttccgtccggtctcttgtgatcctttaagatcatcttacgaacagtcttcttctggtactggtaaacagcttcaccaagaactgcaagccattcctcattatctgcaaatgcttccttcatcttctctgttacagcatcaatattcttctctcttgtctgcttgtcatctgtgaatacagcaacttccatctcttctggagatacaacctgcttcatagcctcaaacatctctgcaggaacagcacagcttacataagaatgcttttccttgccaacctcagcaacaatcttatcaataaatgcaatgattgtctggttgatatcatgagccttatatatagcctcaatcatcttgtcttctggaatctcattagctcctgcttcaatcataataaccttctgcttagttgaagcaactgtaagctgaagatctccatcctgccactgtgcctgagatgggttaacgatgaattctccatcaatcataccaatctgtgttgtagcacatggaccgtcaaatggaatatcagaaatagatgttgcaatagcagaaccaatcatagcaagtaattctggtctgcaattctcatcaactgacataaccatgttattaagagtaacatcgttacgatagtccttagggaataatggtctcataggtctgtcgataactcttgatgtaaggatagcattctcagatgccttaccttctctcttgttaaatccaccaggaatctttcctgctgcatacatcttctcttcatattcaacgcttaatgggaagaaatcaattccttctcttggttctttagatgctgttgctgttgaaagaacaacagtatcaccataatgcattaatgcagcaccgttagcctgtgcacacactctgccgatatcaactcttaaagttcttccggcgagttccatttcatactgtttaaacatatgaactccttccataaaaaatatatatttaacagaaggtccgaaacaactgaaaaacacaccataaactaccgccatgatatacatttcagtggtctcggggtatcccttctgccattaacaacgcaatagggcggagttatacactccgccctgattaattactttcttaagcctaaacgctcaataagatttctgtaagattcaatatctgtatccttaagatatgcaagtaaagctcttctcttaccaaccatcttaagaagacctcttcttgagtggtgatccttctggttaaccttaagatgttctgttaactcagcgattctttctgttaagatagctacctgaacttctggagaacctgtgtctcctggctttcttccataagtagcaatgatttctgctttcttttccttagatatcatgtctaaatcctcctaaatattaatctcctgccactaagcttcaggtcggagtgtcctacagctgggtgacggctcatacttgattattttaacacaggcattaaacctttgcaagtattaattatccaataagaaacatatttcttgcaaaatccgaatctgccgcaatctgtctcttcaacccttctacatcttcaaacttcatctctggtcttataaaatgtatgaattcaacatcaaccttcttgccatacacatccttgtcaaaatcaaaaagaaatgtctcaacacttatctccggtgcatcacttactgtaggcttagttcctaagttagtaaccccgtagaatttttcaccatctatagtcgtctgggtagcatatactccattaggtggcaggagcttatactccgtcggatatatgttaatagtagggaaatcaagcttccgtccaagctggtttcctatcgaaaccacacctgtaacattaaacggtctgttaagaagaacatttaccgtttccatatggccaacctttaattcttctcttatatatgtactgctgatttccttatcctgatatttttccttttcaacaataatagttgtaaaaccaagttcttttcctgcttccacaagcattgctgcatcacctgccctgtcttttccaaaacggtaatcagtacctacaacaacatactttgcatgcagcttatcaataagaatcctgcatataaaatcttcaggttccatatgcatgaattcatctgtaaacggatattcaatctcaacatctataccaaaattctcacacagtctgcgtctttcactgcttgtagatataaaatgctgatacttctgtggacatattgaaagcggcaggctgtcaaatgtaaacaaaactgcaagcagattctcctcatccgctttcttccttacaatctcaataagcttctgatgtcctgtatgaattccatcgaactttcctaatgtaactgcacttttcttatttaattgaaaatcatctgttccatgaatatattccaaagatgatcacgcccctttacttgttgtcttcgtaaaatatcttaaccggataaagcacttcatctcgaaattcatatacgccgataaagcatttatcagaatcatacactctgtatttctcgttatcattgattgcgacatctgcaggtatctgttctcttgacagcttattgccattgtgaagataccggctgtattcttctgcaaatgttatctcctgataatcactgaatatcttatctatgccagttatcctgtcttctatttcaccctttaacacaagagccgatatctggttaagtgtaagtgtatcatcaagcatgaattcacctacccgcgttcttgtaagcttcatcatacatgctccacacccaagcttcttacctatatcatcacataatgacctgatataagtccccttcgagcagtcaacagtaatagtaactgttttctgtttatccgaaagattgatatcattcacccttaatgtattaatatggacagttcttggttttctttcaatctcaataccttttcttgcaagctcataaagcttctgtccattatactttaaagctgaatacataggcggtatctgctcatactcacctatgaattcattacatgctttaaggacatccacttcactcacattaacctctgactgggcaacaattttccctgatatatcaagagtatctgtcgttgtgccaagaagcattacagcctcataagtctttccccagtcagttataaggtcacacagctttgtagccttaccgatacacacaggaagcaccccgaccgcatcagggtcaagtgtgcctgtgtgaccaatttttttagttttaagtattcctcgaagctttgcaactacatcatgagatgtaaatccctgctccttatatacatttaaaacaccattcatgcattatcctcattatactgctgctcaatcatttcgccaatcttattaacgatactgtggacattgcccttagcagagaatcctgctgccctcacatgtcctccaccgccaaatgctgtggcgattcttgcaacatcaatcattttctttgaacgaagacttactttgtattcgtccttatctgtttcataaaggaatatagccacttcaactccgtctgttaagcgtaactgctcaataattccaccaagttctttgccagtgacaccatagaaattcatttcttcaatagatacacttgaaaatatacatctgccatcataaaacaacacactttcaagcaaagctcttccaagaatctggttctggatataactcttcttgtaaaagctgttatcgataatgtcagaataatcaattcccatctccatcatctttccagctatatccattgtccttcttgatgtacagctgtacttaaacacacctgtatcatggattattcctgtatatatgcactctgcaacatttttatcgaccttatcctcgtcaaatgttgtatagagaacttcacatgccgaacttgactgtggctctacataattaacatcagcaaatgaattattgcttatatgatgatctatgcagatagtcttatcagcgttttcaaagcagctcataaatggttcaattctatccattgaactgcagtcaagtactacgaataaatcaaaatgcttatcctcggcctcatgcttaatatcattaataccagatagataattaaattcatctgacggcttttcaagataaacagtaacctcgcactcaggaagattcttcctgatataattatataaacctaatgttgaaccaacacagtcaccatcaggacggatatgtcctgtgatacctataacctttgcatgtccgatttcttcaataatattcatgactaacctctttattctgtctcgtcttcaacctcaacgtgcatcttattatcatgttctgtaacttcatcaataagcttagacatattaataccatactcaattgactgatcaagaatgaatcttatttcaggagtatttcttaaattgacagttcttgcaagctgtcttcttatatatccttctgcactcttaagacctgtaatcgtatccttctgtgacttttcatcaccaagaacacttatatatgccttacatgtcttaaggtcaggagcgacctcaaccgctacaaccgaagtcatagggttgattctagggtctttaatctcacttctgattatattacttaattctttcaatacctcgccgttaatacgggtattctttacactatttttacgcatatattctccaaataaaaactaaatcctatcttggcacttcaaccatgatatgtgcttcaatcatatcctctggctggatatcattgaacttttcaaataccataccacactcagtacctgccttgatttccttaacctcatccttgaagtgcttaagagatgcgataggtccttcataaaccttctcacttcctcttgttatacggacaacagaatctcttgtaattcttccctcttcaacgatacagccggcaatattaccaactcctgaagccttgaatatctgcatgattcttgcatgaccgataatcttttcttcatagataggctcaagcatacccttaagggctgcctcaacatcttcaatagcattgtagataacgctgtaaagtcttaaatctaccttttctctctctgcaacaattcttgcctgattatcaggcttaacgttaaatgcaatgatgatagcattagaagctgatgcaagtactacatcggattcattaacattaccaacaccaccatgaattaccttaacaacaacctcatcattagaaagtcttacaagacttgacttaacagcctcaacagaaccctgtacatcagccttgatgataatattaagttccttcatattaccagcctgaatctgctcaaagagtgcatcaagagataccttatgcttagtatcatcaagaagcttctttcttccctcgctgataaatgtctctgctgtacttcttgcttccttctctgaatcagcagccataatgatttcacctgcattaggaacatcattaagaccaagaatctcaaccggagtagatggtccggcaacctttactctgttacccttatcatcaatcatggctcttatcttaccatagcaagaacctgctgatacagcatcccccacatgaagagtacccttctgtacaaggatagatgctacaggaccacgtcccttatcaagctcagcctcaataacaatacctcttgcctttctgtcagggttagccttaagttcattaacctctgctgtaagaagaatcatatcaagaagctcatcaataccctgcttagtatgtgctgatactggaacaaatgtagtagaaccaccccagtcttctgcaataagaccatactcagtaagctcctgcttaaccttctcaatattagcattaggcttatcaatcttattgacagcaacaataatctcaacacctgctgcctttgcatggttaatagcctcaattgtctgtggcattacaccatcatctgcagctacaacaagaatagcaatatctgtagcctgagcaccacgcattctcatagctgtaaatgcttcatgacccggagtatcaaggaatgtaataagattaccatttacatttacctggtaagcacctatcttctgcgtgattccgcctgactccttagctgtcacatgagtttctctgattgcatcaagtaatgaagtcttaccatgatcaacgtgtcccataacgcagacaactggtggtcttggaacaagcttatcctctggttcttcatcttccttaagaagttctgcaataacatcaaccttctcttcatgctcacatatgcagttgaactcgagagcaatctcttctgctgcatcgtaatctatctcttcgttaatagtaacaaccttaccctgtaagaacagcttcttaacaagtgctgcaggagctaccttcatcttatctgcaagttccttgatagtaagagtatctggaagaacaagctgcttgattgtctcttcttccttttccttcttctcaggctttgtcataggcttcttatcaaatctgctgttagcgaacttaagattttccttagcctcattatctctctttctgtcattcttcttgctgtctattcttgaatcatgtcttcttgaatctggcttagctgaaaaatcaaactcttccttaggtgcagaatctcttctgtcattatttcttctctgacctccgttaaatcctccacggttctggtcattatcctttctgaagccgccatttccagactgtccgtttctgtcatttctgaaaccgccgttattgttgcggtcattgtttctataaccgccattattatcacgattaccataaccaccattgttgttacggtcattatttctgtaaccgccattattatcacggttgccataaccgccattgttgttgcggtcattgtttctatagccgccattgttacggtcattatttctgtaaccattattatcacggttaccgtagccgccattgttattacggtcgttattcctgtagccaccgttgttatcacggttaccataaccaccgttattattacggtcattatttctgtagccgccgttgttatcgcgctgtccgtctctgttattattatctcttctggaattcttatcccttgaactgttctgtgggaaatatacctgtgagatatgcttcttatcatcagcattgccagacttattctgtgttccctgctgtggctgctttggagcctgattctgctgtctgttatccctgttatcattctttacaggctgtgactgctttgctggctgtgctgccggcttattctcaaccttaggtgcaggagcaaacttctttctcacacttgaaatttctgcatctgtaagtccgcttacaggcttataagtcttctcgctgttgctaagcatatcagtaatatccttagatgttatatttaattcttttgccaattcatgtactctcatatttgccatttaacctcttttccaaataacagcactgctgttattctaaaccctgttcaaaatatttttctatggtctttgcaaatccttcatcaaggactgccagtgatgcgcggaattcctttcctatcgcgtggccaacactcaccttgtcactaaaaaaatgtatcggaaccttgtaataagtacacatatttgtaaacattttcttagtattatctgaagaatcatctgcaacaataactgtgtatgcctttccggttttaacagccttctctgttgaaaactctccgcttgcaacctttccggctttctgcgcaagtccaatcatattaaggattttctgtttattttccaatattattcagctcctttgctaactcatcatagacagcagaatctactgccatcttaaatgacctttcaagtcccttattcttaaatgctttagacaggcagtcttcattcgcacatatataagcccctctgccattcttcctgcctgtagcatctataacaattgattcatcctgtgtcttcagaatacggattaagtccttcttatccttcatctgaccgcagccaatacactgtctttgtggaatcttctttactgtagccactatgcatcactcctaataattattcttcatcaaggcttaattcagatggttcaacatactcttcttctaagttctcttcttctgtatgttcttcaggttcagcctcgctcttaatatcaattccatatcctgtaagctttgcagcaagtcttacattctgtccctgcttaccaattgctaaagaaagctgctgctcagaaacaacaatcttagccttcttctcttcatcatcagctactgctgaaacaacctttgcagggcttaatgcgttaacgataagctgtgctgaattgctgtcccactcaatgatatctatctgctcattgccaagttcattaacaatagctttaactcttgcaccgttaataccgacacatgcacctacaggatctacatttgcaacattagctcttactgccatcttagttcttgagccggcttctcttgcaatacccatgatttcaacaacgccatctttaatctctgtaacttcttcttcaaaaagtttcttaacaagctcctgtgactttcttgaaactcttacaacaggaccacccttttctctgttaattacatcaacaacatataacttaattctatcgcctggcacaaacttcttatccttgaacttgtcatcagccttaagaactgtctggagtcttccaagatcaattgtaagatcaccattgtcagcaactctctgcacaatacctgtaataagttccttctccttagaatgatactcattataaagagcattcttttcctgctctctgatagtctgcacaatagtattcttagcattcttggcagcctttcttgagaactcctcagactttacttcaacagtaataacatcaccaagctggcagtcaggcttaatctttctggcatcttctaatgcaatatcagtacctgatacatatttttctttcttattctctctgttctctggaacaataacttcctcaacaacagttctgtcagaataaatgtggaaatcacctgttcttctgtctaactcaacacgaccgttatcagccttatcaaactcagccttgtactcatccataagagatttctcgatagctgcaaacataatctctttatcgattccattctccttctcaagagcatcaagtgccataattaattccttattcattgcttttaatttcctccaaaaatatattatacttcatctacaaatgcccatctgatcatagccagattacttctgtcaaatgttttagttacatcatcaatactgattgttaccgtatctttatcatattccttaagaaccccggaatattccttagatttatcaacaggactgaataatttaatctcaatcattctgccaatactcttttcataatccttctctttcttaagaggtcttgtaagacccggagaacttacctcaaatatatactggtcatcaatgtaattctccctgtccagtatctcattgaaagctctgctcacattctggcagtcatcaatagtaactccgccttctttgtcaatgtagacacgcagataccagtcgctgccttctttcacgtagtcaacatcaaaaagttccacgccgttagcttcaacaaccggctgtataagttctgttgtcttagcttcatagctttctctttttcccatgcagtactcaccctttctaaaagtattcagttttcttatatatgaacgaaagagtggacatctctgcccactctttccgtatcacatatagtagcttgtaggggaatcgaacccctgattccgccgtgagagggcggcgtcttagcctcttgaccaacaagccatagctttcgttgtcttgcagttgtgtaccgcagcaacaatgatatcttaactcaattatcgtaatccgtcaagcacttttttgaatttttttaatattttttacaataatcattcaaaatcttcaaaaaagcgcttaaatactggatttcaagctaattaataatcttatgcaaaactaaaaattgctgtaaatactcccgcacttgcgattcccataatcactcctgcaagtaaaactcctaacaaaactgctattacactcttcttaaatcccatatcaagaaaacttgctgcaagtgttcccgtccatgcacctgttcccggaagcggaattccaacaaaaagtaataatgctacaaaaagacctcttccagccttctccttaagcttctctccacccttgtgtcctttttcaatacagaaagtaaagaactttccaatatatttcttatcctttccccactcaagaacctttcttgcaaaaaggtaaataaccggtacaggaagcatattacctattacgcacacaatatatgactgtaacaatggtaactggaatccctgtgatacaggaattgcacctctaagctcaataagtggaaccatagaaataagaaaaatatacaaatacttttttaacatactatctcctatttaatttaataataaacagaattgataatacataatatttgttaaaaaatcaagtgtattatatattctcaatctgccagtcaattggttctaccccattagcctttaaaaattcattgcactggctgaaatgtctgcagccaaaaaagcctctgtacgcagataacggactcggatgtggtgctttaagaataagatgtttcggattattaagcattgatgcctttctctgtgcaggcgacccccacagcatatacacaataggtctgtcctgcatattgacagcattaataactgcatccgtaaactgctcccagccgtgtccctgatgtgaattagcctgatgtgctcttacagtgagtactgtgttaagcagaagcactccctggtcggcccatttcttaagatatccgttattaggaatataacatccacagtcatcatgcagttctttatatatattcttaagtgaaggcggtgcttcctctcccggaagtactgaaaaagacagtccatgtgcctgatgtacattatgataaggatcctgaccaagtatcagtaccttaaccttactaagcggtgtaaaatgaaacgcattaaatatatcatctgccggaggatatacaacatatttgctgtattcttccttaacaaatgtaaataattccttgtaatatggcttggaatattcctccttaatagcaggaagccagtcattatctatcattgacatatccatatcctcctacatacgcataggaataccattatctgcaaggtatttcttaagttccataatatcaagttccttataatggaatagtgaagctgcaagtgctgcatctgcttttcccttagtaaatgcatcaagaaaatgttctttactgcctgcaccgcctgaagcaattacaggtattgatacatttgacgcaattgtattagtaagctcaatatcatatccggctttcgttccgtcacaatccatacttgtaagaagaatctctcctgctccaagcttttctgccttcatcgcccattctacagcatccatatgcatatcaactcttccgccattcttatatatgctccaatgaccatcactattcctctttgcgtcaattgcaactacaacacactggcttccaaacttatcagccgcatcagatataagctgcggattcataatagctgccgaattaattgatatcttatcagccccttctcttaaaagtaccttaaaatcatctgtgcttcgtattccaccgcctacagtaaacggaataaacactctttctgccactcttcttacaagatcaacagttgtgtttcttccatcacttgaagctgtaatatcaagaaatacaagttcgtctgcacctgatttatcgtacattgatgcaacctctacaggatcccctgcatctcttaaatcaacaaaattagttcctttgacaactcttccatccttgcagtcaaggcatggtataattcttttagtaaacatcagcaactccttttagcaattataatgacgcaaaattctttaatatcttaagtccgacatcactgctcttttcaggatggaactggcatgcaaacacattgccgctttcaaccgaagcatgaatatgtgtagtatactccgtagttgctgccacaatcccctcatctgctgccttaagataataagaatgtacaaaatacacatacggattaccttcaagtcccttaaaaagtctcgcttcaggcttaatatcaagagaattccatcccatatgcggaatcttgaaaccatccttagcaggaatctttaatatctttcccggaagaatatcaagtccctccgcccccggagtctcatcactttccttaaataaaagctgtaatcccaaacatattccaaggaatggggttccaatacctgtcaccttcttaatagtatcaacaagtccgaacttatcaagattgttcattgcatcaccaaatgaaccaactcccggaagaataaccttatcagcctgtaagatttcacttgaatctcttgagactaaaacttcctctcctaatgataccagagccttttcaacactctttaagttacctgcgtcataatcgataattgctatcattgtactgcctttccgtattcttctattctgtaataataattagtaaaatctgtatctgacattgatgataatcctattgcttctgtttcagatatcttaaatgtatcctgtaaagccaatactatctgcttatatacagcagtaaacttattatcaatgcctaactcctgtgcctgcggacgaagactattatatctgttcactcccttaataagactgtcaagtgcttctgtcttcatgttaagcttcatataattctcatatgaatcatattgtttctgaacatacataattgttgaagcctgctcataaagagtcttatcactgccattaagctttattccgcttaacttatcatatgctttctcatactgctcattgctgtaataatctttagccagagaaacactgttgttataataaaagcctgaacttaaaacacttataagtaccgaaacacccgccacaaataatacaagcataacaatcgaaacaggctttatcttaagaatatcctgcggtttaggtggttctttcggtttctttaccttcttaggctttaccttcttaggtttattagccttctgtgctttcttagcctctcctgcctgcttcttttgctctttcttctctgctgccgcagctttctttaattccttattcttctgcttttcttcttcatcaagtctttcggcttcttcctcagccttatcctcttcaatgtgctttgctttcatctgttcaagcctgtacttaagtcttgcaaaaaagcctttcttaggaacctgtgactcatcaagcgtactcttgtttccgaacacatcttctataatctgctcattctcatctttaggttcatttccagatgatgaatttcctttatcagacgaatcttttactacattctcttctatacgttctttctctcccacagcttctgatgtactctctgcagcttctgatgcactctctgcagtttctgtatcatcctctagactgtcaaagaacactttcttaatcttcttgaaaaagccttctttctgtggttttaactttttcttatcatctgcactaatcgtctgcgcctgagtatcagcacttttttcattatgttctgtttctttatcaggagaacttccaaacagatcatctatagacgcactgtctgacttaacatcatcaataatatcatcaagattcatattcataagtcttttcatatcgtcatctgaaagttctgaattatcatctgatgtcaactttgcctccgctgcctcttctagcggagtattatcaagaagcgcctctaacttagcgtctgcatcagcttcacgctctggctcattagcctctttaacagcattctcagcctcaagtttctctttagcctgccttgcaattgtctctggatcattataagactggctctcctgttccttttcattcagcgcattaagcatattactaagataatcatcctgctgttcattatcagccaaaattcttacctcccatccaatcaaaatatactaaaatattatcataaatattgattattaacaacattttacaagttcttttataaactgtgctccattcatctcaaaagcacatgccctgtccccgatttccttaggaatctggtaaaatgtactgtgaacacgatacatcttagccttctgattaatcatcacaattctttcaaatggccatcttataacattagggttagaaaaatcttctcccagttccacaataaccagcttctttgcaagtgaggatgacagccatttattgtagaaatcccactgtttctcctcttcttcagcattattttcattgaccggacagacaattcttctttcattaagtccacaattcctgatcgtaccagctttatcagtagacacaataaagtaattcacatgttccatagatgcaaacagctttttcagattgtcatatatttctgtatcatcagaagaatatatttcttttcccaagccaaaaagtacataatcagcactctttatatcatcaattaaatcattataaatcataagtacctccatttcataaccatatgattataacatcttttgagagagttgtcatcgcttcagtattttgcacgggtggcgctccgcgacaatcctttttgcacgagcagcgatatgccagaactatgttctggcattgtcgcggcgctcctcgagaatctatataaagttcacagtttgtgcaagcacaactgtgaactttccatatcttctttcatcgctgctcgcgcaaaaaaggacaccgcccatgtcaggcggcgtcccataagaggaagtgtaaaatgaagaaaattatctgagtaatttatcgatttctgatacaagcagtccgatttccggctttgacaactggacatctgcaccaagtgattctccctttgctctcatctgttcattaataagtgatgagaatataacaaccggaatattctttaacttgtcatcagacttaataagctttgtaagtctgtggccatccataagcggcatctccagatcagtgataacacagtctatatcaagcggtacttttcctgccttggcatctgatataaaatcccatgcttcctgaccattatgacataatgtaagattatcataacctgatttaacaagtgaatcagatatcagcttaataagaagaggtgaatcctctgctatgacaatatgtgcttcacttcttggtctgccttcaagcttgagaatatcagaagtcttaagacctgtctccggacttatatctgatacaatacgctcaaagtcaagaataataataagctgaccgttaatcttaacaattcctgtggcaattccgttgtcagcagtacttattgttgtatctggagtaataatatcagcccatgatactctgtggattccaacaactgtatgtacatgaaaagcgacattcaatttgttgaaattagttataataaacatatccttcgaaatatctcctgaaggagcacttttaataaccttagcaaggtctacaactgttatcattaaatctcttggcatgaatattccttctacactaggatgtgcattcggaaccggtgtaaccggactatatggcacaatctctttaatcttggcaacattaataccataatgattattccctattgtgaattcaagaacctctaactcattagttccactctctatcaaaatattagtttccatattaaattcctccatgttgttcacgaacaacttctatgtgaagattataacagaaacatattaaaaaaacaatgaaataatgaaaaacttatcttacaggtcttataatgcttctgctgcacagataagttataaggaaatatcctccataaataactgctacgaatgccagtgtaagccctatagatgctgccattgaactcattcccatagttgcaagaattatgttaataaacttaattccaaacacagaatgaataagtgcgagaatcagtggaaacgcaaaaaatattccaatctgcttaaaaagcgccatatcaatcattctctcatcaaccccaagcttccttaacattccatatcgttccttattgtctgcactgtctgacaattctctcaaagcaagaattgccgcactgcttataaggaatataattcctaaatataaggcaataaatgtagctaatgctccaagcccgacactgctttcagccaggtcaattctggaattccagctaatgaaactcgtttgaaatgatatatttttcattaaattgtctaactgtgtttcaatagaatatctttcttccttagtatctgccctatagtcagcactaagtcccatattacgtacctgctgtggttttaccgcgttatcaggcacaacaagaatcccgtcattcatattctgaacaccaatctgtacaaaaccatccatgcattcactatatcttggtttatactcttttccattgacagataatgtaattcctttctttaatgcctgatttctaatcataaccatgttcttataatctgccactataatatattcatcgtcattaagttcatacgtactattaccatacagtcttgcaacagaattataatcgccaatagtcattaccggcataatagtatctgccataaactgataatcatctgttttaatatcccctaatgtatctttaactgtcaatccggtgttgtatatattatattctgcaacatccttaaaatacttctgcgcatcaaatccactgttattaagtgtttctattatacttaatttggaatcttccagcatttccctgtctttttcattcatatcctgtgatgtggcatatgcctcgctcatcgcatcatatgaatattttgcaagttgtacatcaacaggacacatactgtccagatcctttgaaagcgaatccttcattgaaagtgctgcagaaagcacgcttattgtaataaaaagcatgatacatataacagttgtcgagaatacagtagtgttaatcttgctgcagaactgccttaacacaaagctgttcacacctttataatacacactcttaatacttgtgaatattcttatcataaaacctgagactgaccagaatattaaaaatgttgcaacacaaccaagtgcaataggaacaccgattttatcaaaagtatttaaagttctaacaccccttgtaaccatccagtatgcataagaaagaatgccaacacctatgatgaatactattgtgcagacaaccgggttcttcatggtaaccttctcagttttcttacctgcattgagaagatcaataagcttacatctgctgatactgaatgtgttaaatatcataactaacacatacataattgcaaaatatattaaagtcttgacgcatgccttcattgagaatatgaatttaaacttagtcatatcagcatcaaacatattagcaacaatcacgctcataaactgtgaaaggattgtaccaataacaagccctgccacaagtgaaacaatgccgataagcagtgtctcaaagaaaagaatcactgaaatctttctcttgctcattccaagtgtaagatatatgccaaactccttattacgtcttttaataagaaaacggcttgcatatataatcagaaatccaagtatgcacgatacgaatacgctcactcctgaaagcatgtcattcatcagcttgataatatccatcacatttgctcttacatcaagcataacgctctggctgtcaattgcattaaacacataaaatattgcaacaccaagaataagagtgaagaaatagacggtataatcctttaaactcttcctgatgttctttaaagatatcttaaagagcattattgaggtcgcctcctaacaatgtcacaacatcaatgattttatcaaaaaattcttttcttgtagattcgcctctgcgtatctcattaaagattttaccgtccttgataaatatcactctgcctgcgtagcttgctgtaaatgcgtcatgtgttaccataagaattgttgccaaaagctcagtattaagaaaattaaagctctcaagtaacatccttgatgaccttgaatcaagtgctcctgtaggctcatcagcaagaataagctttggattagtaataatggctcttgcacttgccactctctgcttctgtccgcctgacatctgataaggatatttgtttaatacatcttcaatgccaagctctcttgcagtctgtcttactcttaattcaatctcccttgccggaacattctgtatagaaagcgccagtgcaatattttcaaatgctgttaaagtatcaagaagattaaagtcctgaaagataaagcctaactcctctcttctgaacttgttaagcttatttccctttaacttggtaatttcattgcctccgacatatatcttacctgtagtcaccttatcaagtgttgatatacagttaagaagagtcgtctttcctgaaccgctcgctcccattatagaaacgaactctccctttccaacctcaaacgaaatattgtcaatcgctttggtaagacttgatttgtttccataatacttttcaatgttatcaatcttaagtattgtttccataataattaattcctttcatatagattaattatgttttaccacttaactaatccggtgtcgtttgttcaatattacggaacattacatttttgtaacattactccggtactatgtaatgatactactaacaggttttattgataattctgccatctgatatctctataatctcatcagataactggtcaagttcttctttatcatggcatgcaataattattaccgctcctcttttcttctgttcttctaatatatcatgaaccttctcaacactgacatcatcaagtgcattaatcggctcgtcaagaataataatatcaggattttccataactgctgccgcaattcctaacttctgcttcattcccagagaatactttctgtaagttctcttatcatcatggtcaagtccgatatcttcaagtgcctttcttatctgttcatcaccaattctgttctgaatagatgccagcaccttaagattcttaaaccctgtataattacctataaatgaaggattctcaattaacacgcctatactttccggaaaagatatatcttttccaagtatctttccatcaatatcaattattcctgaatccggagtaataagcccgcatattgcacgcataagcatagtctttcccgaaccattctttcctcttaatccatatacctttccacctgtgaattccagattgatatcccttaatattggtgctttctttattgtcttattaacatctgttattttaatatacattttttaatcctccctcacaagaatatcttttttattaaatccaatcattccggccacatacacaacaatatacacgacaaggcatactgcgaccgactgccatacctgtattctctgtgcattatacacactgcttcttaccaccatagaattatttcctatcatcagcggattgtttataaatactgacataacattccatgccataactgcgagcatgccaatcatcggattcgtaaacatggagattgtcatctgaaccagtgctgttaccaaagaaacaacaaccggcattacaagcatatacactataatccacacgtttgccgcattatccggaacagatttattactaatcttttcaaaaagctcataattaatcttcatactcaggtttccattgcataatccatatacaaatgctgttgcatactgaattgcatatacagaaagtacagtcaggcagttccacagacatttactgttccaccacaatcttctgcttctgcatttcataagaaaatcaatccctacgccttcacaatcatcattgcaataactgtatatcatgaatggcacaagaaactgaatcagcatccacacaaaaggaaatacaatctttccctccttaataataagaacaggatcataaccgccctgaataaagaatatcgtatccatcattccgaattcatgatttcctaatattatcagcactccggcaagcataagaacaacaattaaatatctgaatctgtcagcatagaaccctcttgcaatatcatgccatataacgcctcttatacttttgttactcatcttcttttttatattcataatactcacgctttctttgaagaataagacctgcaataatcagaacagccataattaaagcagctatgccaagctttctggcgcactctccgtaactataccatgcagccccgaatataatcattttatgataggtaagcggtataaatatatctactcctgcaaatataataacagccacacctgatataacatctgacgaaaatattatttcaaatataattcctataaaacatgttatcgcaatcatcaaagccattaatatccagtaagcaaacattacctgtatgcttgtcacctgacctgccggcaatacatccatattcattaatttataacttgaataactgttccagttaaaaaacacatcaaacttagttgctgcatatgcaattgcagccagttcatatattaacgacagcactgccgaatacactatcgtacagatactctgccacagatatattcctgccctcgaactgtatttcagaattatcattggatctctgtcgcatttcatcattctctgattgcagacagctgctataatcatcatcagtggaaacacataattctgtgacatacaggtcaatacatctaatacacacggtgttcccgacgcatttctttgtaaagaccttaagaaaattgtaagcagaacttcctgggaaataactgctcctgcaagccagaacagcatttctgtattaacatatcttcttctcaattcattccacatattatttacccattctcacatacttacccggagttactgagaaatacaactgccattcttctttgttcagcttatcagcatttatgctgtgaggaaatgatatgctgtggataaggaaaggtatatctacagtaatgctcgtcccctgctcaaacttagaaaaattgacatctttgttaatttctcttatataatcattagatattccctgtgaaaaagctcccgatgccagtctgatatctgcataaggaaatcctttcatctctcccgttatatctaaagtacattcagcaaccatcacatataaatcatcctgctcatcacttatgtcttttcttttatcaattccatactcattcaaaaaatcttcaattgacataaccttataactgctgacagatgccgaatatccattcaattcaaccgattcattaagctcatattcagttacacttccctgtggatacatcttattgactttaactatatagaacgctgccactcccgccaatatacatactaacgctattattaatattttcttcttcatatcagattgcatcctttcttctgcttcgtacaaaatacgatactgttatcagcactattaacatcaccatatcaattatcataaatttcagttcagaataacgcagtttggatgctgtcagatattccatagggccatctcttccaatagatgaacaaacaatataataaaagaaatacatcatgaatggtgtaagtgcgaccataaacctgttatttacaaggtctgcaaatatgtatgcaatacagttaataagtccaaatcccacaaatgcaaataaaaatactataacagccattgcaaacggtgctttaaaaaataaatctccaaaaactgacagttttgagaaattaaactgtgagctgaccgattctggcttaaaagctggcaaaatcatagctgtcacaacaaatgatataacaagcggaaagcttgccacaaaaccacctactataaactgggcaaaaagcttcgctttgtaatacttctttttatcaattcttgtaaatatattattaacataatgcttcttcacatccatcaatatacttatagaatatggcaatgctgtcagcagcggcataataaagtaataaagaaatacataagaccccggtcttactcccatccacttcatatatagtcccggaagctgtataccgctgtattttcccatctcaagcagtttatctaatgtttttcttgcaggaataatctcgttccatatattaaatccaacaataactaatcctattactacagatattataagcatcttattcttaaatgctctttccatttctattttaattaatttattcattttctcctcccggttcatgtatgattgctaatggtcctatatatggtgatgtcctatcatgaaaactcaaagcaattgtgtcattttcaacctcttcgtctgtaaatatacaatataatattaatttttttgtttcacctttttcaaaactgaaatatgtttttcccatttgattggcttctgcatcagagccaaccgttcctgcatttttaataggcggatgtgttccatcatcttttaaactttctatataccaaacagtctgaaaaatattatcatatacaccagatgtttcgttatcatcaacatccttagttatttctaattctactgctgcatagtaataatctgatataaagttattattactatccatgctagccttcttattttctaatccataatcaatcctatttatatcaaagtcacactgtctcgatactttacaatcattaactcttacatgaaatatgttataagtacttctatcattttcatcatatttaccagatgtcaaaatatgcaattttacatcgaactcttctccatatccagcaatttctattccttcatatggtttactttctgtagaatcatttttaacatttactgtagtcttctctgtctcttcctgacttgttgcaagtgtcggcatttcttttgtcagcttatcaagcgtaccattcttaacccctattagaattgacaataataatactgctataactgctatacttattactgcactttttattttcttcttcatatttctccctttcaagtaagagattgtataccgttatctgatatacaatctcttttctagcagataattatatcagattctatacactgtctggactccataaaaaaccaactgaatattcagcccctgtattactttcacactttattgctgctccatcatatccattttctttgacatagttatacatccatatctcatctcctggaaatacatcataatcaatcagatcaaaatcttcatagtaattatgagaatcattaccatctgagccaacaagtgttgcattaaatgaataatcatttgatgaataaacaccttttatgtatccacaagatgtatcttgtttgtctcttcctctggtataatccagatactcccccgcagattcatcaaatgacatatgggcatactcatctttgcaattattagcccacactacacctccaccaattgacattaccattgctcctgctgcgaccactgtcatcagctttcctgttagtttctttaaatccataaagaaatcctccttagattttaatcagatacataagtacctgtctgcttcaatgtatcttttatatttatcaatttcaatagcccatgcacaagcggtcgtttttttgcacaagtggtaactatttcataaaaacgctctatctaatttgcctctggttcatgtatgattgctaatgttcctttgcatggtgacccctcaatataaaaatctattgctaatgtttcattctcaaattcttcatctgttataagatagtataatgttattgttttagtttcacccttttcaagatgaacatttccatgagtattgtctgaacttgtcccaacattttcataattttcaattttattatatgtaccatcttcattcagttttacagaatgccataatgtatggaattcattatcattatctaatattatatcattatcattaatatctttagtaacctctaactctatcattgcatagtaataatctgatataaaattataatctgcatcaatactatctttcttatcgtctagtccaaatcttattctattcacatcaaaattacattctctggaaatattaacggttctaacagatatataaaatacattatatgttttccgattattttcatcatatttatatcttatatcatcatccctcaattcaaactgctgacctatatacgccacatctcttttacttaagttttcttctcttgcagaatcattacctgtattgttttgattttcattttgtatatttgtctgttcctgttttgtttcaagtgtcggcatttcttttgtcagcttatctattgttccattcttaacacctattagaattgacaacaacaatactgatataatgcctatactaattactgcactttttattttcttcttcattttttccctttttaatcaagagattgtatattattatctgatatacaatctcttttttacaaacaatttaatcagattttatacactatctggactccataaaaattttactgaatactcacttcctgtattactctcacatttaacagctgcataactatatccattttcttttacataattgtacatccatatctcatcacttggaaaaacatcataatcaatcaaatcaaaatcttcataataattactatatctatcagaaccaacaagtgatgcattaaatgaatacccattagaagaagattctccttttatatatccacaagatgtatcttgtttcattctaccacttgtataatgtagatactctccctctgcctcattaaatgacattctaacttcagtatctgtgcaattattagcccacactacaccaccaccaattgacattaccattgctcctgctgcaactattgttgtcagctttcctgttagtttctttaaatccataaagaaatcctccttagattttaatcagatacataagtacctgtctgcttcaatgtatcttttatatttatcaatttcaatagtccatgcacaagcggtcgttttttgacacaagtggtaaatatttcatgaaaatgccctatctaatttgtctctggttcatgtacgattgctaatgttcctttatccggtgacccataaatatgaaaatctattgctaatgtttcattttcaaattcttcatcagttattagaaaatacaatgttattgctttagtttcccctttttcaaaatatacatttccatgcttatccggtacatctgaaccaacagctccgctattactgatacgctgtaatgttccattgctatctatctttcctatataccacattgtctggaacatacttatttctccatcaggcggtacatcatgatcattaatatctttgttaacatttaatttcacagttacataataatagtctgatatgaaattattattatcatccatgctgtcttttttatttgtcaaaccataatcaatcctttttatatcaaaatcacattctcttgatatatctactgactttacggttacattgaaaacattatatgtatctctattattttcatcatatccataccttatatcccaatctattaattcaaactcctgtcctatatttactatatctctttttctagaatttcttaccctagcagagttgctactgctttcatttttttcagactcgttttctgctgacttctccgtttctgtctgacttgttgcaagtgtcggcatttctttcgtcaacttatctagcgtaccattcttaacccctattagaattgccaataataatactgctataactgctatacttattactgcactttttattttcttgttcatatcttctccttatactagaaagactgtacattgaatttcatcaacatacagtcttaatgtaattccctattcacttcttttcaagaacatatgcacaagcggtcgttttttgacacaagtggtaattatttactaaaaagattagctgatttaattttcttctggttcatgtacgattgctaatgttcctttgcatggtgacccataataatgaaaatctattgctaatgtttcattctcaaattcttcatctgttataagatagtataatgttattgttttagtttcacccttttcaaaatgtacatttccatgagtattgtctgaacttgaccctacattttcataatccttaattttattatatgtaccgtccttattaaccttaacactagtccataatgtttgtaaattattataatcatctgcaaacatttcattgtcattaatatccttggttacttccaattcaaccgtcatataatagtaatccgatataaaattatcattattatccatactatctctttttgtactcaatccgaaatcaattctattaatatcaaagtcgcattgtctagaaatattgacgctcttaacagttatataaaatacattataagtttctcgattattctcatcatatgtatattttacgtcattatttcttaattcaaactgctgaccaacatttgctatatctcttctgctagaatttcttattctcacagagttactgctttcatttttttgagactcattttctgctgacttctttgtctcttcctgttttgtttcaagtgtcggcatttcttttgtcagcttatctagcgtaccattcttaacccctattagaattgccaataataatactgctataacgaatatacttattactgcactctttaatctttttttcataatatttccttttcaaatcaagagattgtatatccattatctgatatacaacctctttttacaaacaacttaatcagactttaaacactatctggactccataaaaactcaactgaatattcagttcctgtattactctcacacttcattgcagctccattatatccgttttccttgacataattgtacatccatatctcattacctggaaaaacatcataatcaatcaaatcaaaatcctcataataattatgagaatgattaccatctgaaccaacaagtgttgcattaaatgaatagccattggatgcactttttccttttatgtatccacaagatgtatcttctttatctcttccttcagtataattcagataattacctgaaacctcatcaaatgacatacgtgcataatgatctgtgcaattattagcccacactacaccaccaccaattgacattaccattgctcctgctgcaactattgttgtcagctttcatgttagtttctttaaatccataaagaaatcctcctttgattttaatcaaatacataagtacctgtctgcttcaatgtatcttttatatttatcaatttcaatagcccatgcacaagcggtcgtttttttgcacaagtggtaattatcttgttttaaaaaacttatttaatttgcttatggttcatgtacgattgctaatggacctataaatggtgaatttttaaggctaaaacttataacaagtttatcattttcgacttcttcatccgacaatatataatataatgttaatgttcttgtttctcctttttcaaagctaaaatttgtttttccaatttgattagtttccgcatcagagccaacacatgcactagttttaaatgactgtgttgttccatcgctattcaattttaatatagaccaagtcgtctgaaaaacattcatataatccatcacatcattatcatcaatatcctttgttatctccaattctactgttgcataataaaaatctgatataaaattattgttttcatccaaactttttttcttattatccaatccaaaatccaacctgttaatatcaaaatcacactgtctcgatatcttgcaatcattaacttttacatgatatatattatatgtagttctatcattttcgtcgtacttacggccatctatttttctacgtattacaaactcttctccatattcagcaacctcgattccatcataaggtttactttctgtagaattatttctcgcatttaccgttgccttttctgtctctgcctgatttgttgcaagtgtcggcatttcttttgtcagcttatctagtgtaccattcttaacaccaattagaattgccaataataatactgctataacaactatacttattactgcactctttattttcttcttcatatcttctccttatactaaaaagactgtacatccatcaatgtacagtcttaatgtaattccctattcacttgttttcaatagcatatgcacaagcggtcgttttttgacacaagtggtaattattctttatctttcttaacatatttggtcgaaaggaatatatgacatgttacctttccttccttttcctcatacctgatttccccattatatttggcaacaatatcccttatgctcttcgtaccaattccatgattattcttatcaagcttagtagtcaggaacggattctttctgttaagaaatgtttctttaacaggattctccacatccatgaatattccacccctgcttgttatctcaacattgacatacggatcactgcattttgctgctgcctcgattgcattatcaattacatttccggcaagaatacacatatctatatcatcaatcagtccaacctgaccaagtaccatacatgtaaatgctatattctgcttttcacatttatcactcttatcattaagaatatagttgagcgttctattatcacagtattttctataagcatatgagttgattttctcactcattatattctttaagaaatcttccgccttatcataattgttgtcatccatataaccaattgcagaactcaggcactgcttaaggtcgtgtcttaactttctgctctcttcatacattttctggacacgttcaacctcaaactgttcatttgcatattccattcttttattaatctcctcagtcctgttaaaaaagtcctgcatccaatgtccgattatttcaaatgttaaaactgtcacaattaatattccagcggtttctacaccatagttatatgtatcatatatgcctgttccaaagaataatcccgccaacactgaacttacacatatctgtatgaacatcatttccagattatccaattccctgtattttataattattgcagacagatagactacaaacatatataattccacaatcagatatataatacatattgctattatatcagcctgattagcagataatatggctattccgatacaatttatcagtgatatttccagtattaccttaattgttatctgttctatatactgtacaatcagaatggcaatgataatcattagttccattatcacccattgattaattccataatatgtcattatatagactgctgcccctgcacccactaacagaaccatcttaatcacatgtattatattatctcccgtcaacttccttatcttgtccataataaatattacacctgtattcattacacacaggaatacacatgtaagcactatattaattatatccatcatacctgtttcctacctgttattatcaaacatgaattttctgtattcttctatgacatctttcttcctgcgcctgcttataggaacgcgctcgttattatacatcacaaatacatcgttatcttcatcaatgctcttaatatatttcatgttaataagcacacccttgcttgactgcacaaatccatatttttcaagttctgcaacatgcctggtatatgaatctgccaataatatttctcctttaagacttttgacgcatatcttccttttctgcgttgcaattgaaacaaccctgtcaacatagaatttctctccacccagttctattacctgcctcatctttatcagtttatcaactatctttaccatcattcttgtaaattcacggtcaaatctgtctttaactatatacccaagcggtctgaatctgaatgcttcataaaccagattctcatgagatgtaacaaatattataattgcgtcattattcattaatactatctgttccgcaatatcaaatccattctcatcgcccagttcaaggtcaagaaataccatatcataagcattgtctgaataattactaataattgtctgaccgtcattgtagatatccacctgacaatcttctccctgaaaatactgcttaaatacatcttttatagtcgtccgttccttctcacagaactctctgttgtcatcacatactgccactttcattgctgtctgttatctccttatagaaatcattcttataaaatgtaatcttcacccgtgtatattcgcccttaactgactcaatgcttaccttagagcctaatttgtcacacagcttctttacaatataaagccccattcctgttgccttggagaactctcttccattctcccctgtaaatgatttgtcaaatactctcggcaaatctgacgcatttatgccaattccattatccagtatttcaaggacaacacattttttatcctctgctgccgacatctttatatacgactctgtctttgtcttatccttgtactttatgctgttattcactatctggttaagcatgaattccatccactttgcatctgtaagaacaatcctgtctgcattgctcacttcaaatgtgatatcattttcaagcagatcatccttattctttaatgctacattacttataatcttagacagtctggcatcgttaattatatagtctttttctgcattttcgcttctcacataataaagaatctgctcaatatagttattgattctgcgaatctgcgtattcatcctgtccgcaaattctttatcacatttatccatatgattatgaagtataagagtaagtgaagctattggaagctttatctcatgaatccacatttcaacatactctttgaactgctccattccaagcctgtatcgtttaacattctccgtcattgacctgtctatgtcactcacagaatcatagaaaatctgaccttcatagaaagccggtctgacaagtgtctctgtaataagatatttttcttcaagtgcagctatgtttgcctccagttcgtcatagaacttctttctgtggtaataatctgccagcacaactgcaatatagcatattatcattatacatatttctgcgattatcaactggacagacaccttgaatgccgccatcataagtacgcttatgataagcattgccacaaatatgcacattgaatacagtctgtctttaatatattttcctgacttcatacgagaatatatccctgtccctttcttgtctcaataacatcttccagaccaatatctttaaatctgcctcttaatctgcttatattcacagtcagtgcattgtcattaagatactcctcattgttccacagctcagtcataagctcatctcttgaaactatatgctccctgtgtgataacagatacatgaatattgtcatttcatttttagtaagagttatctcttcatccttatacttaattacacccttgtgtggcagtatttccattccacggtaagttgttgtattatctgacttcgcaccaagcctcttaaatactgcattaatccttaacagaagtattgtcggattatacggctttgttatataatcgtctgccccataactcatggaaagcacctcgtcagcctcggaatccctgcttgtaaccataataaccggcacatctgatttactccttaactgctgcaaaagcatttccccattcatatacggaatattgatatcaagcagtaccaggtcaggctctgcagcaataatactgtcacatgcatttttaaaatcagtcagtacaaccgcttcataccctgaattttccagcagttccttaagctccctgcttatatctttatcatcttcaacaatcagaattctgttcattataagttcctcactgcattttgatataaatgtattgtaaactgtttcactaaaaaaagacagagaaaactcaaaaaggtttctctgtcttgatttacactgttcctaaacgcccaccgtgttagaagctgtggccgccgccacttcctccaccgccgccggatgagcctcctccgccacctccgcctgacgaaccgccagaacttgattctcgtggagaatatgtttttgtctgatgtgtaaatacaacattacaattattaaatgccctgtactcaaacaatccattcataaggctctttgttgatgccttcctctttgaggagtacacacgcacaattatataattaatgacaactgcaataacaaccgcaagcaatgcattacttatatatttcattggctgtgcaatctttcttccctgaagcagcgtatattcctgctcatacaccttcatcgcacatatataatagtctgcatcagatgcataagtatacacattgtcagtaattgtttctgcatatgccttattaattgtcctgttaatagcaccattactatgtatccatatatttctgttatccatatcaataacgaatatcgttccgctctcagagccatatttttctctgtacaaagacttaatataactctctgtcgaagtgctgttatagcttatagagttaaacataacattaccataagtggtaattaatttcatcttctcaaggagcatgctcttctcagcaactgataaaagaaatgcatcatcaacaatcactgcttcatagcctgtatcctgattaacataacagaaatcctgattagcataatcctcaacctcatagcctgtatcagcgtatactctgcttcctgccattatgatacttagaactgctacaagaaaggtcagtaaaaatgttattttcctacgcattatcattacctcccttataattatcaaactgtggcagtcttcttgttgcaagcacattgtagtacttaataagctcaacaagtgtaaacatcaacgaagcaagcacaaatataactgcaccataataaaaaaggtcagataccggattaataagcagaatcagtgttgaaacagccaatgctacaagtgcgcctacacttccaggcacattttttcctcctgatacttctttatatgtcttgcaattaccaagcgtaataataacgcctatagcaaaacatgccgcactgacgaaaaaagaggaacccactgaaaatactgcactaaatatagaaaaagcaaacataaaattaggaattccaaccatgcatattgcaaatataacaacaaccttcaacaatggtgccattttatttttttctttcttacttactctgttaatccttgcattatttctgccatcagccatctgttttgccagattatcattatctgttccggctttatatctgcggctggaaagctttgattcttcccatgagcctctatcatcaagcttctggtcccgtctctttatttttcccagttcaaacacatacaatataattgtaatcagtgctattacagctgcaacattaagtgttaccttcggtcttaatgtgaagaacatattgagtaatataaatattggaacagccagaagtgctgacccagcaaaatatctgccaatagaaaccggtaaatctgccgatacttttccagtctgaccattgaccgttgcatatgcaactctgtccctgttcctatacgacagaaaccacactggatacaatgtcctgtcaacagactcgattaccgcattacattttgatttaatagtactttctgtttcatgaagtgatacccctccgagcgggatattattggatacataatcatatgtctcttcaccagccatatcaattgcatcattcatataaacatcacaccctacatctgccgtatcagcataaaatccgctaagaaatgccggcgtaaatcccgccatattcttaacatcatacggtgcaatcgcctcacttatattatcatcaaatgaagatgacgcatcaaacgatattcccttatactgacagtccatatcaccgttaatattaaagtgatccgtataaatgtaatctccccgtcttttgcttttctctcctcttaatacaacaggacctttctgtgatacatgataagcccagtatggcatatagattcccctgaaaccatcaatatatttttcatcttttaattccttaggtgcaaaccatgcacgcttcatcatcttcttatattgattcttacaatcctgcttggttttgctgaacggaataatatatcccggacggagttctttggaaattctgctttccagaactgtagatgctccacagaagctgcagaaatcagcaatcgtattatctgtactcataatttcaccgccacactgcggacacttgaataccgtaacatcatactccttattttcttcagccgaatttccttctccaagcttatatggattataatgtgtattacaatgctcacataacatcgactgtgacgatatatcaaaaattaaccgtccgccacaattaggacactgatacattcattctctcccctcatatgtaataacttaattcaaagttatgctaattgtagcacccattattactcttttcaaacccacatttagtatgaaaacgcacaaaaaaagcaggtcatgcgacctgcctgtatacattatatttcatattgctctttcaaaactgcacattaaaattctttcatccgattactcttaagaataactctctttgttctatccaaaccgtcttaaggaagatgtcagcaacactcctgagactatttttgtactgactaatttcaaaaagcattttggggcttcatgtatcttgtatccagatgtgttgaagaatttctgtaaagagaaaaatatggatggtgtatacatgattccgtcttctgtacatgaatttctgctactggtaatggataaggaatatgtaaattgtgactatgttaagcaaatgattaaagaagctaataaagaaaacttggagaaggcagatatactgtctgacaatctgtattactataacgccgtaaatgacgctgtaagcattgtgaaataggaggctggcatgaaatatacatttaggagtgaaaaagagcttcaaggggctatacaggcttctgcagacattccacagaaggtgatagataatgcagagtatcacattggacttgtagaagaatgttttgaagatggtgcatgtggaaacttccatatactgacggatgatgatggtatagatagtgatacatacaaggattgtctcagggagtataacctgattgaaggtgactatgagtttgacgacctgatatgtgcggaaaatggttctgagtggcatataagggcattcataggtacagacgcttactggggtttcttttacaaatgtaagactaaggaggtttgctatggaaagtaagaaagaacagttgataacagaagttgtctatcagggaaatcatacatatgagattaagaaaacgatagatgggtttaaaggtgataaagcaattcttataggtctgtatccgacagttgatggagataacattacaaagattgatagtactcagttacatctgattaatcatatgaaagagcttggattaaatgaggtaaggattatgaacctgtattcagaagtgtttgacagaaagcctactacatcacaactgacatatgacaaggaaaactttgagtatattacacaggctgtcaatactgcaggagagtacaagctgataattgcatatggcagttcacacagcagtaataagaccactaatactttaaagaagaatctgcttgaagctatcagtaatagtaaggctaaggacagagtatatcagataagttctgaatatattgatacgattggttcagatccgacacatgtactatacttaggactcagacatggggatgaacaatggaatcttgttccattagatgtaaatgatgaaatgctaaagatatcagcaagacttgttgagaagaatcctgatgataatactgtcaaaagaagaatcagaaagaaacaggatgactaatgaggaaaggaagtgatgatgtatgcagtggttcggtttaggattgtgcgttggaatagcagtcattgcagcaaagctatgcagttacactatataagcatatcttacaattttgtaggtgatgtgattacgccaaaaattgtaaagaagcagattcagtcatataacgaggatgaggtaaagaaactctttgagctggtagacaaggacgcaagtagtaatgtgaaattgttgatatatcttgctataacaacaggaatgagaaggtctgaaataaacgcactgacatttgacgatgtagacctgaaagagaaaactataaatgtcaataaggcaagggtatatcagcatagaggtaaatgtgttttgaaagaacctaagacggcgagtagtgtaagagtgattcctataacggattttacagataaagagggaacatatcacagagccagtaaagagatcgattgagcgatacggcaataagcccgaaatgctctcgcttatcctgaatatggcaatagcagagctggtactgcttatcacaaaggtgcttgaggctataagaggcattcacagcaggcagcagcgtgaaaatgctcacgaagataaaaacaaagctcaaaagcaggacaacggaatacttacagcagatgtgttaccgccagagcctgttatgataccggaagcagccgcttatccgaagttaaaaaagataaagacagaactggacagccagaatgccattatctttgaagctgagaaactaagaggcagtcttgaaatcgaaatgtcaaacttaaagggactggcgaagctcaccagaaaaggcgatttgcagagaaagattgacgaaaagacggattatatcaaccgattaaaggtaggactctcaaatatggttcgtaatagcggttttgaaaacatgaacgagttcctgctgacattcagagaatgcaggaatgcttatacggattatcagagacaatacgaaagctggaagaatgcctgcagaaaaccggatacacctacgcataaggatgaaaaactgtcggataaacttgcaagactacaaagggaagccgctgaaaaccagaacagtatcagcaggcagacaaaggacagagggggaagataatatgctttttgttttatattcttttgacggaattacgatagaatattggaacttagcatgatataataatagaaaatttttaggaagaggtgagaacgatatgaaaattatccgaggtaactactcagtacagttgatgtaaactgttggcagattgtgctgaggttaaaagaaacttgccagtagtcgttgactgtactgccctgatgcttgaaatacaatatgtaaaggagtacagttatgcgttatataaaagaaatattaaagaaaaacagcatatgggtattggtctacattggactaggtatatttaattcatttgtggctaattacaaggttgactattttcaaaaggttattgatggattggctgatagaacacttgcatttgcaggagttgcaacatatggttttattttgctggtaaattactgtatgaattatctggataattaccctgaaaagaagttggaacatggtatttatctggattttaagcttttgtcacttagaaaaataagtacaatcgattatacggaatatcagaaaataggaacgggcaaacttgttcaaaggattgagaatggttcagcagcaggaagaaatgtattattcaatttctggttgtgtttgattcgtgacttacttcctaccattagttttagtatatactttatttggaaaatagatgaaaaagtcacttatgtactgtttgtaggctatacggttatttttataataaccaacattctattgaaatttctttacaaaataaaagaaaagattttgaatagtgaagaactattaaatcactatttggtcagaggctatatggaaatgttggtatttcgtatgagcaaacagttcccgagtgaaataaagaagacttgtaatgcaaaagatgatattgtttcatcaaaagtaaaaatgaatatgattcatgaagcattcttcacaatatttgcactacttgtggcaatgttagatattggtattcttttttatgcatggaaaacgaaaaaacttacagtaggttctgtggttgcactaattgcactgattgaaaatgcttatacgccaattgccatttttaatgtactttatgtccaatataaattagacaaggcgtcgtataagagatttgaggaatttttaggcttaaaagacgatgttcaattaagaaacggtaacgaaataaatacaaatgttggaaaaattgcaataagaaatttatcattccaatatgaggaacgaaaaattatagatggcttgagcctgtcaatacaaaagggagaaaaaatagcttttgtaggagaaagtggttccggaaaatcgaccttgattaggatattattagggttgctaaaatataatcaaggagaagttcgcttaggagacatggagttaaaagaaatttgtcttaataatctgtatgatagagttagttatctatcacaggatgcccctgtttttgacggaacaataaaagaaaatctggtatttgagaaacaagtatcagaagaacaaatgctggaggcattgagtgaagtgcaactatctcatttagttgaaaatcttgcggaaggtttaaatactgaaattggtgagaaaggtacttgtttatcgggtggagaaaaacaaagacttgcattagctcgcttgtggtttgaagactccgaacttgtcattttggatgaagcaacatctgcaatggataatttaacagaagaaaatgtaatgaaatcagttatgcaaaaaatgaaagataaaactgtcattgccattgcacatagattaaattccattgcaggttttgacagaattattctctttaaagaagggaggattgttggacaaggtacttttgaagaactactacatacagattcttattttatggacttgtataatgcgaatgtgaaataattgttttttaggtcgaaacttgtaaaaatacaaaggggctgttgctattgcacttttttaattgttagagtagcagtcccttagtgtacttaaagttcaatagagtcttctgcgtttacccatatctgcatagttccatccagatatagttttgcatattcaagaggttcatcaatagcaagagcatttaatgcacactgagagcatggtgtagttttaataccatcttctgccttgttgcagtcaatacggagcatatatccggcacaggtgtaaatgtctatgctattccggtacatattgtattctgcgtaaataatattcatatcgtgtctccttcaaatcaattaatcaaaataagaaattcagaagcatttcaatcagttcaccatgtcagttttattttgtgttatactgtgttatatgattttgtttcccttgctttttcccttaccagagtccataaacactgatggaacgatataacacaagggaatatataagggaaaacacacttgttacaaacttagtattttcaatggtttgtgagaaatttgataacaaaatataacagttattaaatttcttagaataggtgaaatctcaatcggaagttgtggaggtatagtatggaattcataagtaaagagaagatagttgaattatcaaatccaggagttgtttcaagacaactattaaatcctgaaaattcatcaagtgaaagggtgacaattacagaggttcatcttgaaataggtgcttgccaaccaagacatacacatgatgcgtcagaacaaatttggtatgcaacaaaaggaacgggtaaactattacttgcagatgaacaagaaaaagtgtttactgctggggatgttgtaagatttgcagataaagatgttcatggtttattgaatgatggtaatgaggaatttgtgtatgtatcagtgactgcaccaccaataaactttggatatgcatataaggataaaaaatagacaaatttcagtttgtaacgaaggtatttgcgatgaaaggaattaacattgagttattggggattgcaataatacctttaggaattgctgtgacaacaaataatttttggggatatgtcctaggtgttcttggatttggcgtcgctgtagttggctgttttctaaaagataatcactaataacttcttgtttgaaaaattgagaaaacgtaatattgaacaaaaaagaaatgcacagttcttagcttatcgtgaactgtgcatttttgtaaataaatgcttttaattagccgattatggcatcctctgctgtaaaatgttccagagaattttcttttacctgaatgcagatataagtaattccagaaatatcggatgcaaaaaactgacgctttgcagcaggtgcgatttttagccagtctccagttgaaagactgatttcttctccatcaattatggctttgccgttacctgaaagaattccatagatttcttcattttctttatgagaatgaacaaatgggacatttgctcctgcaggtagttcgtttaaactgatttctgcacctgttaaagacaacttttcatgcagctcaattcggttttcctttccaatagttgtttttgtgtaatttgccataataacctccatagttaatttgtagtttctggttgcttggcattagtatagtgtgagacacatacaaaaacaagtacgcacctttttgtaactgtacactcaaaattgaatgtgttacaatagactcggaggtgagaattatgcgagcaaaagaagaattaccggaatgcccagttgcaacagcagtatctcttatcggaggaaaatggaaactgctgattttgcgtaacttgaaagagcgtccatggagattcaatgagctacaacgaagtatagatggtatttcacaaaaggttttgacagatagtttaagacaaatgatgagtgatgggctggcatatcgccacgattaccatgagcagccaccgagagttgaatacggcttaacggaactcggaacaaaaatgcttccaattgttaattcacttgctgactttggtaactactataaatcaattattgaacagaattaaggacgttagtatttgaaaagctcgaacaattccagtttgtacattatggagaatattggtgtgaaaaataagctcgatagcttattttatcacacggctatttgtttatgagcagaacaaatagccattgatggcagaggaaaattgcctgcacaaattttttttcgccgcttcgcaacaaaagttgctcagaaatggagattagaatgaagattaatgaatatcaggaattggcaatgacgactttaaatctggaactaagcaaaagagatgtattaataaatagtgtaatgggattatgtggcgaatcaggagaagccattgatatagtaaaaaaatggatggctcaaggacatgaattggacaaggaacatttggcaaaggaacttggagatgtagcttggtatttggcagaagctgcgacagcactagatatatctcttgaagatatttttaaagcaaatatcgataaattaaagaagagatatccagatggatttgaaacaaaaaaatctctagtgcgcctaaaaggagatatataaattcatcaaaatataatagtataatcattattgaaatttcgggcacttttcaggcacttatttcgtcaataagcattacataaaaatcattacacaggctatcggctcctactggactagtgccataaaggagacctaagaaagccagtgtttaagcggtctcacggcttcgaaccccggtgggctcattaagatgggaatggttgaaaaaccattcccttttttcttttcgtgcctactgactaggaggggaacggtcgtcttgtgaagaaattcattctttattatttccatgcattaattattgtaattttgaaaacccgtataaacactgggaatgtttgtaggcaagttgggcacttttgtggcacttggtgtctgggggagtggaatgattgagaataggagatttaacttggttgagttttatgttaaaatggggaaaatgaatcgcagtttgtaaggaacagaaactttggagtttacggaggaaagaataatatgatttttcattatgcaggcaaatataatggagacgaaaatagtcttccatacaaagagcataatcctaatgcaattccatttaaagaaccaaaggatatgaagaaatattcgcttattgcaaatttaggatgcgttttgataatgattgtattagtaattccattcttgcttatgggcataaaatatattcctaatagcaaaatacagatggtggcaggaggaatttgtggtggattgtctatgtttccgcatgaattattgcatgcagtatgctttaaaaaagatgtatatatgtataacgacctaatacatggtttgatgtttgtagtaggaacagaagatatgagtaaggcacgatttattttcatgtgcttgtgtccaaatcttattctaggcataattccctatattttattcttgatatttccacaatttgttggggtaggcttatttggaattatttgcattggaacggggtttggagattacttaaatatttacaattcaataaggcagatgccaaaaaattccaaaacatatttatgtggaatgcattcttattggtatatgtaggaatatgcagcttccagcttatagaacatattatacataaatataacattttagaaagttaaattaacaacagataaacatattagtataaaaatataataaggttacaatgcgaggtttaggtactattatcaatgtactttgggcacttttcaggcacttatttataaactaataatttgataaaaacgattagaacaggtaaagtttttccattttcatctagaaaggtttttagagtttatgatgcatcatattctgaaaaattggttcataaagaattagcacagtatcgaataaggaatgatagagaattttttatattatcatattcaaaagcctgtgaaatgatagagaaaattttaatagacaataatatgatgtattataagtatgacaataaagagaagtaggaatttgagtattagtttataccattatatttacagatacaagtaataaagagaaaatagactgcatggtaatcaacatgtatcggtatctatcttttgaagaattgtatcagcatcacagtaaagtatccattggatataacaaagatgagattgcaaatccgaaagaaatgctcatgtattattctaaagaaatgatagagaaatatggtgttgttgccattgaaataaaagttttatagcttcctgtttatagattacatcttacagaatatccgtaaatccaccaacatacaactatatataataattttgatacaaagaaacatagcaagtactcgagtaataaaacttaaatacctgctcttattttatttataggaggttgtcaatgttattggtaatggatgaggattactttaccggggttcgaacccagtgggtttatttattctttattaatttttaaaataggtttatgatagaatcaatttaaatacagaggtgatatgaattgattataacagtcatagcgatattgatagctgtacttattattatcgttgtaactaatattggtaataatagtagcggtaataataaaaagccacatacttatgaaccgtgggtgattgaagcacctgaaaagcgggctggtcgtcggggagaacatatagcgacagaaatcattaagggagtacttcgtgaaggagattatttattcaccaatatttctgtatcatacgatggaaagcgcacagaacttgataatgttgttgtaaataaatatggtgtgtttatttttgaagttaagaattacaagggtcaactttatggcaatgaggatgattataattgggaaaaatataaagatgacggatatggaaatacatttgtgaaagaagtcaaaaatcctgttaagcaggtaaaaaggcagatttatatccttgcgaaatatctggaaggctataatgtgtgggttgaaggatatgttattttaatcagaagtaacagtccagttcaaagtacatatattttgcagagtgtcgaagatatcgacagggcaattcatacatttaaacgaaatcatctgagtagggacacggttgaatcaattaagaagatgcttgtataatcattgatattgatttacggatattgtatcaaagacagataatcagtctcaggaagatgtcagcaacactcctgagactatttttgtactgactaatttcaaaaagtattttggaaaatgattaaagagactaataaagagaacttggagaaggcagatgtaatccctgacaatctgtattactataacgccgtaaatgacgctgtaagcattgtgaaataggaggctggcatgaaatatgcatttaggagtgaaaaagaacttcaggaggttatattttggtcgcttgtcagattaaaaaaacatcactattaccaacatcaatattaacattattaatatcggaggtaacatgatggatgtccaaaagaaaagaccgccgccttgtctatgatatcttgcttcattgtaaacaatatctagcaccatccatacaatgttgtacaatgaaaatcctaatataaaactgcgttctacaataaacttacttgttaaagcaaaatacactgaaaaaacagtatatgtaatgcataaaccaaatgcactattgattaatattgccacaaactttgaatacattttttactccttccattctctttacacatatatcgttggaaattattatagcatggatttggacaaatatcattcaactgttgtgatattgccttaataaacattattatgattttgggcacttttatgtcacttggtatcagtgggagtagaatgattgtaaatggaagttctaacttggttgagttttatgttaaaatgggtaaaatgaattgtaatttatagagaaaagcacatgttaaagaatctttgcgtaactatatatgcaatgtaatgtgatgattgctttattttgaacattatttttcggataatattattgaaaggaggtcgtaatattatgaatataggaaatcaaatattgaacattcggaaagaaaatcaattaacacaagaggagtttggcaatttgctatttctcttgacacattactaaaggaggattcgaaaatgatacaatctatggataaagaaagagcaatgggcataataaaacacgaaaaatcaaagagtgacaaaaaggtagttcaatatattaaaggacatgattaaatgaatttaataagggcggtcctattgtgcagcatgtgtgagaataaaaggagatggcagtattatgaacaaggcatatgagcgagaaacagaaatgtggaatcaggtatttaaggaatgtacccctgtggatttaagaactttagatttacaagttgaaacaatgtttgacgaagcgttaaagctgtttgcacaaaaaacaacaaatgtattagattttggctgtggtacaggagatatttcttttcaatatttgcagtatcagcctacacataaagttttaggaattgatgcttcaaaaacgggcatagaatttgcaactgaaacagcaagattaagtgattataaaacggcaacttttcttgaaggtacagaccatacggtaaagcaattagaagaaaattcatttgatggagtgatattatcaaatgtgttggatgtaatgccaaaagatgtgtcaaaggaggtagttgaagatttagaacgggtattgaagcctggtggatattggtttattaaaatgaatccgtattattcaaaagaagaactggaaagtttcggatatgagaatatgggaaataacatttatgaagagaatcatattatgagactaagacaggctacaacaaattactggaaagaaagatttgcacgttttggaaaggaaattatttatctggaatttgagtatccgtggcaggagggaatgaatcgtctgtttgtttaccagagttaaaagaatctggctgtgccacatttgcaataataagaagtttgcgctataatactacttatacaaatcgtgaaatttagtattgatttaggagatatcgcttatgagagtattttatgggcttataattacggcggtaattttaatgattggggcgtgtgctttaaaggcatataaaaaagagggtgcactggcaagagttgtgtttttatatgagcttggtgcatttatatgtgggataatatttttagtatatacatatgttccagggactaccattacagtgttgtgcaagggacttattatggcgagctttgactggctgctggtacttcttatgtattatacccagtattatacaggcatgtttaagggtgttatgggtgtaaaagtttttatgattgcctattcgctgtttgagaccgttgcatttttgattaatgcatggacgagatggatatttgatataacagatatatcgggtgaccagataattgttcagtttgcaaaaggtaatgttctgggcaggttacattatgtatttgcttatggcattatgttgctgcttattttaagttatttagtaatggttaagagaatgtcaagattctacagattcagatattttgctattctcatattattatttgcagcatttttacttgatataatgactacatggtctgattcaatatatgacatgtcaatggttgcatttggcatcatgtctgtacttatatattatctgacatacagttatgttcctaatgagcttattgagaatacattttcacttataatcagggatatgaatagtggaattatatgctttgataacgctggaagatgtatatactgtaatggtattgttaaagaaatgtattctattactgataatattaatgaagtagagcataattatgcaagctggcttcagactcagacagagcatgataataagaaattcaggcagacaatcagcgaggggaaagagagaagaagctttgatatttcatataatcgtgtatatgatgataagcataattttatatgtgattatttcatatttaatgatcgtactgaagctgttgagcttttagaatatgaaaagttcagagctacacatgataatctcacgggacttcttaataaggagcagttctatgaggaaactgccaatgtagtgcgaaacgacaggaatcacaaatattgtctggtgtgcagtaatattaaagattttaagcttgttaatgagctttttggaatcgaaaaaggtgatgagattattaaaatgcaggcggggcttatcaaggcttcatctgaaagtggctatatatgtggaagaatccagaatgacagatttgctgtgtgtatgccgaaggacagttttaagaatgaaataatgcagaatagtattgtaagcatgcaggacagattcaacaatgcatcatttaagataagggttgtagttggtgtttatgatattgaagatgttgatgagcctgtaagtaatatgtgtgataaagcatttattgcgagcgagactattaagaataattatgaagctaatattgcatactatgatgataagctgttaaagagaactcttgaagaaagaagagttattggagaatttgagggtgcacttgaaagaaaagaatttaaaatgtttcttcagccacaggttaatactcatggtaaggtttatggagcagaggcgcttgtgcgctggcagcatccagatagagggttactgtcgccattcttcttcattgatattctggagacgacaggtcttatatataagcttgatatgtatatgtgggaatgtgcagcagctaaattaagtgaatggaagaagaagggtgatacggttcattatatttctgtaaatatatctactaaggatttttatcttatagatgtatatgaggttattacatcgattgttaagaaatatgatattgaacctaagatgttaaagttagagattaccgagacagcacttatgtctgatcttaagaagaatatggaggtaattaagaacctcaggggttatggatttaagatagagattgatgattttggaagtggatattcttcgctgaatatgttaaaagatataagtgcagatgttcttaagattgatatggcattccttcgtgctacagagaatgaggttaagggacaggatattctggagactattatttctcttggtggaaagcttggaatggaggtaattactgaaggagtagagacagacaaacagcttcttatgctgacagagatggggtgtcatatattccagggatattatttctcaaagcctataccagtcgaagaatttgaacaaaaatatatgaatgaataatgggaggaagttatgagcgagaattgttcaggaagctgctcaagctgcagttcagactgcgaatcaagaaaaggaccacagatattaagaaatgccaataatggcaaagttaagaaggttatagctgttgtcagtggcaagggaggtgttggtaaatcacttgtcacatcaatgctggcagtcaaagccaataaggaaggaaagaaagcggcaatacttgatgcagatattacaggaccatctattcctaagtcttttggacttactgaaagggtaacatgtaatgaagatggaactgtaatgtatcctgagacttcaaagaatggtattaaggttatgtcacttaatcttcttatggaaaaggagactgatccggttatatggagaggacctgttattgcgggtgttgttaagcagttctgggaagatgttgactgggatgagacagactgtatgtttgttgactgtcctccgggaacaggagatgtacctcttactgttttccagtctatgccgatagacggaattattattgtaacttcaccacaggatcttgtttcaatgattgtggagaaggcaattaatatggctaagcttatgaatattccggttcttggaattgtcgagaatatgtcttattttaaatgtccagattgcggtaatattcattatatatacggaaagagtaagattgatgaagtggcagcagctaacgacatcaagactgttgcaaagcttccaatggacgcaaaggtagctggacttgtcgattcaggaaaggctgaggaacttgatgtgtctgcattagatggaatatttgatgcaattatggcttaacagagaagaataatgaaaagattgattttatttaaaggcggagtagaaacattagaattctttacagagcagatggctgctgtatgggagaagatgggctgctccgttttctggtataatttaatgttacagcaggccagttcttctgcactggtggaatttttcaaggctcacagctcagacgagtggtatatgtttacatttaactttgaaggaatagcaggagaagccggtctgtatcgtgatgatggctggaatttctgggactgggcaggtgttaaggttgtaaatgtggttgtagatcacccgctttattacaacaaatatatccgaaagcaccctgaaaagtatatccagcttgatattgatgaaatgcatgtcgcatacatgaaaaggtttttcccggaagtacatactgaatatatgcttacagccggaacagagcttaattataacagatgtataatgcctgataagaattacctgtcaatgaaggaaagaccgatagatattatatttacaggtaattacactccgaaaagaatactaaggaaacatctggataacatggatgatgagtatatagatttctatgagggtgtgctgtcatatctgatagacaatccgtcagagacgattgatgcggcggcggaaaatgcgttacgcagggaattccctgatattacagatgaacagcttgtcgactgcatgcctaatatgatgtatgcagaccttgctgtaagatttcactacagggagcttgcaataagggcactggctgattcaggacttaagattcatacttatggcgaaggttataattatatcgaatgtaaccaccatgagaatataattgagcatggaggtgttgattccaaggtgtgtcttgatatgattagtcaggcaaagatttctcttaatgtaatgccatggtttaagatgggcgcacacgacagagtgtttaatactatgcttaatggaggtgttgcacttactgatacttcgctgttttatgagaacacatttgcagatggtgaaaatgtgttgttctattcacttgaggatttaagagaatatgaaaagtcgagatatgatgagtgtattgcggcacgaatcacggataaggttaaatgtgcattagctgatacgaaacatttgcaggaaatcgctgacagcgggtatgaatgctgtaagggcaggcatagctggattgagagggctgtagtgattgggaagtatttttgttaaatggaattgaataatacaaataaacaatatatggacactttttctgtacttcatgccataaatcactagaatatatgactcaattacagtattattataattaacagatacggataggttatttaatgataggagtatattatggcaaattcacaaaaaggcaagattgatatgaccacaggtcatatcatgagaaatatcatactgtttgcgataccgattattattggaaatgttttgcagcagttatatactacggttgatgcacttgtaataggtaaatactgtggtgatacatctttagctgcggtaggaacgagttcgcagcctgttgaagtattattatgtgtctttttaggaataggaacaggtgtgtctattcttatttcacaatatatcggagccagggaatcgggaaaggttgtttcagtatgtggaacttcaataacatttatatatattataggtattccgattggaattcttggatggtttgcagcaccgtatattctggaattcatgaaagtgccgcaggatgtgtggggtgccgcattaatctatacaagggttgtattcttaggtacacttggtaatctggggtataatatgaatgccggaattttaagaggacttggagacagcaaggcttcactatggtttctggttgtatcatgtgtttctaatatagtatttgatttattgtttgttgcaggttttggaatggatgtagctggggcagcactttctacaagtattgccatgtttatttcatggattgtaagtattgtttatataagaaagaagtttccagagatacagtttacatttttgccgagaagattctctggaacaatgatgaaagacattctggctattggcttacctgttggtcttaacaattcactatattcattaggacatgttgcattacagacctttaataactcacagggggctatatttatggcaggaggtgcagtagcaggaagaattacaggatgctctaacatagcaattaccggattatcttcggcggccactacattttcaggacagaattatggtgctaagaaatactcaagaattaaagagggacactggagagttccattgtgttcaggtcttattacattaagttttggattgttctttataatgatacataaacctataatccgtttcttttcatcagatgaaatggtattgatgtatgcgagcaggcatgttattgtcatgctgctttcccagtggttttatgctatttttaactgtataatatctattgtaaacggaaccggaaaggtgcgttatactacaattgtcaacattcttatgctttgggcagtcagaattccgagtgcctatattattaacagatactttgatggaacatgggtaatgttgtgcttcccaatttctttcagctttggaatgtttgcaatgataggttattatctgttctcgcctgcatggaaggaagttatgagactggcggaaaataaacaaaatgaaggtgaacagaatctggcgtaaggttgacgacatcgtaagaatatggtaatatagcacatgttcgcggatatggcggaattggcagacgcgctagatttaggttctagtgtcaacagacgtgcaggttcaactcctgttatccgcatatttttttaaggctgatgcacttctttgtgcgtcagctttttttgatttggaaaatatcagattgtggtgtacaataaagaaaacatgtccggaaaggaggccaatatggcagagtatgtattagaaaacaacattttaaaagttacggtggattctaagggatgtgaaataagagatgtattgtgtaaaactgacaatacacacagaatgtggaacgccaatcccgaaggatggaaaagagttgcacctgttcttttcccgcttattggcaaatataaggataaccaaagcatttataatggaaaagtatatgaaatgggtcagcacggatttgcaagagatatggagttcacacttgttaagcataatgacgatacgctggttatgagacttgaatccgatgaaaatactaaagagaaatatccttttgattttgcattggagctggagtatcatcttattgacaatgaaattaaagaagtgtacagagtaatcaataaagataatgtaatgatgcatttcagcataggtggtcatccggcttttgtaacaccagagaatgatgcaagcatggctggctgtaagataagatttgatgcagacagaattacatatcatctgataggagattatcaattaatggcgagggatgagtatgagctgccattaattaatcatgaatatacaatacaagaggacagctttgaaaaagatgcatttataattgagggaagtcaggcaggaacggtaagtcttgttaaaaatgaaaagccttttgttacagttaagtttgatacgccagtatttggtctgtggtcatgcaaatcaaaaaatgttccatttgtatgtatagagccgtggtatggaagaacagatgccatagattttacaggggagcttaaggacagggaatacagtaatcatcttgatgccggagaagttttcgagaagtcattttcaatcttattttattaataacattattaacataaaaacagcgccgtatgccattgtatgcaatatagcgctgttttttatgcaaagtgattactttaaaaacatatgtattaaactgttatttgtttttgtgtatggctggtagcgcataggcaggtcaagccagcattttttatctacaatgctcttatagtgtgaaaatgtatcaaatccggcttttccgtgatatgagcccatgccgctttcaccgaatccgccaaagcccatattggaagttgcaaggtgaatgattgtatcattgatacagccaccaccgtaattgcatcttgaggttacataatgggcttctttcttattcttagtgaatatatacagagcaagcgggtgcatgtgtgcattaacagtgtttactgcctcctcgacagagtgaaaggtaagtataggcataagcggaccaaaaatttcttcctgcatcacagcgtcgtcaaatgtaacgttatccattatcgtaggttcaatacgcagagaatctgcatctgatgcaccaccaagaacgactttgctattatcgataagacctgatattctgttaaaatgcttttcattaacaattttgccataatcattgttgttaagtggagaatctgtaaactggcgctttgtttcgttgataagttctttcacaagctggtctttgatactgtcctgaacatatatgtaatcaggcgcaacacatgtctgcccgcagtttaagaatttgccgaatacaattcttctggcagcgagctttaagtccgcagattctgttactatacatgggctttttccgccaagctcaagtgttaccggggttaagtattcagcggctttgcgcataacttctttgccgacagcctggcttcctgtaaagaatatgtaatcaaaatgttcattaagcagacagttattttcagctcttccgccagttacaacagatacataagcagggtcaaatacttcttttattatgaggcacataacatcgctgacataaggtgagtacgcacttggtttaagaatcgcagtgtttcctgcggcaattgcatcaacaaggggttccattgtcagaagaaatggataattccaaggactcataataaggacaactccgcgtggtgacggcttcttaaagcttctggaatgaaactgtgcaaggggtgttggaacatttttctctctgctgaatttcctaatatgttttagcatataagatatctcgctgagagtaagcccgacttcacacatataactttcaaactggcttttgccaaggtctttatagagagcatcaaatatttcattctcatgtttcttaattgccgaatatagtttctttaaggcatcaattcttacatttacatcaagtgttgtacctgtaagaaagaaatgtcgttgcgattgtacaagtttattgatttgtgtagcttccatattatacctcattttcatgtgtattatctttcataagtttatagtagaactgttcgagtgtcttagcgtccataagaaccggaacagggtagagaggattagcctctttgtcggcataccctgcaagcttaggaatatccttctctttaatctcaggaattgtatcgccaatgttaaatcttactttcatatctttgactgcctgtataaatgctttggcagcagtctcatctggcacatccttatctgcaacaccggcggcaattgcaaggtcatgcagcttcgtatagatggattctccatagctttcaagaaccattgggagaattacggcatttgcaagtccatgaggaacattatattcgccacctagagaatgtgcaactgcatggatatatcctacatatgatttagtgaatgcacatccggcataataagcagctttaagcatattctttcttgccgttgtatcagaaccgttagtgtatgctctgtcaagattgttaaatattaactcagtagccataagtgcatcttttcttgtacccggagttgttgagtttccgatgtaggcttcaacggcatgtgtaagtgcatccattccggtagttgcggtaattgaagcaggaagtgtaagggttaccttcgggtcaaggactgcatatcttggaataagcggaaagtcgttgatagcatatttgtggcgggttgtggcgtctacaattacggctgcaagagtagtttcacttcccgttcctgctgttgtagggattgcaatcagcagaggaagctttgcgtggaccttaaggattcctccaagcttagacagatgtgtcttaggtcttgctattcttacaccaacagctttggcacagtccatgcttgaaccgccgccaaagccgattatgcagtcacatttgttatctttatatatggcaagtgcctcttccacggtatcagttgtagggttagctacagttttatcgtaaacatggtattcaatgccagcattgtcgaatacatctgtaagcatagaaagaatgccaagctttgcaattccaggatcagtaataattataggacatgatttcttctttttgttaagtacagatggaatgtcagataacgcacttacaattttaggcttcctgtatggaagaaatggcagtgcaatcttgaagacagtctgaaaacttctgcagtatattttcttgaaaatgttcattgtacacctcttttgaatttaaaatattttgactaccaaattataatgcgatagcaagttatttacaagtaaatatgtgcgattaatttatatacaagatataataaataattaaaataattaacaactttacaataaatattatttatgatatattatgtttattataaaaaattaaaagcgagttgtataattaaattaaaaagattataatatgataaagagagggtatatatggatataggaaaaataagagaagcatgtacattaaggaagataaagtggtcagtacatgttgcagcaagaatggctgagagggatatcaagaggaatgatgttattaattgtataatgaagggggagattattgaatattatactaatgattatccatatcctagctgtctgatatttgggtatacattaagaaacagagttatacatgttgtattaggttatgatggagagaatgtgtatatagtaacagcatattaccctaatacggataagtttgaagcagatttaaagacaagaaaggagcaatagtatgtgtttttattgtaaatgtaaaacaacaaaaccatcggttacaacacatgttgttacttttgataattgtgtaattataattaagaatgttccttgtgaggaatgtgaggaatgtggagaaaagtatttttcagatgaagtcatgtcccgtttggaaaagattgtagaaaaggcaagagagattgccagtgaggtatatgtcactgattataataataaagttgcataaggtgctaagttttatacaaagcaccttatgcataagaattagtcaggaatctgcaggccggttccatccatatgaaaattttcagtattaataagctgtgatacaggcacgattttgtagccttgggactgcagcccggttattacagattcgagagcttcggctgtatatttagcaccgttgtgcataagaattatggaaccgttcttaagagctttatgtgttgttacggtcttaattatgttgtctgttccatagtccttccagtcaagggaatctacatcccattctataggatagaagttacaaccatagactgtatcaataagcgttgaattataatcaccgtatggcgggcggaacaggaagctcgtatatccggtgatttcttttattttattggcaacagacatgatttcatctttctgctcacctacagaaagtttactcatttctttatggttctggctgtgattgccgaggtcgtgtccacggttatagatttcaagaaccttatcagggtagctgtccacccagcctccggtcatgaaaaatgtggttttgatattatatttatcaagaatgtcaagaatctttatagtatcttcatcgccccatgcggcgtcaaatgatatggaaacatattttttggaggtatcaagattagtttttttactaaggtcaacacagtatataggaagtttacggctgcctatgctgcaattgcccatgattgctccgccgccaattccatttccctgattggatgagttgtatggcggtaatctgtcggtattgggagtgttgtcagaagtatgttgggtgtctgatgattccgatgtttcgttattgattttagttgtttttacaattgaatctgatgatgtttttttatgtcttgcggttattatgccacagattactaaaatgattataacgcagtatatgaatataatgcgcatttgtttattagaaaaaagagacatactgatacctcggataatgcttagtatcaatatatctctttacattttaaaaaattactgcttttttcattacttagcagaagaactgctttctgttgcagatgtatctttaacaagaccatcaggatggagtgaaacatttaattcacttgtgctttcatcgtaatcatcgccaagaatctgcttaacgagagtctggcagtatgaaaggctgaaatcagagcagccggaatcgttgcggattgcgttgcctgatgccagtgattctgtgtaatcacttaatttatatgtagtgattgctttcttgccgaaaagcttctgtgttatgacaggtgtaagattataattcttaacataacagcctgtttcatctttaacaagtgtcatcttagccataccgcctatcatacgaggcttctgatcctgattagaaacgaagttaccaagtgaatagtatacaagcatttcatgccccttagtatcagatacaacctcgacaggttcaagaacatgaggatgtgtacctataactacatcaacaccaaggcttaagaaaagctgtgtccagtaattctggttagaatctggtgtgtagacatattcagtaccccagtgtggaagtacaataaccatatcagcaagctgtttagccttagttacatctgctgtaatcttatctttatcaagcatgtttacaatataaggcttggaatcaggaataggaattccattagttccgtatgtgtagttaagaaatgctatcttgaagccttctttttcataaacatatatattctcatagtcttcctctgtttcgttgataccaagaacagtagtatcaggatgataagtcttccagaatgaaaggcagttctcaacacccttaagccccttgtctaatgtgtggttggtagcatgaaggataatattgaatcctgctttaacttctgcatcaccaagtgcccatggtgagttaaatgttggatatcctgtgtaagcaaaatcagaaccgccgaggattgtttcctgattgacgatttttatgtctgcagagctgatatccttagctatgttagtgtagaggtggtcgaagttgtaagttccatcatccataagaccactttttactacaccttcatgcataagcatatcaccaatcatcataaggtcgacttcgacagtcggaaccttggttgtagtttcttcctctgttgttggttcagcagtagtctcattattctggttatcggcaacagaaggattattttcttttttgtgactgccgataacagcgaatacgatacctatagttacaacaaagagtacagcagcaatgatagcaatgagttttacattaagctcagagcgtctgcgtctcttaagaggtacatttgttttcttagccataatttatctcccttaaaattattaatatatgtcttaaaaagacgaaatatgcataactatggtacattaagaaacaaaattattcaagaaaaatatttgtattatacacaaagagattaaaatgtagtatatttataaaagttggcaataagccacaataagaaatatataattatagcggaggtttcttatgagcagatacactaaggacgatatattcagaatggttgaagaagaggatgtagagtttatacgtcttcagtttacagatatttttggaacacttaagaatattgcaattacttcaagccagcttgagaaggcacttgataacaaatgcatgtttgacggttcttctgttgaaggctttgtaagaattgaagagtcagatatgtatctgtatcctgactacgatacatttgaaatattcccatggagaccacagcagggaaaggttgcaagacttatctgtgatgtgtatacaccagatggcaagccttttgagggcgacccaagatggatacttaagaaaactattaaagaagcgaatgaaatgggataccgctttgatgtcggtcctgaatgtgaattcttcttattccatacagatgacaacggacttcctacaactttaagccatgaaaaagctggatattttgacctcggacctaatgacctgggcgagaatataagaagagacatggttcttactcttgaggatatgggatttgagattgaggcttcacatcatgaggttgctcctgcacagcatgagattgattttaaatatgatgaggctttaaagacagcagataatatacagacatttaagatgacagttaagacaattgccaaaagacatggactttatgcaacatttatgccaaagccaaagtttggtatcagcggttctggaatgcatattaatatgtcacttgcaactgaagagggtaagaatatatttgcagatgagaatggaaagattggtttatcagatgatgcatatcattttattgctggtattatgaagcacgcaagaggtatgtcagcaataactaatccgcttgttaattcatataaaagacttgttccgggatatgaagcacctgtatatatagcatggtcagcaaagaacagaagtccgcttataagaatacctgcatcaagaggaaatggaacaagagttgagttaagaaatccggatcctacagctaatccatatctcgtgctggcactctgccttgcagcaggacttgatggtattaagaacaagatagaagtacctgagagtgttgactgcaatatatatgagatgacacctggcgagagaagggcagcaggaatagagaatatgccggcagaccttaaggaagctgttgactgtcttgtggcagatgagtttttatgcagcgtacttggagaacatattacaaccaaatatgttgaagctaagatgaaagaatgggaaaactacacaacaagagtctcacagtgggaaattgatgaatatctctacaagtattgattaaacatggtaaagcgtatgctaagtagaaaaggagttaattgatgtccacattgattgtagcatttcctaagttagaggaggctaaagcagtaaggagtcttttgattcacagaggcttcgatgtcgctgtaccatgtacaagtggggcacaggcaatcaatcaggctgatactttgtctgatggaatcataatatgcggatataagctgtcagataatatggtttatactgaattatatgaatataagccaaagagctttgagatgttgttagttgcgtcccagaacagatgggaagattgtcaggacaatggaattgtatgtgcggcaatgccaataaaggttaatgaccttgtgtcaactatagagatgatgcttcaggcacagataaggcgtagaaggaaattaaggtcacagccaagaaagagaagtccggaagaacagaagataattgatgatgcaaagcatctgcttatggaaagaaataatatgtcagagcaggaggcattcagatatatccagaaatgcagcatggacagtggcaatacaatggtagagtcagcaactatggtgatgggaatatatcaggatgtataacaaatgtgtttcattactacatttataatatgaaaaggagaccaggtatgaagtttactaaaatgcatggagcaggcaacgactacatatacgtagactgcacacagtcggtaattgataatccgtcacaggtcgcaattgatttaagtgacagacattttggaataggttcggatggacttattcttattaagaagtcagataaagcagatttctttatggagatgtacaacgcagatggttcgcagggacagatgtgtggcaatggaataagatgtgttggaaagttcgtgtatgacaatggacttacagataagacaacagttactattgatacacttgcaggtgtgaagatacttgaacttaaaaccggtgcagatggcaaggttgagacggcaagggttaacatgggcgcaccaattcttgaggcagcacagattcctgttgatacgaaggaacttaaagaatataaaggctgtgagatagagacaattgccggacaggttgttaagacacctgttgtggatgagactattgttgtagaaggtaaggagtacaaggtaacagcagcttcaatgggtaatcctcatgctattgtttatcttgataaagatattgatattaagaaatttgagattgaaaaaatcggacctttctttgaaaatcacaaagcatttccagagagaattaatactgaattcattcaggttgtagataagaataatcttaatatgcgtgtgtgggagagaggttccggggagacacttgcctgtggtacaggtgcatgtgcgagccttgttgcaactgttcttaacggaatgtgcgacacaacagcaacacttcatcttcttggtggtgacttaaagattacatgggataaagatgagaataccgtatatcttgaaggcccggcgaaaacagtatttacaggggaggtagatatttaatatgatgacagatatgacaatggataattttcttgcggttttatcttcaagtgaaccggtgccgggaggcggcggagcgtgcggatatgtggcagcagtaggcatgagccttggtaatatggtgcttgcacttactacaggaaagaagaaatatgcagagtatcaggaagagattgaagaacttattgttaaagcgacagaccttacaaagaaacttgcagagagcatggataaggatgctgaaagctttaagcctcttgcagcagcttatggtcttcctaagcatacagaagaacagattaaggaaagagaagcaattatggcaaaggcacttgttacagcctcagaagcccctctgtcaatgatggagcttatacttgaagccatgaagcttatcgaccgtatatctgtaattggaagcagaattgcaatcagtgatgcaggtgtcggcataacaatgtgtgaggctgcaatgaagggtgcttcgcttaatgtatttatcaatacaaagcttatgaaggacagagaacttgctgaagatatgaactttaaggcagataagatgcttgctgaagcagcacagattgaagaagaaacatttggaagagttatggatgctgtaagaccatagaacaagattgcaaaacaaggaggaaaattcctctcctcgctggagaggctcggattttgcttcgcaaaacaaggaggaatatatggagacacttaagggattaccggttgctaatgctattaatgagaagattattgaagagatgaaggactggaatggcgcaattccacatcttgcaattgtgcgtgttggtgaaagaccagatgatatgtcatatgagcgtggcgctaccaagaagatggaaaaagtaggattcagatgtacttcatatacatttcctgctgatattgataatgatactttccagaaagaatttgacaagattaatgaagatgaggatattgacggaattcttcttttaagacctttgccaaagcatcttgatgagaaggcaattgagaacagaattgccagtgtgaaggatctggatggaatatcacctatgaatcttgcaaaggtatatgcaggggatccgacaggatatggtccatgtacagcagaagctgtaattgagatgttagattatgcaggagttgacttaaagggtaagagagcagtagttatcggaagaagtcttgttatcggtaagccggttgcgatgatgcttatgaagaagaatgcaacagtaacagtgtgtcatactaagacagttgatatgccgggagtatgtaagggcgctgaggtgcttgttgcggcagcaggcgttgcaaagatggttgacaaatcatttgttgcagatggtgcagttgtaattgacgttggaataaatgttgatgaagacggcaatctgtgtggtgatgttgattttgaagatgttgcagagaatgcttctgtatgtacaccggttcctggaggagtaggttcggtaacaacatcagttcttgcaaaacatctgcttaaggcagctaaggcaagaagagcataaaaaagtccttgctttattgtacataagaatgtattataatttgcggtatgaattggtagcaccaatttgcaccgcaattttttatttatggagaaatgttatgaaattattgagacagtttcttataatactggctatttcatttgtcggagaagcacttaaatatctgcttccgctgccggttccagccagtatatatggaatggtgatactttttgttggacttcttaccggacttataaagcttagctgggtaaaagacgcaggaaaatttcttatagctgtaatgcctgttatgttcattccggcaggagtaggactgatgtcttcatggggggtattaaaacctatgctcgtgccggtgcttgttgttacggttgttgctataattacggttatggcggttacaggtcaggcttcacagataatcatacgtgctgacaggaagagagaattacgcaaagcacaaagaaatgaggttaatactaatgaatgattttttcagagaatcactttttgccggagtcacattaagtcttttatcatactttattggttctgtgcttaagaaaaaattcaagcttggaatattcaatccactgcttatatcaataataataacaataatagtacttgcagtatcaggtgttgattataatgtatataatcagggtgccaggtatcttagctggtttcttacaccggcaactgtatgtcttgcaattccgctgtatgagcagtggagtcttcttaagaagaattacaaggcagttgttgtaggaatagcatcaggtgtgcttacaagtttaacaacggtacttgtgttatctaaaattatgaatctgagtcatgcagaatatgttactcttcttccgaagtcaataactactgctattggtatgggagtttctgaggaacttggaggttatgtaacaatcacagttgcagttattgttgtaacaggagttcttggaaatatatttggtgagcttatatgtaaaatattcagaataaaagaaccgattgccaaaggacttgcgttaggatctgctgctcatgcgataggaacagccaaggctatggaaatgggcgaaattgaaggtgcaatgagcagtctttcgatagcagttgcaggtatacttacagttgcactttcatcagtatttgctggatttatgtaaaattaggaggcgttaaacatgataatcacgattgcaagacaatgtggatgtatgggtgaccagataggaaaagcactggcagagaaatattttataccattttatgataaggatgctgtgtgcagacttgcgaaagaaaaaggcttgtatgagaagtatccatatttttatggagaaatgcctcttgatatgatgctgtatgctgatacaatggcaggtgatgatacaacagataatggaaaaactccacgcaaggctatggctgacataatcggtaatgaaaattgcgtagttgtcggcagatgcggaaataatgcattcagacacagagaagatgttatatcagtatttctcacaggaaacaaagaaaaaagagtagaacttatagaaaagaagcacaatgtcagccctaagaaagcagctaagatagttgaagatacagaccttagaagacgctcatatcacaattattatacaggtgaagaatggggaaatgcagaatattacgatatatgcatagatgtttcaaaggttggggaagatggtgcactaagacttatagaagcctatattaatgagacaggggtgttataagctgaaacaggataatatgaatcagaagaaaatatcgcaggaatacgaaaaggcaattcaatatatttatgagcttatgaaaagcggggagcttacaataggaagcaggctgcctactgaacgtgcacttgcggaaacgcttggcataggacgcaattcaacaagagaagcattaagtattatgcatggaatgggacttatagaacgccgtcagggttctggtaattatatatcagagaatgtcggtcagtctataaagcagactatattaatgatgattgcattaaagactattactaagcgtgaagtatgcgaattccgccgcatgatggaaaagtcagtgtgtaatgcagtaatacatacaggtcttacgaaagaacaacgggagcggttggaaagcatggttaatcagatgagcatggtaacaggtgaaaaccttgttgatactgataaagcatttcacgaggaactgattgcagataccggaaacaacctgtggattacactgatggaagctgttgttgaagtctaccgcgaatggatagattatgtcataaagcatgcagatggaattaagaaaaagaaacttttaaagacacatgaaatgatatatgatagccttataaagaaggatattgagacacttaatgcagcgattgatgagcattacgatataattgaggagctgctgggataaagaagccataacaaggaggatatatgaaatacaaaatcgttgtatttgatctggacggaacgatacttaatacattggaagaccttgcagatagtactaattatgcactttcagtatttgatatgcctgagaggacgattgaagaaatcagacattttgttggcaatgggataagaaagctgatggaaagagctgtaccacagggaacaccagaaagcatgatagttaaggtgcatgaaacatttacagagcattacaagaagcactgtgccgataagacaagaccttatgatggaataaaagaacttattgagaatataagaagttccggtgtgtacactgcggttgtatctaacaaggctgattatggagtgcagattttatgcaaagattattttccgggactatttgattatgcggttggagagagagaaggcataagaagaaaaccatatccagacagcgttaatgaagtattaagacagtttgatgttgacagaacacaggctgtatatgtcggggattcagaagtagatgtccagacagcggctaatgcaggaatggatgtatgtatggttggctggggattcagagatgaagagttcttaaaggataatggggctgagtttgttgtacacagccccgaagaagcatgggaattcattaataagtaatatacttataacacgttatgaagcaaggcggactgcaattcacaaagctgggggttcttggatttaagaatcagttctaccagaccttcggtgataagcattgcaccgtccttgttaaaatgtgtattctcagaaacagtatctggcttggcgagttcttttaagaaatcgtcaggccattttcctttattgatacctttcttgatagaggtatatctatgtatattatcatgtccgattttttcaaaaagttcaactgaataagaaaacagatcaagtacaggagtgccggtttcttcgccaatctggcgcatagctcttatatagctgaaattattaccgccgtggcagccgggagcgtccatgattgttccgtcatcattaaaaaatgttcttgcaggcgcagtaactaatacaggagatgcatcatgctttcttgccatatcaataaactgtttgatgaaccatttgtaactgcccatagaagcgtcttttgagtatggatagtaagtgtcatatggataagactggtttatggcaagaacactgttaagaacagcctgtttatcagttattgaatcatcattattaagtgcctcaatatattcaggtggtatataattcttaggcatcttaactcctgctataacaggaaatcgacctgattcatttggtacgccaagcggagtctgacggttaaacatagatttgtaatcctttgaatcgtcatcattatgacagaactctataaaaagatagtcgccagcctgaatatgtctgtcaatctcttcaaatcttccttcattaataaaaagtcttgaacttctgccacctttggcatagttaaatacatttacatcaggcttaaagaaacgtggcagaaactgcccccagcctgcaataaattcttcctcagtataattctgtacaatagagtctccagcaagataaatattcatacatacctccttgtttttcgaagcaaaatgcgactgcccatgcaggagcagaggtattgcttccgttgttttgcgaagaaaaatgctttcaataagttaattatagcctcaaatgttctgacaaactacatttgttttgtgaatatactcattaaaaacagataattaatgtttcaggtggacagcattgcacagcttaaagaaaaggtgttataatacaaggcaaatataagcacgaggagattgatatatatgtacgaatttacagaagactgtatgatacacattgataatattgatgaagaacatagaaaactgttccagatgcttaatgaagcatttgcactggtaaaagaaacagataatgctgcgtcaattgcgaagaatcttatagataatcttaaggattatgctattacacattttgctcatgaagaagaatacatgaagagtattcatgacccggagctgccaatacagcagagagaacacaaagcatttgcagaaaagattaatacatttaagttagatgaatcttcaccggaggcagcaagaaattctcttaatgagctgctgctttatcttaccagatggctttacagccacatcttgagcagcgacatgatgattggaaagatggcaccagaaactaatgttgatgacgcatttgcatttacagacaaatatataacaggaattgagcttgtcgatgaggagcataagcatctttttgatattatcagggacactaatgatgttatacatgcagaacttcttcatgataaatatgatgaaatcataagacttctctcagaattgagggaatacacggagacgcatttcagtgatgaggaagaactgatgaagaaaatcggatatcctgaaattgaagcacagaaaagggcacattcagcatttgtagaaaagcttgtgaatattgatttcagggagcttgaggcaatggatgataatcaggaggaatatcttatggatcttataggattcctgcttggctggctgtctaaccatattcttgcttctgataaaaagattggtaaatatataaaagaacacaatattgtacttgaaaagtaatattctttatgatatcattcatgtgtatgaatatcttaaagactatgaaagagacttcttttcatggaacctgacaggaaagcgatgccaccgactgaaagcatacgcagggaattgataagaggaacgctctggagttggatggttgagcagccacggctgggtaggtcattccgttacacgcgttaagtgcaatgagatgagaagcttagaacttttcaatgcgggtggtaccgcggataacacagtttattcgccccgggatgtatattacatcctggggcttttttgcgcgaaaaagcatagcaggatgttaggtattattattttatttgacaggacataacattttgcctgtccagaaaagaaaggagattgcaatggcaaacatgtacagagatgttaacttaagtgaagttaatgaaagttacatcggcaaggagttaaaggttgcaggatgggttgagaacatccgtgaccacggaggagtttcatttatcgatttaagagatatgtatggagtacttcaggtagtacttcgtgatacaacattacttgatggtattcataaggaagagtgtatcgctatcgagggtattatggagcagagagatgaggaaacttataatcctaagattccttcaggaacaatcgaacttgaagctaagaagattacaatacttggacaggtataccagcagcttccatttgaagtacagacttctaaggaagtaagagaggatgtacgtcttaagtacagatatcttgatttaagaaaccagaaggttaaggataacatgatattcagatcaaaggttatcgcattccttcgtcagaagatgacagacatgggattccttgaaatccagacacctatcctttgtgcttcatcaccagaaggcgcaagagattatatcgtaccttcaagaaaatataagggcaaattctatgctcttccacaggcaccacagcagtataagcagttacttatggtatctggttttgataaatatttccagatcgcaccttgcttcagagatgaggatgcaagagctgaccgttcaccaggagaattctaccagttagatttcgagatgagcttcgctacacaggaagatgtattcagaatcggtgaagaggttctcacagaaacatttgcaaaattcgcaccagaaggatacgaagttacacaggcaccttatccaatcatcagctataagcaggcaatgcttgagtttggttcagataagccggatcttcgtaatccacttagaattatcgacctttcagaattctttaacaaatgtacattcaagcctttccagaacaagactgtaagagcaatcaatgtacatgcaaagctttcaaagggacagcatgagaagttgcttaagttcgctacaggaatcggaatgggtgggcttggataccttgaggttcttgaagatggaagctacaagggaccaatcgataagtttataccagaagaactcaagggagaaatcaaagaccttgcaggacttcagccaggagatacgatcttcttcatcgctgataaggaagacagagctgcgtacttcgcaggacagattagaaacgaacttggtgagagacttgatctcattgagaaaaatgcatacagattctgttatgttaatgacttcccaatgtttgaaaaagatccagaaactaagaagattggatttacacataatccattctcaatgccacagggcggacttgaggcgcttaatacaaaagatcctcttgatatccttgcataccagtatgatatcgtatgcaacggtgtagagttatcatcaggagcagtccgtaaccatgacatgcagataatggttaaggcatttgagattgccggatatgatgaagaagtattaaaggcaaaatttggagcattatacaatgcattccagtttggtgcaccaccacacgcaggtatggcaccaggtgttgaccgtatgattatgctccttagaaatgaagagaatatccgtgagataattccattcccaatgagcggaacagcacaggatttaatgtgcggagcaccaaatgaggtaacagagcagcagcttagggaagttcatattaaggttagggattagtggatatacggacggctgtgaggtttataagttcaccgcaaggcacgctctcgctgcttgtcgctcgcagcggacactaggttcgctgggatttgttggcactttgtgccaactgtcccagcttaccaagtgccggcggctccaaagcaccttgcttgcgaacttataaaacctcgctgcctgttcgttgccaacaaccgctaatttaatatgacctcctctgatgcaaagaggtagagacttccactacatctcgcccaacggcgacgagcgcagcgatgtcgcgtctcgttccggggtagatgtgtgagcctggagaaattggataaagcgttaacaagacactttggagccgccggcacttagcaaaatcggctggcggagtctgaaaagctagcttttcagaaggaggtggccgatttcgcttagtaccgctgcgagcgacaagtagcgaaagcgtgtcttgtgatggtttatccaatttctccaggcgtatataacgacaacgaaaggagacgcacacatggctaatgtaattagtgatgagacaattgagtatgttggtatccttgccaagcttgaactctctgatgaagagaaggaagctgccaagaaggatatggcgagcatgcttgattatattgacaagctcggagagcttgatactacaggggtagaacctatgtcacatgtgttccctgttaataatgtaatgagagaagacgttgttactaatggtgacggaagtgaggcaactcttgctaatgcacctgaatgtaatgaatcaggatttattgtacctaaaactgttgaatcatagaaaggacgcatatgagtttattagattatacagctgttgaactggctgctaagattaaagcgggtgagacaacagcaacagaggctatggaagctgttattgcacagattgaaaaatctgaagatgagcttaactgttatgtcacatttgacaaggaaaaagctcttgcagcagctaagaaagcagatgaggatatcaaggcaggtaagcttacaggacctttggccggagtaccatttgcaatcaaagataatatgtgtacagagggcatgcttactacatgctcatctaagatacttggtaatttcgttccaacttacacagcagacgctgtagaaagacttcagaatgcaggagctgtaattatcggaaagactaacatggatgaattcgcgatgggttctacaactgagacaagtgcatttggtgcaactaagaatccacgcaatcctgagcatgtacctggtggttcatcaggtggttcagcagcagctgtagcagctaatgagtgctttgcagcacttggttctgatacaggtggatcaataagacagccagcttcttactgtggtgttgtaggcttaaagccaacttatggaacagtttcacgttacggacttatcgcttatggttcatcattagaccagattggacctttatgtaaggatgtaactgactgtgcaactatcatggaatctatcgcaggcaaggacgataaggattcaacatctattggtagggatgattattcatttacaaaggcattagttgatgatgttaagggaatgagaattggtattccaagagattattttggagaaggtcttgaccctgaggttaaggaagctgttcttaacgctgccaaagttcttgagagcaagggtgcaatcgtcgaagagtttgatttaagccttgttgagtacgcaattcctacttactatacaatcgcagcagcagaagcaagctctaaccttgaaagattcgatggtgttaaatacggatacagaactaaagaatacgaaggactccacaacatgtacaagaagacacgttcagagggctttggaccagaggttaagagaagaattatgctcggttctttcgtattaagttcaggatattatgacgcttattatcttaaggcattaagagttaaggctcttattaagaaagcatttgatgaagcatttgcaaaatacgatgtaattcttggacctgttgcacctacaacagcaccaaagcttggttcatcactttctgatcctattaagatgtatcttggagatatctatactatctctgtaaatcttgccggacttccgggactttctgttccatgcggtaaggacaagaatggtcttccaatcggcttacagcttattggcgactgctttaaagaaaataaccttatccgtgcgggctacgtttatgagcaggcacgaggaagatttgaataggagggaggcataagtatgaaagattatgaagttgtaatcggacttgaagtccatgttgaattagctactaagacaaagattttctgtggatgctcaactgagttcggcggagcgcctaactcacatacttgccctgtgtgtacaggtatgccgggttctcttcctgttcttaataagaaggttgtagaatatgcagcagcagtaggacttgcaactaactgtacaattacacaggactgcaagtttgacagaaagaattatttctaccctgataacccacagaattatcagatttcacagctttatcttccaatctgccgtaacggtcatgttgatgttacattatcagatggaacagaaaagacaataagaatccacgagattcatatggaagaggatgcaggaaagcttgttcatgatgagtgggaaggcgtgtcatatgtagattataaccgttcaggtgtgcctcttatcgaaatcgtttctgaaccagacatgcgttcagcagaagaagttattgcttatcttactaagttaagaacaacaatccagtatcttggtgcttctgactgcaagcttcaggaaggttctatgagagcagatgtcaacctctctgtaagagagcgtggttcaagcgagttcggaacaagaacagaaacaaagaacctcaattcatttgcagctattgaaagagcaatcaaggccgagacagctagacagattgacttaatcgaagcaggcgagaaggttgtacaggaaacaagaagatggaatgatgacaaggaatattcatatgctatgcgttcaaaagaagatgcgcaggattacagatatttcccagatccagaccttgttccaattcacatcagtgatgagtatttagcagagcttaaggcaaaacagccagagttcaaggacgagaagaaggcacgttatattgaagaattcggacttcctgaatacgatgcagagattcttacagattctaagaagttcacagaaatctttgaggaagctacagcaatctgcaaccagccaaagaaggtttctaactggattatgggtgagacaatgcgactcatgaaggaagaatcagctaagactggaagagaattcagagccgaggaattaacattttcacctgaaagccttgccaagattattactcttgttgagaaaaaggaaatcaacaatgcagcagctaaggagatatttgagcatgtatttgctgaaaatgttgatgttgacgcatatgttgaggagcacggtttaaagcaggttaatgatgaaggcgcactcagagcaacagttgagaaggttattgctgataacccacagtcagttgctgattataaaggcggcaaaaagcaggcaatcggctatcttgtcggacagacaatgaaggcaatgcagggcaaggctaatccgggaatggtaaatgctttgttacaggagcttttaaagtaacacatgaacttaaaaccaaaaggagatgtggaatgaaaaaagttaattttgatgtaaaactcccagcatttgttgacagaatagtatatgttgacaactatggtgcaagaccatactgctatactattgaagatgcatcaagaaatgctgatgctataaacagggctattaactatatctcagaaaagggcggcggaactgttgtgattcctgagggaatctggtttacagcgccaatcgagattaagagcgatgttgagttaagaattgagaagaatgcaatacttaaattttctaaagatattgaccagtatccacttattatcactaactatgaaggtcaggagtgtataagagccaagtctcctatcacagctgaaaatgctattaacatcggtataaccggtggcggtgttattgatggaagcggtgatctgtggcgccctgtaaaacagtttaagttgactgacagacagtgggaagctcttatgaaaaagagccagtatacaattgatactaaagagggcggcatatggatgccgacagaaagctcatttaaaggtaatgagcataatatccagcttgacgctgagaatgcacttgagaaagcaagcgaatattatgatttctacagacctgtaatggtaagtcttcgtcactgtaaaagaattcttcttgatggtgtaacatttatgaattcaccggcatggaatatacacccatttttctgtaagaatcttacagtaagaaatgttacggtgagcaatccatattatgcgcagaacggtgatggaattgatgttgaatcatgcaagaaggttcatatacataactgtacatttgaaacaggtgatgatgcaatctgtttaaagtcaggcaagaatgccgtagcaagacagattgaaggaccttgtgaggatgtatatatccatgactgccttgttaataagggacatggcggcttcgttatcggaagtgagatgagtcgtggtattaaaaatgtactggtagagaattgtacttttcttggaactgatgtcggagtccgcatgaagagcgcgcttggacgaggcggagttatcgaaaatattaatataaagaatattaatatggttgatatcaaggaacaggcaataattcttacaatgtcatatgtgcttaattctcttaacagaaatgaagagattaacggaattgacaaggacgatattccttatattaagaatattaattttgaaggaattaactgcctcggagcaaaggaagcggttgttatagagccgttaaaggatatgcctgagacaatcactgatatacacattaaggcttcatcatttgttacaagtggtgagaatcgtgttgaatgtgattgtcttacaagtgaacagacaacttatgagatattataaagaaatcccggcagcactgatatatgtgctgctgggatttatgtgttgtatcttaatttttcttttctgcttgggctgctaataattgctcgtatttagccaatggctcttatgcagggcattttacaatagacagttcttaagaagaaccatctttatattgtatgttgagtacatactggacagatgaatcgttatcgtcatagaaagtaaccgggtgcgatggcgtgaaagctaaagcgtctgttaaatctttaagtttatttcccagcttcaatcttagcctcatattcatcaaagatataaccaagaatcggtgccataccgacaaactcgcagccataaagataattgtcagtgccctcaattgcctgacttcttataatcttgacaacactgtaaagagtatctgtttcagagccaagattaagagcagcattaaaataaaagttgataggaagcatgctttttgattcaaatgctataccaccctcagatatattgataaccttgataggtgaatcaagattcttaatttccatgttatcctgcttaaataaagatgaaacattgagtgacaggtctgctttcattcttttaaaacgtcttttttcaattccattagccataataaaatctcccatcttaatattattatccaagtgaatagtacacttctaaaaactgactatatttatatttttaataatacactttaatgaggtaatgcgcaatgtattattgcaaaagataaagtctattgattttgaatggacgctggtatataatatttttgtttgtttttaaaccgcataaacactacggtttgataactttttaactaataattatattaagaagaaaaggatggatgaactcatgggaaaatgtgaattactctatgaaggaaaagtaagagaagtatatgattgcgatgacaagcttgttatggttgctacagaccgtatctcagcatttgatcacattttaaagaataaggttacagaaaagggagcaattcttacacagatgtcaaagttctggtttgattatactaaggacgttgttgctaatcatatggtttcagttgatgttaatgacatgccagagttcttccacaaggatgaatatattggaagaagcatgctttgcaagaagcttacaatgcttcctgttgagtgtatcgtaagaggatatataacaggtagtggctgggcaagctacaaggaaaacggaacagtctgtggaattaagcttccagagggacttaaggaatcagagaagcttcctgaaccaatctacacaccaagtactaaggctgagattggcgaccatgatgagaatatttcatttgagaagagtattgaggttcttgaaaagaagttcccaggtaaaggtcttgagtatgctactaagattaaggatgcaactataactctttacaagaagtgtgcagagtacgctttaagcaagggtattattattgcagatactaagtttgaatttggtcttgatgagaatggtgatgtagttatcggtgatgagatgcttacaccagacagctcaagattctggccattagaaggatatgaggcaggaaagagccagccatcatatgacaagcagtttgtaagagactggttaaaggctaatccggacagtgattatttacttccagatgatgtaatcgagaagactgttgagaagtacaaggaagcatataagcttcttacaggcaaggatttttcccgcaaataatcacagtcgataaggaatggagaattatgaatcagattgatattaatgacagccactatgctgaagatgaacttcatgaggaatgcggagtctttggtgtatatgatttcgatggcaatgatgtttcatctacaatatattatggcctttttgcccttcagcacagaggacaggaaagctgcggtatagcagtcagtgatacagaaggacctaagggaaaggttctttcatacaaggatatgggacttgttaatgaagtctttaatcctgaaaagcttgaaaagcttaatggtaatataggtgtcggacatgtaagatattcaacagccggaagcagcagccgtgagaatgctcagccacttgttcttaactatgttaagggaactcttggtatggcacataacggtaatcttcttaatgcggttgaactgcgtgaagagctttcttatacaggagctatcttccagacaactattgattcagaggttattgcttacttaatcgcaagagaaagacttaatgttcctactgttgagggagctgtgttaaatgcgatgaagaagattaagggtgcttattcacttatcgtaatgagtcctagaaagcttatcggagcaagagacccatttggtttcaagccattatgtatcggtaagagagataatgcatacttcttatcatcagagacatgtgcactcgatactgtaggtgcagagtttgtaagagatgttgagcctggtgaagttgttactattactaaagacggaatcaagtctgataagtcactctgccagaaaaatacagcaagatgtatatttgaatacatatattttgcaagaccagacagcaagattgacggaatgggcgtatatgagtcaagaattaatgcaggtagaatcttagcaaagactcatcctgtagaagctgatattgttgtaggtgttccagaatctggtaatccggcagcacttggtttctcaatggaatcaggaattccttatggtaatgcatttatcaagaataactatgttggacgaacattcatcaagcctaagcaggaacagagagaatcaagcgttaaggttaagctgaatgtacttaaggaagcagttgcaggcaagagagttgtcatgattgatgactcgattgtacgaggaacaacaagtgcaagaattgttaatcttcttaaggcagcaggtgctaaggaagttcatgtaagaataagttcgccggcgttccttcacccatgttattttggaacagatattccttcagaagaccagcttatcgcatcaggccattctgtagatgaaatctgtgaaattatcggagcagattcattaggctatcttgaggttgacaagttaagcgagatgatatgtggacagacaggttactgtgacgcatgttttacaggcaattatccaattgaaccgcctaagattgatatccgcggtgagatgggctgataaagcgattgcagcatgctgcctggaggacatctctgatgtggcggttggttgaggcttgctatagccgtgtcgcggacagtggatgtgccttgaaagcataatattgctgaatatgaaggcaatttctggctgaatacctataagattaacatatgtgctgatttggtaggtgttttttagcagaataatagaatatatgacacaagatgcctactaaaagcatggaatatgttatttagtaggcatttttagtaaaaatgtagtactattataatagtcacaaacgaaatttacctactaaaatactgaatatgcgactatttataggtatcatgacaacaagcaaagaaaatcaggctaaagcaaacagaaattaacagtttcaaagtgtatcatgacaataattacaagaaaaggggaacaggatgagttattttccgttttttagagaaatagaaggggagaaatgccttgttatcggtggcggtaaggtggcagcaagaaagataagcaggctgaagggatttggcgtgaagattaaagttgttgcaccgtctatagtttctgacatagaggcagtggcgcaggcttgcgataatataagtgttgaaagaagaatattcacaccacaagatattgaaaatgtggattttgttatcgcggcggctggtgaagaagtggataaagaagctacaagattgtgcaaagaaaaggcaattcctgtaaatgttgtggataaccaggagttatgtgattttatattcccttcaattgtgcagaagggtgatatggttgcaggctttgttacaggtgggaagagtccgcatgttgcagctaagttaagaagagattttgaagcaaatgtatctgataatatagagagcatattagattatctttcagaggtcaggacacttgccaaagaaaagatagatgatgacagaaaaagagcagcatttataagagaagtttctgaattctgcatgaaagcagacagagtgtgcagcaacaaggaagaaaatgcatttttacagaaatatcttgataacaggagtgagacagtgcttccgggggcagcacttgttggagcaggatgcggctcatatgaactcatcacaataaaaggtcttaatgagataagacgggcagaggttatagtgtatgatgatttgattgatgagcatctgctggaatttgcaccggagagctgtgagcttatatacgccggaaagaggagtggcagacattccaaggcacaggaggagattaatgagcttcttgtagaaaaagctcttgaaggcagatatgttgtgagactaaaaggtggtgacccttatgtgttcggcaggggcggagaggaagcacttgcacttaaagaacatggaataccagtgcatgaagttccgggggttacatcaggtatcggtctgtgtggaatggcaggaattccggtgacacacaggggtgcaagccgtggatttcatgtgattaccggacatacggcagataatctgtcaccagaggttgaggaaatcaggtggaaatcatatgcgaagcttgatgaaacatttgtatttcttatgggtttaaagagtatagacatgattacggaaaagctgatgagatatggaaagttgtcagatacgccggttgcggtaattcacggtgagaatacagatggtacatatgtaaagcttgtcggaacactttcggatattgcagcaaaggtgaaagaagtagacttcccatcaccagctattatagttgttggcgaggttgcgtcactggaattgacggattagcagaaacttaagatgcgctgaaaagcagcgcaggaatagaggttaacatggataaagacagacttgacagacagatagagtttataagagagattgataaggaaaagagcattggcagacagacgtatctggcggatgcgtcaagaaaggaagatgacgctgagcatgcatggcatatggcaattatgactgtgctgttgtctgaatatgccaacgaaaagattgatgtgctccgcacaatgacaatgcttcttatacatgaccttgtagagatagatgcaggcgatacatatgcttacgatgagaatgctaagaagacacagcgtgaaagagagttaaaatgtgctgacagaatattcagtattcttccagaagaccaggggaaatatatgcgtgaattgtgggaggaattcgaggcacaggaaacaccagaagcaaagtttgcaagaactatggataacttccagcctgtaattttaaatgatgcttcaaaaggaaaaagctgggcagaaaagggtgtgcatcttagccagatattaaaaagaaatgcacgaacaggagaaggctcagaagaactctggaaatattcgtatgaaaaatttataatgcctaatgtgaaaaaagggaatattaaagaggattaaaatagtagaaattcgagttaagggggtaaaatttacaaaaaagtaaaaaaatacccccttaacttaaaaaaacatttcttttgctataataaaaatataaaacggaaattttccgaaaacaatattttatgataatccagacgataagagaacatatattaagagtgttataggagaaatattagaaaaggatattaagcacagggtaaagatacgtaatgtttcagtttttgaaaaagtgcagacatatcttattaacaactttggctcaacaactagtttgaagagtatcttgaaagaacttcataaatctggaatggacataaagagagaaactttgaaccgttatattaatatattaatggatgcaaaaataatatacgaatgtaagaggtttgatttaaaatccataaatggtgagcagaagtattatttatcagatatgggtttctattttgcaacaaatactgataacagaattaattatggaccagcccttgaaaatgttgtttttaactatgcaaaatcaaaggggtatgatatcagtattggaagaataggaaagttagaatgtgattttattatgagagataatatgaacaactatggttatgttcaggtgacgatgacaacaatgttaaacagagaaacagaggatcgagagtatgctccattagagatgattaaagataactatcctaaatatgtgcttacaagaaatgatatgatacaaaaaagaaatggaatcattcatgaaaatataccgcagtttatggcatctggaaagcttttctaaggatgctccagcataaccacaacgcggaattcctgcttttcctccgagtaaacataattgagcagaccattatatttatctgcaatgcgctttacacttttaagaccataaccgtgaaaaccagtgtcctgttttctggaatgaagttttccgtcatggcctaaaggagatgatttgcatgagttagcaatgcttataaggtcagcgttgccgcctctgataagagaaacattacaatctatatatggttcatcacatgatagggatgcatcaatggcgttatcaagaagattgcagaatatggaagtgaaatcctgtgcgggaagatattcaagggtgttggcgcgtatgtctgcctcaaagcttatacctgaattactacattgttcggcatatcttgagataattacattcagtatatcaattttgcaatatcttttggattttcttagtgcatcacttcccagaatgttattgatatatccggttatttcgtcaatatgttttccatcattcagctggctgatagtattaaggtggttcttaatatcgtgaataagaatgtgctgtttctcattaacttcctgaacataattataataatgttcagtgtcagtctctttctgtaattcaatctgcaatctggcatattcaacatttttttggctgatatcctgctgcagatagaaagtcaggatattgattgagagcagcagaaccagacatatgaatacaataacagagtcagagccagacaatttaccgttgagacatatatagccaagagaaacggtaatgatagaggatataacaggtatcagatacagcataagggtgcttttgcgtatagaagcattattgactgtatctttagagaaaattctggttactaactgtgaaatacataaatagacagatttgcttaatataacaaatgtaaatgccgaactatgtatgtttccatcacggaatgcatatatcgttatgtcaggaatagctgcggcaataagtccttctgataatgccataagaattgtcagggcaagggcatgaaacagtgcccaaaccggttttgaatcataattaagcacgatgcagcacagatagacaatgaatgagcaaaatgcattgagtgccgcattagtgagaattgctacaggtataagcagactgaacatgccaatagtgattaaaagagataaaaatgtgttctttcgtgaagtaaatatccggttgcagtatagccatagaataatggcttctataagatatacaaataaatagtacaatattaaattcataaatccccctctgattaataaactagcgcaatgttgtaagaaatgctgaataggtattaaaaaaatcattatacttgcgcaaggcaatatcagcgtaaagatgattttccatatatattctgctgttattataagacataatataattcatattcactatataacatcgatggctctgataaaagctcccagacggaagcattgatttaatgctggcaagagtctgggtggttgtatatgtatctgaaaccgtgtggatagtaagattgcggcagtgaggattaacctccaccataatgatatcctttgctgataatatataggttgtgcctttacattttacaataatcctgccgccaatagaattgaattcagatatggcgtcttcaaggttacgcataaaacgtttactttcaacaggctttgaaatataacggaatacatgaaagcgcatggcttcgtcaagatattccggaaaggaagttataataattattattgctgccggataagatttaacaagcgaattaccaacggcaatgccatctatgccagacatctggatatctaaatatacaatatcgggtttgatatctgaagccagaatgtcttcaccagagtgaaatatgtaaatatcaggtcttttcagtttatgttcaatataataactttcgcacagagttttaatctgctcgcatatcaaattgtcatcatcacatataaatatattcattatccaatctccataaaataaaactattgttattataaccgatgagaatattaaaataaatgttattttaaacacgaaaagtgtcatttcacgcaattggtattgaattaataaaatagatgtggtattaaaggcttatataaagcgttgtacacatatgcgcatgggtatgggagaagaccagctcatgtatatagataagagagaaattgaaaaagccgaagaatggaaaaatatttttagtgagccagttcatttactagggaggtgatattaaatgaagagaagaggcattaggtatgtgattccaattatatttattgcagtattggtgggagcgatggtgacatatgttctactccacaagaatacagaagcagagaagggcttagattatgcaagtcttatcggggtaacaggagacagtgattttcagaattactgggatacagatggatggtatgatctggctgcagttgaagatggatattattacatgaattttgaacagaagttgttgtttttgaatctggagacaaatgatgttatacctgtgtgtgcaaaacctgagtgtgatcataaatcttcaagttgtaatgctttttttggaaatggagcggcattgaggagtatatattattatagaggatatatatattattttggactttctaatggcatggcacagttatgccgcatggataagagtggcacaacaagagaagttataggtgaacttatacctaatgatggggttgactcgattcgagctgtttttcagggggaatacgcttttatatatgatgggagtggccttgctgatgagcaagagactacaaagagcataatagaagtatctctgacatcaggagacaagaaaattgtatatgaagttactggaaaagggatatcaataactaatgttaaatgttttggtgataaaatattttttactgtgagggaagccgattccatatcagataaagccataagtgtgcatagcagaggtttgtttagctattcgtgcagcaatgatgagatagaagaagtgagtggacagaatattaatgattattatgttgtggatggaacaatgtattactttgttacgggagaggggctttacaagatagatattggaagtgatatatcacaaaaaatatgggagtcaacagaacaatgtgatatgtgtagtgtatcttcagatggagaatacatttatcttaataatcataagtactgttattatatgtgggaattatatggcttttcagaaaacagatatatagttattgataaaggtggaaatgttattaatgagatattgtgtcctgatgcattggcgttatattttggggatgacaggtatttattttataaaagtatgaacgatgcagaaggtcttatgtatatgaaaaaagatgatatagagactggtggagattggaagcaggtgtttgaatgacaaagtatataaggctgtttaagaaaggaatgtatagattttgtatgatgtttcttcttatattgatatcatcaggatgcaatgtaaaggaaatagaaacacagacacaaacagagactaataaccaatatgcagtacaagaaccagaaatgacagttatagatggaataaattatataacggagcaaggcattaagttaaaggtgacatacccaataatatctaaagatatcgccgatggtaatttggttggaacatatatggtaaatccagtaaaattaggcaatggattgggagaaaaggatgaaatggcgtatattgttgccggtattatagagtggccatcattatataatgatgaaaatatagagaaattagagtatacggcatataatgcatcctgcatatttgattacagtgatatgagtgagaataaatatacaaaaaaacagatggatataaaaggcgaaacaaaaacaatatatggaaatgatgaaaataagttaaagttaataattataaatgaactcccaacatctgataaagcagcttatagttatatgcagcctgagtatgttgagataaagagtgttattgacgatatcaataaaatgattgtaggagtccatgtttattatatggatgggagcgaagattctgattattatagagtagaaagtatatctaagagtgatataagcaggatacaaatatacaggttatgattggcatatagggggaaatatgcaggaattaaaacgtatcatcaattataaacggattatattgttgttaattgctgcaacagttaatgttgtattctttttgtatgacaataagccggtaatggatgaagatataatcaacaaagaaaatgttgctcatgagacatatattaagaattatcacgaagaagtgaatgcaataattgataatgctgataaacttaagaaatatagtatttttaataaagctggaagtttttcgtatgcgaatatattgcagacggcaagggattttgaacgagtaaagaacgttattttaccagaggatgagtataaaggggtgcaggcatatacaacttattattatcaatatttctttactatgcttgtaatgatgtttgttatatacgatatgtttgcacagcgggataatggcatgtggagcataacatatagctgcgctaatggaagaatcatgtatgcgataaagcagacgggagttattgttgttacaggagcttttacacatactctgatatactggtctacgtttattgcggcaatgctgcaaagaggaggcgtcagggacttagtaaatccagtgcagacaattgagacatttgataaatttacatatccgtggagcaaaataaagtatgtgacggtgctatatctgatatcaatggtgtgtatagttgccctatgcattactatatggggtgtttttgttatgttccgtaatcgtgtctatgcactggttacaatgcttatatttgcggctgtggagcagtttatatattctcatatagacatacatagcgtgtggaatggtctgcattatattaatattattaatataattaatataaatgctacattttcatcatatagaaactggggtgtgggaacttatgtatttcctgtattttcagtggtgctgttcgtgcatattatatgtgcaggtgtaataggttatattgctataaatgtgtctgcttcaatgaaaccatacaaaaatacaacatttataaaacggtttacagattgtgtatcagctggctgtcagaaaattcttgcaaggattccgtttctatttaaggaaatacataaatttatatttacttctcattgtggctgggttgttgtggtaatgctgacagttacagcgtatgtatgccagacaggccagtatcactatacagatgacaataagtatatggatagtgaatacatgttacatggagggaaagattatacatattttcaggattatcttgataatctataccagcagagagatgagctgcaagctgacatagatgattatggagatatattgacaagagatgaaagcgttgatattggtagttatgttaatctgaaaacaaaacaacagcagatactaaagctgatagaaagtcgtagggaatacgcggacaagattgaatatatcggacatatggatgaaacatttaatataagagcatggatgatatcggacagaggatatgaagtgatattgggcaagaaaggactgtatcgcagaataatggtaaatcttgcactgatatgcggttttatacttatgtcagcagatgcaggaagacttgaaagagtcagcggcatgatactttttgaacatagtacagcattgggacgtaataagatgagatgcaataaatatttgtcgtgcataacaattacaataataatgactgttattatatgtggaatggaattcttatggatgagacatatatatgggataccttacatgaatgcgccggtcgtgagtcttacatttatggggaataaacttggaatgggactatatgcatctggaattcttaagtggatgctgttacatatgacaatatggcagtatatgcttatgcaatttatcatgaggcttgtaatatgtcttatattaagcgttggcataatgaaaataacaagaagcattaagaatataaaataaaggcataaattgcaaacgcagttctgctatgatatacttaatctgtatatagccctgcgatggctgaataatgaatttttgatatatgaaaggcggatacgagatgaacgacagatatcagacaccacttgcagaaagatacgcaagcaaggaaatgcagtacattttctctcctgacatgaagtttaagacatggagaagactctggattgcattagcagagacagagcatgaacttggacttcctattacacaggagcagattgatgagttaaaggctcacaaggatgatattaactatgaagatgccaagagaagagagaaggaagtaagacatgatgttatgtcacatgtatatgcttacggacttcagtgccctaaggctaaaggtatcatacatcttggagcaacttcatgctatgttggtgataatactgatatcatcattatgacagaaggcttaaagcttgttcgtaagaaacttgttaatgttattgatgagctttctaagttcgcagataaatataaggcacagcctacactggctttcacacattttcagccagcacagccaactacagttggtaagagagctacattatggctcaatgaattagttatggaccttgaagaccttgattatgtactctctacaatgaagcttttaggttgtaagggtacaacaggtacacaggcatctttccttgaacttttcaacggagatcaggataagatccgccagattgacggaaagattgcagaaaagatgggatttgacgcatgtgttccagtttcaggccagacatattcaagaaaggttgatacaagagtacttaatgtacttgcaggaattgctgcgagcgcacacaagttctctaatgatatcagattattacagcacctcaaggaagttgaagagccatttgaaaagtcacagattggttcatcagctatggcttacaagcgtaatcctatgagaagtgagcgtatggcttcacttgctgatttcgttatcagtgacgcacttaaccctgctattgtttcatctacacagtggtttgagagaacacttgatgattcagctaacaagagaatgtcagttccagaaggcttcctcgctgttgacggaatccttgacctctacttaaatgttgttgacggacttgttgtatatgataaggttattatcaagcacatgatggcagagcttccattcatggcaacagagaatattatgatggatgctgttaaggctggcggagacagacaggagcttcatgagaagatcagagagctttctatgatagcaggaaagagagttaagcaggaaggtcttgataataaccttcttgaacttattgcagcagagccaatgttcggtgttactcttgaagagttacagtcaaagcttgatcctatgaagtatgttggccgttctaaggaacaggttgacgagtatcttgctaatgttatcaagcctattcttgattctaataaggaagagcttggcatgaaggcagagattaatgtttaattaataatttggaggtgttataacatgaaggttgtattagttaatggcagcagaagagatgcaggctgtacatatacagcactttctgtcgttgctaaggaattagaggcacagggaattgatactgagatagttgcagttggcagcagagttgttaagggcgagcttgacgcagttgtcaaggaagttggcgctaagataactgatgcagacggacttattgttggttcacctgtttattatgcttctccaacaggagagatattaatgttcctcgacagattatttggtgcatatggtaacgagcttcgttacaaatgtggttcttcaattgcatctgcccgccgtggcggaacaacatcaacagttgatgtgttgaataagtatttccagattaaccagatgccggttgtatcatctaactactggaatattgtacatggcaatacacctgatgaggttgttaaggacgaagaaggcatgcagacaatgagacttttaggtcagaattttgcatggcttgttaagtcaatagacgcagcaaagaagcagggaattgagcttccacaaggcgagaataagattaagaccaactatatcagataatttataattcttcataaatatttaatgtcataagaggcgtgctgtatatataattatgtatatacagcacgcctttactgcccgggcagtgatgaggatagacagatatttaaggagtattgttgtgaagtcttacaataggagaaaacttatgaagagaataattcttggggcagtgatactgcttgtggtgcttattgccgcaatcgtagcctgcgccctgataagttaccacaaacagccagagcttactgctgatgagattaaacagcttgatgagcagggcatatggaaagagagaacaagtgccgagcgggcgcgcattattgaggataatgacgaggcgcttaaagagcggataagaatgataagcaatgcaaagagtgagattatactctcaacatttgacttcaggtcagatgacagcggaaagctgatgcttggagcacttattgatgctgcagacagaggtgtatcggtcaatgttatagttgacggggtatccggttttaccaagatgaagggcaatcctgattttaatgcacttgcgtcatcagacaatgtgaatgtgaagatatacaataaggtcaatccttttaagccgtggcagtcaatgggaaggcttcatgataaatatgtcatagccgacaggactaattatatacttggtggaagaaatacatttaactattttctgggagcatatccgggacataagaattacgacagagatgtgcttgtgtactgcgaaagtcctgatgaaaccagctctgtgaatgatgttcttgcttattatgagagtgtctggaactataaggagagcaaggcatttttaaagaataacaaatgtgcaggcaataagaaggtcaaggcggcaaggaaagaactacttgataattacaacatttattatgcagataacaaagattacctgactgacactgattatacagatgaaacagttgaagtcagcaatatagcacttcttagcaatccgatagaatgtggcgcgaaaaaaccggtagtgtggtatcagcttactaagctcatggagcaggcggattcgcaggttaagatacatacgccttatattatctgcaatgagtatatgtatgacggattaaagaaggtatgcgattctgttgaaaatgtgtcactaatgactaattcagtaggcaataatggcaatccatttggctcagcagattattatgcgcataaggataaggtgcttggcacagggcttgaagtgtgggaatatgaaggcggatattcataccacggaaagtcggttcttatagatgatgatatatcggtggttggctcatttaatattgatatgagaagcgtgtatcttgatacagagcttatgcttgttattgacagcaaggagattaatgaacagcttggaggtgccatgcagacgtatgagcatagtgcaagaaaggctaatgctgatggcacatacgataatccatataatgtgcagcctgtagcgcttacgcctaagagagaacgcagaatgaagctgattaagaatttcctgttgtggacgaggtatttgttctagatatctgttctggaccggatatattctggatttgtaaattacatggcatgagcagggcgtcaggttggcgaaggcagcaggctgatgcggctggcaggctgatgaggctgttgggttgatgtgatcggcaggccgatgtggctgtcaatctgatgtgattgtcagtctctgtggggaagacctacgaaagtggtattaattgtaacttgagtaggtttttcttgtagtgaatgcctgtagcagctcggtaagctcatctcagatttaatggctgagaaaaagtttgaaaaaagttttgaaaaaagtcaaaaaagtgcttgacatatatcaagttttaatattataatagcagagcagtttgcgagagaaatcaagcgaattgttctgaatgtggggtcttagctcagctgggagagcatctgccttacaagcagagggtcacaggttcgagccctgtaggccccatttctttttaagacattcagtaaatattatggcgagatagctcagttggctagagcacacggttcatacccgtggtgtcgtgggttcaaatccctctctcgctactatctaagaagtggaagcaggcgatgcttccactttttttgcgcgagtagcgatgagagaagccatggaaagtttacagccgtgcttgcacggacttggaactttgtatggttttacgaggagcaccgcgacaacgacagaacgaagttctggagtatgagctgctcgcgcaacccgcggcgatgagccagctcacacaggaggggaataatgacacatttacaggaagaattgtttaagctgcaggacacagagtacagggattttaacagcagtctgattccgggaattgagaaagagacagttataggagtaaggactccggttttaagaaaatttgcaaaggaatatgcaaagagcggagaaactgagcagtttatgcgtgagctgccacataagtattatgaggagaataatcttcacatgatgttaattgggcagattaaggattatgctgagtgcataagtgagcttgaaaagttccttccatatattgataactgggcaacctgtgattcaccgcttccaaaatgttttgataagaataaagaagatattcttgaaagggcgaagaagtggattgcagcagataccacatatgttaaaagatacggaatgggcgttatgatgcgcctgttccttgacgaggattttaaggaagaatatatacagcttgttgcaggtgttaagtcagaggagtactatgtaaatatgatgattgcatggtatatggctacagcacttgctaaacagtgggatgcggcgattccttatatacaggaacacaggctttctgaatgggtacacagaaagtcaatacagaaggctgtagagagttaccgcattacaccagagcagaaggaatatttaaagggtttaagataaggttatgaaatcaaatgaaatagatatgacgacaggttccctgccaaagaaaatattaatgtattcagtgccgcttatgttgtcaaatgtactgcaggttatgttcaacctgtgtgatgtggcggtagttggtaaatttgtaggaccactggcacttggtgcggtaggttcaacgagtataattattacattgacaaccggaatcctgctaggactagcaggtggtgtcaatgctgtagttgcgctgtttgtgggggctaagaatagtgcaaatgtaaagaaagcagtccacacttcaattgtaatatgtatgattgcgggactgctgttgcttttgtctgggctgttcctttcaagaccggtgctgaatcttataggaactaagaaagaactgatagatggtgcagttatatatcttacaatatatcttcttggttcaccggcacttgcaatgtataactatggtaacgccgtgttaagtgcagttggagatactaaaaggccacttatgtatcttattacagcaggtataattaatgtggtacttaatctgttctttgtaatagtatgcaggcttggggttgtcggtgttgcactggcaagtataatatcacagtatatatcagcatttctgatacttaaattcctgtttggctgtggcaaggattacgggctttatataagaaatataggaatggattcgcatatagcagcgagagtgttaaagattggattgcctgcagcagtacagtattcactttttgcagttgccaatctgtacatacagacggcagttaattcatttgaccatgtagttgttgagggcaattcggctgcggctaatgctgataacattgtgtatgatatgatggcggcattctatactgcatgtacaagctttatagcgcagaatctaggagcaagaaagcgtgacaggattaggaaagcatatcttgttacacagatgtattcatttattataggagcagtgcttggtgcattgcttgtagttttcaggacacagtttcttagtctgtttacaagtgatccggatgtgctgcattacggctcaataagactgggaataatgggatgctcttattttgtatccgcatttatggataatgcggcagcgggagcaagaggacttggcagaagcgttatacctacaataatagttataatgggttctgttgtatttagaatcatatgggtgtgtacaatatttgcaagtatacatacactgatgtcactctatcttgtgtatgcgagtgcgtgggcatttacatctattataggaacggtgtattttataataatattcagaaagactttgagataaaagggctgtgtcttaacacatataatcgttaaggcacagcctgtttaatattagttattattagcgatagcagcttctgctctttctaaatcttctttggtatatttagttaatatctgttctttagttattccgaattctagcatggaaattattgaattgactttttcagtgtctatgccaagttcaataccctcatttctgcctttgctttcacattcagcctgaaatcgtttcattgcttcacacatattaacagtccctccttgttcattatctatacataagtccataagctttggaactgaggttatgctacatatcagttccattacatcaatatctacattgcgggattcatattcacgatatattgaatcgaaatcatcgttatatatgttccttataatattaaacacatttcttacatcttcattataaaatgtatacttatcagaatcaagtatctgaaccagatttaacttatagtcggagaagtaagttttgatattatcaggcatggaaaccatcatgtcagagaggcatgatgggccgtcccataatgaatcaccatagtataaaacgagcgtgatgatagggtggaagcggtcagatttgtcaattccagacagaaactcttcaggagagctgaaagaatccttatttagcttatgctgtttcttgatatcgttgtattcctttatgtagccgagtgcgtcataggtcatggtttgcaaaggcatggcataatgtgtcttgtcctgaatttcaagaccgagaatattaaactctacgccgtctgacatcttctttacaacatctctgtttctggtaatagattcattgtaattcttagactggatagtagcagaaacatcagtgtccatctcagtaagcttatcaggcttaagcacctgcctgccattaaagacagtagcattgaaaaggtctgcaaaatgttcattatcgcgccagaaagtcttaagagagacatctttctggtgagtagtacggttgttattattcatatgtcgcctttcttaaatgtttcatatgtgagatatagttaaaatataaaatgatgcatcaatgtgtaatatataataacaatacgaaaagaatatgtcaatataatttataaaatatattatatatcaatattttcaatagtaatcatgaagaaattatgaaaaaacggcatgattttaagggtgatacagatattgctgtatgtctaaataaaataatcaatcacatacattttacaaaaactttacgaacacgagattatgcattttacataacattgataacataccctctgcaagcagatgcagagggttttcttttttgagacgactcacatatcattcggtcaggaaactgattcaagcccctacgaaaatcttctgttaatgcttgcaaataaaaaaagaggaaggtaacgaaagttatgagaaaaggaattaaaaagttacttacagttgcattaacagcaacattaggccttgcagtattagcaggctgtggaacaggtacatcatcaaatggagatggatcagcaaacggaggcacaactaaggagctttcaggcaagattcagttagcaggaagtacatcaatggaaaagatgtgtggcgctctcatggaagcatttatggaagaatatcctaatgtaacagtaacaacagaatatacaggttcaggtgcaggtattgagtcagtaacatccggagctgttgatattggtaacgcttcaagagctttatcagataaggaaaagtcagcaggtattgaggagaacatcgtagcaattgatggtatcgcaatgattactgataagaacaacaaggttactaatgtaacaaagcagcagcttacagatatctacacaggaaagattactaactggaaggaccttggcggttcagacgaagctatcgtagtaatcggcagagaggcagcttctggtacaagaggagcatttgaggaacttcttgaagttaagaataaatgtgcatatgcacaggaacttgacagtacaggtgctgtacttgccaaggttgcagcaactccaggtgcaatcggatatgtttcattagatgtagttgataagacagttgcagctttaaagcttgatggtgtagatgcaacagaggataacattaaggctggtaagtatacactttcaagaccatttgtaatggctactaagggttctgtttcatcacagagtgagcttgttcagacatggttcaacttcgtaaagtctgacgcaggcaagaaggttatcaagggtgtaggcttaatcctcccagagtaagccggaaaatatagattctgaatggagagattgacatggatgaggttataaatgttggtatgaacagaataaataaaacaccagaagctgttaaggcaacggcaaatggttcgttaaaaggtaataaaaagtcaaagcatgcaagtgaaagtgtagcacggtttatattccttatatgtgcggtagtagctatcctggcagtctgctccattaccatctatatgtttataaaaggaacagagagtcttaaaagcgtcggaatagcagacttgctctttaaaacagtatgggcgccaactgctacaccgcctgcatatggaattgtatacataattctttcatcaattgcaggaacaacacttgcgattcttctcggtgttccaattggattattaacagcagtttttttgacagagatagcaggaaaaaaacttgcagcagtagttcagccggcagttgaactgttagcagcaattccttctgttatatacggacttctcggattaatgctattaaaccccctcctttataaattagaaaagcatgtattcgcgaattccacaacacatcagtacacaggaggagccaacctcctggctgcagtgctggtgcttgcaattatgatacttccaacagttatcaatatgagcgcgtcagcaatcagggcagttccaatgaatttaagagcaacatcacttgctcttggagcaactaagatacagacaatattcaaggttgtagttccagcagccaagtcaggaattataacaggtatcgtattaggtataggaagagccttaggtgaggcaatggctattaatctggtagccggtggttcagtaaatcttccgcttccgtttaactcagtcagatttcttacaacacagattgtaagtgagatgagttatgcagatggagtacacagacaggttcttttcacagtaggacttgttctttacattttcataatgattattaacctgataattacatttatgcagaagaaaggggagaaagcaaatggataatcttaaagccaagaaaagacatccggaagaaatagcagtttatacagcaatatatgtatgtgcagcattttcagttctcctgcttttaggaattattatatatgtgttcgcaaagggcgcaaggcgtgtaaactgggcatttcttacaggtgttacatcaattcttcacggaactgtgggaattgccggtaatattctgaacacattgataataatattacttactatgataattacaacgccaatcggtgtaggtgctgcgatttatttaaatgagtacgccaagccgggaaagcttgttacagttataatatttgcaacagagacacttgcaggaattccatcaattatatttggtctgtttggtatgcttttcttcggacagttatgtcacatgggatattcacttctgacaggttctcttacacttacattaatggtgcttccgcttgttacaagaaacacacaggaagcgttaaagactgtacctgacagcttcagaacaggagcggtaggtttaggcgcaggtaaatggtacacaatcagaacaattcttcttccgtcagcaatgcctggaattgtaacaggagtaatccttgcaataggaagaattattggtgaatcagcagcattgctttttacagcaggaagtgcacatcttcttccaaagactttcgatgcatttcttgagaaaatatttcattcgggcggaacacttacaatccagctttatttaagcgcaagcaagggtgaatttgaggtggcattcggcatagcggttgtacttcttgtaattgtacttcttattaattttggtacaaagaggctcgctaagaagctcgaaaagcactaattgggaggaatatatgagtaataagattaaagttaaagttgaaaatctgaacctgtattacggtgagaatcacgcccttaaggatgtgaacatggatatacaggaaaatgcggtaacagcatttatcggaccatctggctgtggtaaatcaacatttttaaagacactaaaccgtatgaacgacttggttgacggtgtaagaatagatggcaaggtgcttcttgatggagaggatatatatgatccgtcagttgatactacaatccttcgaaagaaggttggaatggtattccagcagcctaatccttttcctatgagcatatatgacaatattgcttatggtccaagagttcatggaataagagataagaaaagacttgaccagatagttgaggagagccttcgtggtgcagctatatttgatgaggttaaggacagattgaaaaaatcggccatgggactttcaggtggacagcagcaaagaatctgtatagcaagagctcttgcagtacagcctgaagttcttcttatggatgagccgacatcagctcttgaccctatatcaacatcaaagatagaggaccttatggaagacttaaagaagaaatatacagttattgtggtaacacataatatgcagcaggcaacaagagtttcggatcagacagcatttttccttgtaggagagatggtagagtttggagatactaaacagatattctcttatcctcaggataagagaacagaagattatatcacaggaaggtttggatgatgagaagtaaatttgacgaacagcttgacagacttaataaagaaatgatgaagatgggctctgcaattgaagattctatacgaaaggcagttgatgcccttgtaaaacaggacgcagagcttgctaaaaaggttatgcttcaggacgaggagattgacagggagcagaagactattgagagcatctgctttaatcttcttatccagcagcagccggttgctaaggatttaagaacaattacagcagctttaaagatggttactgatatggaaagaattggtgaccaggcagcagatatcggcgagataactattaaacttgccagccagtcatacataaagaagttggagcatatcaatcagatggcttctgagacaatgcttatgttaatcagaagtattgaagcctatgttgagaaggacatggataaagcgagaaaagttatcgcgtatgatgatgtagtagatgacctttttgaaaaggtaagagatgaccttattgcaatgatacaggcagattcagccaatggtgagcaggctgcagatcttcttatggttgccaagtattttgagagaataggagaccatgcaactaacattgcagaatgggtaatatttgctcttgatacgaagggaggttttgatgaaaatgcttctgaacatttgtaaaaatactaatttaactgaaaagaaatatgaatatctgtttcttcttcttaacacccttgcatggtgtgcaatcggctttgttgtatgggcagttgtaagcatatttgcattcaggggaatggaatggatgtttacattcgttggatatttcggacttattcccggctttatcggaggggttgttgaggcctggaggaatgagcggtaacgggacttttatttatattaaaaaaggcatagaatataggcagaggtgattgttatgaaatttgctatgaaacacggaggcttatgttctatgtcttttgttttgcgtatatgttcatgtgttgtattcttgtgtacatgggtggcgtttctttgcgcgtgtgagggtaatgcaagcaaaatcagtaacacaggtgttgaggaaagcacttacgttttacagtctggtattggaacagatgcagccacttctttagagggacagccagtgatgagaaaaggttataatccacagatggattttgcttatgatgagcatgatgatgtagatattgacgagaattatgttggcagcttatgcggtgaagccacaaaagaacttgaaacaatgttcggaccagcagaattctatgtgacagcagaaagtaacgaagatgacagttacacaatcgatgtgtattataatgaaaaagctgcgtcattttcagatgatgaggtggaacagataagaatgtatattaatcaggaatacaaagaagtgagactgtcagagattaatatacagggctggtagttgtaaattaagccagcttatgttatattaattgaggcgttgaattggggacaccacttttcaagaccagcagacaggattatatgaatgaatcatgtcagcgaacatacaacaggcgtcggtaataaaagatttccggcgtgtttatattatgattttaaaggcagaatcagctggaaagcggttctgccttttttgcgcgagcagcgatgagagaaggcatggaaagttcacagtcgtgcttgcacgagctgtgaactttatatgggttctcgaggagcgccgcgacaatgccagaatgaaattctggcatatgagctgctcgcgaagcaatgagccgtgcaagctggaatgtgcttgcacaaattccagcttatacggcgaatgcccataatgaacaacgaagggaaaggagagtctatggtacagattaacggagagcaggttgaagcttcaaaggttgtggggaaaacacttcttgcttatgtaacagaggcagggtatgaccctgtaggcattgtgattgagaagaatatggaaataattcacagggaagactttgacaaggttaatattgctgatgaagatgtgattgagatattgcattttgttggcggcggacagttttaatatgagtttagtttgagagcagggagtctggctgcttataagcaatgtcagagcggttaataataggcaaagacctactcaattacagaatttgaaattgagtaggttaatatttggcagggaaatattaagaaacctacaaggcgtgagaaaatcaagatttagtaggcttttgtgatagctgacagcctataaaagcgagataaacaaggtatttataggtcgtattaaaacatgagagtaaagaaagacctataagaagctttataagagtttgattagtaggttttctgaaaataagagagctgacgcgaacctactaaaagacagaaaaatacattttttataggttttctagcggtaagaggacaaattcaatcagcaattacaagattgagaacataaaagagaggcaggacagactataggtgcaggaagtattgccagaaaaagaacagtcatcagaaacataataaaaaagataacaggaggaagcaaagatggaaaataaggcacaggacaagaaagaagataagttaatattaggaggacatgagttcaacagcagattcatattaggttcaggaaagtacaatgtgaatcttattaaggcggcagttgagcagggcggtgctgaaattatcacacttgctcttagacgtgccaacacagagaataaagagaatattcttgatttcataccgaagggagtaactcttcttcctaatacttcaggagcaagaaatgcagaggaagcggtaagaattgcgagactcagccgtgagatgggttgtggagattttgtaaagattgagattatgcatgatgcaaagtatcttctcccagataactatgagacagtgaaagcaacagaaatacttgctaaggaaggatttgttgtaatgccatacatgtatcctgatttgaatgtggcaagagatttacagaatgccggagctgcctgcgttatgccgcttgcctcaccgattggaagcaataacggactttcaaccaaagcatttatacagatacttattgatgagattgatttgccaattatcgtggatgcaggaattggcaagccttcgcaggcatgtgaggcaatggagatgggagctgctgcggttatggctaatacagcgattgcgaccgcaggaaatgttccggcaatggcagaggcgtttaagaaggctatagaggcaggaagaagcgcatatcttacaggtatgggaagagttcttgcaagaggaggaagtgcatctgacccattgacaggattcttacgctaaatgtggaacattaaaatataatagaaaagaaggcagaataatgaacgaagaaaatcaggtgtattttatagacagtgaccagcttccaccggctgcgttagagagaaaacataagttagagcaggatccgtcattcagaacagattacatgaaatatcttgatgacatggaaataattgattcagatattaaggataaagtcttaaaggcaatggatgagtatgattatgattcatacgcagctgcagatgtggagagggcattaagcaaagaaacatgtaatattgaagattttaaggcattgctttcaccagctgcagcaccttatttagagcagatggcaagaaaagcagagaatgaaactaagaaacattttggcaatacagtgtatatatttacacctatctatatagctaattactgccagaattactgcatatactgtggcttcaactgctacaataatattcatagaaagaaactttcattcgaggaaattgagcatgagatgaaagttattgcagatacaggaatggaagaaatcctgatactgacaggagagagcagaaaatattcagacgttgaatacattggtgaatcagttaagattgcaagaaaatatttcaagaatatcggcatagagatatatcctgtaaatgtggatgaataccgctatcttcatgagtgcggagttgattatgtaacagtatttcaggagacatataatcctgtaaagtatgagacattacatttgttaggtcataagagagtatggccatacagatttgatgcacaggaaagagcacttatggcaggtatgagaggtgcaggcttttcagcattgttaggacttgatgatttcagaaaagacgcactggcaacagcactgcatgtatattatcttaacagaaaatacccacatgcagaactgagtcttagctgtccgagactccgtccgataatcaacaatgataagattaatccaagagatgttggcgaaaagcagttgtgtcaggtgctttgtgcgtacagattatttctgccattcgttggaataacagtttcaagccgtgagagtgcgcagtttagaaatggtataaccaagatatgtgccactaaagtttcagcgggtgtttcaacaggaatcggcgaccatgaatctaaatatacaggaaaagaagatggtgatgccggagatgaacagtttgaaatcaatgataaccgttcatttgacagaatgtataaggatatggaggatggcgggcttcagccagtcgtgaatgaatacatttatgtatagaaaatatatatgtataacgaacaagcaccttgtgagtggcagcggtggtgcagagtgtactatgaatgagtacattacgcagattgaaaaatgtgtggcactgcacccatatgccatgatacttcgtgaaaaggatatggacaggcaggactacagggaacttgccagacacatacaggtaatgtgcaggaaagcttctgttaaaatgtttgttcacagtgatatcagtgcggcaaagtatgcagactgtggaaatgtacatttttcaatggaacattttaaacaaatgtgtgaagaacaggcagatgtgataaagaggcttgattgtgtgagtgtatcgtgtcacagtatggaagaggcagtgaatgctgtccgcgcaggagcagaccagattgtgcttggaacgatatttgagacacagtgcaagccggggaagatgggggcaggacttagttttcttaaagaagtgtgtagagcggctcatactgttaatcccacagtaaaagtgtttgcgattggaggaattaagcctgataacattaaaaaagtgcttgaagccagtgcagatggcggatgtatgatgtcatggtttatgcaacataattaatataatatacaaagaaaaacttctgtgatataatttcgcggaagtttttctttttttaaaattttttaaacttatttaaacttcatttcgtataataatatatagaactaaagaaagggcagaaaattatatgaaagacatgttaagactaggtactaaagatagaaaaaaatatctaattataagcgtagtgtcagtcttagttatagcattaataactgtttccataattgctgtgcaattaagacataataagaatgaaaaaaagaaaaatgtagaagaaacaactgtgcatacaatgatggtgcaggaaactacagtgcaagagactacagaagagggaaccacagaagaggatacaacgcaggaagagagtgcagaagtagtagatagggaagtggttgaagaattttttgaaaatgagatatcaacagaaaatgaggaggcatttgaacttccgccaaggcagcttacggacgagtttatcccatatgatggacagaagagagaaataacatgctatggggatagtatgatggccggagcaggaagtgcaactgaaggaaaagtaaatggaattgatatatatgggtggactacacctgttacaatagaaaaactgactaatataccaacacataatcttggagggtcaggagaaaattcaagtcagattacttttagggctggtggaacaaaggtttatatagacagggatattacaataagtgaaactgattcggcaatagctcagattatagatgaaaatgaaaatgtatttgaaacagataattatagtggatatggatttgattatgatccttatccgggtgatatgtatataaatggttatttgtgtgatgttaaaaatacaggtgatggtcaggttgaaattaaacttacaaagggatatgcagcatatgacaattctactgataatagtgttgttatatatgaaagtgaaacagctgcatattcaagacagggagcagatataaaagcagagagtgatatagtaacagaatatgacacagtgataaaagaaacagagtcacaaacatctggtgaaaaaccaatggagaagccaacagaaaaaccagcagaaacttcaggcgtagaaaaagttacaatttctggcggaacacaggcaatgacaagggcatcacaggaaagaagtgcgaaagatatattaatacttgaaatgggaagtaatggcggctgggaaaatgattatcagcagcttattcttcaatatgataatataatacttaattccggctgcaaatattatattatagtgggagatactgatgaccctgcggactcagcggatggctatcagggagcatatgactcagatggcaattatgtgggaatcggtgatacatcatgggaagcagcgttaagacttgcatatggagaccatttttttaatacaagaacatatatgattcagaatggattaagtgactgcggacttgatacaacaacagatgaccttgagaatttcaagaaaggtaatatatctgaacaattaagatatgactggacacattttaactgttatggatattattcaaagggaattggtgtatacaagaaaggtgtagaactaggatactggagttagaattttacaagaattatacatgaatatgattacaccttttacatgatatggttattataagtatgcattgaaggggtggacagccaaaagacggggatggctgtgattccctgacatgtaagcctattaaccatgaatgaagaaaggtggtaatcatatggaagtagctatcttaaagcattcgcagcgtaagctgctttttttatgccctaaaatgttaatttgttaagaaggtttgaatagattgactgtatatgttattatttcaaagtaaaatcaataagaaatattaaagagaaatatgaatgtttaacaaatacagaaatataaaaaagattggtcttgtgttaataggtcttgccttagttatatttttaataaccaatgtaagaatccgttctgttgattcctacagaaagcaattcagtaatatggcagattcgggtcagacacagcccgacagaccagataataatgatagattacaggatgaaaccatcagtaccgataatgccaatgccacagacaacggcagctttgatggaacgggtgatggaacagtttcagatgacaattctgcttctggctcaacggataatataacagttacagataataattccggttcaggtggtagagaatcagacaggagtaacggaaacgccgtatcaggtggcaatgattcggaaagcagcaatttagggaataatacttcagaaagtaacaattcgggaaatgatgattcagggaataattcacagaataccagaccggcaggcaaggtaatcagttgtactatagagataagatgcgataatgcgacagcgagaaaagacactgttaatccgtcaattgcatcacgtatccctgatgatggaactatacttgaagttacaacatacactgcagttgaaggctttactgtatatgatgttcttgcagcagttacagcaatgcatgatcctgtaattccgatagttgctaattctgataagtcgtatgtatcaagcattaataatctgtcagagaagaatgtaggaccacaaagtggctggacttacagagttaatggagttctgcctatgatggcggctaatcagtatacagtaaaagatggagatgtaataaaatggatatacgtgtgccagttaggcgacaagtaactaaatattcagcatttgcagtaatgcatccgtggacgaatttcatctacattgcacttgtgctggtgataaccatgttcacaatgaacccggtgatactggcggtttcgtatgcaggttcacttgcccttggaatatatatgcagggtggttcttttattaagaagaatattatgataacaattcctgttgttatattctctgtgttaatccagccaatttttaatcacagcggagttacaccgttgttttatattaacgataacatggtatgtcttgagaatataatatacggcgcagttataagtcttttattaattgcagtcatacaatggtgcagtgttgcagccagttatctttcttcggagaaaatgatgtatctgttcggaagttttattccttctgttggcatgatattttctatgatattaagaatgataccgcttatgagaaagagatacagacaaatacatgacgcacagatgggacttcgaggagtggagaataagaatggcatctttgaaaaaatcagacattttgcgaatgaattttcaactcttataacatggtcacttgaaagctcaatggaaacttctatgtctatggagagcaggggatatggacttaaaggaaggacaagctttaacagattcagattcacactaaaggatacctttacgataattataatgcttgtatgttttgtgatggctgttattccaatagcaggaaagaagcttgcagtatattatctacctgtaatatattatacgaaatcaggtgtagaaggagtgctggcagttacagcatttgtaatactgacagtaactccattgataatagagataataggagatgtgcagtataagagacgaagttcatataacgaaaggtaattgcataatgacagacacaattattaatgtttcatcactttctttcgggtatgcaggaagtgatgtattggtacttgaagatataacatttgatataaagaagggcgaggttgcgctgattataggcgcttcaggaagcggaaagactacgcttcttaagatgcttggtaaaagcatgattccagaggggagacttagtggaaaagcagaatattacggcagacagataagcagcttaagtcaggcagaagcggcagttaagattggatatgtcggacagaatcctgacaaccagattgttactgataaggtatggcatgaactggcatttgggcttgaaaatctcggcgtgccaaatgcagacataaggcgcagggttgcagaaatgtctgaatatttcggtattaccggctggtatgataagaatacagaggaattgtctggcggacagaaacagcttcttaatctagcttccataatggttatgagaccagaggttttattgcttgatgagccgacggcacagcttgacccgcttgctaagaagaagttcatagatacagttctggagcttaacaaggattttggaataacaattatgtgtgttgaacacaatcttgcggatatctattctaaagcggacaaagtgcttgtgcttgagaatggaaagcttatatataatggttctcctagaaagacagcagaaagtcttgttaagacagagaatccgcttgtttatgggcttccttcatctgtaaggatatatgagggctgtaagaaggatattacatttgaaacagactgcccgcttacagttaaagagggcaggaaatggatagccagtcttaatattaaaggagaatcttatgtatcacaggataagcattacgaaaccggggatacagcggtttcagttaaaaatgtgtttttcagatacactaagaattctgcaaatgtacttgaaaatatcagctttgatatagagaagggcaggataactgctctgcttggaagtaatggagcaggaaagacaacgcttttaagacttatgtcaggaattaaaaagcctatatcaggtaaggtgaaggtgaatggaagatgtgcagtgctaccgcagaatcctatggcattgcttaatcagataagtgttgaggaagaattagcatcagcagttatggataagagaaattcgtctgttaagaatatggacagaaaacagagaattgtgcttgttgagaatatgctggagcggacgggacttctaagggtgagaaagcagcatccgtatgatttgagtggagggcagcagcagaggcttgcatttgcaaagattctgctgtatgaaccggatattattctgcttgatgagccaactaaaggaattgacccgttcttctgtaaaaagatgggtgaatggctggaagaattaaagaatatggggaaaactattgtgatagtttcacacgatgtggaattctgtgcattatttgccgacaaatgtggattaatatttgacagaaacatagaaagttacacagattcacacagcttctttgcaggcaatatatttttcacaacggatactaacaggattatgtccgattttttcaaagattgtgtaacatgtgatgaagctgttgaagcgattcacagatgtttagaggataatagataatgagtgttaattacatgcttataagcattattatactggctgttgcaattgctattcctttctttacgtttgaaaagaggaagccgaaggcaaggcatgttgtgatgattgcagttatgtcagctcttacagttgttgctaatataatatgtgcgtatacgataccgcttcatgctggtacagcacttgtcataataacgggaattgcatttggaccacagacaggctttcttacaggtgtactgtcaagatttgtatgtaatttctttatggggcagggcgtatggactccgtgggaaatggctgcgtgggggctgcttggtgttcttgcaggaattgcattttacaaaccggagcttgtcggatattttgatgataagaaagagattgtaagaaagcaggcaagaacaggtctgtcagttatggctgttcctgttgtgtgtatggttgtctcagagattgtgggatatattgtatatatatttactgaaaagccgggagagacattctttgggtggaggctgtatgctttcggacttgctggaattattatggcagttcttcttatgagaagccgtataccttgtaattttatcacagtgacaatatttacatttataagtgtgtttgttatatatggtggaattatgaatattgcagccatgatgatgaacagtacatatacggattcaggcagtgcaaatatatcatgggaggcactgaaacttctgtacataaccggagcaccttatgatgcaatgcatgcgggcggagcggctgtatgtgcatttctttttggtgatggactgcttggaaagcttacgcgtgctagaattaaatatgggttatagagagctgctataatttggaaagcctactataataacatttttaggcgattgagtgggttgattgaggtatatgatattgctattgaggggcgagaaacctactcaataacggattagatatattttagtaggccattttttaagaatagaagctgtctggcatgaaagttgtatgcaaaagacctactaaattggaacaaagcatttggttagtaggtgattgagattaattggatgaaatatattccttgaaaaacctacggaagcgatgatcgatagtgacttagtgggtctttggcaaatacacagaagaaaaagcttatactatggtgtgaattaccaatatataaaaactgccgccggatatcgcgaggattccggtggcagagctgtgtgtctgcagttattagcggacactttttttattgtaaacagttacacatgcgaatgtagcagcacaagcagctaagagcaggtacatgtaaacattaacatcaccagttgcaggtgatacttcattgccggtagaaggttctgtggctggctcagtagaaggctcagtagaaggttcagtagaaggctcttctacaggagcgttctttgcgtctgcaatagccttaacatcagcggttatatcaaatgggttagttttaccctcaagagtatagaggtaagtgatgataccctgtaatgcatcaggtgttgctgatttgaagtcttcctgacctgtgtatgtattaatataagcaccattacctgaagctgatttgaacttattaacaattgaattatataaaacagcagtattaacatccggattgttgtactgagcaaagaatgcaaggttcataccagacgaattagtgttgccaggtgttggatattgaacactatatcctgatgtgccatctgttaatatagtctgcttagaatagtctgcagcactgtcaacagctttctttacatcagaatctgtatcatataatgatgcaaagaatggaaatacaaatccattactatcagttgagtttccccagttgtcaataccattaccatcagcagtacaagctgcaaggagagctgatttgatatcagctaatactttgtctgagttactgatggtgtctctgtaagcattaactactgaatatactgaaccaatgtgatagatattcatgctgttattgcttaagtcatcaactgaaaatgtgttgataattttatcaaatttactgacaacattgattccgttgaaatcagtagcatcaattcctgatgcagaaagaatcattataagatatgtatagcttgaaatataataattcttagcgttgtatccgttattgatgtttatagttccatcttcgctaatgttattcttaacgaattcaagatatgcagcaagctggttagagcagtcatatcctgaacggattgcaaggaacaggtctcttgaaactccatagaatacgccggtatcagcatatgtagagaaatcaatactgttcataaggtaagaagcagtaagctgggcttcctgtcttacatcggctgcagcaggagctgtagcgtctgttgttgtatctgcgaaagctggtacgatattcatgcagattaagcatgcagcaaccagaaatgcaaatatctttctttttaattgtttcatgttttcctccttgaccacctctcaccaggtgatgtgaaaatttatagtgcagtaaatatcctgacttgccgcttaagccatttcttaggccttcccgtgcacagtgccatacttaagttaaggatgaatgtatagcgtatttaaaactaaagctgctgctgattacagtggcataatataaaaaacgtgtcggcatacagtagagtgagctgttatggattctgaccatattccttactgcctgcttgattgtacctttatgtagaaaatgtgtcaattacatttacctttgctttacatatattttacataactccgatagtggattttacacaccagtgtgacaataaaattattgccaaagaaaagatgtggttaagagaaaaatgaggaatgatatgaaattcacagaaattaagaaaaagtttttggactattttcgggaaaaggagaacggggcaatgagcataaacactaaagaaacaacacagagaggatgttacacaaacagggagttatcatggcttgcatttaatgagagagtgttaaatgaagcagctaatcctaaagttccacttgcggaaagacttacatttgcatcgatataccagactaatctggatgaattctttatggtgcgcgtgggaacgcttatgatgcagatgcagcttcaggaaaaggaaagagacaataaaacaggaatgacaagtgaagagcaggtaaaagctattcttgataaggtgagtgagcttgagaagaaaaagggcagagtgtatgaacagcttatgggagaacttgagacagccgggataagaataattaattttaataagctgtctaatgatgaaggtgcaatgctggaggaatattttgatatgcatatagcaccatttctctcgcctatgataatagggcagcagcagccatttccatttcttgcaaataagcagttatatgcaattgtgcttatgaagactaagaagggtaagaataaaataggaatagtaccttgttcaaacagtgtatttaagagacttatagaaattcctacaagaccaggaacatttatgctttctgaagaattgattctgcattttgtatcaaagctgtatgagaattatgaaatacaggaaaaatcagttatgagagttattagaaatgcagatatagatgctggttcatttgatgacgaggaccttgattacagaaatatgatggaacatatggttaagcagagaaacaggcttaatccggtatgtgtacagttaaatagagaaataaacgacaaagcaaagaaaaagcttacagattatctggaaataggtgcaaaacacctgattgaagagagaactccactggatatgtcatttgtattccagctgcagaacgtgttaaagaataagcctgagctattttataagaaaagagttccacagccaggtaaagaaatcagtatgaatgaaaagataattccacagattgagaagaaagatgttgttctttcatatccatttgagagtatgagaccattcatatctatgctggaggaagcagctagtgacccgactgttgtatcaataaagatgactctttacagagttgctgacagaagtaagatagttgagactcttattgaagcggctgaaaatggtaaagaggttattgttcttgtggagctgagagccagatttgatgaggctaataatattgaaatgtctaagagattagaagaagccggatgccagcttttatatggtctgggtgattacaaggtacactcaaagttatgccttataacacgttcggttaataatacattttcatatataacacagataggaacaggcaattataatgaaaagacttccagattatataccgatctgtcacttattacagctaatcaggagataggtgcggatgcggctgcagtatttgctgctttgcagaagggagaaacggtggatagttctaaccagcttcttgttgcaccaaactgcctgcagaacagaattctttcaatgatagatgagcagattgataaggcaaagaatggtcaggatggatatgttggagttaagattaattcccttacagacaaacttattattgagaaattaattgaagcttcacaggcaggtgttaaaatagatcttgaagtaagaggaatatgctgtataaagccgggagttaaaggatatacagataatatccgtgtggtcagtgttgttggacgttttctggaacattcaagaatatatcgttttggaagaggagatgaccagaagatatatattgcatcggcagactttatgacaagaaataccacgagacgagttgaggttgctgcacctgtgcttgataagcattgtcaggaacgcataattcacatatttgatcttattatgcaagatgatgagaaaggcaaagagcagaatagtgatggagtatactgtgacagacatatcaataatcctaagattgattcacaggaaactttatacgaagaaagctatgaagcggcagccagtgcagaataattaagaaaatggaggctaacaggtatgaagataggtatgcttacaagtggtggagactgccagtctcttaatgcggcaatgagaggtgttgccaaaactttgtataataattcaaatgatgttgaaatatacggatttcttgatggttataaaggaatgattactaagaattacaaactgatgaaagaagaggattttagtgggattctcacagagggaggaacaattcttggaacttccagaacaccttttaaatatatcaatgagcctgatgaggaaggacgcgataaggttgcaggcatgattaagacttataaggatttaaaacttgactgcctggtaatgcttggtggaaacggctcgcataagactgcggctcttttatcgcagaaggggttaaatgtcgttacttttcctaagactattgataatgatatagaaggaactgagatgagttttggatttcagtcagctatagatgttgcgacaagaactattgatgagatccacacaacggcagcctcacacagcagagtgtttattgtcgagattatgggacataaaacaggctggcttacacttcattcaggaattgcaggaggggcagatatcatacttatacctgaaattccatataatgttgatgaggtgttgaatacaatcagaaagcgtgaaaagcagggcaagaaatttactataattgcaatggctgagggtgcaatatcagatgaggatgcaaagctgtcaaagaaagagctgaaagaaaagagaaagacatatacatttccatcagtagcatatcagttgagtgatgagctgcagaaaaaagccggtcaggaagtaagagttacaataccgggacatgtacagcgcggcggaattccaagtgcatcagacagaatacttgcaacaagaatcggagttgaggctgcaggacttatattaagaaaagattatggcaatatggtatgcatcaaagatggaaaattctctaagataccacttgaagaggttgcaggtaaaacaaagatggttaacgtagataatgaacttataagacaggctgaaagcttaggcattagtcttggcagaaaggcataagtggtatataatacaaagcaaatgcttcaggaaagaagggaaatgctttgaagaaatcagacagactaaagatagttattcttggaataactggattacttattcttattggaaccggaatatttatatttataggacagagtatatgtaccatggctggtgtagggctttttgttattgtgtgtcttggaatggttgttgttgcaggaaagaaagatgaccagacagaaacaatagaacagcttaaccagacaatatctgaacagagcagaaggataatgaatactgaggggcagcttgcaagatataagagagaacttgcagaggcgactggtaagaatgaagcataataattaaatattaaggagatagtcatgttactagagattttaaaggcaattcttttcggtatagtcgaaggaattacagaatggctgcctataagcagcacagggcatatgattctgcttgaccaggtagtcaaacttaatgtatccgcagatttttataagatgtttcaggtagttatccagcttggagcaataatggccgtagttatattattctggaataaattgtggcctttctatatgaagaagactaagagtggtaagaaagcagcttggaaagatggcgcacttgcaatgtggattaagattattattgcatgtattccggcagcgattgtcggattgattttcgatgataagatagatgaattattctatcatccaatccctgttgctattgcacttatcgttgtaggtatagtttttatagttgtggagaatgcaaagaaaggcagcaggccagcaatcagaagtataggtgagataacttataaggcagcaataataataggtctgttccagcttatagcagcagtatttccaggtacatcaagatcaggtgcaacaattatcggagcactcataatcggagtatcaagaagcgttgcggctgaatttacatttttccttgcagtacctgtaatgttcggagcaagtcttttaaagattgctaaatatgctgctgtgggaatggctatgacaggaacagagtgggttgttctcattgtaggctgccttgttgcgttctttgtatcagtattcgtaatcaagttccttatgggatacatcaagaagcatgatttcaaggtgttcggtgtgtacagaataattcttggtatagcagttattgcactcagctttgtattgttttaattctaatacacttcaaggtatgaattgtatacataaccgcttgtaccattataatcaataagggtgtaataagcaccaacagatgatatagaaccggtagtccctcctggcacaactgcaaaggagtggctgccgtttttgtctttatgcatattgacataggaagcacctgtcacacggtaacttttaagagcagatgtattggttatgcgtccatttgcaaatgtatacgatggctgggcggctgtttcaggctgtgtgttttggacttcagtctgaacggtttctggctcggaggattcacaggatgtttcagattctacagtttctgtctgagtttcagtcacgacggtggattcctgttttgttacatcctgagaagaagcagtttctttaactgttacagcaggcgttgttttagacacagtttctgaactgatatctttaacagtaactggctgggtttcagaattgctggcagtgtgaatgtttttttcaagaccgccaccgccaaaaccgatgttttcaaagatgacaactccggttataattattacaagatatatacataaaaatattttaacaataagattattgattttcattgtgactaaagacctcatattttctataataaattaatattagttctttttatggggcaggtcaataaaaaaagtgataatccagaggtgtaaaatgaacataataggtcacatttcaacagattttccaacaaaatttgggattccaagacagagtggattgatagaggaattaaaaggtgtcataacatttgaaccagaatacagacagccagaggctttcaggggattggaggatttttcacatatatgggttttatggcagttttccaagtcgcagaagaaaactatagcggcaacggtaactcctccaagacttggaggaaaagtacgaatgggagtatttgcaacaaggtcgccgttcagaccgaatgatatagggttgtcatgtgtgaaattagagcacatagaatatacggcagataaaggaccggtactattcgtttcaggggtggatatggttgatggcacgccgatatacgatatcaagccgtatgtaaaattcacagactcacacccagaggcaaaagaaggatttacggcagccacttataacagaaatcttaaagtgatatttccatcagacctgcttgcaataatgccggaaaacaaacagacagcagcggttaaaatattagagcaggatccaagaccagcttatgatacagacgagacaagggcttatggggtaacattttcaggctttgatatcagattcaaggtgcatggggatgtgctgactgtgtttgaagtggtggatattgaggcggctggtggatataagaaggtaaagtgagctggtgtcaatttcacttgataatccagctaaaatgtgctttacttatatggactaggtaaacaattaatgttgcaatcaagattaaggaggagctatatgagagttggaatgggatatgatgttcataaactggttaaagaccgtaagcttatcatgggcggagttgagattccatatgaattaggtctgcttggacactctgatgcagatgtgcttcttcatgccattatggatgcattactgggtgcagctgcacttggagatataggaaagcatttcccggatacagatgacagatacaagggaatatcaagtatcaagcttctggaagaggttggaaagaagatagatgaggctaattatattatagaaaatattgatgctactattattgcacaaaagcctaagatgcgcccatatattgatgatatgagaaagaatatcgcagatgctttaaagattgatgttgacagagtcaatgttaaggctactacagaagaaggacttggatttaccggaagtggagagggtatttcttcacaggcaatatgctcacttaattctgtttctaattatatatacggtgcggctgatatgacaaactgtagacctgactgtggtggctgcatgggctgtcagaacaaatagaactgacaatacattcgcagctttaattcatataatataattaagaatagaaaagtcaggattaacagattatgaaatatagagattatgtaaagcaggaaatagcggtaataaaggacagagaccctgctattaagtcggataaagaggtatatctttatcctagttttaaggcaatacttaaatatagaaaagcccataagttatatcttaagggcgaatattacaaggcgagaaagatttcacagaaaactgcaagacagactggaattgagatacatccgggagcgcagattggcgaaggactttttattgaccatggacatggagttgttatcggagagacagctattatcggtaacaatgtaacactttatcaaggcgttacacttggaggaacaggcaaggaacaggggaagagacatcctactctggggaataatattatggtaggagcaggagcaaagattcttggctcagttaccataggtgataactgcaagattggtgcgggttctgttgtattaaaggatgtgccagcgaattctacagtggttggtgttccaggaagagttgttattcaggacagcgtaagactgtttgatgatttagaccagatacatcttccagatcctgttatgcaggatatcgagaacttaaagcaggagaacgcaagacttaagaagagacttgcacaccttgagaacagcgtcaatgaaagccgcagctcgtatgatgataactaaagtgtgattatgaaaggaaatctgacatgaggatttataatactttatccagaagaaaagaagagtttaagccattagaagaaggtaaggttaaaatgtatgtctgcggacctactgtatacaaccttattcatattggtaacgcaagacctatgattgtatttgatacagtaagaagatatcttgagtataagggatatgatgttaattatgtatctaactttacagatgtagatgacaagattattaagaaagctaatgaagaaggtgtatctgctgaggagatttcaacaagatacattgctgaatgtaagaaggatatggagggcatgaatattaagcctgcaacaacacatcctcttgcaactcaggaaatcggcggaatgattgatatgatacagactcttattgacaagggttatgcttatgaagtcaatggaactgtatactacagaacaagaaagttcgcagaatacggaaagttatctaagaagaatattgacgacttggaggcaggacacagagatgaggcacacagccttaaggttacaggtgaggatgagaaggaagacccacttgatttcgttctctggaagcctaagaaagaaggagagccatcttggccatcaccttggagcgatggaagaccgggttggcatattgaatgctctgttatgtctaagaagtaccttgctgacgaaatcgatatccatgcaggtggagaggatttaatattccctcaccatgagaatgagattgcacagtcagaggcagctaatggagtaccattctctaagtactggatgcacaatgcatttcttaatattgataacaagaagatgtctaagtctttaggcaatttctttacagtaagagatataagcagggaatatgaccttgaagtgttaagattcttcatgttaagcgcacattaccgcaatcctgttaatttcagccatgaccttatggaatcagcaaagaacggattagacagaatcttaactgcagttgataatttaagacatctgtcagagaatgccaaagatgttccaatgacagaggatgagaagaaaataatagcttctatagatgacatttataagaaattcgaagattcaatggatgatgatttcaatacagcagacgcaatatcagctatatttgaacttgtaaagcttgctaactctaattcaagctcagacaattccaaggaatacatcgatactcttatgaagaagattacaactctcacagatattcttggacttaagacagacaagaaggaagaaatgcttgatgaggatatagaggcacttattgccgagagacagcaggcaagaaaagataagaattttgcaagagctgatgaaattcgagatgagttattagcaaagggaattgttcttaaggatacaagagagggcgtaagatggagcagagcctagataacgaccttgtaaaatgcatatatgaaggtctggatatgaagcatacagagccttcgcagttatcacctcttgttcttgcatatatcggggacagcatatatgaccttgtcattaagacatgggttatagaacagggaaatatgcaggttaataagcttaacaagaaaacgagcagtattgttaaggctgaatcccaatctgccatgataggtgtaatagagccaatgctcagtgaacatgaggaagctgtgtataagagaggacgtaatgcaaagtcatacacatctgccaagaatgcaagcattggagattacagaagagcaacgggttttgaggctcttatgggatatctgtatcttagcgggcagtatgagcggatgatggaactggttaaagcaggactggaaagccttgagttaaagtagagccggcaaagcagaatccatatctgtaatggataactggattctgctttgttaatattaaggagaaatatatgagatacaatgaattaacatttcagggaagaaatgctgtattagaggcattccgctctggtaaaactattgataagctttttattcttgacggctgtcaggatggaccaataaagagtattgtcagggaagcaaagaaaacagatgcaattatcaattatgttgataaggaaagactcgacagacttgcaggaacaggacatcatcagggagttgttgccattggcgcagcttatgaatatgcagaggttgaggatatacttgcagcagctaaggaaaagggagaagatccatttatattcattcttgatgagatagaggatcctcacaatcttggtgctattataagaactgccaaccttgcaggtgcacatggagttattattcctaagagaagagctgtcggacttacagcaactgtagccaagacatcagcaggcgcgattaattacacacctgtagctaaggttactaatatttcacagacaatcgaggaacttaagaagcagggactctggtttgtatgcgctgatatgggcggggagacaatgtataatctcaatctcaaaggacctatcggccttgttataggtaatgagggcaatggagtaagccgtcttgttaaggacaaatgtgatttcatcgcatcaattcctatgaagggtgatattgattctttaaatgcctcagttgcagcaggtgttcttgcatacgaaatagtccgtcagagacttaattagggagtttttttatgaagcatatggaagagtatcctgatgaagagcttattgatatgtacagggcaggtaatgagcaggcaattgagtacatatttgagagatataagtatatagtgcgaaagaaagcaaaagccatgtttcttgccggaggagacagtgatgatttaatccaggagggaatgataggcctctataaggctgtccgtgactatgataagaaaaaggatgcatctttcatgacatttgcaggaatgtgcataaacaggcagattcttaatgcggttacagcttctaacagaaagaagaatacaccacttaatacatatgtttcttttgatgagccggtcaatccagaagatgattctcaggtaaagctggtggatgtactaaagtctgataaggaacagaatccggaaagactttttattgatcaggaaaatgctgaaagtttagaagataaattatacagtgtgttaagtgattttgaaaaaaatgtgctggaattatatatgtctggcaaagattatatagctattgcgcagatgcttgataagccgccaaaatctatagataatgctatacaaaggataaggaataaagttgacaaaataaccaacctataatattatgaataggtgtgttaagacacatgctattgtagctcaggggtagagcacttcattggtaatgaagaggtcacgggttcaattcccgtcaatagcttaatttaatgtttgtgttttttaaaacagattggaggacgctatggtaaaagctattgtaggtgctaactggggtgatgaaggaaagggtaagattactgatatgcttgccgaagaatcagacatcatcgtaagattccagggaggagctaatgcgggacatactattattaatgattatggaaagttcgcgcttcatcttttaccttctggagttttctataaccatacaacaagtgtcattggcaacggcgtagctcttaatattccatatcttgttaaggaattaaagagccttacagaccgtaatgtaccaatgcctaagattcttgtatcagacagggcacagattcttatgccttatcatgttgcatttgatacatatgaagaagcaagacttgctggtaaatcatttggttctaccaagtcaggtattgctccattctattcagataagtatgctaagattggtttccaggttaatgaattattcggagacgagcaggaacttaaggaaaagattgctaatgtatgtacattaaagaatgttatgcttgagcatctctatcatcagccacttcttaatgaagaagagatattcaatactcttatggaatataaagagatggttgagccatatgtatgtgatacatcagcatttttacatcaggcacttaaagacggaaagaagattttacttgagggtcagttaggttctcttaaggatactgaccatggtatatatccaatggtaacttcatcatcaacattagctccttatggtgctattggtgctggtattccggctgcatcaattacagatgttgttacagttgttaaggcatattcttcagcagttggtgccggagcatttgtaagcgaaatctttggtgatgaggcagatgaactcagacgcagaggtggagacggtggtgaattcggagctactacaggacgtcctagaagaatgggatggttcgatgcagttgctacacgttatggcgtaagaatgcagggaacaacagaggttgctcttacagttcttgatgtacttggatatcttgatgagattccaatgtgtgttggatatgagatagatggaaagattactaaggatttcccaactactccacagcttgagaaggctaagccggtattaaagactatgccaggctggaagtcagatatcagaggaattactaactatgaagaacttcctgttgagtgccgtaactatattgaggctattgagcaggaaattgaagcccctatcacaatggtatctaatggccctggaagacatgagattatccacagaaagagtaaattttctaaataataacatttaacattaccgtatctgcagtacaacagttttgcagatacggtctttttataggtaattgaaggtaaatccctctcctcacctgaggggaatgtgcttacaataagcacatggattttgcttcgcaaaacaaggagggaaatatgaagtttaataaatattttgaccacactgacttaaagccggaagcgactaaggatgatatacgtacattatgtgaagaagcaaaaaagtataattttgcatcagtatgcgttaatggaatatatacagcatttgcaaaagaatgtctttccggaagtgatgttaagacatgtgttgttgttggatttccgctgggagctatgagtacagacgtaaaggcttatgagactaagaaagccgtagaagatggtgcggatgagattgatatggttattcctgtaggacttcttaaagcaggtgaatatgatgctgtgtatgaggatattaaggcagtaagggatgcatgtgcaggaaaagttttaaaggttatattcgagaactgtcttctgactgatgaggagaagattaaggcgtgcgaactgtctgttaaggcaggagctgattatgttaagacttcaacaggattctctacaggaggtgcaacaataagtgatgttgcacttatgaaagcccatgtggaaggaaagtgtaaggttaaagcggcaggcggaataagagattacaacacagcagctgccatgatagatgccggagctgacaggcttggaacaagcgctacaattaagattatggaaggaaggcagtaaaattactgcttattccttcctgaaagaatcttgtatacaagtgtcattgcatatattacaacaggaaatacaatgtctgtgaagagcagacctgtaaatactttatgacatgcctcattgtctatgaatgcaagtattaaagtagcgattatcattatgccccagagtatgactgcagttaatgcagcaaatcgttttaatcgtttcatgaataagacctccaatgtcagatacttaataatatacattacattggcatgccgctcaagttatttataaaaatgttgcgtaacagataaaaaatgttataattaaatgaggcatggaggccgatgtaactattaggaaacagaatcaatagacaaggaggtatgcatatgtcaattaatgcttataatgccagtacaatatcagcattgttcgcaggactcaataattcgtctagtggaacatcattgtcatatggcattgattttacaacttataattcaataaagaatggctcttatagcaaactgatgaggaagtattacagcaataaggcttctgaatcaacggatggtgcgactgccaataagaataccggtaaggtacagagtattgatatacagaagaataatgcgacggtaaacagagacaacgcagcatcacttgtggattcagcatcagaacttaagaagtactctctgtggtctaaagttgataagacagataaagatggcaatacagctaaagaatatgatactgataagattgcaaaggcagtatcttcatttgttaagaattataattctttagtatcatctacagcagattcttcaagcagatatgtgcttaacagtgcatctaatatggtgaattatacaagggttaatgctgatcttcttaagaagattggtatatctgtcggctcagataataagctgacggtagacgaggataagttaaaggcttcagatatggctgtggttaagtcggtattcaaggattccggctcatttggacagacaatatctgccaaggcttcaactatatatggtaatgcagtatcacagttatcagaattatctactaagaattcttatacatctaatggactgtattcatactcatctggttatacatacaaccagtacacataattaatattttgaaaggtaacaatcagacatggcattattagaaacatggagaaaactcgcatacgagacagagatggatcagaagaacgcttcagaattctggggttcatattttaatcaggagaaggctatttatgagcagattctcgcagattctgatacagtagttaaaggaactgttaaagaattagcagagaagtttggagtagaagtacttcttatgacaggattccttgatggtatcaatgacagcttaaagactcctaatccaattgaaactatggatgagaatacagaagttagtctcgattatgacaaggaaaaactttattacaacatggtaggctgcaaggctgactggctttatgaattgccacagtgggataaccttcttgatgagcagacaagaaaagacctttacaagaagcagaagctttctggaactgttgttaagggcaagaaaatcggaagaaatgatccgtgcccatgcggaagtggaaagaaatataagcagtgctgtggaaagaatgcatagcttttaaacactaagacctgccagataatggcaggtcattttaatgttaagtacaggaatgataagaggtaattataatggatgcatatacaggctttgcatatgtttatgatgagtatatggataatattccatatgaggaatgggggcagtacatgattgctctccttaaggaaaatggtgtgtcatgtgattcatcggtgcttgaattgggctgtggaacaggaactgttacaagaatgcttgctaaggaaggctatgactgtgttggacttgatatgtctgaggatatgctgtctatagcttctgagaaaacatttgaagagggttcgcaggttatatatacatgtcaggatatgagggattttgaagtgccttatgaagtagacggtatgataagtataggggattccatgaattatattacatctgttcctgaccttgaaagtgtatttgcatgtgttagtgagaaccttaaaaaaggcggtgtatttatatttgatttaaagacaatacatttctttagggatatacttgctgagaatacatatgctgagaacagggaagattccgcatttatatgggacaactattatgatgaggaagaacgcaataatgaatatgagcttgctgtgtttgttaagaatgaggatggtacatttgacagatttgaagaacagcactatcagcatggctttactatagatgaggttacaggtgcagttaataaggctggacttaccgtgaaaaatgtgtataatgcatttactaaggatatgcctgacgataagtcggaaagattatattttgtgattgagaaataataaggagataattatgggtgattatattgttagagccacagcagcaggtggccaggtaagagcatttgccgctacaactaaagggcttgttgaagaagcaaaagaaagacataacatgagtcctatcgcaactgttgcacttggaagacttcttacaggtggtgcgatgatgggcgcaatgatgaagaatgatgcggatattcttactgtacagataaagggcaatggtccaatcgggagtatgactgttacagctaatcctaagggggaggttaagggatttgttggcaatccacaggttatgcttccgcttaaggatggaaagcttgatattgcagatgcggtaggaattggtgtattaagcgtaattaaggatattggacttaaagagccatatgtcggtgatactattcttattacaagtgagattgcagatgaccttacttattattttgctaacagtgagcaggttccatcttctgtaggacttggtgttcttatgaataaggataatactgttgagcaggctggaggatttattatccagcttatgccgggagcaacggatgaatttatagataagcttgaggcaagaattaaggagattaagtctgttacagccatgctggaggaaggaatgactcctgaacagattctggaacatattcttggggatatggagcttgatattcttgacactattccaacaaagttttactgtaactgttctaaggacagagtgagcaaagctgttatcagtgttggaaaagaagaaatccagaagatgattgatgatggtgagccaattgaggttaactgtcacttctgtaattcacattatacatttacagttgatgaacttaagaaaatgtacgactgctgtataagataaatctcaggcatatggaggtacacatgaataatattatacttataggaatgccgggaagcggaaaaagttcgcttggagtagtacttgccaagaagataggatttggattcattgattcggatcttgttattcaggaaagagagggaatgactcttgaaagaataattgaaaagcacggagatgcaggattcatacagattgaaaatgaagtgaattgttccatcagtccacaccacacggttattgcaacaggtgggagtgctgtatatggaaaagaggcaatggaacattttaaggatattggtactgtggtttatctagaacttccaccagaatcacttgaggagagacttggaagtcttaaagaacgtggggttgtgtctaatggaaagacaactgtggaagagatatatgctgacagggccgcactttataagaaatatgcagacattacgcttaatgagcagggaaagcagataagagaaactgtggagatgctgtatgatattataatgaataaagaccagtataattaaacaactggttgaactatgtaagaatttagggtacaataatctttaccttttaaatacgaaaacaaggaggattaacatggaaaacgaagctctttctaagaactttattgagcagattatagataaggatattgagagtggccattgcaagaaggtcattacaagatttccaccagaacctaatggatatcttcatattggacatgccaagtctatattattaaattatggacttgcaaaggaatatggcggacagtttaatatgagatttgatgatactaatcctactaaggaaaaggttgaattcgtagactctattaaggcagatgttgaatggcttggagcagagtggaacggagacgtcctttttgcatcagattattttccacagatgtatgaagcagctgtaaaacttatcaagaagggaaaagcttatgtagatgatttatctgcggaggagattagaaagtacagaggaactcttactgaaccaggtaaggaaagtccttatagaaaccgttctgtagaagagaatcttcagctttttgaggagatgaaggaaggaaaatatgcagacggaacgaaggttttaagagctaagattgatatggcatctcctaatattaatatgagagatcctgttatttacagagttgcacatatgacacaccacagaacaggagatcagtggtgcatatatccgatgtatgattttgcacatcctattgaggatgcagtagagggaattacacattctatatgtacacttgaatttgaggatcacagacctctttatgactgggttgtaattgagaccggttataagacatctccagaggagaatcctaagcagattgaatttgcaaagttatatcttactaatgttgtaacaggtaagagatatattaagaagcttgtagaagatggaattgttgacggatgggatgatccaagacttgtatctattgcagctttaagaagaagaggatttactcctgaagctattaagatgttcgttgagcttgttggtgttactaaggcacagggttcagttgaatatccaatgcttgaatattgtataagagaagatttaaagcttaaggttaagagaatgatggctgttcttgatcctgttaagcttgtcattgataattatcctgaaggccaggttgaatatatggaagtggctaataatcaggaaaatccagagatgggaacaagaaaagttccatttacaaaggaactttatattgagagagaggatttcatggaagagcctcctaagaaatatttcagacttttccctggtaatgaagtgcgtcttatgaatgcatattttgttacatgtactgactatgtcaaggatgagaatggaaaggttatagaagtacattgtacttatgatcctgagactaggggtggaaatttcacaggccgtaaggttaagggaacaatacactgggtttctgctacagaaggctgtaaagctgaagtcagattatacgagaatatcgtagatgaagaaaagggcgtttataacgaagaagatggttctatgaatatcaatccgaactctaagattgttcttacagagtgttatcttgaaccagagcttatgaaagctgtaagtgaagataagttccagtttgtaagaaatggctatttctgcgttgataataaagattcagaacagggtaagcctatatttaacaggatagtttcacttaagagttcattcaaattacagaaatagtgaggttatcctgatggaaggtattggacaaaagaaggaaacagattatatttttgataagacaatcaaatgtgatgtatgtgggaaggaatttaaaacaaagcaggtaagaaccggaaaagcaagatttattgggacagatgatatattaaagcctctatatgaaggaattgatacatgtaaatatgatataataatgtgcccacattgtggctatgcagccagtttacgtttgtttggacatcatactgaaaaacagaggcaggctgtaagggacaatgtgtcttcaagatttactgcaaaggagccggaaacagaaacttacagctatgagagagctgtgaaacgatgcaagatggcgatgcttacagagatggtgacaggtggcaagataagtgagagtgcatatctttgcttaaagctggcgtggatatatcgtggggagatacaagaggcaaaggctaatggagcagcacaagaacgtataagtatgtatgagaaatatgaaaaagagtatctggaagatgcatacagaggttttaaacaggcaagagagactgaatatcctccaatagcgggaatggacgagaatacgataacatatctgctcacaagcattggaatccattgtggaaagatagatgaggcaagaagatatggttctgctttgcttatatccagaacagccagcatgaagttaaaaaacaaaacaagagatgtattggagactattaaaaagaattagcactaaaggggcgtataatcattatgaacagggttaaagcttttgtacagaagatatggacctatgatctggttcacacagcagtttattctattgttcttgaactaatagttgaatgttttaacagaagaggaataatgggacttgcatttccatttatgcatccaattatttttatatacaatacacttataataatgacaagcatggcacttgcattattttttaggagaagaatgtttgtgtatagtgtggtttctgttttttggattggattggcacttactaattttataatactttcttcaagaaaaacgccatttacggcgatggatttttatcttataaaagatgctataaaggttgcgggattatatgtgagtgttatacagattattcttattgcattactggttatagcggttattgcaggacttgtttttctgtggcggaaagccccaaaacttgaagtgacaattaagaaaacaaagtttgttgcatatgcagcagtacagatgatacttgtatttcttgcagcatacggaatgggaattactcttctgtttacaggagctgttgaaggtcactttggtaatcttgcccaggcatataagaaatacggattcagtcactgctttgtgagcagtgtgcttgaccggggaattaagaaatcaggagattattctgaagaatatatggattcacttaagaatgatcttgataatgttgatgttgaagcgagtgaaaagactcctaatattatatttgtccaactggagtctttttttgatcctacacatgtaaaaggaataactttatcagagaatccgctgcctaattatcaaaaacttatatctgaatgttcttcaggatatctctcagttccatgctttggagcaggaacatgtaatacagagtttgaagtacagacaggaattaatattgatgattttggaccaggtgaatatccatatagaacaattatgaaatccaaggtatgtgagtctatggcctatgaccttaagaaacttggttattcaactcatgcaatacacaataatgatggaacattctatgatagaaatctggtgttttcacatctgggatatgaaacatttacttcaattgaatatatggatgggtttgaagaaacgcctatgggatgggctaaggattatattcttacaggagagattactaaggcacttgattcaacagctggaactgactatgtgtttacaatatctgtacagggacatggtgattatccatctacaccaatggaaggatacacaccagagattaaagtgactaactttccagttgcagaacagcagatatcatttgaatattatgtaaaccagattcatgagatggataagttcataggtgagcttatacagtctttatcagagagagatgaagaaactgtacttgtgctttatggagatcatttacctacatttgattttacagatgaaatgcttactaacggagataaattccagacacagtatgtaatctggagtaactttgatatggacagacaggaaaagaatattcaggcatatcagttgtctgcgtatgtaatgcaaagacttggtatatctgagggatatatcatgaaatatcatcagtcaaagcagaaacttccagaagatgagtatttgaagaatctcaaaattctggaatatgacattctgtatggtaaaaaggaaatttatggtggagaaacaccatatgaggctacaaatcttaagatgggtattgatgatattgagataacagatgtctataattataacaatacggtgtttattgagggcagcagttttaacgattacagttgtgttctgattaacgggaaagaatataccacggaaaaggtgagtgaccgtcttttaagagttaatggtattaatgtaaagaaggatgatgtagttgttgttgcacagaagggcgatgataaagttgaactcagccgtacaacttttacagtaaagcaacagagtaagaaaaacgcacaacaacagtaaatgtgctatctttaattgacagcgggtacctgaaatggtaatattagtaaggtgtttcaaacatcaagattttttttggaggtacttgaaatgaagggtacagttaaatggttcaacaaccagaagggttacggctttatcagtgatgagtcaggaaaggatgtatttgtacattactctggacttaacatggaaggcttcaagtctttagaggaaggcgctcaggttgagtttgatgtaacagatggcgcaaagggtcctcaggctactaacgtaacaaaattataatcggttgtttttcagtgtgccttttttatattatatatagaaagatatattgtaacacaataggattatgggggcggtcacaattaatattggaccgcctttttttgataatataatctggaggttttatggagaatttaaatattaattatgacaagacagtgagtaatgcaactgtcagtatgatatcagcaggcgcaatacttgttatatctgttctgatagttcttcttgtgttggtaattaagagatggaagggaagatttatacctttggcattaggtgttctttcgtatgttgtatttgggtttatgttttcacagcttttgatgagtgttctttcgcttatacctaatgttgatcagtcatttacgtataataccaatgcatatgtggttatatataatattctgcttgcagcagggtttggtattgcaagatggtttacggcaaagatgatgactgacagatataacagaacaggggacgtgcttatggcaggaacgggccttgcaattggagataccgttattacttatgcattgtcaatgtttacattttttgtatatgcacaggcaatatcagctaatggattagaaaaattcatctcggatatgtttaacagcggaatggctgagagtgatgtaattacattatatacttcaaatgtatcacagctgattgattcgcctgcgattctgtggtttttaatggctgtatctgcggttcttgatattgcgcttaatataatgctgtttatggttgtatatggcgtagtaaagaaacaggttaattatatgtatgcatattatgcgataattgcacagtttgtttctaatataatgttccagttatataatgcattttcacttactaatattattgttttgtttattgttaagcttgtgattgtgggaggaatagctttatttataaagcaattcattatgaaggagataaaatactcaaatgactgatgtgaaaaaaggactaacagcaaatgaagtagagcagttaacaaatgatggcatggtcaatgtgtcagttggaaaacaatccaagaccattggccagattgttgcgggcaatgtatttacatattttaacctgatatttgctgtatttgctgttcttctggctcttgtgaggtcatataataatatgacatttcttccggtaattatttctaatatgtttattggaataattcaggagataagagctaagaaggttcttgataaacttacggtggttaatgcacctaagacatcggttataagagatggacaattacatactgtagcttcggagactctggttaagggagatttgtgcgtattttcagctggaaaccagctgagtgcagatgcaattcttgttgatgggtttgttcgtgtcaatgaatcattagttactggtgagtctgacgaggttgtcaagaatgccggggatatattactctccggcagttttattgtgtcaggagaatgtaaggctgtgcttacaaatgttggtcttgacgcatatgcagcaaagcttgcaatggaagcaaaggcaggacgaaagaaacacaaaacagatatgatgcaatctcttgataagcttgttaagacaatcggtgtccttataatacctataggagcaggactgtttttacagagcagatttgcagtcgggggctcaataaagagcagtatagattcaatggtagcctcacttgtcggaatgattccagaagggctgtatctgcttgcaagtgttgcactggttgtcagcgttatgagacttggaaagaagaatgttattgtacatgagatgaactgtgtagaaacactggcgagagttaatgtattgtgtgttgataaaactggaacaataaccagaccagatatgtcagttactcatgttgaaatattggattacacagatggttacggaaagcatactgattaccatgaaacagagagaattataaaaaatgtagtggcggcaatcagctctgacaacgcaacaatggaagcaatacattcgtattatggaattgaagaagaatgtgagtgtgaccaggtatttccattttcttctcagaataaatacagtggcgcaagatatgggaaagacgtatatctgttaggagcacctgaatatctgcttcttgattcatatcctgattataggaatattattgataagtattcatgcaatggagagagaattgtcgtgtttgggctggcgaatgagcagataacaggagaggctgtcacaaaggcgataacccctatggcttttataatacttgagaatgagataagagaaacggcaaaagaaacatttgaatattttaaaaagcagggggtcgcaattaaagttatatctggagataatccgctgactgcatcaaaggttgcaatacgggcagggatagatgatgccacatattacatagatgcgactacacttaaaacggataaggatatagcagatgcggttcagaaatatactgtttttggaagagttattccggagcagaagaaaaagattatagaagcatttaagatggcaggcaatgttgtcgcaatgacaggtgacggggtcaatgatgtacttgcattaaaatgtgctgactgtagtgttgcaatggcatcaggaagtgaggctgccagcaatgcagcacagatagttcttctggactctgatttttcaaagatgccggatgttgttggagaaggaagaagggttgtcaataatattaagcgttcagcatcgctgtttcttgcaaagaatatattctcaatgctgcttacgatatttacacttatatcagttaatctgtatcctttatatccgacccagttatcattcttaggaatatttacaataggtgtaccggctttctttctggcattacagcctaataagagtcttataaagggtgatttcctgctaaatgtagtactaaaggcgttgcctacaggtctgacggattttattgtagttacgattataacaatatatggcaattgcacaggtgcaccacatgagcagacagcgactgcagcaacacttgtgcttcttaccgtgggcatggcagcactggtaagagtatgtaagccattcgatataataagagtatgtgtatgcgttgcaatggcatgcggaattgtattttcaatgatatttttacgctcattatttgcaatggttgtattaaaggggctggcacttaatcttactgttatgatgatggttctgtcgctgcctctgtacagatatgtatgcaggatgacggcatggctgatagatttctttgagaaccataaccgtcatttcagacacctgcttaaaggctgatatattaaaaatgtattactgcttatttagagctttttcagagaattcagttgttacaaggctgctgtaaggaactggagatttaagctcaccagcctgcgtaagaatgtcctgtaaaagattaaaactgtcttcggtgaatacagtagaggttttccatgtatcctgtgatttatatctttcaacaattgcggttattgttgcaatatcggtttctttaaactgaggtgcaatgatggccgcaatttctgctgatgaatgtgtattgacataatcaagccccttctgtgtagcgttagtgaatttctggattacatcaggatttttcttgatatagcttttctttgcacaatatgctgtgtaaggaacatagccgctttctacaccgagcgaggcgataacgtggccttcaccctgctgttcaagtaaagttgcagaaggctcaaattcaactgtgtaatcacctattccagatgtgaatgcggcagaagttgaaccaaaatcaacattctgaaggatttcaaggtctgtttcagggttaatattattctttttcagaatatattcaaataacatctggggcataccgccggctctgccgccgataacagtttttcctttaagttcagaccattcaaaattatcattggcttcccttccgacaaggaaattgccggcacgctgtgtaagtccggcaaagttgacagcatagtcatcagagccttcggcatatacatagattgatgattcagaacccatgaatccaatatctgcatcaccggatattaaggctgtcattactttgtcagcaccaaaaccattagttacggtaagctcaagcccttcgtcggcaaaatatccattctcaatggcgacatattgtggtgcatagaatatagagtgtgtaacttcgcagagagtgatttttttaacagaattgtctgttttttctttgttgcaggctgtcattggaaatgttgtgaccagtatgatggtcataataataaataatgatatatatttgctgaaattcttcaatgaaattctccgttgtagctgcttttattgttatagtattatttttctgtaattttgttccacaaaagtaataaaaagattgtcatttaatgagaaattatggtatcataatagaaaattacagtgtagataatttaatatctgtatatggaggcgcgttatgtttagaaagaataaaacaacagctaaagcagcgtcaggtaatgatttgaatacattgcttgatgtatttgataagataatatctggtgagatatcgcatacaggtgaatcaccggctgatataacactttttgaaaatcctgaggttgccaataagtttaatgaagttgttgagacttataagagattcaataataatttcgtaatgagacttaatgaggctatggagtcaattggcgataattcatatgtaaagaatatgatggatgaggtgcagtcacaggctcaggctattggtgctatgggagagtcaggacataatcttgaagaatctattaaccacattaatgttgccatggctgatattaaggacaatactcatgagatgcttgctgctacacagaacagtacagctaatatgaatgagagtattaaggttgttaatgagtcatcagaaaagatttcggatattaacagacaggtacaggaatttcaggacaagattcataagattggagagattgttgatattgtgaagaaggttgcaagccagagtaatctgttagctctcaatgcttctattgaggctgcaagagcaggagaggcaggaaaaggttttgcagttgttgctgatcaggtaagacagttatcaagcagtacatcagaatctgctgatgatattgttaattatgtaagggaactcaatgatgatattggaagattggcagtatccatggatgatacaactgttaagctttcagaaggtaattcaaaggttgaagaatcactttcagatattgaaagaatgaataaccagatggttgcaattaatgatgctgttaacggaatattcgcagatattgatacacagtcatctattactacagaatttgccaagcaggtagacagtattgcggcaagctatgataagttatctgataactgtatggctacaggtactcatatctataagattggcagatatattgatactgcaagaagtgatatgttcaggtcattctctaatgttacaacacaggatatgataagaatattccagattgaccactttatccttatgtggagagtatataataatgctgttggatttgaaactcttaaggttacacagcttaacaatccggatggatgtaagttaggtaagtggatgaaagcacagacagatacgcgtattacaggaagcagacagtttaaggatcttgatgcggcacacagacagattcataaatatgctgttgattcttggaacgccaaggagtctggtaatgtagaacttgcacttgaatacttccagaagtgctatgatgcatttggtgtatatagtaataagatagaagagttcaagagctatatgagaacaattggttatactgatgaaactgaaaaagtgactttcagaaagtaattaaagtgaatggtctcctatggtgaagcataggagacttattttaatgtaagaaggaatagagtggtttagataattataaggagatagcaaacagagtatggaagaatataaagaaaaagcaaaggaaattatggttataggccataaaaatcctgacacagattcaatatgttcggcaatatgttatgctgatttaaagaataagataaccggaacagataattatgtgcctaagcgggcgggacatcttaatgaggaaactcattttgtactgaacagattcggtgtagaggctccggaatatattaaagatgtacgtccacaggtaatgaacatagagataagacacacagagggaatagacagagagatttcggtgcgtaatgcgtggaaactgatggattcacttaatgttgtaacacttcctataacagaaggcagaaaacttacaggccttgtttcgattgatgacattgccaaatcgtattttgaaacatttgataacagagtattgtcgaatgctaagacaagttttgctaatattgttgaaacacttgggggaagagtaattacaggtgatgaaagcgagatatttgacaaaggaaagatgcttattgcagcggctaatcctgatatgatggagagcatgattgatgagggggatattgtaattcttggtaacagatacgaatcacagctctgtgcaatagagatggaggcaaaatgtcttataatatgtgagggagcaaaggtatccaatacaattgccaagattgcaaagagccataactgtattattattgaaactgattatgatacatatactgttgcaaggcttatgaatcaggcaattccggttggattctttatgacaccaagagacagaattgtatgttttaagacaaccgattatgttgaagatattcaggaaattatgactaagaaaaggttcagggatttccctattgaggatgaaaacggtaattatgtaggaactatttcaagaagaaatctccttcgttcaggcagaaagaaagttattcttgttgaccacaatgagaagaaccaggcagtcaatggaattgaagatacagagattcttgagataattgaccatcacagattaggacctatacagacaatcacccctgtatttttcagaaaccagcctcttggctgtacgggaacaattatttataagatgtatcaggaggcaggaattaatatagaacctgttatagccgggctgatgtgttcggcaattatatcggatacattaatattcaaatctccaacatgcacacctgatgatatagaagcggcaatggagcttgctgatattgcaggaattgaccctgaagtgtacggaagacaaatgtttggagctggaagtaatcttgatgaaaagacagacagagaaatattctatcaggattttaagaagttcgcaattaatgatgttaccgtaggtgtggggcaggttaatgcaatgggacctgaggatatagagaagataaaagcaaaggaagtgccgtttatagatacagtaacaggtgatggtgggcttgatgtagtatattttcttatgacagacatatcaacggaatgctcctatgtactgtgttcaggtaaaaatgcggatacaataatgtcacaggcatttggagttgacaaacagcaggatacatatatactaaagaatgttgtttcaagaaagaaacagttcctcccggccattatggaagctatggagcagtagagaaaatggagaatagtgatgaaggcattacgaaaagatgatccctgctggtgtaacagtgggaaaaaatattgtgactgtcacatggaatttgatagaaaattagataatttcaagagaaagtttcataaggtaccaccaagaaatattattaagaatgaagaacagcttgcaggaatgagagaaagcagcaagattaatattgctgtgctagattatgttgcagagaatattcatgcaggaatgacaactcaggatatagatgatttggtataccagaaaacaaccgagatgggtggaatacctgcaccacttaattacgaaggatttccaaagagtgtgtgtacttcaattaatgagcaggtatgtcatggaataccatctaagaatatccagcttcttgatggtgatataattaatgttgactgttcaacgatattaaacggatatttttcggattcatcaagaatgttctgtataggtaatgttgcaccagaacataagaagctggtggatgttgcaaaagaatgtgttgagttaggtcttgcacaggttaagccatggggacatcttggagatgttgcggcggcaataaatgaacatgcaaaggctaatggatattcagtagtaagagaagttggtggacatggaataggtcttgaatttcacgaaaccccatttgtaagttatgtaattaagaagggaacaggaatggtcatggcaccgggcatggtattcacaattgagccaatgataaatgcgggacttccagacatatatatagacgagggcaacaactggacaatatatacagatgatgattcgtactcagcacagtgggaaataatggtgcatgtgactgaggacggatatgaggttatgagctactaaaagtttgtgtatattcgcagatgaacacaaacaataaaacagacacaacacatccgtcctgacaggacatacaacaataagtgaaaagctccatatactgtagtgatacatgtatatggagcttattttatgatgatgacacaacaggttccggcgatgtgctatgtaccgtggcagcgttgggatgaattatatgagccttcgcgggcaattatgcggggaactatgtttcctgtacttgataaaccatttacaggaggcaggtcatgaattgttgtaataatattagaaatgaaaaagctatgattatgaagaatatttatgagcttggctttgcacttgttgaaactatgctttatcttgatacccatccggatgatgcagcagctattgaatattatgcagagattaaggataaatatgtacagtttatgaaaaaatattcagattattatggacctctcagcatggaatatatggtaaatgacaactactggatgtgggtggcaacacctatgccatgggaatataagggaggtatgtaatatgtggaattatgaaaagagacttcagtatccgattaatataaagaattgtaatcctacgctggcagcaatgattatttcgcagtatggtggaccagatggtgagcttggagcatcaatgagatatctttcacagagatattccatgccatacagggaggttgccggattgctgactgatataggcacggaagaacttggccatcttgaaatggtcagtacaatggttcatcagcttacaagaaatcttacaatggaacagataaaaggaactccgtttgaggcatattatgttgatcatacggttggagtatggccgcaggctgcaggaggtgtacctttctgcgcaattgaattccagtcaaagggggatgcaataactgatattgcagaggatatggcagccgagcagaaagcaaggagtacttatgataatctgttaagactctgccgtgatgatccggatgtgtatgaaccgctgaagtttttaagagaaagagaagttgtgcattttcagagattcggagaagctatgtcgattatacagagcaagctggattctaagaacttctatgcatataacccggaatttaaaaaataataaatagaatgatattaataaaatattatgatagaatacatttataaaagactgattaaaggagtacttatgaaagagaagatatatactatacctgttaatgatgcattttcatcagactgtgaatgtccgatttgttcaatgtataaggcactggaggatgatgcagtaagctatacaatgggacctagttatatggaagatgatataagggctgtgactgataaaaagggtttctgtcagaaacatttaaagaaagtgtatgactgtgagaacagacttggctttgcacttgtcatgaagacacatcttgacagggtgattaatgatattgaaagtctgcaagatggaaaagtggcaggaaagtctatgtttaagaaagcagataaaccggctgtgacaacgtatactgaacagcttgaaggcacatgctttgtatgtgaaaggattgataacacatttcagagatatctggacactatatttcatatgtataagcatgatagtgatttcaggggaaagtataaagcatgtaagggattctgtacgaagcattatggcatattgcttgagcaggcagctaattctttaaagggggatatgttagatgaatttattaagacaactaacagtctctatattgagaatatgaagcgagtaagagatgatgttgaatggtttattaataagtttgaccataaatatattgatgagccatggaagaatgcgaaagattcactggtaagagctatgataaaggatggttcttatatagcagatgaaccaggaaaaaggaataatacaagatgataaataacagccctgtggtgtgagataccgcagggctgtttgcacatgtaataatatctgttaatacgaaaatgtaacagaatacattgtataattgtttcgtatggttgttttatatgagtacgaaagctgtacaccggcactggaaacagcggatttaatatcaaggtcgttagttgttgtgaattctatatgctgggaacggcttttaatacaccttaatatataacggtcaagttcatactgtgttccagctgaatgaagcttagcctgaacaggatatgtatatatatatccattagctggattagtttcgttgaaatcagatgtccatgtatgatcaattgccatatctgaatcagatatattgaagtaactgtggtcaatatattcctgtgagctgcctaccgggtcatcccatgtgacatctacctgataccagtcattatcaagcttaacaacattccatatatgttgttcattaccagcctttccggatattgtataattctcgattcctaacatatccataaatgttttgaaactttctgtataaccgctgcatacagcctcaccattaatcatagcgtcataggcattaaaagttgaaccaccattatcaatgtacgttatatgtgatacaagataatcgtggattgccagttcattttcataatcgcttcttgcaggtgaggttacttcggcaagaacttctatgtatttgttatagagttcaacctgacggctgtttaactgggaagtgtttcctgaattaaaagcttttataattgcataattatcccagcattcaaatgttacaacaaggttataaccatctttaattctgcggtattcacattttatctgctcaattccgcttattcttgtcagccattcattggcatctataaggtcagggtcgggaacaaatatgttacatgaagtctggttatccgacattgcttctatgatgaaattaattatatcttctgtgtcagttgctttattgtcaaatgctgtatatgaaatctctgtagaactgtcagagctgttatcattcgtaaacggtaatgtgcatccgtatagggatgcaagaattacggctccggttaaaagagacgcccaatattttatatgtttcatgtgtggtctcctgaaaattctgttataatcatatacgattgtataacgagataattgcaaatgtaaagcatatttatggaggaattttatgtcagattataaattaaaaaatgtatgtgatttcgacctggcacagacattggaatgtggtcagtgttttcattttgtaaagcttgatgaagaggattatgtattggctgcaaaggggcatgtactgcatgtttcacaggaggacgataccgttacattctatgatacggaagaagatgaatatgtaaatgtatggaaagattattttgatatggacagggattattcggcaattaagaaaaagctgctggaaaaagatgataagttaaaagatgcaattgaaagtatgtggggagtgaggattcttaatcaggatttttttgaaactcttatatcattcattatatcgcagaataagcagataccacatattaagaagatagtatctgatatatctgcaaagtttggtacatataagggaacatatggcggagtagatatgtatacatttccatcacttgatcagcttgctaatgcaagtgaagaggactttaaagagttaaagacaggattccgtgcaccttatattatggatgcaataagaaggaatagggaaggccagtttgatgaaaatgaacttaagagcatggattatgattcgtgcattaaggaacttatgacaataaaaggtgttggagagaaggttgccaactgcgtaagccttttcggacttggaaagaaagaagcatttcctgttgatgtgtggattaaaagaattatggagacaatgtattttgacggtgtggacactccaaaggataaaattgctgcttttgcaaaggaacagtttggggaactggggggatttgcacagcagtatctgttttattatggaaaatcaataaaaatgggtgttaaataataattattaataaaatctaaaaaatataatatatttgaattagctgttgacaaataaaagcgtgaagtgttacattatgtgcagtggttagcactcgaaaagaatgagtgctaacaggaaaatgaatgctgccatgaagggttcactctcatgtgaagacagcggaatggaggaatatataatgaaattagtaccattaggagacagagttgttattaaagcattagttgcagaggagactactaaatcaggaatcgtccttcctggacaggctaaggagaagccacagcaggcagaggttattgctgtaggacctggcggagttgttgatggtaaggaagttgttatgcaggttaagcctggtgataaagttatttattctaagtattctggaacagaggttaaacttgatgaagatgagaatctcatcattgtaaagcagtctgatattcttgctatcattgaataattgacaatgtcagttgcagatgaggacggtttgaacatataagaagtatatttatttaggaggctattattatggcaaaggaaatcaagtacggaattgaagctagaaaggctttagaggaaggtgttaataagttagctaatacagtaagagtaacaatcggacctaagggacgtaacgttgttcttgataagtcatatggtgcaccacttatcactaacgatggtgttactattgctaaggatattgaacttgaagatgcattcgagaatatgggtgcacagcttgttaaggaagtagcagctaagactaatgatgttgcaggtgatggtacaacaacagctactgttcttgcacaggctatgattaatgaaggcatgaagaaccttgcagcaggcgctaacccaatcgtattaagaaagggaatgaagaaggctactgattgtgctgttgatgctatcgcacatatgagcgaaaaggtaacaggcaaggatcagattgctaaggttgcggctatttcagcaggagatgaagaagttggacagatggtagctgatgctatggagaaggtttctaacgatggtgttatcacaatcgaggaatctaagacaatgaaaacagagcttgatcttgtagaaggtatgcagttcgacagaggatacatttcagcatatatggctacagatatggataagatggaagcagttcttgataatccatatatccttattacagataagaagatttctaatattcaggaaattttaccaattcttgagcagattgttcagagtggttctaaacttcttattatagcagaggatgttgagggtgaagctcttacaacacttattgttaataagttaagaggaacattcaatgttgttgctgttaaagctcctggatatggtgacagaagaaaagagatgcttaaggatatcgcaattcttacaggtggtcaggttatttctgaggaacttggacttgaacttaaggatacaacaatggatatgcttggtagagctaagtctgttaaggttcagaaagaaaatacagttatcgttgatggcgaaggtgctaaggaagatattgatgcaagagttgcacagattaaggcacagcttgaggagacaacttctgaatttgataaagagaagttacaggaaagacttgctaagcttgcaggtggtgtagctgttatcagagttggtgctgcaacagagacagagatgaaggaagctaagcttcgtatggaagatgctcttaatgcaacaagagctgctgttgaagaaggtgtagtatcaggtggtggttctgcttacatccatgcttctaagaaggttgcagagcttgttaagacactcagtggagatgagaagattggtgcccagattatcttaaaggcccttgaagctccattattccacattgcatacaatgcaggtcttgaaggtgctgttatcatcaataaggtaagagagtctgaagttggtacaggatttgatgcatacaaggaagagtatgtcaatatgattgatgctggtattcttgatccggctaaggttacaagaagtgcattacagaatgctacaagcgttgcctcaacacttcttacaactgaatcagttgttgctaatattaaggaagatgctccagctatgccagcaggtggtgcaggcatgggcggaatgatgtaattccacaatataattaaaacttacagcccggtgggtaatttcccgccgggcatattgctttaaagaaaggttattgaattatgatagaaggaacagtagagcagattgttaaagttaccgctcctaagatttcgattttttacagaataatacttgtaattgcatgtctgctcgcagcaacaacaattgtgcagacaggctggttaggtgtaatagttcttgttatatttatattctttacagtgtttgtatttgaatattataacgctgaatatgaatattcatatgttaacggaagcctcactatagataagattatggctaagtctgtgagaaagaatgtgggaagctttgatcttacaagagcaactctggttgcgaaagtaaacagtcaggaagctttgggtaaggcaagacagcagttaaggacatacaattgttcatcaggagttgatgaccctgaagatattgtaatatacacatatgacaatgacagcaatgagatgataagactgtttatgcttcctgatgattcaatgaaagaagcaatagtaagtgctgttggtaatggggttgcacatttataaaaaatgtttgacttttagcggcagttttgttatattctcttgtaacatatttataaactgactaagatgtcagatacgcgtagaaacatccggattaatttatttattcggattttttctatatattaaaacacaacagaaagcgaggattttagcaaaatgggtaaaattattggtgaaggcattacatttgacgacgtacttttagttccacagtattcagaagtaacacctaatatgattgacctctcaacacagctcactaagaatattaaacttaacattcctttaatgagtgcaggtatggacacagttacagaacacagaatggcaatcgcaatggctagacagggcggtattggtattattcataagaatatgtcagtagaagctcaggcagaagaagtagacaaggttaagcgttcagagaatggtgttatcacagacccatttttcttacatccagataatacattacaggaagctaatgaccttatgggtaagttcagaatctccggagtacctatcacagatgataatggcaagcttgttggtatcattactaacagagatcttaagtttgaggagcattttgaaagaccaatcaaggagtgtatgacaagcgagaatcttatcactgctccagttggaactactcttgaagaggctaagaagatattaggaaaggcaagaaaagagaagcttcctatcgttgatgatgattataagttaagaggacttattacaattaaggatatcgagaagagcgttaagtatccatcttcagcacatgattcacagggaagacttttagcaggcgcagctgttggtatcacagctaatgtcatggacagagttcaggcacttgttaattcaagtgttgactgtattgtaattgattcagctcatggccattctaagaatattattacaactcttaaagatattaagtcagcattccctgatcttcaggttattgctggtaatattgcaacaggtgcagctgccaaggctctctgtgaagctggtgtagatgcagttaaggttggtatcggacctggttctatctgtacaacaagagttgttgcaggtattggtgtaccacaggttacagcagttatggatgcttatgcagaggctaagaagtatggtgttcctgtaattgctgatggtggtatcaagtattcaggagatatcgttaaggctatcgcagcaggtggtaatgtctgcatgttaggaagccttcttgcaggttgtgatgaggctcctggtacattcgagttattccagggaagaaagtacaaggtatacagaggaatgggttctatcgctgccatggagaacggaagcaaggacagatatttccagactggtgccaagaagcttgttcctgagggtgttgaaggacgtgttgcttataagggtcttgttgaggatactatattccagcttatgggcggtttacgttcaggtatgggatattgtggagcgcctacaatcccagtacttcaggaaacagctcagtttattaagatgtcttcagcagctttaagagagagtcatccacatgatattcatatcacaaaggaagctcctaactattcagtggaagataagtaattaataatagtattcaacccggacagattgtgttgtccgggtattttttttcatgataaaatgtaatttcttctgaaattattgctattgaacaatggtatgatgtataatgaacagagtatttatatattaatgtgaatgaacaggggatattttgggacgctaaatcaacgagaaggagaaaactatgaaggacagaatactcggcagatatattgcaaagaatcactcagataacgtgttcactgacagagagttacaagtcataaagcagggagatacggatacgcttgttgaaacatttctgcatatggacaatgattattacaagacgcagatgcagtgtacattaaaaagtcttggaatgttcatggatggtaatattgaactgaaccagatagattatgaaagagaatataagggtcagtttattggctgtcaggttatggatggggatattgatgtgtttcttggcgtagctggtgataacagggaacttttgaaagtagcatctacatttgcacaggaagatatagaagaatttgatgaagatgcttatgatgcattatgcgaatttattaatgtgatgaatggggcatatgcaactaaacttggggaagcagatattgaagtaacacttcatccgccagtgttttataaagatacagaagttacggcagataccggtttttatgttgtgactttcaatattgaagataatgtatttaagattttaatggctgctgataataaaatccagctttcagcttaataaggagaatagttatggcaaaaattttgatagtagatgattctaagacatcaagaaaatttttaagaaatatgcttgaagatgcaggacatgagattgtatcagaggcagttaatggggtagaaggcgtagaaaaattcaggttgtataagcctgatgttgttacaatggatagtacaatgcctgttatggatggtatagaagcagtaagagagattattgagattgatccaggggcaaaggttattatggtaactgctgctggtcagaagactaatatggttgaggcattaaagagaggtgctgctgattttattcagaagccatttgatagtgctgtaattattaatacaatagaaaaggttttggaagacgaataatgtataattaccgtatagagatagagtacgatggtggaagatatgatggttggcaaagactgggtaaggatgccagcacgaatactatagagagcagactgtgtgagataatagcaagaatgactggtgagacagttgacatgtatgttggatcaagaacagaaaagggcgtgcatgcactttgccagacagcgaatttcaagcttgagaaggaagttaaggcacttgatattaagaattatcttaacagatatctgccaagagatattgcggttatgtctgtttcacaggttgatgaaagatttcacagccagcttaatgcaaagtccaagatatatgagtacagactggatacaggtaatgtagctaatgtgttcagaagaaaatatgcgtatcatacattcagtatgccggattttgatgccatgagaaaggctgccggatattttgaaggaaaacatgattttaaggcatttacaacagcaaagaagaacaaaagcacagagagaactattaagaggataaacattcagtatgaaggaacaagagcttacataaggattgaagctgatgatttccttcataatatggcaagatttatgattgggatgctgcttgatgtaggcaatggtattaagaagccggaagatgtgaagagatgtcttgatggggaaaacgtacagatgtcattaccggcagagagttatgggctgtttcttgtaaaggtggtttattagatattgtaaaaggtggagaatatgaagacgattattgaacttattactgatgagattaaaaatgtattcactgaatgtggatatgatgaggcatatgcgaaagttacagtttctaacagacctgacctgtgcgagtttcagtgtaatggtgctatggcagcagccaaagcatataagaaagcaccatttatgatcgctgatgaggtcgttgcaaagttaacagataacaagatgttttctaagattgagagtgttaagcctggatttatcaatattaatatatgtgaggattatctggctggatatcttaatgagatgtctgaaacagagaagtttggatattttaatgctgataaggaaaagactgttattgtagattatggcggagctaatgctgcaaagcctcttcatgtcggacatttacgttctgcagttataggagaaagtgttaagagaatcaatacatttgctggaaataaaactataggtgatgtccatcttggagactggggtctgcagatgggacttatcattgaagaattaagagatagaaaaccagaacttccgtattttgatgacagttttaccggtgagtatccagaggaagcaccatttactatctcagagcttgaggagatttatccggcagcttctgcaaagtctaaggaagatgctgcatttgcagaaagagctcatgaagctacacttaagttacagagcggtgacaaggcatgccgtgcaatatggcatcatattatgaaagtttctaaggctgatcttaagaagaattatgataatcttaatgtacattttgatttatggaaaggtgaatcagatgcacagccatatattgacgatatggttaataagatgattgcagacggaattgcttatgaaagccagggtgcaactgttgtagatatccagcaggagggtgatactaaggagcttccaccatgcatcgtaagaaaatctgatggtgcggcactttatgcaacatctgaccttgcaactattgttgaaagagaaaagttatatcatcctgatacatatatttatcttgctgataagaggcaggaacttcattttacacaggtattcagaacggctaagaaggctgggattgtagcgcctgatgcagatatgagatttgtgggctttggtactatgaacggtaaagatggtaagccattcaagacgcgttcaggtggtgttatgagacttgagcatcttatagctgatattgatgaagctgtatatgagaaaattatgtctaacagaactgttgaagagacagaagcaagagatacagctaagatagtaggacttgctgcattaaagtatggagatctttctaatcaggcatcaaaggactatgtgtttgatattgagagattttcatcatttgagggtaatacaggaccatatattctttacacaattgtaagaattaagtctatccttaacaaatatacagaaaatggtggaagcacagataaccttaagattacggctgctacagaagaaagtgagaagaatctttctttatcacttattaagtttgcagatataattgatggggcatataaggataatgcgccacataagatatgtcagtttatatatgaggtatctaacgcatttaatggcttttatcataacaataagatactttcagaacctgacgaggctaagaaggcaagttatattgcacttatcagccttactaagagcattctcgagcagtgtattgatttacttgcgattgaatgccctgacagaatgtaaaggagaaatttgatgggtaaattattatcatttgcaataccatgttacaactccgcagagtatatggaacattgtattaatacagtgcttgccggtggggatgaagttgaggttattatagttgatgatggttcaacaaaggataatacatatgaaatagctaaaagatatgaaaaggaatatccggatattgtcaaagctgtacatcaggaaaatggtggacatggtgaggctgtaaatacaggtcttaagcatgcaacaggaaggttctttaaggttgttgacagtgatgactgggtagatggcaaaagctataagagaatgcttgctacattaagaagctttgaagagggcagcgagccggatatggttattgcaaactatgtatatgaaaaggtcggagccaagagaaagaaagttatccactacgagaatgtatttcctgtagagcagatgtttacatgggatgatattaatataggcgattttaaggttgaccagtatattcttatgcatactgttgtatatagaacacagcttttaaaggattgtggattagagcttcctaagcatacattttatgttgataacatatttgtattcgagccacttccgtatgttaagaacatgtattacgtaaatactaatttctacagatattttattggacgagaagatcagtctgttaatgagagtgttatgatttcaagaattgaccagcagctttctgttaataagagaatgattgattcgtttatttcagaaaatcctcagaatattaactgtagaaaatatatgattaactatttaagaattatgatggaagtatcgtctatattcttaattgtatctggaacaaaggaacatcttgcgaagaagaaggcactctggcagtatgctaaggataaggatgaagtgctttacaagaagttacgacacagtcttttgggctggtctgttaatatccctacatctgcaggaagatggatatctaagcagggatacaagatagctaataatataataggttttaattaaagagatttagaaggagaagaatatatgtctataattgatgcattcagacttgatggaaaggttgcagtagttacaggtgccaatacaggtcttggacagggaatgtccgttgcacttgcgcaggcaggtgctaaggttgtaggtgttgcaagaagatcctgcgaggatactaagaagcttattgaaggtgatggaggagaatttgctgaggttatagcagacctttcagacatgtcagctatagatgttattgtgaatggtgcacttgcagcttttggaaaggttgacattcttgttaataatgcaggacttattaagagaaatgatgctattgatttcacagaagatgaatgggatagtgttattcaggttaatcagaagatggtattcttcttaagccaggcatttgcaaagcagtatattaagcagggacatggtggtaagattattaatatcaattccatgctttcatatcagggcggcataagagttccttcttatacagcaagtaagagtgctggtatgggacttacaaaagctatgtgtaatgagtgggcatgccataacattaatgttaatgctattgcaccaggatatatggctactaataatacggcacagttaaggagcgattctgacagaagtgaagctattatagatagaattccggcaggacgctggggaactcctgatgatatgaaaggagcggttgtgttccttgcatcagctgcatcggattatgttaatggatttacactggctgttgatggcggatggcttgcaagataacttaaaagagtatgataaaaggcgtttcaactttaactgtttgaaacgccttttgtgtattgtttttaaaagttgattttgcaaatgtttctgtcaacatgtgacttgatatacgcaggaacagcagcgttaatatcatcgggcatgtccttctgacttaacatgacaatcatacgtcctttgttaaataacatgtaatagccgaatttgttgtaaacattagtgaactgattccactcatatgtgtatacaagattatgctcaggaatatctgccataatagcattattcataagagtaattgtacatggggcttcttctgatggatctctgtgctttaaatgatagttaacacttgatctgaactggtatccaaaaatatatattgggtaaaaccagcatacagcataaagaatcagtaaaaagctggaataataatgaaggcatagaagcacaagcgaaattacggcaggaagccatgacagaataagctcaatgggatttcttataaatctgttccaaaatacaatcttgaaataatcctttccagaagcttttaatgttgtgttaaatttaataatgtccataataatcctcataaataaattgatatagagatataataacacccttaaatagataaaacaattaattatctgtgaaattaaaaatgtatattgaaatgattgtaaaatcatgcaaaaatcagtttccaaaaagattataataggctataatattattagatttgtgtattgctggaggaatattttgagtagtgataataacagaaatatagggctttcagagattatacgtatgcttgaaaataatgttacatttactcaggcagcagatagtgttcttgaatgcataactgacagcatggatatatgtgatgctgttgtaatgcagatagacagggaaagtgacactatgcatgtgatatctgaaactggaaattgttttaaagatgaatcaggcacggttaaacggtcagagtttgtattatgttcagatgcaattaagattacatacgaaggaaatgcggatacagcacagaaagggcttctggacagacttggagtaaagctgagcataacagtaccgattttaattaataatgtaaaagcaatgtatcttatagttcttagtaatgatgtacaggcagtatcagataataagattaaggaatacataagcgacatggcactggtacttcatggtatagcacagagcaaggtgattaataattcacttatatcatcttatgatgttttacagaagattcttgataatataggctctggaattattgtgtgcagcaggtattctggcaatatattgtttgagaatgagatggcagctaatgtacaggaggttcgggatacaataagggaatgtctggaggatgtgtttacatgcgaagatgtacacagaaatatcggagcatccatggaacgctacaatacagagtcaggattgtggtttgaggtgaggttttctgaattggagtggattgacggaagtgaggttattgttgtgaccgccgtagatattacccagaagaaaaagaatcagcagaagattgaatatcaggcacataatgattttcttacaggtctgtataaccgtatgaaatgtgaagtcgatttaagaaaagttataagaagaacggaaaaggcaggacttaaaggagcggtactgtttattgatcttgatgatttcaagcatattaatgacggacttggccatcagtatggggatatacttcttcagcagattgcggcaggacttacgggaattccaggtttgcgtggacattgttacagaatgggtggagatgaatttgtaataatagttgaacctgaaatatttggagacttaaataatattattgggaatataactgctttatttaataagccgtggtatcttatggaaactgaatatttctgtacaatgagtatgggagttgctgtgttcccggataacagtgttgatgttcatgaaataacaagaatggcagatgttgcgatgtatgaggcaaagaggtcaggaaagaacggctatacttattacagcagtaaggttgagaattcgacagccaagaggctagatatagagaataatatgagacaggcagtttctacaggaattgacgaattcgtagtattctatcagcccgttgttgatgtcaacacacagatgtgtacttcctgtgaggcacttgtaagatgggacagcaaagcactgggatttatgggaccgggtgagttcataccgctggcagaatatcttggacttattacttcaattggtgactatgttcttgaggaggcatgcagaagatgtaagctatggaatgataatggatatccggatttctatattaatgtgaatctgtcggtagtgcagcttttacagaagaatgtggttgagaatattaaaagaattcttgataagacaggtgttaatcctaagaatatagtacttgagattacagaatcatttgcaattaatgatatgcagagggttatggatattattacaggtcttaagaagttaggacctaggattgcacttgatgattttggtacaggttattcttcacttaactatataaagcaacttcctcttgatatcattaaggttgataagacatttattgatgatattgttgaagatgattatgcacaggcatttattaagcttatagttgacctttccaagactatcggtactaagattgttgttgaaggtgttgaacataaggagcagtttgaactgcttaaaagtcttggtgtggattatatacagggatattattttgggaagcctgtaccagccaatatttttgaagagaaaaacttagaggggagattgggcgaatgaatatattgattaaagagggcagagtgcttgaccctgcaagtaaaacagacaaagttattgatgtgcttattaaggacggatttattgctgcagtggaggagaatattgatgagtcacaggctgatgaagtgattgatgcatcaggatgcatggttatgcctggactggttgaccttaatgcacatttcagggaaccgggacttgagcataaggaaacaatcagaacaggctcaagagcagcagcaagaggcggatatacaacagtctgtatgatgcctaatacgaaacctgtaattgataatgttgatatgctgcagtatgtaacagataaggcagaagaggttactgacattaatctgtatacaatagctgccatgacggcaggtcaggagggtgaatatcttactgattttgaggctcttaaggatgcaggtgctgttgcagtcagtgacaatggcggaactattatgaatgcaagaactgcaaggcaggctatgaggcaggcagcagaggttgacattccggtatttgcacattgtgaagatactaacttggctgcaagaggtgttatgaatgccggagagagagccaaggaacttggtcttttcggaataatggatgccgttgaggatgttattgttgcaagagatattcttcttgcgaagaatacaggtgcaaagctgcatataagtcatgtgtctaataaggaatcagcatttattataaagattgccaaggaacaggggattccagtgacagcagaggttgccccacatcatttcacactgacagaggatgcggtgaacggggatgatgctaactttaagattaaccctcctttaagaaaggcagatgatgtaaaggctcttaaagaagcgcttgcatcaggggttattgatgttattgcaacagaccatgctccacatcatcctactgagaaggaaagaccttttgacgaagcaccgtttggtgtagtaggtcttgaaacagcagttccggttactattactgagcttgtaagaacaggagtgcttactccgttacagatggttgagaaaatgagttataatccggctaagatacttggaattgacagaggagttcttgcaccgggaaaagttgctgatataacagttgttaatcctacagaagagtatgatattgacagcaacagatttgcttcaaagggaaagaatactccatttgaaggaaagcatgtgtatggaaaggttttatatacgcttgttaatggaagagttgtgtattcagaccataatggaacagaaattcttattgaaagagaagttccaaagttgtagaataaagtgattttgcgtatgaattaaggaggctaaagtagattaatgattaagaagcttgttgataagattgtagagactaatgcaccaatagttgtaggacttgatccaatgatgaagtatcttccaaagcatcttgcagatgttgcatttgagcagtatggtgagacacttgagggagcagcggaggctatatggcagtataacaaaggcattatagataatatatatgacattgttccagctgttaaaccacagattgcaatgtatgagcagtttggaattgaaggacttaaggcattcaagaaaacagttgattactgtcacgagaaaggcatgattgttatcggtgatgttaagagaggcgatattggttcaacttctgaggcttatgcggtagcacatcttggaaaggtaaatgttggctctaaggcaattactccttttgacgaagattttgcaactgttaatccatatcttggctctgatggtatcaatccatttattaaggtttgtaatgagcaggacagaggtatatttatacttgttaagacatctaatccttcaagtggagaattccaggatcagcttattaacggaagaccattatacgagttagttggtgggaaggttaatgagtggggagcttcaagcatggacggagattacagtaatgtcggtgcggttgttggagctacttacccagagatgggaagagtattaagaaaggttatgcctaaggcgtatatccttgtaccaggatatggtgcacagggcggacagggcaaggatcttgttgatttctttaatcctgacggacttggagctattgtaaacagctcaagaggaattattgcagcatatactaaggagcagtatgcgaagtttggtgagaagaacttcggagaagcttcaagacaggctgctcttgatatgattgctgatatcaacggagcacttggcaagtaattatacatatttacacacaggttaataatggagattattatggcgtacagagaaaatgcgaagattcttaaggcggattgtcttgctgacggagtctatgaaatatggtttgaaacaaaggatattgctaaggccgctaaggcaggacagtttatatcagtatattctaatgatggttcaagaatgttaccaagacctatcagtatatgtaaggttgagaataataatttaagaattgtattcagagttgccggcaagggaacagaagagttttctaagatgaaggcaggagaatatcttgatattcagggacctcttggcaatggttatgatctgggaaaaattgctgcagagattaaggcagaaggcagaagctttgataaggctattcttttcggtggcggaataggtgttcctcctatgcttgagcttgcaagaagattagactgccacaagaatgttgtagttggttacagaaacagccagactttccttaaggaagattttgaagcagttgctgatacagatgtgtatattgcaactgaagatggaagtgttggaacaaagggtaatgtattagatgctgtaaaacaggaaaaggttgaggcagatgttatatttgcatgtggaccaactcctatgcttcgtgcaattaaggcatatgcacttgagaatgatattccgtgttatgtttcattagaagagaagatggcatgcggaatcggtgcatgtcttgcatgtgtatgtaaatcaactgggattgacgaccattctcaggttaagaataagagagtgtgcaaggaaggtccggtatttaatgttaaggaggtagaactgtaatgagcgatattaatatgtcagtcaatattgcaggagttgaattaaagaatcctgtgacagttgcttccggaacattcggatcaggcatggagtatggggaatatgttgaccttaacagacttggtgcagtaacaacaaagggtgttgccaatattccatggccgggcaatcctacaccaagaattgctgagacttatggtggaatgatgaatgctatcggattacagaatccgggacttgatacatttgtaaaaagagatattccatttcttaagcagtatgatactaagattattgttaatgtatgtggaaaatctgaagcagattatgtggatgctgttgaaaagcttggtgaacagccagttgaccttcttgaaatcaatatctcatgccctaatgtcaaagagggtggaattgctttcggacaggttccagcttctgcagaggctattactaaggcggttaagaaggtagcaaagcagccggttattatgaagttaagccctaatgttactgatattacagagatggcaaaggctgtagaggcaggtggtgctgacgcagtttcgcttatcaatactcttacaggtatgaagattgatgtgaacagaagaacatttgcagtagctaacaagactgcgggcgtatcaggacctgctattcatccaatcgcagtaagaatggtttatcaggttgccaatgcaattaaccttcctataatcggaatgggtggaatcagaacagcagaggatgcacttgaaatgattatggttggtgcaagtgcagttgctgtcggaacagcgaattttaatgatccatatacaactattaaggttattgacggaatcagggaatatatggaaaagaataatgtagcagatattaaggagctgattggttgtgtcagatagaatacttttcttaagtaatggttctatatgctatgactcaacaacttactttattcaatgtataggtgaagaattaaaagctatgggctgggaagtcatgcatatcagattagataaagccacacagaaggataagctgtgtgtgctggctgatgagtatgactcccagccttttgattatgtgtttgatattaatacaaagctggacgcagtatgtgatgattcaggaagatactgctttgacagacttggaaaagcggtatggcattatattcttgaccatccgttctatcatcatgacagtctcaaagtgcctttaaagaacatgaatgtaatatgtcttgatgagatgcataaaaagtttattgatgaaacctatcctcatattaacagctgtattgttcttccgcttgctgcaaagcaggcagagagcggtctgaagccatatgatatgcgtgataatgacctgatattcacagcgtcttatactgaccctgatatggtgtattttaaggcaaagaagcaggatagtgaaaatgttgttttttttaatacatttacacaaagactgtttgataatccggagcttacgcaggaggaagccataaggaagatgtatccgggtattagtggagttcagacagcggagaagctgcgggagaatttcatggcggatgtttatattcaggcggcaatcaggcaggagattgtggttcagcttataagaaatcatgtgcctgtgaagctgtatggacataactgggatacttttcttacaaaggcagaggttcttatgaaagaggatttgacattcattaaggagcatgttgaggactgtggcgaggtgacatatggcgagcttccggctatatataataatgcaaggctttcaattaaccagcttccatggtttaaggcaggaatacatgacaggacgccgcttgcacttatgaatggctgtgtgagtattacagatggaagtacttatatgcgccgggagattcctatggattcaggagttgaatattattctcttgatgagctggaaaatgttggagagaagattaaaagccttgtggctgatgtgggttctatgaaggagaaagtggcaagaggcgttcagtatgcagaagatatgtggtcgtggaagcactgggctgtggagtttgtggaggctgccaaggaatgttgaggcgtgctgaggcgtggcgcttgagactgttggtgagatagatatagtgtggtgcggcgttcaggcaggtgcgttctataagattgttttttatagaggttttataggctgttttcagacagaaaaagtgttttcggtgcggaattacctataaggctggcacgaggaagcttttgataggtggattgagagataaaatggctggtttagcaggcaatttgctgaaattgtcctataagaacttgactaatgcgactatctataggtatcacgtcaaatatgcatgtatttaatcatgtcacagccattatggaaactaaagacagggataaattctaaaaagacatgacagtcattgataaaaatgattgccatgtcttttcgattataatgaaacaatatagttataatgttgctgcgatatcttctgcaatctgttcaggagtaaggtggttgtcctttaatacttctgatgcatcgtatctgtcaataaattctttcttaataccgaagtttaataccttcatatcagaagaaccatagaatgctgcaatcttagctccgaagccgccttcaaggtagccgtcctcaagagttgcaactactgcgtggtctttctttaattcattaagagtgtctgcgtcaatacctgagatatagtaaggattgataacagttgcgtcaattccgtgtgaagtcttaagaatattagcggcttttacagcagtttcatagaaagttccaagtccgagaatagcaactctgcttcctttcttagtaacttcataagtgccaagcttgctgaaatctttagttacaggtgtgcctgtggataccattctgccgcccggaactttaatagcaacaggatactcattctgtgttaaagaccagtcaagcatagcaatataatcttccttggtaacaggtgcaagatatataagtcccggaatgctgttgagcatagggatatcctgaagtccgagatgtgtaacatcattcatcccgtacacagaacctgcaaatactgtaaatgttacagcattgccattgatacatacatcttgtgtaatctggtcataggctctctgtataaatgagctgtaaacaccaaatacaggctttccgccgttagcagcgataccggaagccaacgcaacagcagtttcctctgcgataccaacatcaacaaactgttttcctgctttagctctcatgtcagcagtaaatcccataacagtaggagttccggctgtgattgcaacaacactcttatcatcggccatcttctttaacagatattctaaagaagcgtcagagaaatcaggctctccgcccttggaaagagattcgccggttgctatatcaaaaggtgcatgccagtgccatttttctttgttctgttcagcaggtgcataacccttgcctttaagcgtattaatgtggacaacaacagcttttttagtatctttaaccttttcaaatgcttcaattaaagaagcaatatcatttcccttatcaacatagatgtaatcaaggttcattgctttgaaaagattacattcagactgtccatttgtttcacgaagaagctttaagttggcataaagaccaccgtgattctcagcaatagacatatcgttatcgttagcaacaataatcatgttgccatttaattcagaagcaaaatcaagaccttccaaagcctcaccgccgcttaaagaaccatcacctataacagcgattacattaccatcttcaccgtttaaatctcttgctttggcaagaccgcaggcaagacttatagaagttgaagtatgacctacagtaaagaaatcatgttcactttcgtccggattagtgtatcctgacacatcatcataatgctcctcataaagatatgcatcttttcttccagtgagcattttgtgaggatagcactggtgtgatacatcaaatacgattttatctttaggcgaatcaaatacataatgcatggcgatgattgcttctaccataccgaagttaggaccaaaatgtccaccgtgtctgctggctcttgtaagaagggcgtgacgtatttcttctgcaaggacattaagctgcatgatgttaagcttcttcacatcagcgggactgttaatattctcaatatacatattttctgatactccttgtcttaatattttattacattttatatgataacacctaaagtcaggttgaggtcaagggaaatgtgaatggagttttaaactatttgctataaggaaatgatgttgaaaaaataatcgggttggaaattggaaatctatcggattgaaaattagaaatctgtcggattggaaatacgaaatcaatcggattgccaaggtatgtgattaattatatgtgtagcggatgttcgataagatatagtgttttagagtgtttgagaaactcaggatgagattgaaaaattattattatacatgatataatattatattatgagaagttaagtggacaaaatggtggaatgaggaggtaactcttatgaattcaaactttgactttttacaatcagagtttccggttttagcaacatttggttgtcaggctgaaaagtattgcttttctgatcctaattcatgccttatgaaattgggaatgataggggagagcattgttaatttaatgtttacttatgatagaatccaattgccatatgataatacagcagttacaagaatagatactcttcaaagagagggattgctaacaagagatttaacggatattttacatgctcttaggaaagccagaaataaagctgtgcatgagaattatgattctgaatcagaatgtaaaattctgattcaaatggctcatagtctatgcgaatggtttatgcagacttatggcgattggaattatcagcatcatgattttgttatgcctgaattagaaaacaagagagtttcggttacacaggaggagaaagctgcagaagagagacaggcagaagaacttacaaaacaggcagaacaaaaagcaagcatagcagaagctatttctaaatcagagcgtcagaagcaggctggtaaaatggcaagtcagcgacctaaatcagaagctgaaactagatatattattgatgaacaattgcgtcaagtaggctgggagacagatacagaaaatctgcgttattctaaaggaactcgtccggcaaaaggacataatatggctattgctgaatggccgacaaattctacagtaggacagagtggacgtgtagactatgcattatttgttgacactaagttgataggtgttattgaggcaaaagcaatacataaggatattccgtctgttattgattatcaggggaaagaatatccacgtaatattcgtaaggaagattcagcgtatcagattggagaatggggggaatacaaagtaccatttacttttgctaccaacggaagaccatatctaaagcagcttgaaacaaagtcaggtatatggtttttagatttgagaagccctgcaaataatccgacagctcttcatggttggattagtcctatgggaatggtagaattgctagagaaaaatcctcaagagggtaattcagcattgaaggcattgccatatgattttcttacagaccctaaggggctaaatttgcgtgaatatcagttaaatgcgataaaagcggcagaacagtcagttattgaaggaaaaaagaatattcttttagctatggcgacaggaacaggaaagactcgtacagtattaggcatgatttatcgctttttaaaaacgaaccgattcaagcgtatattgtttcttgttgatcggacttcccttggagaacaggcatcagatgtattcaaagaagttaaattggaagacttaatgacaattgatgagatatataatgtcaagggacttgaagataaaaatattgataaagaaactagaatacaggtagctactgttcagagtatggttaagcgtattttatataatgacggagaaactatgccggctgttacagattatgatctggttatcattgatgaagcacaccgtggatatattcttgataaggaaatgggtgacaccgaaattttgtatcgtgaccagagagattatcaaagtaaatatcgaagtgtaattgaatattttgatgcggtgaagattgcacttacggcaacacctgcacttcagacgacagaaatttttggacaaccagtgtttaaatatacatatagggaagctgtcatagaagggtatttagtagatcatgatgctcctcatcatctggaaacaaaacttagtacaggtggaattcactacaaattgggtgatacagttatgatttatgattctgtgacaggcgaaattacaaatagtgagttgttggatgatgaattagattttgatattgaacaatttaatcgacaggttattacagagaattttaataagacagttttaagtgaaattgctcgtgatattgatcctgagaatccggaagaacagggaaaaactctaatatatgcagttgatgaccaacatgcagatatgattgtatcaattttgagagatatttattcggaatatggagtctctaatgaggctattatgaagataacaggtagcgttggaggcggaaatcctaagaaagtgcaggaggctataaaacgtttcaagaacgagaattatccaagtattgcagtaacagtagacttgttgactacaggaattgatgtgcctgaaattacaaatttagtgtttatgcgtagggtgaaatcacgtattttatttgaacagatgttgggacgtgctaccagattatgtcaaaaaattcataagacacattttgaaatatatgatcctgtgggagtatatgattctttgaatgatgtgaatactatgaaaccggtagtggttaatcctgcaacaagctttactcaactattggatgggctgtctgaaataaatgatgataaacaggtagaacagcagattaatcagataattgctaaactacagagaaataaacgaaatatgtcgcctaaagtgatggattattttattagcatgactgatggaaaagacccatcacagtttattatggaaattaaaaagtcagatgttcaggaagctaagaatagtctgcttaaataccgtgatgtattcaaaatgctgcaagaaacgaaagcaaatggttttcgttctgttgtggtttctgatgcagaggatatattgacagaacattcacgtggatatggaaatgcagaaaaaccagaagattatctgaatgcattttcacgttatattcagaataatcgtaatgaaattgcggcattgaatattatctgtaccagaccaaaggatttgacaagaaaagatttgaaggatttaaggttaacactcgatagagaaggatttactacacagcagttgaatactgcactttatgaattgactaatgaagagataatggcagatattataagtttgattcgacgctatgcaattggctcaacgcttgttagtcatgaagcacgtattcacagagctgttgagaaacttagaaaaaaacataatttttcaaagcaggaacagagctggatatctcgcattgaaaaatatttgctaggggaatctgtaatgaatattaaggtgtttgatgaagacagcagatttgcaagctatggaggcttcaataagataaataaagtatttcagaataatcttgaaagcattgtgcttgaattgaatgaatatttgtatgatgacggaggaaatgttgcatgacaacacaagaaattgtatccaaattatggaatttatgtaatgtactaagagatgatggtatcacatatcatcagtatgttacagagttaacatatattttgtttttgaaaatggctaaggaaactggaacagaagaacagattccagagaaataccgttgggatgaattgaaggctaaaagtggagtagaactgaaaaagttttacaaggagctgttatcagaacttggagataatggtacaggtagaattcgtgaaatatatcagggtgcagcaacaaatattgacgagcctaagaatcttgagaaaattatagccacgatagatagtcttgattggtattctgcaagagaagaaggacttggaaatctgtatgaaggtttacttgagaagaacgctaatgaaaagaaatcaggtgcaggtcagtattttactccacgagttttgattgatgttatgacagaacttatgaaaccgcaagtaggagagagatgtaacgatcctgcatgtggaacatttggttttatgattgctgctcatcagtatgtatcagaacatacagataatttttttgacattgaagatgcagatttggcaagatttgagagggaggaagcatttacaggttgtgagcttgtacatgatacacatcggttggcattgatgaatgctatgctccatgatattgaagctcctattacattaggtgatacactttcaaatattggaaaatcaatgcatgattacgatctggttttgacaaatccaccttttggaactaagaaaggcggagaacgtgctacacgtgatgattttacatatcctacaagtaacaaacagttaaactttttacagcatatttatcgaagtttaaaaaacaacggaaaagcaagagctgctgttgtattgcctgataatgtgttatttgctgatggtgatggcgagaaaattagattggatttattagataaatgtaatctacacacaattttgcgtcttcctacaggaatattctatgcacagggtgttaagacaaatgtacttttctttactcgtggaaaaacagataagggaaatacaaaagaagtctggatttatgatcttagaaatgatatgccatcatttggaaaaactaatcctttaaagccagagcactttgatgactttatagcatgctatgcagatggagacttaggcaagcgaaaagaaacatatagtgaagaaaatccaaatggaagatggcgtaagttctcaattcaggatatccttacaagagataagactagcctagatattacatggatgaagacagaatctgatacagataattatactctcgcggaattacttgatcagattaaagaaaagtctgagaatattgctaaagcagtttcagaattagaacaattgattggggaagtggaggagtaatggatacaaaagcattaagacaaaaaatacttgatcttgctatccgtggcaaacttgttccacaggatccgaatgatgaaccagcaggggtattgttggaaagcatcagagagcagaagcagcagatgctcaaggaaggtaagctcaagaaaaaggatattaagaatgatacgattatctttaaaggtgaggataatttgcattatgagaagtttcaggatggaactgtgaaatgtattgaagatgagataccgtttgaagtgccggaggggtgggcgtggagcagattagtatccttaacagcgattattaccaagggggcatcacctaaatggcaaggagtagattatacatcatcaggcacaatgtttataacaagtgaaaatgtcgaagttgaaacacttctgcttgaatccccaaaattcttgcctgagaagatcaacaagatccaaccacgctcaatattagaaacccatgatattctaactaatatcgttggtgcttctattggaagaacgtgcgaatatacattagtagattctgccaacacgaatcaggcagttgcaatcattcgtttgatagcagtagatatggtgtcctatgttgtaaagtgcttaaacagcgactactgtgttaatctgatgtttgctaatcaagttaatgttgccagagccaatttaagcttatccagtctcgcaaactttcttattccaattccaccactaaaagaaatgtaccgtataattgcacatcttgattgtagtctgcggcacataagtggtattcagagcagtgaggatgagctgcgtcagctaatactttttactaaaacaaaaatcctcgatcttgctatccgaggccagcttgtgccgcagaatccagatgatgagcctgcttctgttcttctagaacgcatccgtgcagagaaagaagagctcatcaaacagggcaaaatcaagcttgataagaaggaatctgttatctttaaaggtgatgataactcttattatgagaagattggcaataaagtaaattgcattgatgaagaaattccatttgaattgccagaaggttgggcttttattcgtctaaagattgcatgggaactcatatctggaagagatttgtctccatcagaatataacgataaaaatgatggaattccatatattacaggtgcaagcaattttagaaatgggcatattagcttagttcgttggactaccgttccgcaagttattactcggagaggagacttacttctgacttgcaaaggaactatcggcgaaatcgcacataataactttggggaagctcacattgcgcgtcaaattatggctattcgcaatatctatagccttaatgttgattttctggcattatgcattgaatattcaatgacgaaaatcaaacaagctgccaagggacttattccgggaatatctcgtgaagatattcttaacttggttatacctattccaccaatcaaagagcaagaaaatatttgcaacaagctcaaagtaactttttcagcaatagagcatattgaaaagagcctcaattgaggctcttttcgattatagccaggtggctaaatgcaacatttatagatttatcaatgcgtttctgtttagataacggaggaactgcgatgagcatttcttttaatgtaagtggctttaattccttttagttggttgatccttcgcctttcttttcaagttcggtttgatgtgccttcataaaagcatataggtaatgtgagctaatgcaactaaagctatgaattaccgtaacatgggaatcaggaacaattaagagacctgtagtattatcggtatttctataaattccgactcgtccaagagtacctgttccggttgagttaattactatatctccatcttgcatatgttcatcagtcggataacgttttattgtggtctcgtcaagatattgagccaaactaatatctatgccattgtatttggtgttgcatttctgagcaaatacaataacattgctgatttctgcatattttgtagattttcctcgacaaatttctttaacacagcaattttctaaacgcatccatgtccaagtatctggaatatcatatggtatgtcttcatcaatgcaagacacctcaccatcaatcttctcatgataagaggagtgaaaacatcttcgatataatattaaggcgaatttctcgcaaaaatattatatcggaggtgtctttttatggagacaaaaataacatttgaagaatacttgagaaaggaaaatttatcagaaaatacgataacatcgtatctatggacagtgagttatttcaatgcgaattacgatgttgttagcaaagaaaatctgcttgcctacaaagggtatttgatggaattctttaagcctaaaacggtaaatctacgtatacaggcaataaacaagtatttggaatatttagaagaacagcacttacagctaaaagctgtaaaagtgcagcaaaaaaacttcttagaaaatgttatcagcaatgcagattacaattttcttaagaagcagctcaaaaaggatagtaatatggaatggtattttgtagtttggtatttagcagctacaggggcaagagtaagcgagctgattcaaattaagattgagcatatagaaattggatattttgacctatacacaaaaggtggtaaactacgacgattatatataccacaaaagttaaaaatagaaactcttgaatggctggaggaatcgcaccgttcctctggctatttgtttcttaacagatatggagaaagaattaccacaagaggaatttctcagcaacttaaaaactatgccgagaaatacggacttgataaaaaggtggtttacccgcattcattccgtcacagatacgcaaagaacttccttgaaaagtacaatgatattgctttacttgccgaccttatggggcatgagagcattgaaacaacacgcatttaccttcgccgtactgccagcgaacaacaggaacttgtagataaaatagtaacctggtaaaaatattaagccgtcctcaaataagggcggctgtttcctaaagtaatgcatttgaaatcaaatcaagctgtttatatgcaatatgaatatgctcgacaattcttgcttgctctgctaatggagggattggaataatcataagagaaagtgcattaagatatattcctttttgagctgtccctttactattgtcagtgagccatttttgaatttgaggagattggacaatgtgcatcaaatataaaggattaattaagcatggtttaataactgcaacactcctttgtaatgcaaaatgattgttgttctgaactactgcacttcgaccaatactgccaacaatagtaagcaatacatcgccaacttcaatattagtacgttgattctcaattttccattcttcgtttgtaatccatcgtgatatttcgttcattaaaatagaattatcatttatatttgcagcacttaacaaagggatgccactaccattatttggtggtggattatgagaaccatcactaattgaaagtgcgatttctctcagagatgcccaattccaactatctggcaaatgtatgccataataagagttatcatcacctttaaagataacagatttcttcttatcacgcttgattttgccttgtttaatcagttcttctttctctatacgaatactctccaatatcacagatgctggttcgtcattcgggtcttgtggaacaagtttaccacggatggcgaggtcaaggattttgtacttacttaaagatactattttttgaagttcttctttttcagtatcaatagtagataagaaattgtcacagatttgaaatctatcaacaatttgtagctgctgtacatatggacatataggaatcaaagttgaaagaattctttctaatgccaactttggcatcgccacttggtgggttttatcttgaaactgctgttgaacaaaatccgtttgcaatattatgcaaaggaatgacttatttatggctatatttgttatttttacagcattttcggtgagattcattccgtccaacttgtctggaatttctccaacaacaccaattgttccagctattgttacatacaaatcatcttttgcaattgtgtaattcttgattgctgaaaatatttcatcagaaatatacctcaaattagaaatattgacagaatgatttttcatatcagttactctgatatatgcatgggtagtaatctcttctgaaaaacttgctcctttaggtaatctctttccacctttaaccattgcaatatctctaactcgtgcccagcaccacccctccggcacttcaaacggtatctcatcttcaatacatttcacagttccatcctggaacttctcataatgcaaattattgatacaagtagtaagtttaatgtaccttcgtggaaaataaaaaagtggagcccacgcatggaactccaccggctacgggcatcgcaagtttccgtagcgcaaccatatgtacattaacattacaagatgtgtatgtcaataaactcatgttagatattgaattatattttcctgtatcggctgattttatcccagttagcaggaaatcccatattatcaagcaattgtttctctgtaagatgaggacactgcttaattacagtttttataagttttgaaagagcagttttaaagagtctgaattcatcattatttatcaggtagcgtagggcaattacaactgcgaataaatcctgcttgccgtatacatagtgattattgttttgattgatttgaagcttttggtgtagcagggtatcaggaattgtctcgtttattctgaatgaaaatagacgctctccatgagcacatacattacggcatttgcctataatgttgataaactgatgcaattgtttttctgaaacattctgaaagtttttgctgattttggttctaatatcagtagttgcatattgatacattttggaaatctgcccaaatgttaaagcatttgttgcaacccataatggtacattgtgatatgtattgactgaatgctcaatataggcatatttgctgggtgtagcaataactttttgtaatgaatgagtcaggcgaagcagttcacgatggttctttctggtgtgattataattatttatattaagatacatggactgctgttcaccatatttttcacagaagtgataggaaaacatggattttatatggcgttctacatgaagaatgtatttcagaaataaagtgcgcaactcttcatcaaagtagtagaaagaaaccaattcatcaaaagtaacgccatgaatatatttatttgacggagcatgtttgaaaagagatttgtatccgcctattagagaatagtagctgagttcttccagttttttagtggcatattcgtgattaggaatagcaagttgtttgtcatattcaagaatatgtagttgctgctcataggtgagaaagttttttgccatatagtatttcctttctgaaacaggcataaaaaaagtggagtccacgcatggaactccaccggctacgggcatcgcaagtttccgtagcacaaccactacatgtaatataccattgatatccattgatgtcaaacagcattttgttagcagcaataatagtttatgcgtttctgcgtgtgatattcttattttgtatcttctagtcattcggattattcagataatcattattttgaaaaatatagttatcatatgctgaaataatgatatctgaaataactataagtattataacacaaaaacaaacatatgttctatatgttttgcactttttaaaacatttgtgagagatgcagaaaggcttggactttattgatatttttgtaacaggagcacagatatataggggttaaaggtgtgttgtgggagtaagcatgaagctgctgaattattaacttgacaatggttagtgggttttagtgatttccggctgccagataatcaggaaaaggcatacataggattttgatgagcagattttaatatgcagatttaatgttccaaagacgcattgaaacgggaaaacatttatgataaaataaaaaccaatattgaatatgaagcagcaccgccggacagcggggctgaataaggaggatataatggagcagtataagcaggaatttatagatttcatggtagagagtgatgtgttaaagtttggagattttactttaaagagtggaagaaagtcacctttcttcatgaacgcaggtgcgtatgttacaggaacacagcttgcaagacttggggagtattatgcaaaggctattcacgaaacatatggtgatgattttgatgtactgttcggaccagcatataagggaattccaatcagcgtagttacagcagttgcatatgcaaagctttacggcaaggaagtaagatactgctcagaccgtaaggaagagaaggaccatggtgctgataagggaggattccttggaagcaagttaaaggatggcgacagagttattatgatagaagatgtaacaacatctggtaagtcaatggaagagacagttcctaaggtaagaggagcggcagatgttactatcgtaggacttatggtttcacttaaccgtatggaagtaggacttggcggaaaggttagcgcacttgaggagattaaggaaagatacggtttcccaacaagcgcaattgtatctatggcagatgttgtagaacacctttacaataaagagtgtgagggtaaggtagttattgatgatgcactaaaagcagcaattgacaagtattacgcagaatatggtgttaagaacgcataatagctgatgttaatggagggttaattatggaagagaatctttataagaaattaaagtcagtaggagcttctaatcttgtatttggtatcctgataatactctttggtatcggtgcaggtgtaatgatgattattaatggtgcaagacttcttgcacacagatcagatagcttattctagtgaaggggaactgcctggtgggttaattatgcctgccgggcagatttgttatgaaaaagaaacattatgtaatgcttataaaatgggcgctttttgttatatatatgattctgctcttttatgtagtctttttcgcagaaggaatgggaagggcagagatagccagcggttacaaatacaatcttacactgttcacggaaatcaggcgctattggcgttatcttggacattttgactcgcttggctggatagcatttcttaatataattggaaatgtgctggcatttataccatttggcatattcgtgccgtggctttccaatggcagaattaatgtatttgctacatttgcatatggattcgcactgtcgcttacaatagaaacagtacagcttatatgtaaggtcggatgctttgatgttgatgaccttgtgcttaatgtactgggagcattgtgcggttatgcggtatatgcgatagcatacagaattgttaaaatgtttaataaaaaggacaggtgaaaaaatgaaactttttaataaatacaagttctctgataaaagtcaggcacttggtggtttgatatcgactgcgatgggaatactgtcattgctttcttttggttacggagtgtatctgtcttttaaagcagcaggagaaggcggcttaagagtaggaagtcttggaatattaagccttatcttagcggtaattggaacagtaatcggactaatcagcttcaaagaagataataagttctacggaacttcgagatttggttcaatgctgtgtggggtaatagcagtatttatgatagcagtattcttaatgggaatataatccttatcagggcagaaggagaaagaaattgtttaatgataatgtagaagagcgttacgctcttgcaatagaaagaattaaagagatagcagaggaacctgggcttaagacggatgggtttgcagattatttcaaatgtattgccacatttatccttaagatggataagcttgcggctgacttaaaagctgatgttttcagagattattcacttgaagaatataagaatctgaatacaggtctgtatgaagatgtaattggaaaggcttacgagacaagctacgctaatccggcatatgcagcttcaaagttagggctatcagagggaaggcttttgtcattcctttatgttgagataagaggaatgattgtgtatgcatatgaaggcagaatggcagaaatgacagcacttatggagctttttgttgaagtgtactgcatgtgcgtatcgactgaggaagactgtggaaagccagattataagcagatgaaagaatctgtgtactggtatgtgagcgattacagtgatgaccttatggagtaccgggtaagagagctgttagaccctgaacttgattttgcaactaagataattatggagtctgaccttacagatgtaagatatctgtacagattcggtgagtatgtcacagacaatgagattaagacagcagagtatcttagttcgctcagtgaagaagaaatccagaagatggcggacacatttacagaaggatacagaatcgggtttgagcttacaggcaaggatttatcaaagaagaaaacagttaatataagatattgtctgggatttgaaagacttgtgagagctgagattaacaacttcacaaagcttggactcaaacctacgatatacagggcagcggtcaacacgattaataaaagacttaacattaaggttggctattacggagctaatcctaacaagcagatggatttcgatcatcgttttgacaatgcactttatatggatggcgaatttgttgagagaaagacaggcgcattaaagcttgcatatgagaagaacaaagagcttgcagcggtgcatggtggacctgctgttatggaagtgtttggtgaagtgccgtttgagcctcagattaaaagcgaggcattaacgcttgatactaagcagcagaagctttctgtgaagtacagcaatgacgcgggaagcattgttaatgagtatatcaaaggcgaggagagaagctttacaataattgcttatccgataccggagattggcgagaatttcgaggaaatattcaagggtactgttaagattaatacccttgattataacaaatataaagctatccagcaggcacttattgatgtacttgatactgcacagtatgttgaagttaagggaactaacggaaactgcacagacatgaaggtttctattatgaagataaccgaccataagacgcagactgtatttgagaactgtctagcggatgttaatattccgcttggagaagtatttacatcgcctgtgcttaagaaaacaacaggtgtgcttaatgtgagcagtgtatatcttaatgatatcaagtttaacaatcttactgtatggtttgaggacggatttgttaaggattatacatgtactaactttgatgatgaggctaagaataaagagcttttcaaggcaaatgtgttatatgaccatgaaactctgccgctcggagagtttgctataggaactaacactacagcatatgtgtttgccaataagcatgatattgtgtataagcttccgattcttattgttgaaaagatgggaccacattttgcagtcggtgacacatgctattcaagggcagaagatgtgtatgtaactaatccggacggtaaggagattatctcaagggataatgaggtttcacttcttcgtaagacggagccggacaaggcttattataactgtcacaccgatattacaattccatatgatgagattggcaatatcactgttgtggcagaggatggaacaagaacagacttgattaagaacggcagattcgtgcttgatggcacgcttgcacttaatgatgcatttttacaggaacagtaaatatgtaatatgggctttttcttgacgcgtagtttaaaacaaagtacaatgataattagtgttttcactaattttaatattatatctatcggacataggaggttaatatggctttagtaggaattgttatgggaagtgactctgatatgcctgttatggcaaaggcagcagacattcttgaacagttaggaatttcgtatgagatgacaattatctcagcacacagagagcctgacgtattctttgaatatgctaagagtgcagaggagaagggatttaaggttattattgcaggtgcaggtatggcagcacatcttccgggtatgtgcgcagctattttcccaatgcctgttattggtattccaatgcacacaacatcactaggcggtagagattcattatattcaatagtacagatgcctacaggtattccggttgcaactgttgctattaacggcggtgctaatgcaggtattcttgcagccaagattcttgcaacatctgatgcagcacttcttgaaagacttaaggattatactaagaatcttaaggaaagtgttcagaagaaggatgccagacttcaggaagtcggttataagaattattaattagtaactgaatagttacattaacttacatttatcataatattgaaggagaaagaatcatggattacaagaaatctggagttgatattgaagcaggttacaagtcagttgagttaatgaaagaggctgttaagtctactatgagagaagaagtgttaggcggaatcggcggattctcaggtgcattttcactcgctaagattaaggagatggaagagcctgtattactttcaggaactgacggatgtggaactaaggttaagttagctttcattatggacaagcatgatactatcggtattgatgcagttgctatgtgtgttaacgatgttgtatgtgctggtggagagccactcttcttccttgattacatcgcatgcggcaagaattatccagaaaagattgctactatcgttggtggtgttgcagagggctgcagacagtctgaatgtgcacttatcggtggtgagacagcagagcatccgggacttatgccacaggatgaatatgatcttgcaggatttgctgtaggtgttgttgataagaaggatcttattacaggcgagaacatcaagccgggtgatactcttatcggtattgcttcaagcggtgtacacagcaatggattctcacttgtaagaagcgtatttacaatgacagaggaatctcttaatacatattacgattcacttggaaagacattaggagaggcattacttgctccaactaagatatatgttaagacaatgaaggaaatcaagaaggcaggcgttaaggttaagggctgcagccatatcacaggtggtggtttctatgaaaatgtacctagaatgcttccagacggtgttaaggcagtaattaagaaggacagctacgaagtaccaccaatctttaagatgcttgcagaagatggcaatatcgaagagcatatgatgtataatacatttaacatgggtatcggtcttgtacttgctgttgatcctgctgatgttgatacagttatggaagcagttaaggctgcaggcgagactccatatgtaatcggaagcattgaagctggcgagaagggagttactttatgctaagagttgcagttatggtttccggaggcggaactaatcttcaggctattatcgatgcggttaaggatggaactatcactaacacagagcttgtagcagttataagcaataatgccggagcatatgcactcacaagagctaaggataacaatattccagcatattgcatatcaccaaaggactatgaaagcagagatgcatttaacgatgcattacttgataaagtgaatgagcttaatgttgaccttatagtactcgcaggattccttgtaagaattccagagaaaatggttcatcagtacagccacagaattattaatattcatccatcacttataccttctttctgcggagttggtttctatggacttaaggttcatgaagcagctctggcaaagggtgttaaggtatcaggtgcaactgtgcattatgtagatgaaggaatggatacaggagagattattttccagaaggcagttgatgtacttgatggtgatactcctgaaactcttcagagaagaattatggagcaggctgaatggaagcttcttcctaaggcaattaacaagattgccaatgaacatgttaattaatgattactgactaagtatatagataacaatatgcggaggaattaagatgaaagtattagttgtaggcagcggcggaagagagcatgcaatatgctggaagttaagcaagagtcctaaggttgacaagatatactgtgcaccgggtaatgcgggaattgcagagcttgcagagtgtgttgatattaaggcaatggagtttgagaagcttgtagcatttgctaaggaaaacagcattgaccttactgttatcggtatggatgacccacttgtcggtggtgtcgttgatgtattcgaggcagagggcttaagagtattcggaccaagaaagaatgcagctattcttgaaggatctaaggcattttctaaggaccttatgaagaaatacaatattccaacagcagcttatgaaacatttacatcagccaaagaggctaagaagtatcttgagactgctgagtatcctatcgttcttaaggctgacggacttgcactcggcaaaggtgttctcatctgtgagaacaaagaggatgcacttgcaggtgttgatgagcttatgcttgacaagaaattcggaacagcaggtgatacaattgtcattgaggaattcatgacaggccgtgaggtttcagtactttcatttgttgatggtgatacaattaagattatgtcatcagctcaggatcataagagagctaaggatggtgaccagggtcttaacacaggcggaatgggtaacttctcaccatcacctttctacactaaggaagttgatgagttctgtaagaaatacatttatcaggcaactgttgatgcaatgaagagtgagggcagaccatttaagggagttatcttctttggacttatgcttactccaaagggaccaaaggttcttgagtacaatgcaagatttggtgatcctgaggcacaggttgttcttcctagaatgaagaatgatattgttgatgtatttgaggcttgtatcgatggaactcttgataaggttgaccttcagtttgaggataacgcatgtgtatgtgtaattctcgcatctgacggatacccactcgcatatgagaagggcttcgagattaagggaatggaaaacttcaagggtaaggatgattatttcttattccatgcaggttctaaattcaatgaagagggcaaggttgtaactaacggaggacgagttctcggtgttacagcacttggcaaggaccttaaggaagcaagagccaaggcttatgaagctactgaatgggtagatttcgataacaaatatatgagacatgatattggtaaggcaattgatgaagcttaattagtaactgttaagagtcaggcaaaatgcgaagcattttcgatactggcggaaaatagttagtattaaagaaaatgggggcagatggctggagaataccggttatctgccttagtgtgtaaatgaggagacaattatgaaaataacaccagttaagggtactaatgattatcttcctaatgaggttgaaatcagggattaccttcagaatgagatattaaaggtatatgttgctaatggatttgaacacattacaacacctattattgaggatattgagaatcttgataagagtgatggtggtgagaacttaaatcttatattcaagattatgaagagaggcgataagcttgagaaggctgtaagttcacttcaggaaaatcctaagacaggaacagcctgtgagaatgaaattgctgatatgggattaagatatgaccttacacttccgctcagccgttactttgctaacaacaaggacaagctcactcttcctatgaaatgtatccagatggacagagtgtacagagctgaaagaccacagaagggcagacttcgtgagtttgttcagtgtgatattgatattatcggttctgattctacagattcagaggttgaacttattcttacaacaaccaaggctcttaaggctattggcatgaagaatttcaaggttaagattaacgacagaagacttctccgttcattccttcagaattgtggatttaccgaggatcagcttgatagtgtgtgcattacatttgacaagatggataaggttggacttgacggtgttaaggctgagcttacagacaagggatttgacgctgctgcaattgagaagtttatcggattctttggaagtgtttcaagtgcacaggagataagccttgaaagtgttgaggctatactggatgataaagctccagcagaaagcgtaagaggaattatcaacactgtaaatgagctttcagacggtcagtttgatgttgtatttgacctttctttagtaagaggtcagggttactatacaggaactgtatttgaagttgaaagtattgatttcaagggtgctatcgcaggtggtggaagatatgacaaccttattggcaagttcttaggacagcaggtaagcgctgttggattctcaatcggattcgagagaatcttctcaatccttatgcagaatggtgttgagactaaggcatcagcagacaagattgctgttatgtacgatgagggacaggttaaggaagcctatgcaatagcagaaaaatacagagcagaaggtaaagtatgctcattatatgtaaagcctaagaagatgggaaagttcctcggaaagcttgaggaacgtggatataaaggatttgttaatgtcagcaatggggacgagataagcttgttctagtgttgatgtgtaagccccgggcagattagaactatttcaccgggatagtttacataaacctactaaacttagagaatgtatattaatagtaggctgattaatgctgaaacttacataacaaataatgcaacaacctaccaaactgcagttattgtggagtttagtaggttgttttcttgtatattgaagtcgtgataacagagttagtgaaaaatacaactcaatttacctactaaagaagcgagatgtaatgaattagtgggtttctgacaatatttttataaaaaaattttcttaaaaaacatactaacgaagtatatatcatgagttagtatgtttatcttaaaattttcaggttaaataaaaatttttcgataaataatctcaataattatagttgacatatacccatatggggtatattatacatcatataaatagagcataccccactagggtatgttgcaatcacaacagataaatataataaagcgtttatcagacacagaatataacaaccagactaaggaggaacaatggaaaaagaatgttgctgtcataagacaaaagaacgcgatgccaaggaatataaagacctctgtaacaggcttagcagaattgaaggtcagataagagggattaagggaatggtcgagaaggacgcatactgtattgacattcttaatcaggtatcggcagcccagtcagcacttaacagttttacgaaggtgctcttagataaccatatcaagagctgtgtagtccaagatattaaagaaggcaaggacgatacggtagaagagcttgttaagacaatcggcaaattcatacgctagaatttgcacaaggtaatgaagtataaaaggagatgcataatatgggaacagttataataatcggcatattagcaataatagtagtaattgcagttataagcagtgttaagcatatgaaaggtgaaggcggctgctgtggcggtggtggagatactgttgcggaagagaagaaggtacttaataatcctgtaattgctgtcaagactgttgatattgaaggcatgcattgtgaaaactgcaagaacagtattgagagatctgttaacaaaattgatggtgcttcatgccaggttaatcttaagaagaagcaggcaacaattgaagttgacagagaaatcgatgacgctgatataagaattgcaattgagagacttgattttaaagtgacaggaataacaactaaccgcaaggaggagtagtgcgatatggaacagtacaatgttacaggaatgagctgtgcggcttgtcaggcaagagttgagaaagctgtcagcaatgtgcctggagtggaaagctgttcggtaagtcttcttactaattcaatgggtgttgagggaactgcaaccccagatgtaatcattaaagctgtggaagctgcgggatatggtgcatcagttaagggggcaaagagcagcagtccttcaatgcaggagcaggaagatgcgctggcagataagacaacccctgttttaaagaagagattagcagcttcagttatatttcttgttgtgcttatgtatttcagcatgggacatatgatgtggggctggccgcttccgtcagtacttgaaggaaatcatgtggctatgggtcttatacaaatgctgcttacaataataataatggttattaatcagcatttcttcataagtggttttaagggattgttacatcgttcacctaatatggacacacttgttgcgcttggttcaggagcagcatttgtgtggagtacatatgcactttttgccatgacagactgtcaggtgagaggtgatatggccggtgtaatgcactatatggatgaattctattttgagtcagcggctatgattcttacacttataactgtaggaaaaatgcttgaagcccgctctaagggaaagacaacagatgcattaaagagccttatgaagcttgctgccaagacagcagtactttatgttgatggacaggaaaagtgcgtccctgttgaacaggttatgacaggagatgtatttgttgtaagaccaggtgagaatatacctgtagatggtgtcgtcattgaaggaaacaccgcagttaatgaatcagcacttacaggagagagcattcctgttgataaacaggagggagatcaggtaagtgcagcaacacttaatacgtcgggatatataaagtgcagggcgacaagagtcggggaagatacaacactttccaagataatacagatggtaagtgatgcggctgcaacaaaagcacctattgcaaagattgctgataaagtttcgggagtatttgtgcctgcggtaataataatagcagttataacaatagtagtatggctgttatgtggcaaggacttaggatttgcacttgcgagaggaatctcagtgcttgtaataagctgtccttgtgcgttagggcttgcaactccggttgcaattatggttggtaacggagtcggagcaaagaacggaattatgttcaagactgctgtttctctggaacagacaggcaagatgcagacagttgcacttgataagactggtactattacagagggtgagccaaaggttacagatattataacaggtgatagaatcccacaaaatgaacttattgctatagcatatggtcttgaaagaaaaagtgaacatccacttgcaaaggcagttgttaattatgttgaagagagtggcgataagaattcatttgcagaagaagtgactgactttaaggcagttgctggtaacgggcttaagggaatgcttgatacaaatgtagtggcaggtggtaatcttaagttcatttcagaatattgtaatatctctgatgatttaaggaacaaggctgatgacttatcatcagaagggaaaacaccacttttctttgcaagaaataacaagcttcttggaataatagctgttgcggatactatcaagaaagacagcccaaaggctatcagggaacttcagaatatgggaatcagggttgtgatgattaccggagataatgaaagaagcgcgaaagcaataggaaagcttgccggagttgatgaggttattgcaggtgttcttcctgaaggaaaagaaaaagaaatagcaagacttaaggagcagggaagtgttataatggtaggtgatggcattaatgatgcacctgcacttacaagagctgatataggtattgcaattggagccggtacagatgttgcaatagatgcggcagatatagttcttatgaagaacaggttatcagatgttcctgctgctataagactttcaaagagaacacttaccaacatacacgagaatttgttctgggcattcttctataattgtataggaatcccacttgcagcaggtgcgtggataccagtatttggatggacacttaatccaatgtttggtgcagcagctatgagcttatcaagcttctgtgtagtaactaatgcattaagacttaatcttataaagatatatgatacaggaaaagaccacatttataagaaaaagtctagcaaaaataaaaataaaacgacaaaaggagataaaactatgacaaagactatgaatattgagggtatgatgtgtggacactgtgaagctgcagttaagaaggcacttgaggctgttgatggtgtaacagaggcagttgtaagccatgagaatggaacagcagttgttacactttctaaggaagttgataacgatgtattaaaaaaagctgtagaggataaagattacaaagtaacagcagttaagtaagaaatataatgaataagaataaagctataagctgcaaatgtatgtgatacattttaaggtatggaaagccctacgtgatacaaaagtgtcgtgcggggctttttcagtgcagggtaatttttataactgatagttgagtaagctgtttaataatgttaatattatgtatatagattatgggtatgggagatatgggaatatgaatattatgtatctgtctctttatggagttgcagctgtggtgcttgccgtggtgtttataagaacatgtcttgagcgggataagatgacacggatagtgtgtcttacagagatgcttgctctcatatgcgttgtgacatattcggtcaattttatcacagataattacatggcaatgtcggtggcaacaagcataatgatggcagcacaggattttgcactcgttgcacttttaacgtatacaggcatatttacaaggcttgcaaacaggataaccagaactgcagttgttttgtgcatatttgcggcaatggttgattcagttgtatttataattaatatatttaatgaaacggcattgaaatatagtcttaacaaatgtggaggagtctatgttctcggctatgaaggcgagttttggtttggtattcatgcgattatgaatatggttattgtagcatttataattgcactgcttattatcaaatgcatacgtattccatcagcgtattggggaagatatatatttacggctgccgggcttattgttataattgcttttaaatatatattcatcatgaaagctgttgacttaaggtttgacatatcaatttttctatatgcacttatgggaacaatggtgtactggaatactttctggtattctaagaaaaatatgcttacagttacacatgaaatgataattgaacatatgcagattcctgtagtactgtttgattatgagggaattcttgcagattttaattcttcaatgaaggatgttgcaggtaatcttgaatacgataacagggaacagaatattgagtggtttgtcagggagaatgacctgcctgttaaacctggagaggatacatttgaatggaagcataatgacagaatatatgactgcaggattgagagactttcagatgaaaaaaaccgactgctgggtactattattgttatgcaggatgtgtcggagttaaagaaggcttatgctgaacttgaaaatatggttatttatgaccagcttacaggagtttacagcatgtacagctttatggagcattgtaaacagtatgatgaatataatggcagtgttgctgtagttgtctgcgatattaatcatttgtcagatattaatatacagtatggacagaaagcaggtaaccaggcacttataaatgtggctggtgtgcttaagaagatacttatggacagagcatatattgcaagaattaatgaaggtgattttgttgcagtaatgaagaatgtcacggatgcagaggctgataaaacatttgaacagataaagcgaacagtagaaaaagagtgcaataatggaaagcttggtgttactatagaatatggtattgctatgagaaaagcttctaacagatggataatggatattgttcatgaagcggttaatgatatgagagacaggaaaggcagataatacacatgaagtttgatggtgttaaaaaagttgatgaaggaaggtttatcagcagatacgatctctattatacaactgaggatgacaagaaaaaggtctacgagattataagcagaaacaaggatataaagacgctagaagatataagaaatgaaaagactgacggagttgttattgttgcaactgatgaagcagatgaacatattctgattaataaagaatatagaatgtcagtaggagattatgtgtataattttccggcagggcttattgatgaaggtgagactcctgaagtggcggcgaagcgtgagcttaaggaagagacagggcttgaccttattgtaattgaagacaagctttatgacagctacagtgcaataggattttccaatgagacaaatgctgtggttatcggaaaagcatctggagatttttcgccaagcacttcaacgtttgaggagatttcggcggcatggtattcaaaacaggaagtaaaagagcttcttaaggataatcattttgcagcgagaacacaggcattttgctatatgtgggcgagaaataaataataaagaggcaggatatgtttagaggaaaaagaataatttcaggaattatgctggtgcttatgctggttagttttattggatgtaaaaagacttccaaagcagcaacatttacatatgaggagaatgctgccggtaatatagttataactggacttactgataagggaagagcagatgcaaaggttattgtgccagctaagattgatggcaagaaggttgatggaataggcagtggtgtattccgtgatgatacgactgttactgatgttgttatatcagatgggataagttatatagctgaaaatgtattcttaagctgctataatcttaaaacaattgagattccggaatcagttaattctattggaactaatgcatttacagatacacagtgggagtatgaccagcttgcagataacgatgagattattgttaatggtgtgttatgcaagataagcatagatagtggaacgtataatattccggatggtgtaaggacaattgcttcgggagtattttataataaagatggtcttacacaaataaatattcctgacagtgtggaagtaattggggcatatgcatttgctggctgcaagggacttaaggaagttaaactgccttcaggcattaaaagaattgagtatggagcattttctgatatgaatatcagtgagattgttgtgccaaagtcagtagattatataggaaatgaagcatttgaaggaattgagaatgtcgtaaaacgataaggaggatggcttatgataaagaagaaaagcaattcttttctatcatgtgatagaaagacgtctgttaatgttgttatttggtgtcccgatgagacagaatatgacgagcctgttgcggtattgcagatatgtcatgggatgattgagtatattgacagatacgacggatttgcaagatatatggcagagagaggctttgttgttgttggaaatgatcatcttggacacggaaagtcagtatgcacggatgatgatctgggattttttaaagataagaatccgggagaggcacttgcaaaggatgcacatcatcttacagttcttatcaagaaaatgtatcctggtattccatattatcttgcaggacacagcatggggtcgtttgttacaagaagatatatatgtgattacggatatgaacttgatggagttattgtaatgggaacaggacaccagccggcaccaatggtttttgccggaaaggtgcttgctgatgtagtaagacttataaagggggaccgttacagaagcagactgatatctaagattatgtttggtaattataacaagcgtataaagaatgtaagaacagtcaatgactggctgacaagagatgaagcggttgttgatgaatacaatgccggaaaactgacaacatttctgtttacggttaatggttacagaggacttatgaatatgattctgtatgtaagaaagccgcgcaacatagaaagaattcctaagaatctgccaatgcttatgatatcaggacttgatgatcctgtgggagaatacggcaagggcgtttacagggcatataattcgtatcatggtcacattgatgatattgatttaagactttacgaggattgcaggcatgagttgtgcaatgaacttaataaagaagaaatatatgaagaaatatatggctggattatgaaccatatgagtaagtaggttaataaaagcggaatggaagtttcaaaccattccgcttaattctttattgattataatctgatagtggtgtacttaggaatgcaagcaattcctaatgcgtaaggccctgtatggcagcctgagataatactgattcttgtcttgaaatcttcgcgtctttcgagaagcttcacaccaagctgtgcttcaacatcatctctgtatttctcagcttcttccagattagtacagtagccaacagtgatatcccagttttcaatcggcattccctttgattcgatgtatttctgaatcatgtcaataacattagatttacctttgtttcttgttcgtgtaaatccaccaagcccaatttctccttctttcataacgatgataggacggagacttaatttgcttgtgattgtaattgcagtcttggcaagacgtccgcctttacttaagtattcaagtgattctgttgtaaacattattcggccatcgtttcttaaagcttcaagaactttgattgtatcctcatatgaataccctgcttttctcatctggagagcctgatatatgaagagtgaaaatgatgctgaattaagcagtgaattaataactgtaactttagcatcaggatgatcttctaatataatgtccttagctgtgcaggctgagttataagatcctgagaagtatgatgtaattgtacatacaatagcaggtctgccagcttccacacttggcataatagcatcaacaaaatcctgcacacttggaagagatgacttaggaaatgcgccttcgtctgtcattcttctgtagaattcatcatgagtaatgtcatattgttctttaagataattaacaccatcaaaagttgtgtagagcggtacaagtttaagattgtgtgtctctgcatattctctaacaatatcgcaggctgaatcagtgattatatcaaacataatatatattatcctccgcgttgtaaaaacgatttgttttgttaattgagatgataacacatagttttcaaaaccacaatacattaatattaatattttataaaatataagtttgtaaaattaaaaaattgttgtataatcaattcgtatgtatattttttcgagtggaggaaataattaatgaaggtatgtgcatttcttacagatggttttgaaacggtagaagcacttgcagttgtagatatattaagaagagcggatattaagactgatatgatatcaataacaggtgacattaatgttaaaagtgctcagggggtaattgttcaggctgatgagcttttagatgaatatgtatttgaaggagatgagctgttattccttccaggtggtccgggtcataagtcatattatgattgcaaggatttactggaacttcttaaagaatacaataagaagaataacagaattgcagccatatgtgcagcaccttcaattcttggaaatcttggattacttgaaggaaagaaggcaatggcattcccaggctttgaaatgcagttaacgggggcagttataataacagcaccggagagggtagttacagatggtaacattacaacatcgagaggaatgggtacatcactagatttaggactcgagcttgtaagacttattaagggagaagaacttgcagagcaattaaggacttcaacacaatatatataataagtttattttatgcgagaggaacttttaaagatgaaatatgataattatgatgaggatgcaatacgtcgcagcagaaaaagaaaatcacagttgatgaagaagaaaagacagaagattttaagaagaagacttattatgatggcagctgtgacatttttaatagtgcttgcagtagttattgtgaatgtaacattggggctgaaaaaaacattaggtcaaaaagcagcatttgcttctgatataacagatgagacacaatcagagatactgatgccaacagaagcaccaacagaaccgcctcttatatatgcacagatggcagaagattatcaggatttgtcaactgatgcacagatagcgtcgccttatgcagcattactcgatgtcaataatcatagaataatagcaggtaagcttgctgatactaagatatatccagcttcaatgactaaggtaatgacacttattgttgtatcagagaatatagataagatgccaaagacttatacatttggatttgagatgcttaacagactttatagggaagaagcgtctgttgcaggattccttgaaggtgagacagtagatgttgaagatcttatgtatggacttgtgcttccatcaggagctgatgcagccgaggcacttgccataatggttgcaggttctaatgaagaatttgcaaagcttatgaatgaaaaatgtaaagaacttggacttaagtatacacattttactaatccgacaggattatatgatgaggaacagtatacaactccatcagagatggcaatgattatggaatatgccatgaaagatgagaccagagccaaagtacttggaacatatcagtataagactaaagcaacagaacagcatccggaaggaataccgcttacaagtacaatgtattcaagaatatatggtaatgaagcacctggagtactcgtaaaaggtggtaagacaggatttaccaatgaagcaggaagctgccttgtaagttatgctgtaactaataaaggtaatgcgtatgttttctgcactggaggagcaacatacagatgggcacctgtatatgatgagatatatgtatataagaatataattccggcgtcagccaaagatttagaaacagaaacaacgaaaatgtctcctaataattagcaaccagaatatgtcataataattagtattaacggacacataataacatcaagacgttaagttatggcgccataacttttcggcttaaacctaaaaatgtgtttaataaggaggcttattatggctaaatcaacaagttctaattataagactaagaaggaagcacagaatgcacttgacagattcaagatggaggttgcttcagaaattggtgttaacttaaaggatggttacaatggagacctcacatcagcagaagctggttcagttggtggtaacatggtaaaagagatgatcagaagacaggaagagcagatgagcggtaagtaattgcgggatgctcacaactgaatacgaattatcttaagtgataaatgggctgtaatccgaatgtttattagtaaatataaggtttgcagccctatcttttatttttttaaaatagtactggtaatctaaaaacagttgtgttataattcgtgggtatgttgtacgatagtaacaatacatagttcataggaggattaatttataatgagtttcacagttgagaatttagaagagaagaatatggttaaacttgttattgagtctactgctgaggaatttgaggcaggtcttaatactgcatataataagaataagagcaagatcagccttcctggtttcagaaaaggtaaagcacctagaaagatgattgagaagatgtacggtgcagaagtgttctacgaagatgctgctaattcaattattccagatgcttatgctaaggctgctgatgagtgtggtcttgagcttgtttctcagccaaagattaatgtaacacagttagaggctggaaagccattcatttttgaagctgttgtagctactaagccagaagttgagcttggacagtacaagggcgttgaagtaactaaggctgatacagaagcaacagatgctgatgtagaagaagaattaaagagagttcaggagcagaattcaagaacagtagctgtaacagacagagcagttaaggatggcgataatacagttattgatttcgaaggatttgttgacggtgttgcattcgaaggtggaaagggaacagattacccacttacaatcggatctcattctttcattgacacatttgaagatcagattatcggtatgaatatcggtgatgagaaggaaatcaatgttacattcccagaagagtatcatgtagatgatcttaagggtaagccagctatgtttaaggtttctgttaaggaaattaaggagaagcagcttccagagcttaatgatgaattcgctcaggacgtatctgattttgatacaattgctgaatataaggatgatttaaagaacaagattgctgacagaaagtcaagagaagctaaggctaagcaggaagacgaagcaatcgctaagattatcgaagactctaagatggatattccagatgctatggttgacacacaggttaacagaatggtagaggattttgctcagagattacagcagcagggcttatcagttgagcagtacttccagtatacaggaatgactgcagataagattatggaagagatgaagccagaagctgttaagagaattcagtcaagacttgttcttgaagcagttgttaaggctgaaaatattgagacttcagaagaagattttgaagcagagttaaagaagatggctgagacttacaagatggaacttgatcagattaaggaattcatgggcgactatgagaagaagcagattaaggaagatcttgcaatccagaaggctatagaagttattacaggatcagttgttgaaaaataattgaggttgtaagaaacattttagtatattggaggttgtgtaatgagttttgtaccttatgtcattgaacagaacagcagaggcgaaagatcgtatgatatatattcacgtctgcttaaagacagaattatattcttaggagaagaggtaacagatgtttctgctaatcttgtagtagcacagatgttattccttgaggcagaagatccaggcaaggatatacatttctacattaacagcccaggaggatcagtatcagcaggttttgctatatatgatacaatgcagtacatcaagtgtgatgtttctacaatctgtattggtatggctgcaagtatgggtgcattccttctttcaggcggtgccaagggaaagagacttgctcttcctaatgcagagattatgattcaccagccatcaggcggtgcaagaggtcaggaaactgagatcagaatcgttgctgagaatatacttaagacaagaaataagttaaatgaaatactggcagctaatactggtaagtcagttgaagaaatttcacgcgacacagagagagataactatatgacagcacaggaagctgttgcatatggacttatcgacagtgttgtagagaagagataataattgcttatgataaggaagatgcctgcagataatacatttgcaggtgtctcccttgtttttgtgtgataagcgaacctttatttaaaggatttatagtgatttggaggatagtatggcaggcagaaatattgacgagaagcttagatgctcattctgtaataagacacaggatcaggttaaaaagctgattgcaggacataatggcgtttacatttgtgatgaatgtgtagaaatatgcagcgatatccttgatgaagagtttgaaaccgaggcagatgaaaaagaagtggttgatggaatgaatatcaacctgcttaagccgaagcagataaaagaattcctagatgattatgttataggacaggatgatgcaaagaaggtacttgctgttgctgtatataatcattataagagaataatgtcacaggctgatttggatgtagagttacagaagagtaatattcttatgcttggaccaacaggttcaggaaagacattccttgcacagaatcttgcaagacttcttaatgtaccttttgcaattgctgatgcgacaactcttacagaagccggatatgtaggcgaggatgttgagaatatcctattaaagcttattcaggctgcagattatgatgtagaaaaagctcaatatggtattatatatattgatgaaatagataagattactaagaagtcagaaaatgtttctataacaagagatgtatctggagagggtgtacagcaggctcttcttaagatattagagggaacaatagcatcagttccaccacagggaggaagaaagcatccacagcaggagcttattccaattgatacaactaatattctttttatatgtggtggtgcatttgacggactcgagaagattattgaatcaagaatggataagagttcaattggtttcaattctgaacttaaggaaaagagcaacgacgatgttggagagatgttccataaggcgcttccacaggatcttatcaaattcggtcttattcctgagtttgtaggccgagttccggttgttgtttcgttagattcgcttgatgaggaagcacttgtgagaattctaaaagagcctaagaatgctattataaagcagtatcaggcactttttggacttgatgaggtagcacttgagtttactgatgaagctgttgaggcagtagcccacaagagctttgagagaaagacaggagcaagaggtttacgttcaatcttagaatcagtcatgaatgaagtaatgtatgagattccgtcagatgaaacaatatcaaaatgtataataactaaggaagctgtagaaggaaacgcaaagcctctgttagaatacagaacagatgctgttaaaaaagcacagtaatgaaattaattcaggcgggctgttcatgatggacggtccgtttttttagatagagaggaatatatgagtaacaaatatgatagacattatccagctattccattaagaaatgtcactgtttttcctgggatggtaatgcactttgacgtgagcagaaagaagtctgtaaaagctgtagaagcaagtatggcagctgatgaacttatatatcttgtaacacagagagattcgcaggtgagcgaaccagggatagcagatttatatacagtaggaacaattgctaagataaaacagataataaagatgccaggcaaaattttaagggttcaggtagaggggcttgaaaaggcacttgtaaatagatttgaagaagcgtcgggaatgatgcttgctgatgtaagtgttatgcaaggatttgagaagcctgataaaatggtgtcgagagctataattgtaggtatgagagaactattgacacagtatgcacatgttaatccgaagtttgcaaaggatacagtcaagagatggctttcttatagtgatgcagaaaagctgatgatggaatttgctcaggaatttatgatggattttgataaaagacagcagtttcttgaggcagaagactatgagcagatgtatacatttgctgcaacattacttgtaaatgagataaatgcttatactattaaagaagaacttggcaatattgtaagagaaagagtagataagaaccagaaggattacatattaagagaagaacttgcagcaattaatgaagaacttgatggaggaaccataacagaggcggaagaatatgaggcggacgttgaaaagcttgattcaccacagtatgtaaaggataagctaaaaagggagattaagagactgaaatcacttgctggtaataatgctgaggccaatgttgagagaacatatatagagacatgtcttgaactaccatggaatgtgtcgactgaagataacaaagatatagataatgctgcaaaagtgcttgattcggaccactatggaatgaaagatattaaggaaagaattctggaatcacttgcggtaagaaacataacaggaagtggaaaagcacctgtcatatgtcttgcaggacctccgggaacaggtaagacatctatagcaagatcagttgcaaaggcacttggcaaggagtatgtcagaatctgtctgggtggtgtaagagatgaggctgagataagaggacatagaaaaacatatattggagctatgcctggaagaattattgagggacttaagaatgccggagttaataatcctctcatgcttcttgatgagatagataagataagcagtgattataagggcgatacatcagcagcacttcttgaagtgttagacagcgaacagaatgttaattttgtcgaccactatatagagatgccggttgatttgtcaaatgtgctttttattgcaacagctaatgatctgtctaatataagccgtccattgcttgacagaatggaaattattgaagttggttcatacacagctaatgaaaagtttcatattgctaaggaacaccttattaagaaacagattaaagagaatggtctgcttgtatctgatgtaaagttcactgataaagttataagaacagttattaattcgtatacaagagaagctggtgtgagaggtcttgaaaggcagattgcaaagattgtaagaaaagcggttagagaattatacaaagccggagtgttcacatctgatggaacaagagataagactgtaaagaaaacagttaatatatctgataagaatattacagattatcttggaaaagttaaatacagaccagacaaaaagaatgcaaagggtgaagttggtatagtaagagggcttgcatggacacaggcaggtggagatactcttgagatagaggttataacaatgccgggcaaaggcgagttcaagcttacaggtaacatgggtgatgtaatgaaagaatcagcaagcatagctgtttcttatatcagatcagtaacagaaaaaggcagatataaagtggatgctgaatatttccagaatcatgcattccatcttcatataccagagggtgcaactccgaaagacggaccttctgctggcattacaatggcaacggcagtattgtctgcggttactggaattcctgtaagagcagatgttgcaatgactggagagcttacattaagaggtaaagtacttccaataggaggtcttaaagaaaagcttcttgcaagtaagacagcgggcataacaaatgtttttgtaccccgggataacaggtctgatgtagaggaacttgacacagagataactgaagggatgaatataatatatgttaataatgctatagaagtatttgcacaggcattaatgcgttaaatgaaaggagcagcggattatggttataaaaaaagttaatctggatatagtagtcggagttacaagtacacttcctgagacttcattccctgaggttgcatttgcaggtaagtcaaatgttggtaaatcatcgcttattaatgcattaatgaacagaaaatcatatgcaagaacgtcatcacagccaggtaagacacagactattaatttctacaatattaatgacagtatgtatcttgttgaccttccgggttatggatatgctaatgtaagccctgctgttaaggcaaaatggggtaagatgattgagaaatatttaagaaagagcagccagttaaagcaagtgttcttgttgatagatatccgtcatgacccatctgataatgacagaatgatgtatgactggattgtaaataacggttacagacctgtaattgttgcaacaaagctggataagattaagagaagccagataagcaaacaggtgaaagctgtaagaacaggacttggattaaggcaggaagatattcttattcctttttcatcacagactaagcagggacttaaagaattatggcagcttatagattcatatgtactgccacaggaagaagcggcagataatgagtaaataaaaagctttctgacaggcatatacacctgtcggaaagcttttttacataagtttacgaacgatataatcatatacttcctgactgttttcacgccatcttgcacatattatctctgcctgttcttcaactggaacattaaggttaagttcaataagagttgtgtcgccttcttttagctgacaatgtgcaatataattaccattagacagcttgtagcagtcagttacagttccggcttcattctttaattcgtatttgttatcaaacagataggtctctatatcatcacgtatggcagttgatatcttggtgtagaaaaatgcaatggtttcttcaccttctttagtgagagtataatgtgtgctgctctgatgcgagtagcctctaataaagccgtcctcaaccagagagttgatggtttcctggaaagtgaaataatccgtgtactgcttatctaacatgaaagatgaaagctgtgtgtttgataatggaaaattcactttgctcagcatatataaaatcattaatttgtacaatgtggttgagtcagtgttcataaatcgtttccttgataaatcatattttctttgaggtaatgagagagtgtgttgagaactctctttttgtcagctgtccataaaggtgcagcaagaatattcttaggtccgtcaccggtaagtctgtgtattaccatgctttttggcaatacaggaagtatagctcctattgcggcaaggtattcatccatggtaagagctttgaataatcctttacaataatcattgtaaaggtcagtatcttttaaaatgtgcaataaagaaatcttgattcccgatgcaccactgtctgatatatagcgggcagtagcaatataatcgcttattgtctcatgtggaagaccgattatcatatgaacaaccggtgcaattcctatggaaagaagattgcttacggcttcatcatatacggataaaggatatcctctgcgtatatagtcggcagttgaattattaattgtctgtaatcctaattcaatccatacaggcttgatgcgattgagttcatcaagaagctttaggacgtcatcaccgagacaatccggtcttgttgcgatagacaagatacggatatcgtctcttagtattacaggcataaaaagttcacgcagatatccggcatcagcatatgtgttagtaaatgattgaaaatatgcaatatattcactgccggaatatttattagatatcaaagtcttagctttgtcaatatctttaacggcaaaatcaccggaaccatgaccactgcagaatatacagcctgttgtacctaactttccgtctctgttaggacaggtcatgtttccggaaagacttaatttatatagtttcttaccataagtgtctttaagatattcgcttacagaataataatatggaagcataattacttctcaatatggtcaattacggctttgcttacaacatcagcaactcttgggtcaaatgcttcaggaaggatattaacatcacttacttcatcgtctggaacaaggtttgcaatagcaagtgcagcagcaagcttcatatcttcagttatctgtcttgcacggccttcaagagcacccttgaagataccagggaatgcaataacattattaacctggttagggaaatcagaacgtcctgtaccaacaacttttgcaccagctgccttggcaacatcaggcataatctctggaacagggttagccattgcaaatataattgcatctttattcatagtcttgaccatatcggctgtaacgatgttaggagcagaaactccgacaaatatatctgcaccacggagtgcatcagctaaagaaccagtcttgttctcaaggttagttacttccatcattgactgctgcatccagttaagaccttctgaagccttagaaaggataccagacttatcacacattgttacatgcttgaaaccatatgtaagaagaagctttgtgatagcaattccggcagaaccggcaccgttgactactacctggcaatcttctttagtcttgcctgtaactttaagtccattaataatacctgctaatacaacgatagctgtaccatgctggtcatcatggaatacaggtatgtccagaagctctttaagtcttgtctcgatttcaaaacatcttggagctgatatatcttcaagattgataccgccaaatgcaggtgcaatattaactacagttttgatgatttcttctgtgtcctgtgtatcaaggcagacaggcacagcattaacgttaccaaattctttgaaaagaacagcttttccttccataacaggcatagcggcatgagcaccgatattaccgagtccaagtacagcacttccgtcagatacaacagcgatagtgttagacttgatagtgtacttataagctgcttctttgtccttggcaataaccttgcaaggttctgctacaccaggagtataagcaagagcaagatcttctcttgtctgaatcttcattttaggagttgtttcaaatttaccattccactcttcatggagctgtaaggctttctctgcattagtcatgatatctaatcttcctttcaataattagtgcttttaacagtattatatataataacatattgctctgactaaaaaaagtgtaagatgtaagattaagttacaaaaggtagtaaacaccttagatatgtaatataaataatgtctacaataattgggttggtgtctacttttagattaccacttcaaatccaccgtgcttgctcatcccttttggacttccttatgccttcccgctccttcaatgtccaatctgccacgcttgctcgtcccttttggacttcagcataccttaactccgcttcaacatccaatccaccgctcttgctcatcccttttggacttcctcgtgccgtatctccgcttcaacgtccaatccaccgtgtatccacctctcccacaaaagggagtcgaattcttcgctccgctccggtcggcgcaaagccgaggtccaccggacctcgtgcgcccctgtccaaaaacccggctacgccatgttttatccattaataagactcccctctggtccataggaaaaagggagcgaagaagctcacgcttcctcactccctttttcctatggaccagaggggagtcgaacccctgtccgaaaacccattccctgttcttctactatcatagttgattgtttaacattccctccggtacacgagaatcaacacccttgcacctttagtagcttcatgatacgaccagcatctcaaagctttgatactgtcgtttcctacatgttcgaagcctgggtcttaaagtgtaggtgctttaagtcagactgctgcaattaggcagcgtatgctaaattatcgttagcgtttatatttaagtttggattttgacgctttcctgcggatagcttcaccagcttcaagatccccgtcgaaacctttactagcccgtgtgtaagcagtttcacctgcttatttatattaacattggcataatgccaagtcaattaacttgtgcttcaaaactgataaaatatttctaaatatttttaaaatctaagattcttgttcttgaattccttctgtgcatctcttatctggtctttctttgcaatagaatctctcttgtcaaagttcttcttaccttttccaagaccaatttccatcttcacctttccctctttcagatatacctgaagtggaacaagtgtgtaacctttaattgtaagttcacctgtaagcttattaatctgattcttgtgaagaagcagcttcttaggtcttagaggatctttattgaatatgtttcccttctcatatggtgtaatattcatacctaggacatatacttcgccattctcaatcttgatgtaagattccttaattgagcacttacctgctctgattgatttaacctcagtgccgtgaagtaccatacctgcctcgtatttctcttctataaaataatcaaaataagctttcttattgttcgctataagtctgtttcctgatgcgcttgtttttgatgccatgtcagtctccattctattctatgcaaatgcaaaatcaattgttcttagtatcttatcggtgcctataaccacaaccttaaccttctgtccgagcttataacttctgttcccaagttctcctaccatctcatagtgttcctcgtcaaatgtatagaatcccttcatattattgatagaaaccatgccctcgatagtgtttggaagttcaacatatacgccccacgcggtaacacccgaaacaactccatcaaatgtttctccaacaaactgttccatatactcagccattttaagcttgtctgtatctctttcagcatctgccgcacgccgctccatagcacttgtctggacagcaacatccggtaatattgcatcataatggtcagctctcttaggacttaaacctccgtgaagattctccttgataattctgtgaatctggagatcaggatatcttctgataggcgatgtgaaatgacagtaatacttggcagcgagtccaaaatgtcctacacattcagtagtatacttagctttcttcatagagcggagtgtcagtctgcttataagattctcagcatcagaaccctctatctcagaaagaagcttctgaatctccttaggtcttaaatcatcagtaagtcttaatgtataaccaaagttattaataaatgtggctaacttacgcattttttcaggatcaggattctcatgagttctatatagaaatggcatatcctgccagaaataatcctctgcaacagtttcattagcggcaagcataaaatcttcaataatcttagttgctacatttctgtcatacggcttaatatcagtcgggtggccattctcatcaagtataatcttactttcagggaaatcaaaatcaaccgaacctcttgcaaatctcttctttctaagaagctccgcaacctcttccatcatatgaaacattggaacaagctctttatacttcataatttcattagtatcattatctacaagaatcttttttacacttgtatagctcattcttctgtctacattaataacagtttcacatattctatgtccaacaatatttcccttttcatcaatatccataaggcagctgagtgccagtctgtcttctccctgattaagtgaacatatcccattagataacttatgcggtatcattggaataacacggtctacaaggtaaacactcgtacctcgtttaagtgcctctttatccagcgcgcttccctctgtaacataatggcttacatccgcaatgtggacacctagatgatatacaggtccttctttcgagatggatactgcatcatctaaatccttcgcatcctcaccatctatagtaaccatctgaacatttcttaaatcaactcgtccagccttatccttttcactgacaacatcaggaatatcattaattgccttcttaactgattcaggaaactccactggtaaatcatatgccttgataatagacattatgtccacacccgggtcatctatatgtccaagtacttctgtgaccttcccctgtggattcttactctggctgccgtaatcacttatagaagcaactaccttagaaccttcaaccgctccattcatgaattcctgcggtataaatatatcacagttaatctttgcattatcaggaataacaaaaccatacgttctgttcttctgaaatgttccgacaacttccttaatctcatgctcaacaatagcaacaatcttaccttcagccctcttaccgccattcttctctgtagttatcacaaccttgactttatcatgatagaaagcattcatcgtgtcattagccttgacaaatatatcatcttccctgtcaggtattactacaaagccaaatcccctgcttgtgctttcaaatgttccaacaagtgctacattttcaggcttcatatacttacccttctttgatacacctattgttccatctgcaacaagactgtcaagcacttccataagctcagaacgcttagctttaggaatatcgagaagcatagcgatttctttagctttcattggaacatacagttcattattaagaatcatatcagcaagcatctgtcttcgctgtttaaatgtatccttctccatatcccttatatccctttctaaccattaaatatacagattctaccagattgctcgtaaaagcaaaaacactcttaagaaattatccgtttcttaagagtgttcgtaatttagaaattaaaattaagtataactgctataacaataaaaagaattacaagaatcttggttatcttaacaagcttgccttccattgaacggcccttgttcttaccccagtatgaatcagcagcaccactaattgttcctgacaatccgttctgcttactttcctgcataagaattattattgctaaagctatacaaattactacaaatactcccattaaaccaattcttaatacatctccgacagacatatgaaacaatggaattatcttattcataccatcctcattcctgcgcatcatgcgctttttattacataattatgccaatacggcaacataggtcattctatcacaaataaacattttgtgcaagaaaaatcaacaaattaatttcaaccctttgattagttcttcttcacaagaagagactcacctgtcatctcaactggtttctcaagtcccataatttctataagtgtaggagcgatatcacataatcttccaccctcacgaagtgtataattctcatcataattaacaagaatgaatggaacagggttagttgtatgtgctgtatgtggagctcctgtttcgtaatcaatcatcttctcagcatttccgtggtctgcgcagatgaagagaactccgtcaacatcctttactgcatctacagcctttccaacaagctcatcaaccttctctacagccttgattgcagctggaataacgcctgtatgtccaaccatatcaggattagcgaagttgataataataacatcatatttgtcagactttatagcctcaactaagtccatacctacttccggagcactcatctctggctttaagtcatatgttgcaacatccttaggtgagttaacaagtaatctgaactcatcaacattaggatcttcaacaccgccattaaagaagaatgtaacatgtgcatatttctctgtctcagcaagtcttaactgcttctttccatgattagcaaggaattcaccaaatgtgttcttaatattctctttcttgaatgcaaccttcttgttagggattgattcatcataatccttgaagcatacaaatgttaatggaataaatcctgtctttctttcaaatcctgtaaacttatcatcgcagaacgctcttgtcatctctcttgcacggtctggacggaagttaaagaatataacagaatcattagccttaactaatgaaagtggctgaccatctttacagataactgttggctcaacgaattcatctgtcttaccattatcatatgactcctgaagtgcctgtgtagctgactcggccttaatgccatcacctgttacaagtgaatcataagccttttctactctgtcccagttattatctctgtccattgcatagtaacggcctgataaagatgcgaccttaccaactccgatttctgccatcttattctcaagtgtctcaacaaatcccttagctgaagctggaggtgtatctcttccgtcgaggaacgcatgaacatataccttagacactccctgctgctttgccatctctaaaagtccatatacatggcttaaatgactgtgaacaccaccatctgataaaagtccgaaaaggtgaagatccgaatcattcttcttgcagttctccattgcctcaagtaattcttcgttcttaaagaatgtaccatcttcaatatccttagtaattcttgtaagatcctgataaataattctaccagcaccaatattcatatgaccaacttctgaattacccatctgtccgtctggaagacctacagcaagtcctgaagcatatcccttctggaacgggcattccttcataagcttatccataacaggagtgttagccatagcaatagcattaccctctgttctatcatttaaaccataaccatcaagtaccattaaaactactggttttttactcataatgtgattctcctttaaatgtattctaattaattgcctatagcatgatagcacatttgtaaaaaaaatcaaagaccttgtcttgaatattatcatcaaaacaaggtcttttcatgcttatttacttattataattaactatatccgcaaaatccggcttgagacttgcacctcctaccagtccaccatcaatatcaggctgggcaaaaagctctgctgcattagaagcattaacacttcctccataaagaatccttatctgatccgctgtttctttatcatataactcttcgaatacagttcttatgaatccgcatacttcctgtgcctgcgctgtagttgcaacctttcctgttccaatagcccagattggctcataagcaactattgtatgaagcacctgatctttagtaacaccaacatatgcttctactatctgttctttaacaaaatcaagtgtaatccctttttctctctgttcaagtgtctctccacaacaaagaattgggataatgtcatgttcaagagctttatgaagcttaagattaagaactgtattgctttcattaaagtacattcttctttctgaatgtcctatgataacatggcttacccccgcatcaacaagcatctctggcgataattcaccggtaaatgctcctttctcctgataatatacattctctgccccaatatgtatattagatcctttcactgcctccactacaggtactatgtcaattgatggcacacagaacacaacatcaacatccggattattaacattcggtttcaattcagtaacgagcttaactgcctggcttggtgtcatattcatcttccaattgcctgctattacttttcttctcattctacgcctccccacaggaaattatccataataacatatatatggacaatcctattaaattattcccatataactatcctagtaaaataaataatagcatactttaatacatatttcaagtatagtttgtgaaataaataacaaaaatccggaccttacttaacaaaaaataagatccggattaaaatattattatataactatgtcagtaaaattaattacttatcgttagctgcaactacacctggaagttctttaccttcaaggaattcaagagatgctccaccacctgtagagatgtgtgtcatcttatctccgaatcctaagttgttaacagctgctgctgaatcaccaccaccaatgattgttgtagcatctttaagctgtgcaagttcttctgcaacagcaattgttcctgctgcaaaattagggaattcaaacactcccattggtccattccatactacagtcttggcatcttttaaagcttccttgtaaagttcacatgtcttaggtccaatatccatacccatgtcatcatcttcctgatgtcctgcttctacaacatgtgaaggagaatcattgctgaattccttagctacaactgtatcgataggaataagcattttaacgcccttttcttcagccttcttcatcatatccttagcataatcaagataatcatcctctactaatgactgacctacattaccaccatgtgccttctggaatgtataagacataccaccaccaataataagtgtatcaaccttatcaagaagattgttgataactgaaatcttagaagaaacctttgaaccaccaagaattgcaacgaaaggtcttacaggattattaactgcatttccaaggaaatcaatttccttctgcataaggtatccaacaacagctgtatcaacatactgtgtaacacctacgttagaacaatgcgctctgtgagctgtaccaaatgcatcattaacaaatacatctgcaatagaagctaaatccttagaaaatgcttcaccgttcttagtctcttctggtctgaatcttgtattctcaagaagaataacatctccatcattcattgcagcaacagctgctcttgcattatcgcctacaacagtatcatctgctgcaaacttaacttcctgaccaagaagttctgaaagtctctttgcaactggtgcaagagaaaatgcagcatctggtccctttggctttccaagatgtgaacaaagaataacctttcctccatcagcaataagcttcttgattgttggaagagcagctacaagtcttgtttcatctgtaattctgcttccatctaaaggtacattaaaatcacatctgcataatactcttttgccctttacattgatatcatcaatagactttttattaagcatattaatatcctccatataatacataaaatagctacatatacagctttataaaaaaccggagaatagtcataccattctccggcaaaaacaatctaaatgattagtttaattcagcgaagtacttaattgttctaaccatctggcttgtgtatgagttctcattatcataccaagaaacaacctgaacctggcaaccaccgtttggaagttcattaaccattgtctgagtagcatcaaataatgaaccaaatctcataccaacgatatcgctagatacaatctgctctgtattgtaaccgaatgactctgttgcagcagccttcatagcagcattaacttcatcaactgtaaccttcttagcaactacagcattaaggattgttgtagaacctgtaggtgttggaactctctgagcagctccaataagctttccgttaagttctgggataacaagaccgatagccttagcagcacctgttgagttaggaacgatgttgcaagcacctgctctagatcttcttaaatcaccctttctctgtggtccgtcaagaatcatctggtcacctgtgtaagcatgaattgtacacataatacctgactcgattgttgcacaatcgttaagtgccttagccataggagctaagcagtttgttgtacaagaagcagctgagataatctgatcatctgctgtaagtgtctcatggtttacattgtaaacgatagtcttaaggtcgtttccagctggagctgagataactaccttcttagcacctgcattaatatgagcctgtgccttagccttagatgtatagaatcctgaacactcaagaactacatcaacgccaatctctccccatgggcagttattagcatctggctctttgtaaatcttgatagtcttgcctttaactgtgattgtaccagcctcatcatcagctgttacctgatcttcctcaccgaagttaacatatcttccctgtgatgagtcatactttaaaagatgagcaagcatcttagggcttgttaaatcgttaatagcaactacctcatatccttctgcaccaaacatctgtctgaatgcaagtctaccgatacgaccaaaaccattgattgcaacttttactgacataaaaacaattcctcctaaaatgaatttttataacatagtttgttaaaatttcaactaccgtgtattttacataagaagaagcaaaatatcaaggctttcttcccattttttacatttttgcacttttttcaataataactcattatcaattagtcattttgacgaaattttaacaaattctgtatccaatattatctacttaacactaatctctgcttaatactggcttaaaggaaacatttctttgtattcctcaaaatatttatcaaaattagttccattatctttcttgagattaataagatactcatgtgtatcaaacacatttaactcaagctcaataatcgcaactgccacgttagaacaatggtcagcaattctctcgaaatctgtaagcagatcattaaatataaagccctgatgaagtgtacattcacctttctggacacgcttgacatgattcatcttcatttcatcacaatatatgtcaacgagttcttctaacggctctgtcttataggcatattcaaccttgttctgttcaaatgcatctattacatttccaactatttctttcataattaatgacatcagttcaacatcttcaacagcacaatcagaaaacctaagcttttcattaaacagttctgctgctgcctgtgatatgttaacagcatggtcacttattctctcaaaatcagaaattgtatggagaagctttgagacctccttgttctgtccagaagtaagctcctgctgtgtaatctttacaagataagttccaagcttatcttcatatctgtcaaccttatcttctcttctctgaatcttgtcatatttttcctgcgaaaatgtatccagtagttccatggaacgaataagatttttctgtgccatatgtgccattgaacaaagaactgtcttagcctgttcaatagcaactgtaggatgagcaataaatctgtcatcaagtacactgatttcaacaatatctttatcttcctcatcaacaacctccttgaaaattgcacataccatcttttcaaggaatctgatgaatggaaacagtacagcaactgttgcaactctgaataaagagttcacaaatgctatcgaaacagttgtcatcgttctgtccataaatgaaaaatgaacaaaatgattaacactataaaatactactgcccatattaaagcacccaatgcatcaacaagaagatatacaaatgctgttctcttaccatctgtagtcgcaccaaatgaagaaatgataacaggcatggcagctccgacagcaatacccattataataggcagtgctactgaaaatgaaatagctcctgtaactgataaagcctgaagaataccaactgtagcagacgcactctgcaaaacagcagtaaccaaaagtcctataagtattcctataaatggattagaaaacttagtaagcatatcaataaatgccggctcagatcttaatggtgcaaccgctgcactcatgttctgcattcctaccataaggatacagaaacctatcataatatcacctatatgtttctttgtaggattcttacaaatcatcctgaacatgatgccaataacaccaataatagcagcaagaacctctgttgaaagtaagtctacccatccggcaccaccactgatatcagaaagacataatacccatccagtaacagatgtacctataattgcgcccataataataccgatagcctgtttcattttaatcataccagcattaacaaaaccaacaaccataacagaagttgccgacgatgactggataattgccgtaacacctgtaccaagcagtactcccttaagaggtgtattacttaatctgtacagaataacttccagtttgccaccagccactttctttaatccatctcccataagctgcattccaaaaaggaaaagcgctattcctccgagaagaataatcacaatgtgtatcaattcaaaactcacgaaagctcctatctgcgcataaaagtcaaggacggacagcgtagttgatacttctacatctatgcgcattcacataatcagaatttatacgctgtcttcttaataatatcaatactaataatcattttcaaggaaaaattacctatattttacattagtttacatgttctacataaacatcaaaaatatcaattgcggattaattatgtttatgtataatgtatattgacatttaagcatatgactaatatttgatggaggacattactatgctgttatcagattcacatatacatactatgttctcttctgattcagaggagaaccctgtaaatgttgttaacaatgctatttcactgggatttaaacacatctgttttaccgaccataatgactttgatgctcctttagaagatggaaaagtcatgtttgaccttgattttccggaatacattaagtatttccagaatctgaaagaatcatacaaagataaaatcaatattcacataggtgttgaacagggacttatgagaagcgtcgctgacagagttaattcatatgattctgcaaaacagcttgatttcataataggctcatcacatcttgtatatggagaagatccctactaccctgagttttgggagaaacgttctgcaaaggatactgttttaacttattacgaaagtattcttgataatcttggctgttgtcacaactttgatgtgtatggtcatcttgattatattgcaagatatatacctgccaattcttacacatataactggcacgattttaacgatttaatctgcataattcttaaaacaatcattgagcaaggaaaaggaattgaaatcaacactgccggtcttaaatacggaatgcctgaacctaatccttgccttgatattgttaaaatctatcacgacctcggaggagagataatcactgtaggttctgatgcacacgaagttaagttttttgcttacagatttgatgtcgtggctgatatgcttaagaacgcaggatttaattactacacaatatttaatgaaagaaagcctgagttcatcagattatgatgagctcaggcttattttatatacatgtatcttatctgcaccttctacatacatctgtaaaatctgaagctgtaaggtggaagaactatttttccagataattcttccttcttacctgttataagattaagtgcatctgcacattctgtatcaaagtacgctgtgtactcattctcatctgcattaattgcaacaagcactttttctccatctgcttcccttttgaatacatattgtctgtttgtaagcactttctttgtgtaatcaccatagcttaaagccctgctgttatgatacatttgtcctaatgaacttattgtatcagtcagctcattgtattccggcttatcaaatgccggacgcaggatattgtcattgccgctccccttaactgcctcgcaaccccattcacttccataatatatacatggaattcccggcataccgaacataagggcatatataagcggcagatgtgctttgttagtaagtgtgctggcaatccttgaaacatcatggttatcaacaaatgtaagcagatgttttcctgtatacaaacaccatggttcttttccaaactgcctttctatgctgtgtgcaatctcgaacatattcattgaattaaagctagaatacaaccccttataacactcataattagttgcactgtgcaggcactcattacccacaattgtgttgtaatcaccgtgaagcatttctcctacaaggaaaaactcctgcttcatctggtctgtttcgtatcttaaacgcttcatgaaatccctgttaaggcagtacgcaacatcaagtctgattccatcaatatcaaattcatcaacccagccacgcaccgactcaataagataattaaccacatcaggattattcagattgagcttcacaagattgtaatatccttcccagccctcataccagaagccgtcattatatggtgaattgccatcaaagctgatgttaaaccagtccttataggcagaatcccattttttctcacatacatccttaaatgcaaagaatccccttccgacatgattaaacacaccgtcaatgactacctttattcctgcctcatgcagctttgacacaagctctgcaaaattcttattagttcctattcttttatctatcacacggtaatcccttgtatcatagccatgataatcgctctcaaaaattggagaaaaatacaccgcatcagttcctaacttctgcaaatgcggtatccagtctgcaaattctgatatgcatctgttcatcaccccgtcgttgtctcttaatccatcacaaaatccaagtggaaatacctgataaaacaccgcttcttcgtaccacatattattttaacctccgtaactgtctgatatattaatattaagccaattcccgcagtctggcaacatctttcttaatacactcaaccacataatcagcttccctgtgtgtaattgtatggttaattgtcagccttagtgaaccttctgctattttttcatcaagtccaagtgcaagaaggacatgtgaaggctttcctgaattagatgtacacgctgaacctgcagatgcgcatattccctgtttgttaagcattacaaccagcattccgccattaacatactgaaaactgaaattcatattgcccgtaacacggctttccctgcttccattaattcttgaataaggaatttctcttagtattctcttaatcatatagtcgctgattttcttttcctgccttgccctgtcagaaagtgtttcataagcaattcttgccgccgtcgcaagtcctgcaatcccggctacattttcagtgcctgccctaagtccgttctcctgtccgcctccatgcatgaaccgttctggctttccgcccctgacatacagaaatcctacgccctttggtccgcatatcttatgtccgcttacatttaagaaatccacgcccagctttttcacatcaacatcaatatgtccaaatgccgccactgcatcagaatgaacctttgcaccatactcatgcgcaatttcacatacattttctatcggctggatagttccaatttcattattagcaagcataactgacactaaaaatgtatcatttctaatcattttttctaactgttccagcttaacaattccctgctcatcaactggtgcaaatgtgacatctattccataattcttaagccacagtgccgattccgtcaccgcatggtgttctattgaacttactattatatgtccctgttttcttttcaggctctctgctttaactgcccagttatccccttctgtaccaccagaggtgaaaaatatttcatttctgtcagcatttattatatctgcaataatatctcttgattcctcaacaacatttttagctttttcagacaacctgtacacacctgacgggtttccataatctcccaaaagatatggaagcattgcttcagccacttcttttctgacagcagttgtcgccgcattgtccatatatatcattatatttccgccctgcaattccttataatattgtattcaggcagggcatatattgttaataagtctatctgcggtatctgctatgaataataaattatccttaaaaggtggcatattcaaatccgccataatacttacaattgccggcgttctatcaaaactgctcggattttattttcggatacttctcactaattatacaggtgctgcaggagtcggactattccagatgtgcatacctcttattgcgcttgcatttgcagtatgctgcagtggattttctgtagctgtttcaaaatattcagcatcatctccatctctgaaatggcttttctgcgtattaaagattactatttctctttcaattgccgttatgcttttatttcttatattcagcgatttcattgcaaaccatatatttatggaaagccgctgtgagggaataatccgtataactgcaatctctctgccattcatgtgcatacataactgcttatctaattactattacagtcagaaggaatcttttctgccagcctcctcacagcttgtcgaacagcttgtgcgtattggcactattatactttatgtgcgcataaaaaatgtatcaacaatatcaattgctgacgcagttaccggtaatatattcggtgaatttgcagctgccacatactgtgctattccgctgtttttccgttccattcataataaaagcatgacgcagaagctctcctgttcactccgtgaatacagatatattgttaaatatgcatttccaattaacgccaatcagactgttctgcatctgcttgaaggggcagaagcaattcttattcccgcaatcctgtgcatgcatggactgtccaaagatgatgcaataagccagtttggtatacttacaggaatggctcttccacttgtactttttccatgtacggcagctaattcatttgcacttatgcttcttccaaaggtatctgatgaaagttcgaatgtcctgtctgaccatcttgctgtgacagtaaaaagaacagtttccatgtgtttgagtctcggcattataagcatatttttattcattaactatggtgcgcgcctaggtgcaatgatgttccacgaagactctgtatacatatacacctgcattctttcatggctgtgtcctttcctctacttaaaaatcagccttacaagcgtgactaatggcatgggacataccgcccttacattcataattaatataaccggaattatcatccggcttgcctgtgtatttctgcttattccaaagcttggcataaccggttatctgtatggtgttcttattagcaacatatgcatgagtctgctttacatttttaatatatacaagaagctgaacatccagccagacccgtttggcagtataattgtgccattatgtattgcggtcatatctatattttcatcaagaattatatgccgaattgtatttggtcttataataaaagaagcagaagaatacactctcctgcttaccggtgccgccatatgctgcattgtatatattattctctttattcatgaacaatcggaacagcgtcctttatagacggtgccgcttcccaatagtcaagtctggattcgtactgctgccttatccattccacggcagcaagacgaccatcttctgtcagttcaaatatctctgtcgtcttatcttcttccttaacagcacatgaagcatatggtccgcgccacacgcacgcagaaagctttaaatcaggcttttctcctgtctgcttaagcatatatctcattccattgtgctgtcctgtatacacacccttgtatttgaagaaattaagtggcattattccattcggatcaatcattgccatcaccttccacaccattattattctttataagcttttcattataaaatgcacctgcaagatacataatccctattacaactggaaggcatataagaatcagcgtgttaccagttattgaatacttagataccacaaatactattattaaatcaacaactcctgctatagtcataacaattccataaactttgattttctttacagcatcaacagcacctatattggtcattccataaaatccagcaattgcaaagtaaactccttccacaataactgctataaatgctatattcagcagcttgacagccatatataatgcctttccctgctctgttgctgaaaatgaatatagctccgacataatataaaacgcataaaatgccattataattcccatagttaccgcaagcattgatgctaatttaagaattctgcactttgacttttctgttactacgctcatgttcttatctccgttttctgatgattaatgattataacatgggattggggatttttaaagggtgggatgtgcataaggcataccaaataaattaatataccttatttatcataattcatatgcacctcttttaacgccaaatacatcggcttatattctgaatcacagcaatgcaaaggctgcatatcaatctctactgggttaaacacatttgctccataaaagccttctgcttctggaagagaatgtaagaataaagccttaaaccctattacttcatctaataaagaatatgcaaaatctataatacccctcattatccatgcagatatatcatgctctttttattttcttttgccaaataatttaccagctttcttgcaagactctaaaaaatcatttgttactttattctgattaaattcacgtacaaattcttgggattcttgtctttttataacagatattctattaatcggtttcgctaatacagccatattcttcccctccttcttgtacatcaaaccattttctttattctcttcaattatattctatcacctcagtctttaattttaaataactgagcatataattaatctatattacataaattattactattcaaagtttaccatatgcccattttgaaattaatttctttttctataatatatctacttttacttaatttatccccatgattactcatcatttgcatttaattatataacactcatttattgataaagttttgttgttagtttatttattacttcttttataactcttttaaattcattactacaatcataacattcatttttttgattattcaacaaaatcactaactatataaacttttaattttttatgatataatatagtatatttagtttatggaggtacatttatgaaaaacacttttaaaaaaatatttaaaattttatatggttgtgatgataatataaaatataagataatctctactctttttattacaagtgttattgaaaccatattatcatttatgtataaagataatgcttttctttcaaatttattttcaaatttttctggtataggatttgctcttttcttaatatttttgcgtggatttgagttttctaaaaaaatcagttgtgaattacttcgctttgctatctttttccctatgtttttatattcagtatcttatttattacatataacaaataaaaatatatttaaaataattttggcattgttttttgcctttattagttgcttgtatttttcatctaaattagatgattttattatcttaataaaaacacttttcaaaaaactcaaaattaaattatttaacaccgatacccctacaccaacaggtttcaaatctgttcttgaaaatataactgtatttttagtttcaataggaggatttttaatttcaatagaaactatcataaaagttatcacacaaatattaactttagatttcaaataaactaaacacctttttataactataattttaataagcttctgtttcatttgaccttttatgctttatatgagtattttatcatctacacattttaagacactaaaataagcccacatacctgtaaaatacaagtacatggacttatttatatgtcttaatattaagttgtatcaatgagcatctttatccataatatattattatagttgtctccacggaaaacaaactgtctccattttgtctccaccatcacaccaacatactgcaaattatgccagcttatgccacgatattgacaatttacccattcacaggaatcccagtaatcaagctacaaatcccttaaatacagtaattatcataactttcattaaggtcataaggagttatctggtatacataataattcaaccagttcgtatagaggttgttggcgtggcttctccatgaaagcaatggctttctgttgcagtcgtcatcaggataataatttactggaaggtcaggctcaattcctttgtcaatatcacgcttatattcctgatcaagagttaatctgtcatattcagggtgtcccataacaaatatctctttcccgccatcaccaagaacaatatatattcctgcttcatctgaatcagcaagtactttaagtcttggattgtcaagaatctgctgtctgcttgcctgtgtatatcttgaatgtggtgccatgaatacatcatcaaagcctcttactaaaggctcttttctattcataaccctgtgcttgtacacacctgacagcttcttcggaagtaattccttcttaataccataatggtaatacaatcctgcctgcgcaccccagcatatatgaattgttgatgtaacatgcttcttagaccactccattactgttataagttcatcccagtaattaacctcttcaaattcaagcttctcaacaggtgcacctgtaataatcattccatcataattattgttcttaatctcttcaaaagtctgataaaacttcttaatatgtgaagctgatgtattctttgaaacatgtgatgacatctgtaaaaatgtaacatctatctgtaaaggtgtattagataaccctcttaaaagctgtaattctgtgtcctgctttataggcataagattaagaactattatctccaaaggtcttatattctgtgaaatagctctgttttcgtccatgacgaatatattctcttcttctaattctgctttagctggtaaatcactctgaatcttaattggcattattgttccttctttctgttagcattgttgtctgattatatcatatcacctttaataactgaaccaaagtatgtgagttttctttatatttttttgtaaatttggtgtcaaaccttttaaaaccattctgcttttcataaaaatctaataatctatccttattttcagattctagaaaaacaaccatcccaccagccatatattgtagttcttttacttttccaagcgcaattgaaagcaaattgtctcccgaaattgtatttccaatactatcatcataattttttcctaactgtgctatcaaatatgctgacaacgaatattttccattatcagagttctgttcacttacccttgcaatttttcttcttactgtattactaaattcatctgtattaacggtaattggtttaattgttattgtaaaatacccaactatattattcttgtctggcgaaatcacaatatatgtaaccgactggtttttctttgtaaaatctatagattgttctgtaagaaaactttcaacatcaagatttttctcacatttaaaactggagaaaacctgcctgagcatgtcttctccagcttttcccatttttatatattctctgatatttaatactaaaaaatcatcctccatataattttttccacttctccattactctgtatacttcatctgtttcatgtatttctctgtatctgcaagaagatggacttgattctgaaagagattctttatatgacatttcaatcgcatcagcgaattgttcaacctgtttcttacctgaaaccacaaaattcttggtaatgcttgaagttgccatacataatcacctccatatctttctttaacaaattgttttctattaatattatattagacatatataacattatcaacctgttatttctctactttatcatttccataaattcatcaatcgtaagcaccttaacccccagtgaattagccttatcaagcttagagcctgctgcctctcctgcaacaagataatcagtctttttgctgacacttcctgttgctttgcctccattagaaacaatcagttcttccatatccttacggctgtaattatcaaagcttcctgttacaacaatcgtctttcctgcaagcttatctgatatttcttttttctctggcatcttcatattaagccctgactgtcttaacctttctattaattcaatattagcttcatcatggaaaaagtcatatatacatttggctgtagttgtgcctatatcaggaatattctgcaattcttcttcacctgcatcagcaagtgccataagattatcataataattcataatctgcttggctgtattcttgccgacatttcttattccaagtgcagtaagcagtctgtctggtgtattctgtttagacttctcaatagctgcaagcagcttatcagtattcttctcttttcctatgattcccttctcaataagttcatctcggtgttctttcaatgtatatatatcagcataattgtgtatatatccttcttttataagggcatcaacaagagtttcaccaagtcccatgatattcatgcagtcaagagatgtaaaatatgccactgttcttgacaactgtgctgcacatgacggattaacacatcttatatctgctgtgtcatcttctcgtacaagaggttccccacatacaggacatatctttggtgcttcaaacacatgctcaggtgcctttacacatccattaagcttaggaataatctctccactcttaaacagcttatattccccaccaatacctacattcatctgtgtaatataatcctggttatgaagagtcgctcttgatacacttgtaccacacagccttgcaggctttccggtttccggatcatggaatatccctgtaaatgtaagttttcctgttcttcccacatctacaagaatatcatccataacaataaccttttcttccggtggatatttgtatgcaatatgaccgcttgaatacttgcttcctgcagggaactcctgtctgaatgcgatatggtcaatctttacaacagcaccgtcaatgtcatatggaagttcttctctcattcttcctatctcatcaattgctctgacaacctcttccttagtcttacatatcttatgatatacaaccggtacacctgctgcctttaacatatccattcccctgccgtggctttccataatctcatcaggtccgtcctgtacattaaagataaacatcttaagacctcgcttcttcgtaattgaagtatcaagctgtcttaatgttccggccgcaagatttctgggattagcagctgtttttttctcaagtttttcctgttcttcattatatttttcaaaatcttcatggctcatatacacttcgccacgaagttctagtgaatcataaggaaggtcaataacctgtaacacatcccccactacccttgcattagctgtcacatcctcaccaataagaccatctcctcttgtctctgccaactgcaaatgcagcttcccatctgcttcttttacatatcttaagctcatgcttaaaccatcaattttagtctctactgaaaatgtgcagtcaggatgcatggcatgaaccttatcaatccatgcacacactgcatcttctgaaaacacatcttcaatagacagcataggtacattatgtgtgaccttaaccccggcttctctttttacagtgccaccaatcttctgtgaaggtgaatcagatgtcacccattccggatgttctttctcaatctctttaagccttatcataagcttatcatactcataatcgcttatctccggctcgtcctgattgtaatatctatccatatgataatctatcgtcttcttaagttctgaatattcctgtaataaatccataatccgctccttaattatcagcctgtatgttgactgtttctatctgcttatatatctgctcataaagtgtattaagctctttaccgtcaagttccctgtactcaccagtctttaaatcccctaattccacattcataatccttattcttgtcagtttagttacactatatccacattccgcacacattcttcttatctgtctgttaagcccctgtgtaagaattattctgaatgtcttgtctgatatcttttccacaacacattttcttgtagttctgtcgagttccttaagatatattcctcctgacattctctttataaattctttattaattggtttattaactgaaacgatgtattccttctcatgaccattaacggaacgaagcagcctgtccatcatgtcgccatcattagtaagcagtataaggccatcagactctttatctaatctgcccacaggatatatgcgttccttatatccaataaaatctactatgttattctttccctgtttatcagttgttgtacatacaattcctacaggtttattaaaagctatgactacctgtggtggtgtggtgttgtcaactttcctgccatcaacacatataattgtattgtcttctaccatctcacccataactgcaattctaccatcaattgtgatacgtccttcctgtatcattctgtcagcttcacgtcttgaacagactccatgggcactgagatatttattaatacgctctgacatgtttcctccaattcttatcttcattgctgataagttcaaatcaatatacagatgtattaattctaacaaaagaaaaaaattaattcaattgttgcgggttttaatttaataatgtatagtatataagcatataaattattatatgttgtgtacatgtagcttagctggataaagcgttcgcctccggagcggaagatcgtgggttcgaatcccatcatgtacattattgtattattctgtccctacatagttatcaatctttctgttctattatattcatatacatgatcagaaaggacttcatctgcagcaaccccttctgtattaacttcctttaccatattaacaagttcatctttctcaaacatcgaaagcttaggaagaagtataacctcatgcactgatgaaggtagtatatacagatctgctcccagcttctgcgcaaaatcatacaatacattctcatataatatgcaggctgcaccattcagtttgctttcattcgtaagcacatacatatcagacggaacataatcttttaaatcaacttcctctccatccacattaacaccacatttttcaaaaagtgcggccattgaactaatcttactgtgaagcagatccggtgtattcttcaaagcagctttatacacatcatcaatagttacattccagtttttcagattgttattatatattaatgctgttgcacttcttccatattcattatcaagcagacagtaaaacaccacagcaaggtcaagtattctcttatgaggcacctgttcgagcagtttttcattacttctgtaattgacgaccttataaacaatcttgtcctttatagtgtcaaaatgcttaagaatatttacatcaaatgtaacattattcttattctgttcatatataacctctatctgtcgtattatgttcttaatattctcaccattcgtatacaattcataaaagctgtccagatatatagttggcgcgatgtctttccccttctccataataacaagtccatccatctcacagccattattcttaatcacatgattaatagtaatattaccaccttctccagctatataccctgcattcatcttaatatattccacaaattccttatactccatatactttttcctttcaaatgtttcctatccccctgcgcacggaatttaataaatgttttgtacaagtaatatagtatattaatagcaaatctctgtcaacaatatatatagtattctatatgttttgtcgcgttctgttgagtttatgtcgcatttggtataaaaaatgtcgtatctggtataaaaaaagcttttttcagctcattttaccagatacgactaacacaatatatagtattattcaattattcatgccaactgttttaaaacgtcagttataagctcccatgtcctttgtgtcgaagcaatatccaatttttcttttacagtatggatatcaattatatcagggccaaacgatacacagtcaaggtcatcaatctttgcagccataataccgcattcaacacctgcatgcattgtttccaccaaagcccctttattaaaaagtctattataagattcacacagcatatccctgattgcagaattcttcttaaattcccatgctggataaacacctttaagttcataagttccaccaagatattcagtcatttttccaaccttatcagtaagatattctttttcactctgcgaactgctccttattaagtaggttgctgcaaatgttttctcagccagctctgcaacccccagattaagtgaagtctgcaccaaccccttgatatcattactcatcttaacaacaccatcaggtataaaattaagcacatttataagcatctgtgttgtcgcatcatcacatgccaaagtgctgccttcaccttcacaattcaccttgatggtaagatgtgggtcagtaaccgaatactcctctttcaagacatttgcagtattattaagaagctcagtgaccttatctgcttcctgtgtcattataaccgcatcagcaaatggagctatagaattatctttttcaccaccagatatgcttacaatattcacacattctttaacgtcaaaaagaatacgtcccatcagaatattagcattagctctctggcatattatatctgttccagaatgtccgcttgtaagaccattaattttaatagacatctgcgttcctgtcatatccgattttttcaatggataagaagcctttaaagttgctcctcctgcacatcctgaaaggaatattccttcctcctcagaatctatattaagcataattttaccttcaagacagtcagtattaattgcctctgcgccaagcattccaatttcctcgtctaccgtaaacacagcctcaatcggcggatgacacacatccttgctgtctaatatagcaagcgcataagcaactgctattccatcatcagcacctaaggttgtcctgtcagccttgacatatccgtcatctatataaaggtcaagaccatctttttccatatctttaaccttatcattcgtttttacagctaccatatcaatatgtccctgcaaaataacaggtgcagccttgctctcgctgttacttgccggctttttaattatcacattataactttcatcctgcttaaaccacagatttctctcacgtgcaaattcacacagataatcacttatctgcttcacattgcctgagccatgtggaattgcacatatctgttcaaaatatttaaagacagcgtgtggctgtagatctgctaaaatgttgttactcatattttacctcctttacctactatttcatcatatttagcaatctagtaggtcttttcctcattgttagtttgtttgtaattcttcttttcaactaaaacgcctactagataaacactattcacacttttagtaggtctttttcttatatgtctataatatcagacagttctaatcagcaaaaagacctactattttggcttaaatcatcaatttagtaggcaattttctttatccgcattaattatcctcagaattttctctcaataaacctactatttcatcacctttagaagctttaataggttttttccccattcatacattaatttcatatgccattttacactatcgtgtgtggtgggatgggcgacagaatatctccaccgcccattatagggaaaatgtgaggtaaaaacaagatgcgcttcgctgtcttgttttttgttgtggggcgcctgctctgccgtccgcgttactccgtatatgccttttcaccactaagtaatctatccagcatatctgccactgggaccatcgcatttttgacctctgtacttgtattagtctgtgctcctgcttctataagcatcgaccttcctttcatatgcaggcagtaacgatatgcattaatataaatattccgtaacagccccggataatacgcttctcctaaaagatacatctgaagactcattgccagattatcatctctgtttgcattgtaaagatagcctatatctccttttgccttgctgtagcttattccattaaaaaacattacctttgacattgttactccattttcttcggttacaagtcttgtagtatccggaacaccatccctgtgaaggtctattacaacctcaattgacggattttctttcagtatttttgtcacattttcttctgcatatgtataagccttgcttctgtcaagcttcccatcaatataatcatacacactcgtatcatgataaacattgtaaccatatgtattagtgagtatatctgttagataatctccaacaccaactattgttgtagacgtatctccttcaaccgtatccataaatccctcctgtgaatgtgtatgaaatataagaatctgcggagaatccgcatttttctctaatgacaggtcttttgccagaaattcctccggacgcattatctgtgttgtcaggcttgtgatggatgtgactgtatagaacttcataagaaaatcataattatttaaatctgcaatattataaacatttccagctgcattttcctgtataggcaaaggacaaacttcagcgcctgcctccacgaccccctcatccgtctgtgtagcaggttttttatcctcctttgccatgctaaacatatattccgaatcgacccacaccgaacctgcattttcatcataattatcttcaaaatatgtctctacaggaaacaatgtcttaactgcattttcataaattctgttctgaatataatatattagattaaaactataattcatcattattaccataagcattaagcccatgaatataaacatatacacaggcctgtactttctatcactcatatatcctccttactttgcattaccattatattgtattcacatcagccatgaatatgaacaccaacacggttaattgctttggatattatgatacttatgtttctaatgtctgaatcaatgtccttcggggttacatacatttttcctgccccctgaataatcccttcggcatctataacagtaggcacgccaattgcaagcaccggaacacctatattgtcttttgttattcctattctgtgatttccaacacctgagccaggattaattccctggtcagaaagttgtatagtactatttaatctgttcacacttcttgcagcaagagcatctattgctatgcatacatccggctttatctgacttacaacgcctttaataattcctgcagtttcaatacctgtctgtgccataacccccggactaagtgtgcatactcccgtctcatcgccctcacttatcttaatacaaatattatctacaacctcaggtcctaatgaatccgatgttatatttctgttgccaagtccaataacaagaatcttttctggtttgacatttttattcatacgctttaaaagcttaaatatatatcctgccaatgtcgatataacctcttttgcatattcttcgtccccacttgcaatatcatctgcctctatagtaagataagttcctttgggtcttcctatcgcggcttcgcccaaatgatttgtcacctgcaattctgtgaccttcactcccatccttgatttattgctttctcttaatcttatccccctcagttttcctgttccattcattgcttcttcatttgcctctactgcaaggtcagttcttacaactatattatccatttttcacatcacctccccaacatattgtgcagaaaaatgaaatttttataccaaaatctttatttggttcttgacatatagatgtttgtactataaaatgtgtgagtatgtttacattagatcgtccgtgtccggctttaatgcgaaacagatattattattgaattatgatttggaggtgtacggattggctaacattaaatctgctaagaagagagtaattacaagtcaggtaagagctgagagaaataaggcgattaagtctagagttaagacttatatcaagaaggtagaggctgctgttgctgctggtgacaaggctgctgctaacgaagctctccctgttgctatagctgagattgagaaggctgcttctaagggaatcttccacaagaacgctgctgcaagaaaagtatctcacattactaaagctgttaacgcaatggcttaataagaattttaataatttaaagaacccggtgctgacacccactcgcaccgggttcttttttatttactgtatttaattataataagttctactcccagcctgtcattaagccgtccctgcttaactgcttcttcagttttagcacattcattcaatgcatccagtagtgtattcatctcaaaatattttgcctgtgcctgatatttaccgacaacaaatggcgctgctcctatctttgatgcaatctctttacctgaaatcccccttgacataagatctttcacctgtaatattccgttaaactgccttactataagataaagtattctcataggaggttcttttaattccaacaaatcataatataaatcaagtgcctgctgttgtttcttatttgcaattgcacttatcatatcaaatatatgacttgttgtctgtgttgcgcatactttctctacatcttctactgtcacaacatcccttccctgacaataactcacaagcttctctgtctcctgccttatataatccatgcctgcacctgtcttatcaagtatcaaatcacatgcttccctgcttattttaagattatccttagcaagaagccctgctatccatttttcaagagtagcagttgtctgtggcttcatctcgcatatatatcccacagaatcaactgccttatataccttattacgcttgtccacatctttttctaccataacaacaacaagataatcaggaatatgtttaatataatctgcaagctcatcattagaacttttcaaaaaaccggtattttccataataacaagtctcttctgggcaaagaaaggcagtgtttcacacacatcaattatatccttaacgctggcattatccgaatcataatatgaataattcattgtatcatcaccagctatagcattctttaatctgtctctatactgcttcttaagatactcttcctctccatacagaagatatacactcttaaattcacccttcttaatatcatcacttatgaccttcaaacctgctgcctccgtttctaatcttaaacaatagtatcagatatgtacaagtggttcaagttaaaaatattttctcacaacctgttatatatcttcacagttctatcctttcaaagctttaaacgcctcaattttatacgaaccatccctgacacgcaccgcaatctctccactttcgtctgtcctatacacctttgctccaatccccgacaatctctgtaaagtttctgtatgaggatgtccatatgaattacctgccccacaagatatcaatgcattttcaggctttacataacttaaaaattcttctgaactcgcccccttacttccatgatgtccgactttcaatatattaactgacataaaccgtgctgattcaccagcatctcctgccatcctattggcatcctcaacaatgcacttttctgccttcttttccgcatcacctgtcataagcatagaaaaatctccatattccacaagatatacagcagaatagtcgttagctgactcgtaattgtaacccttgcatgggtgcatacactcaaccgagaattctcccgatttaatactgtcacctgcatcagcataaacaacattaataccagtagctttcaatgttctctctaacttcgacatatcatcaccagcctgcttctttactgccgtagttcgcctgattcccggcagtacaacagtacctatctcaaatgtgttatcacacagttcaatcaattcatatattccattaacatggtctttatccggatgacttataaacacataatcgagacttcttaccccacaatattttagataagtatatatggtatatctcccgacattcttcttgcttgtgcttcctccgtcaaacaatacattcatgccctccttagtatgcataacaattgaatccccctgcccaacgtcaagcatggcaatcttcatatctgaatcaatattgtaatgaagccctgtcagcacacatactaataaagcaaaacatacagcatcaatcttcttgttcattaatataacatgtacacatatccatataattaaaactgtaaaatataaaaacacccttgcagtatcaggggttcccgtaacaatgactgcatatttaaaatgtgatgacaaactgcacagcttataataaaaatcaagaatatatccacctgctcccgcaaaaaaatatgctgcttcaagagatagcatgccagcaattcccgtaaatataccgcttatcattatcaacgacataagtggaattactataacattaagaaacaggcttattacaggaatctgcccagatataataagaattaccggaagtgtcacaattgtaacacacatgcctgtaataaccgaatctgcgattctgaataaaattaattgaaaaaatcctgcattctttttatcaggacgtcttatatatataagaatagttttatcatcagacagtatgggtttaatatatataattcctgccacggcaagaaatgacaaccaaaaagctgaatttataagattatatggattaatccacagaagaataacacttgctatccctaatgtattagccatatcactggttcttccaagcacgtctgccagcatatatacaagaatcattattacagctcggctggcagatgcactataacctgtcatgcacaaatatgaaataataagaaatgtactaaaacatgcagatgcgattctgccaattttcttctttaaccagtcatatataaacattccaacaagcgaaacatgaagtgcacttattgccaaaatgtgggaaattccattcttctgatacattctctttacatcatcatcaagccctgacctgtcacctaacacaatcgactgcataattcctgcattctgctcagaatatacattttggtaaatattttttatggaatctgcaaatctgtaaatgctggaaatataactacttccagactgtatattcacaatatctgacaaatctgcacaataattaaatccaagtgatgtataatattttctggcattaaactgcccttcattagatggtatattaaaatcctttaatgttactttaatcttaacttcatcccctggattggcaaatcttttttctgagtatactaccaaaccgcttttaaactgcctgccccatgaatccggcataacaaaggcatttcttatatacaccgcataaccgttttctgactgtttaatatctgctatgtatccatttacataagcaatatgtgttttatctgacaattgcccctgatagcatagcttttccatacttacttcagttcttaggcacataattggaaacatcatgataaaaatcacataaaaaccaggaattcctgttttcttaagatatataaggaatccggtaaacaccattattcccactataataacgatatataacttagcatataatgacaaatatactgcagcaatgctcataactgctgccacaaaaaatggtctcttcaataatatcctttccagaaacgaccattaattatcagataaatctttttttacaagttcattattcatataaaatactgtatcaaggctaattgcatctctatacatcagattagaatttcccttgacaagtatcttaacgccatcaattccttccagtcctgaaagggaattaacaattgaatatatagtcacattgctctttgcattaaccatatcagttgcaaattcctgactgagattaacataacatatcctgtcgacaacagatatactaagcagcttggtattcgacggaatactctgataacaccccgactctgttgttcctttaataagctgttccattacaaccttctcaacagatacattcttattataacagattctcttgctgttctttacaagggcatctcctgacttgttagcaaaatacagattaatcgtcttccacttcacatcagccatagcaccttcctgtgtatctacaaaatcctcatcactcatatttcctatgattgttccatcttcatacacagcatccttaccatcaacataaaatctaacatatagaacatcacttatctgtgataattctttaacaactgctgccctgtaaagtacttcggtacttggtttcattccataataagagctgtcataatagacacctgcgtatattccattaatttcaaccgttggctgcgatacagacaccggcttaattatgcttgtatgcctgccttttgcaacattcattttttcaaggagttcatttgcaactgaaacagcgtcctgactttcaatgtatactctgccttcagttagtgatgttccgtcttcattaaggaaatatacagaatatgcagttcccttcttctgcgaagaacatgaaacagttataaatgttactgcaataacaattataacggatgtcaatttcataatagctttccttatatgtcccatcataactgctcctttcctatcctgatattcttaacagcttataaatatgtccaatggcatacttccgcctgcattactgctggttttcaacataattaagaggtattctcattgtaaatgttgttcctatattttcctcactatgaaccttaatagttccatgatgcataagaattatgtttcttacaatagccagtccaagtcctgttccgcccgtttcacgcgaccttgccttatctacccggtaaaatctttcaaatattttattaatactttcctctggtattcctatgcctgaatcttcaactcttatataaaaatattgataatctgcattcagtgaaacatgtacccatccatcttcgacattgtatttgatagaattctcaacaaggttggatataacctgtgtcatcttaacttcgtcaatctgtgcaacaaccggtctgaaactttcaaaaagcagttcaatattctttttctgtgctaatggcttaactctcttgagggtcatctctaacaaatcattcatattaacagatgtaatattaagtgttgcaacagatttatccattctgacaagagtaagtaaatcttctataatcttactttctctgtctatttcacttacaatatcctgcatgaactcctgatacacttctattggcacattttcctgcgtattaagagactccgccaatactttaatcgaggttataggtgtctttaattcatgtgacacattcgaaacaaattctgctctggactggtctgtttcattagctctgtccattatattattaaaatcatctgcaatctcacgtatttcggtataactcctgacagggattctttcatcagtatgccctgcacttacatttgaaacaatatcaagcaccctttttacaggccggttaagaaaatatatgcctacgataagtaatgccagacatatagttataataaccagtttaatattattattctgactgttcacatcgtgaaacattgcatctatctctgtgtaatcaagatcagctacaagaacggctataaatgtacctgaatcattgtataccggaacagcagcctgtatattacccgttttcttatcatagccggaactgttcttatgattactgaatatatcgaatacccttggattaagaattgtcttattagtatcaatagaatatgtgtcaacactgacaacataattaagattaacaattcttattcttatctgattaagtgccgaataactgctgagtctgctgttcatatcattattctcagctgcttccagactttcataattagaatattctgctgcaataagaaccgcttcattctgtataaccgcagtctgtcttgtaattacagactgcctgtaaatatactcaaaaccttcaaatgtacagattaccgctgttgcaactattaccgccataactgcgaactgtcttgttgaatatttatttatgaacctgaaaaatgactcaaattctctgtcaaaaaagattttcctatggtcatttctttttttaatcttattaaacattaaaatagtaacctactccccacttagtgtgaacatactttggttcactcggattatcttcaatcttctcacgaagtcttctcatatggacatcaaccgttctgccgtcacctgaataatcctgtccccacacagctttaagaagattatccctgctgtatacctttcctggattaactgctaacaattcaagaagatcaaattccttagcagtaagattaataggtcttcctgcaatatacagattacggctgtcacaatctatcttcatatcacccgcattaataatattgttctttgctgctttcttctctgtcacagcatttcttcttaaaatagctttcatcctcgccttaacttcaagaatattaaatggttttgtaatataatcatctgcaccatactcaaggccaagaatcttgtccatgtcatcgcctttagctgtcagcataattataggcacatctgaaaactctcttatctgctggcatactgataatccatcaagcttgggaagcataatatcaagaaggattatgtcatattcattgtttttagcatactcgagagcttcttcaccatcatatgcacagtctacaacactataatcctgcataagactgaacttaagtcccttaacaatcattttctcatcatcaacaactaaaactctgcctgccataatctactcctttttactttctatgcatatgcatcttatcatacgcaaatataattctttatcttattaaatgctgcttccttaattccagacactttcattatatcttctattgtctggaatctgccattatctgtcctgtatcttactatatctgccgcccttgaacttccaattcccggcagtgtcataagctcactttctgtagctttattaatattaacaatcccctctgtctgttcttctataacagaaatatcctctccatatgccggaatatatatcctttccccatcagcaacaagtgctgcaagattaactgcagacatatcagccaaatcatcagctccaccagccattgccactgcttcatacagccttgttcccttcaggcactttacaacacctggagaattaacatgaccacatatatacacatatatgtcctcaactgatgattcactttccatatgccagctgtcttctatactacttgatacgatattatctgcaaatgtattctctgacactgaagcgttctttcttcctgccagatatatcaatccggttataatcagaaaaactgcacatattccgtattgcacagcccttttgtgttttttatataattgtctgtattccatgtacactctccttaagcattaccctttggagattccttttgcgtacttttctattttacaaaattgtactatcgaatacaagcctaatttgcctataattgtttacacttttttcgttctttggtaaaatgttactattaccggctaagggagggaagccatgaattcatcaaagaaatcaattcttaattctaactttacatatcttgctgcctttgtacttccagttataatgatgatggcactgtactatacaagaggcatatttccatggggaaacgaatgttatctgaggtctgacatgtatcatcagtatgcgccattcttttcagaactgtggcacaagataagaaatggtgaaagtcttacttactcatggaatataggaatgggaactaacttcacatctctgtttgcatattaccttgcaagtccatctaactggttcgttgcactttttccacagaaatacactatagagataatgaatgcatttataatacttaagatagctggcagcagtctttctttaacgtattatcttactaaacacaataataacaagcatgtaattgctgccatattcggtatgttctatggtatgtccggcttcattgcggcatacagctggaatattatgtggcttgactgtgttattctgattccacttatcatgcttggacttgaacgacttgttaatgagaaccgctgcatattctattgcataactctaggattatgtatatttactaattattatattgcaatcatggtatgcctttcagtagtgatttactatgttgttcttatgattgcttataacggtattaaaagccctatgcagtatgtgaagaaatttattaatttctgtgtatattcactgcttgccggtggactgggagcgtgtcttcttctgcctgaattctatacattttcactttcagcctcaagcgacacgacattccctgataagcttatttcttatttcagcatattatcaatgctcacaagacagcttatcaacattccggttcatttaggactggatcatctgcctaacatatactgcggcgttgctgtttttgtactgctaccgctttatattatgtgcagcaaagtcaatgcacgtgaaaagattggcaaatgtgtcatcctgcttatcttcctgacagcatttaacttaaatatacctaactatatatggcatggtatgcattttcctaacagcctgccttgcagacagtcattcatatatatattcttcctgcttgcaatgtgctatgaagctgttattaaccttaagaattctactaacaggcagcttggtgcatcattatggattgcaattggtcttctgcttattatggaagaactttttattaactcagagactgaatattcatttaagagtgtatatataagtggaatatttattcttatatatggtctgttaatgtttattcataacaacgccaagttcaagattcctgtcgttcttatgcttacattctcagtatcaatcattgaatgtacaatgaatatggacgcaaccggtattggaacaacaagccgtacatcatatcttcttgattatgatgccgtaaagactgttacaaaaaccgtatctgataatgacacatccttctatagaatggataagctttttggagcgcgttctaaaaatgatggtgcatggcataattaccgaactgtttcaacattttcatcaacatgcaatgcagggatgtcaaagctttacaaccttataggaatggaaaattcaactaatgcatatggctgcaatggtcttaccgctgttactgattctcttttctctgtaaaatacactatttctaaccgacttttagttgaaagtgatataagaaattattatacaggcagcgatggtgaatttgtgtataagaataattacacacttcctattggttatgcgattaacagttcaacagcatatgaccttgttatggctaagaataacaatggtattgagaaccagaatcttcttattcaatctcttaccggaataagtgatgtatttgaatatactacttcattccctactgaagccgattgtattatcacaccttcaaagagtggtcatatgtacctgtcagttgcgaataaatctgttgattccgtaactgttactattaataacacaaccacttacacctacaataatataaagagcaataaccggattcttgatattggttatgtccacgacacagatactgtcgaagtaacttctgataccggcggaatgaatctttctgtatacacactcgatgaagacaaattcatcagggcttacaataaactcaattcagaaagctatcaggttgagaatttctctgatactaagtttacaggaactcttactgcttcctcagacaaagcaatattattctctattccatacgatggtggctggtctgtgtatattgatggcaagaaagctgacacttatgcctgggaaaatgcattgttatgtgttgacgtaagtgccggaactcataccgttgtattaaaatatcgtcctgttaatttaatattgggttgcgttattactacactttgcattattatattgattggcatttatcttgccagctgctttattaaagcagaaaaagtaaatatggcacattttccgttagttatcagaaaatatcttgatgatccgtctcttactaacaaagatattaagaaactgtctgatgataatatagaaagttctattcttgatgatatggatgatttcgagaatcttgaatcacctgatattgatgatgaacttactgacagtcttctctcttctattgaagatgaagaagataattttaatgaagaaaatacagatatttaattcaaggaggatttataaatgaaattatggggtggacgattcaccaaagaaactaatgagcttgttaacaacttcaacgcatcaatttcatttgaccagaagttctataagcaggatattgaaggaagtattgcacatgctactatgctcggcaagcagggaattattcctgaaagcgaaagtgagcagattgtagaaggtcttaagggaattcttgctgatattgaatcaggaaagcttgaaatcactgatgaatacgaggatatccatacatttatggaggctactcttattgagagaattggtgatgccggaaagagacttcacacaggacgaagcagaaatgaccaggttgctcttgatatgagacttttcacaagacaggaagttcttaatactgatgctgagcttaaagagcttatggctgttatcttaagaatcatgaaagaaaacactcatacattcatgcctggatttactcatcttcagaaggcacagcctgttactgttgctcatcatttcggtgcatatttcgaaatgttcaagcgcgacagaagcagacttcacgatatatatgaaagaatgaattactgccctcttggtgcaggtgcacttgcaggaacaacctatccattagacagagaacttactgcttctcttcttggtttctatggtccaacactcaacagcatggattctgtttctgacagagattaccttattgaattcttatctgcattatcaactatcatgatgcatttaagccgtttctctgaggaaatatgcatctggaattccaatgaatacagattcatagaacttgatgacgctttcagtacaggaagctctattatgcctcagaagaagaaccctgatatcgcagagcttgtaagaggtaagacaggcagagtatatggtgctcttatgagcctccttacaacaatgaagggtattcctcttgcttacaataaagatatgcaggaagataaggaattatcatttgacgcatttgacacagtcaaaggctgcatcagccttttcaagggcatgattgatactatgaagttcaacaacaagagaatggaagcttcagcaaagaacggcttcactaatgctactgatgctgctgactaccttgttaaaaagggagttcctttcagagaagcccacggtattgtcggtcagcttgttcttatgtgcattgagaaaaatattgcacttgatgacctttcacttgaagaatacaaggctgtaagccctgtatttgatgaagatatctacgaggctatcagccttcagacttgtgtagataagagacttactcttggagctcctggtccagaggttatgaataaggttattgctatatatgataaatatatggatgagaattagtttcggggttgtacagtctgtgagttaagcattagtgccaactttaggtaagctgacctagtggctgtaaatgccgccatatacagagtttattacggtgtaggaaatcaaacgcgcttcgcttgaacgagatttcctgcaccgaacttttgtatatagcggcattaacacccacacggtaagcttacatgcagttgtcgctaacgcttaactcacagacactaccaccacgaattaccgattttgattcatgccatatgtctccagtataaaaaaatggtatggataatcccataccatattctgactaacaaagtgaactcgctggtcaaattattctttcaaatgtagtctcgacaatccaaaaacaatttaactaactatccatttatattttagaaaaatatacttttttatcggtggtcatgtcgaagaagtgcttcacaccatcacaactaaattgtaagctgtccgtgtgggtgttatgccgccatatacaaaagttcggtgctggaaatctcgttcaagcgaagcgcgtttgatttccagcaccgttataaactctgtatatggcggcatttacagccactaggaccgcttaccttagttgtgatggtgtgaagcacttcttcgactctccaaccgttaaacaactatactcttatcttagttcccttagtatccctgtgtgccgtcttcatcttggcaaagctgatactcttgcccttatattccattgtgaactcatcaccttctgtaagcaggaatacatcttctatataatcatcttttgaaagcttgattcctcttacgccaacagcactcttcttcttcattggaatgtctgttaatgggaactttaagaacactccgttttctgtctgtacaattacattctggttgctctcgacaacctcttcttccttgatttctccatcaagtgagaactttgaataaatctctactcttgcgtctgttgaatacattccgattagcttgtcgtcatctgctaattttgtacatgcaactgtacgctttgcaacctggaattcttcgctgtcaacaagcttcatcattccctgtcttgtgacaaaaagcattttctgattcttaagtcgttcaaatggagtaatgtacacaattatctccttagagctgtcatagttacacagattatcaatcggtgtgcctttatctctgaacttagtgaacggcagatcctttatctttaactggtgcagatctccggtatcagtaaatatacagattttatctgtgttcattaccggaatgacatatttgttttcgttaaatacagcctctttatttctctcaaatgcagccatatcaatagttcttgcatatccgaatctgtccataataaacataacttccatctctggaatcttcttttcctcaaatacagcagcttcgccgtcttcaattacggttcttctttcaacaccgtattccttcttaatattaagaaggtcagccttgataacctttgccatctcttttctgctgccaagtatcttttcatacttttcaatcttcctgacacattcatcatattctttctgaagattaagaatttcaagaccaatcagcttgtacagacgcatttccaatattgctcctgcctgtctttccgtgaaatcaagacctgcagcctgcttttttgactgctctgacttgaatctgattccctcaacattaccattgacaaggcagtccttcgccatcttaagattagcgctgcctcgtaatatctcgataataaggtcaataatatcacaggctcttataagaccttccttaatctccctgttagccttctccttttcaagaagtgttgtgtactttcttgtagcaagctcatactggaaattaatgtgatgtctgattatatccttaatccctaaggtctcaggtcttccatcaacgatagccagcatatttacaccaaatgtatcttctaacttggtcttcttgtacagaagattctcaagattcttgacatccgcgttcttcttaagttcaaggacaattcttattccttccttagaagattcattggaaatatcgacaatatcagtagttttcttagtttctataaggcttactacatcagatataaatttacctatgttagcaccaatcattgtatatggaatctctgtaataacaagcttgtccttctcagaacggttcttggcaggctcgaatacgaccttgcctcttaacttaatcttacctgttccagtctcatatattgcaccaagctcgcttttattaattacaattccgcctgtaggaaaatccggtccagggcagagctgcataagctcgtctgttgtgatatcctcattatccatatatgcacatactgcatcaacaacctctgatagattgtgtggagggatattagttgtcataccaaccgcaataccatctgcaccatttacaagcagattaggtactcttacaggaagaacctcaggctctttttctgtctcatcaaagttaggcacgaaatccacaacatttttatcaaggtcagcaagatatacgtcctgtgtgaacttttttaacttagcttctgtatatcgcatagcggcagctccgtcaccttcgatagaaccgaagtttccgtgtccgtcaacaagagccatacccttcttaaaatcctgtgaaagtacaacgagtgtctcatatattgaactgtcaccatgtggatggtatttacccattgtatcaccaacgatacgtgcagactttctgtgaggcttgtcgtaattaagccccaactggtccatggcatacagcactcttctctgtaccggctttaaaccgtcccttacatcaggaagtgctcttgctgtaataacgctcatggaataatctatataggacttctgcataacctcagaatactcagtccttataatcttctcagccattttctactcctttagcttttacgcatcaatctcagcttcattagcatgcgtatatataaattctcttctaggtggtacatctgtacccataagcatagcagtaacctcagtcgcaagccttgcgtcctcaatctcaacctgctttaaaattcttgtttcaggattaagagttgtctcccatagctggtcaggatccatctctccaagacctttgtatctctgaagtgtaaatgttcctgaagtatgcttctttctataatcctcaagtgccttgtcatcatacagatattcaccctcacccttcttaggcacaaccttataaagaggcggtgtggcaatatatacatgtccctgattaataagctctggcatgaatctgtagaaaaatgtaagaagcagtgtatcaatatgtgctccatccacatcagcatcagtcatgataataatcttattatatcttaatttgctgatatcaaagtcattaccgtagccctctaagaatccacagttgaatgaattaatcattgtcttaatctcggcattggcaagtaccttatcaatacttgccttctcaacattaagaatcttacctctgattggaagaatcgcctgagttcttctgtttcttgcagtctttgctgaacctccggctgaatctccctctacaatgaatacctcacattcatccggattcttgctctcacagttggcaagctttccgttgctgtctatagagaacttctgctttgtaagcatatttgtcttagccttttcttctgcttttcgtatcttcgcagatttttcagcacatgcaattacagcgttaaggtcgtccaaatgtctgtcgaaataaagctgtacctcgtctcctgttacatttgcaacaactgtaccagcatccggattatcaagcttggtcttggtctgtccctcaaatcttggtgcagggtgcttaactgcaacaactgcagtcataccatttcttacatcaagacctgtaaaattcgcatccttatcctttaagatgccaagttctctcgcatactggttgataatcattgtaaacttggtcttaaagcctgtaatatgcgttccaccctcctgagtgtatatgttattacagaagccaagaatattttcctcaaattcattaacaaactgaaatgctacttcaacctcaatatcttcctgcttcttcttaaagtagacgatatcgcatactgtctctttgccattgttaaggtctttgatatatgccttaagtccgtcaggctcatgaaaagtttccttatcctcgctgccctttctcttatcttcaaactcaattgtaagccccggattaagatatgcagtctcatgaagcctgctctttatcgcgtctgctttgaatcttgtcttttcaaatatttctccatcaggaagaaatgtaacagttgtaccagtatcattttttctgcatgtaccaatcttttcaagtggcgctgttgcttttccacgctcgtatctttgcttgtacacaccaccatcaactcttatctcaacctcaagccatacagaaagtgcattaactacagatgcaccaacgccgtgaagtcctcctgatatcttatatccgccatctccgaacttgccgcctgcatgaagtactgtaaatacaacctcaaccgcaggtattccggctttaggatggattccgataggaatacctcgtccattatccttgatagttgctgttccatcatcattaagagttacatttatctgtgtacaaaaacccgcaagatgttcatccactgaattatccgcaatctcatatataagatgattaagaccttttgttccgacacttccaatatacataccaggtctcattcttaccgcttcaaggccctccagtatagatatactgttagcatcatatttattagctgccattattaattactctcctctttactttccaaaatacgcattgaaagtatcctcaaagctgcttcccaacgtatacgcatcctgaatacttaatttcttccattcgctattattaaattccatatatataccagcttcatatttctcaaaatcagtattaaactgctctaactttctcttttcaagaattgcagacttattaacctcagtcttagccttatcattatccgatgtacatcttataatgtaatatctgcctgctgactcaactatactgctcatctcaccagtagacagattgaatgctgctttttcaaatgctgcatccatctcgccacgtttcagttcgtactcatattcgccatccgcattgtactccttggcaacagcaaagaatgaacttcctgaattcacaagattatatgctttattaatatcttcctctgaatctgatacaatatactggatatcaataactcttgcctcatctgcgcttacttcaatatccatgctggaagtaaggtcatcgtagagtttctgtgctattgcaaattcagtaaacattgtattcagtttatccttagttattcctgtactgcttatctgcgattcagttaattcattgtaaaatgcatcaacagccttacccacagaatctttttcttctcttccaagcacaacaccgcgttccttagccttaacattcatagccttgacgcgcattaacttactcttaatctggtccttaatatagctttcaaaatcagcatcaccaattttctctctccatatattactgccaaacatttcctcatattccttcttcacatcagacatgagaatatctgcctcgcatgtattagttgtcttctgtcctgctgtcttaataagctcaccgctcttcattcctgttgtgaaatatatcagacgtccattaaagaacttaatatatcctgcaactaacagaactacaacaagaataactgctaatataataaatgttttttttcttcttttcatattctatcctctttaattatttgtgatatggctcattcttcataatcctgtaagccctgtatatctgttccaaaagaataactctcataagctggtgcggaaatgtcatccttgaaaaactcagcttataatcagctctcttaagtactgcatctgcaagtcccaaagagcctcctattacaaatgttatgttacttgttccttctattccaagtctttcaatcttttctgatagttcaacagaatcaagcattttcccttctattgcaagtgcacatacataagcatcatctttaatggcagaaaggattctctccccttccttattcttaatctgttcattgactatatcacttgcattatccggtgttttctcatcaggtagttcaacaatatcaagcttacagtatcttgaaagtctcttagaatactcttcaactgcctgggtataaaacttttccttaatcttgcctacacatacaacatttatacgcatctgtactatccttccacgaagaaatatccgccattatcaagcctgaatacttctaactgctcaagaagctcatcattgcttaagtcagatacatccattccctcatcatccatcacttctcttaattctttaatatccttgcagtataccgccatacagtcctctaagaattccttagcttcctctaaatcatatgcaacaggctcatcgaaaagctgtttctgatctcttaaaaacaccttcgcacactcatcaatatgtttatccataacttaaatctccttatcttatctctttaaattgctctcttaatgttccttctacccatcctgttacgaaacgcccgtgtttcttaacatcttctacagctttctccataacatatgaataatataccttatccaacatagcgatatcattataattatcaccaaatgccatgcattgttcaggttttagtccaaaatactgctgaacctgctcaattcctcttcctttattaacattagtgtccataaggtctaagtaaagttctcccgatacaagtactgaagccttatcactccatttgttaataaaatgttctttagagttcttaattcctgtcatatcacacacagctatctttaatatatcctcgtcaatgtctgtgaacttatcaactaatgtagtatgataattgaccaccttggtcatcctgtaataatattcttgagacttaggcttaatatatgacgtatgttctcctgatacaagcacctcacaattaggctgttcaattacatcctcaattatctctaacgcaagcttcctatccatcgcagtctttccaatagtttcacccttgtattccacaagtgcaccattctctgcaatatatgcaagcttatcactgacagccccaaaaagtctcttaagactcgttatctgcctgccactagccggtgcaaatataacgcctttatcaacaagtttattgatatactgtatcgtagattcatcgacgctctgtgctccgttaagaagcaatgtcccatcaaggtcacttgctacgaatttaaccatatattttctccttaaaatgttttaagctcatgtacaagtcttgcaacaggcagaccgacaacattattatagtcgccttcaatacccttaatgtatgctgcgaattttccctgaataccatatgcaccagccttatccataggctctcctgtgcttatgtaatccctgatttcctcatcagtcatatcatatacccacacatcagtcttttcataaaaacttacattcttatgtgtgctgcatatagttacacctgtatacacctgatgtatctgaccttctaaagacttaagaattctgaatgcatcctcttcatccttaggcttggtaagaatctctcctttatgataaacaatagtatctgcacctataacgattacagaatcatctttatctgcatattgctctaatacagactgtgccttaatagaagataattctcttacataatcttcaggctccatctctttaatattctcatctgcatcacttgtaacaacagtaaaatcaagtcctacctgactcattaattctcttcgtcttggtgaacccgatgcaagtatcaaatgtttcataaaacttccatctccttgttcttcactgtattttgtgttcaaagcctacttcgactcatacatattgcattatagcataaaaaagcagagtgcttcaataccaccccaataaaaaaggcacaacattactgctgtgcctctctgatatcattaacatttattatcttttattgctctttttgcttatcacaataacagttccagaaataacagctgctgctacaagaatcacaatatatacccatacatgattattgtcaccagtctttacaacctcttcatcagccgcaacttcaccagcttttctgactcttgagccatcaacagtctcatcttcttttcctgtaactaattcttcatctcctgcaacttcaccagtcttctttgtgacctgagttgatgaagttgtatgttcttttgtctgtttattagaatctactgttgtttcatttgactttgttgtctcattaacagctgttgtttcgtttgattctggttttgtcggcttagtttccttaccagcatcaactgttgtctcattcgactttgttgtctcctgcgcagctgttgtttcgtttgattctggtttcgtcggcttagtttccttaccagcatcaactgttgtctcattcgactttgttgtctcctgcgcagctgttgtttcgtttgattctggtttcgtcggcttagtttccttaccagcatcaactgttgtctcattcgcctttgttgtctcctgcgcagctgttgtttcgtttgattctggtttcgtcggcttagtttccttaccagcatcaactgttgtctcattcgactttgttgtctcctgcgcaacnnnnnnnnnnnnnnnnnnnnnnnnnnnnnntgcaactgttgtctcgtttgactttgttgtctcctgtgcaactgttgtctcgtttgactttgttgtctcctgtgcaactgttgtctcgtttgactttgttgtctcctgtgcagttgttgtctcgtttgactttgttgtttcctgtgcagttgttatctcgtttgactttgttgtttcctgtgcagttgttgtctcttctgactttgttgtttctgatgaagactgtgctacagatgttgtttccttttgtgtcgtctcctgctgttgattatctgatataaaatgcatttgtccattgacattaacaaatgacttagaaattgctcttccattacatgtagatgttaaggtaatatctgcttttggtgcaacaactataccacatacctcacctatattaatattaccagttacattaacagcattgaaaataaccgtgtctgatacatcaacatctgttaatccgcctgtattctttccattaatgctgaatcttttaatgtctgcatcaccatcaccgccaagcagattaatgataacaaactgtccctgtgctttatttgttatgttgagctgtccttctccataataagatgaaacttcttttccctgccagtcaatataattattagcatacatatttaccactacaatctgcttattcttaaatgaagcaagatcaatctttctatcatcataagcaccaataactatatcagcctccgaatctggtgtatctgaatacgccttgaaattatcgtatacattatcaagtgctgcagttacatccatataatcctctgcataataaacattgattgtatccttgcagttagcaacattaataacagcacctgttctttttccgttagcatccttaatataatatttattctctctgggttcataatcataatcagttccaagcacaagattattaaatgcattcctatccacattaacctctgatgaaccagaattatcaaaactcttgatatatgttgttccaacgctcatatcaagccatgcactcatccactgatctgttattacaagcttgttagtcgcgaaacatgtctgattgtgattaccattcttaaattcttcagcaactacaccgtaaggttttgctgctcctaataattcattaaggacatcctgtgtttttgaatatgcgccagctcttaaagacgtaccagcaaacacagaacctgcaactattgcaaccaaaagaacgccaactgcagttttcttaatctttacatccaaaccacttaatcgttttctaaaaaacattactatccctccaaaaatgtctgaaccaatagtttccccttaactatatttccctctctcagcgtataatagcattagtaccaaagtactgcttccccctttttggggggttttaattctacattaataaaacaacccatatcctgaatcagtatcattctagtatacgttccggacatgggttatattacacattattcaatttaaatattatgcttcaaggcttctgttcatagctgactctaacgcatcaatagaagctctgatgatatcatggtcaataccaataccaaagtaattctttccatcctctcctgtaataccaacatatgcaatggcactagaatcagaacccttctttaatgaatgttcttcataacagaagatatcacaaggctttccaaaatgactggcaagagcattacttacagcatcaagacgaccattaccaccatcttcaacattgtacttctcaccattctcattaatagttacgactgtctgtattccattaatctgcttgaaatgtacttcagaaatcttgaatactggtgtgtatttcttatatctcttctcaaatatttcaagaacttcatctgctgaaagctccttatgattaacatccgatacatccttaacagcataacccagatcttctctcatagccttaggtacaaccattccatagttatgttcaagaacataagcaacaccacccttaccagactggctattaattcttataacatctgaatcatatgtacgtcctacatcttctggattaattggaagatatggaactgtccatttattaggatcattttcaattctgtaatgcattcccttagatatagcatcctgatgtgaacctgagaaagctgcaaaaacaagcttaccacaccatggatgacggtcatcaatcttcatctgtgtaagtctttcaaatacttctgcaagatgtggcatatcagaaagattgagttcaggattaacaccctgcatatacatattcatcgcaagtgtaataatatctacattacctgttctctcaccattaccaaaaagtgttccctcaattctgtctgctcctgcaagaagtcctaactctgcatcagcaacacctgtcgaacggtcattatgtggatgaagagaaataataacattttctctgttgtgcatgtacttagacatatattcaatctggcttgcaaatacatgtggaagtgacatctcaactgtagcaggaagattgatgatacatttcttatcaggtgttggctgccagatatcaacaacagcgttgcatacctcaagtgcatactctggttctgttcctgtaaagctctctggactgtattcaaaaaggaagtttcctccatcagcttcagcaagttcctttaataacttagcaccttcaatagcaatctgcttaacttcttccttagatttcttgaatacctgttctctctgtgctaatgaagtagaattgtatacatgaactattgctctcggagcaccatttacggcttcaaatgtcttcttaataatatgtggtcttgcctgggtaagaacctgaattgtaacatcatcaggaatcatattcttctcaataagtgtacggcagaactcatattctgtctcagaagctgcagggaaaccaatttcaatttctttaaatccaacttcaactaacatctggaagaattcaagcttttcatcaagactcataggttcaacaagagcctggttaccatctcttaaatcaaccgaacaccagattggtgccttatcaacatactccttgttaacccagtcattgcacttaactggtggcataaaatagcctctttcatactgtctgtaatcaaacattcctaaaacctcctgaaaatataaatatgtattgttaataagtaaaggcttccttaaagataagcataaaaaaatctttcgtccatgggcaattccacccaaagagacgaaagataaatctcacgcgttaccactcttcttcatagctatgctatgcactcaccgaatacgtacaacaaatgtgctgcattatattctgtccactataacggttggcttccggctactcctacttctcataatgatttcaggtagcagctccaaggcgagttcaataagttccttcgactgcctcgcaccacccggcagttctctgactctggttcctatctaatagtcctcttcacagcatttacttattatgtacgcttattatacttgtcattttttataaagtcaagcataaattcaagttcttctttggaaatattcttatcagaatatcttgctttctcataacttgctgtaattctgtctgcagcatcagcatcgtcagttattctgtttattgttatatcctgtggttgcatattttcaagtgatttaccatccgaatccctggctgcctttgatgattttattgctgcttttctgaatgccttcctgtactgcatattaacaggcatattcttagcttcttctgctctctgacgtctctttatccttgcttctgttcttctgtcattaccaatgaattcaatctcatcaccattattatcctgtgactttttgaaattcttggcatatctgataatcatatagacaataaatacaacaagtgcaattacaagaactattgcaaatgctgtaaataatgcactcataacaggattatcagtaaatgcaaggtcgttatctccctttaccacatcatcatcagtgactggattcacggaatcttcgggcatcgtagagacttcttctttctctcttataagtcttaagaacagcttcagcactatccttacaactgctacaaaacctgaaccaatcagtgtaaatatattgccataatccccactatagaacagaatcatgccaagaatcataagtcctgacacaaccatgaccattatcatgttaattcctgtaattctctcagcaggaaattctgatttgccagcattacttataaacagagaattaagctcttttaactggtcagcaagaaaagcaagcagaacaaacagcacaaataatactgtttcatagttaacaagcagtctgttgcctgctgaaccgccataaagacttcctgcgaccataaccagacaatacagaggtgacattctctctcctgcctgcaaggcagctttcttgtcttcctgagttacatcagcaaactgattcccataaagcggttcattcacatattcagtttttcttgcattagccactcttatgcttacagaccttatacacacagcaagtacacttacaaaatatgctgtagactctgcatctccattaccaattataatggctgttataagcaaagcagcatgaatcagcataaatagaaaattcttatgtatattctttcttgccacataagttataataaccggaactgccataagcagtgttgcaataatataactgtcagatttattcgtaagtcccaatataacaaatgcagaaaatgcgaacgctacaatacactggcttattatatctgtcaatgttcttattgttctcagtttattataattataaacttgtcccgactcattcatatgttatctcctgataaacttatttcacttcccagccctctggtctgataccacaataatcaaggctgtattctccaccagtcatatatggaacaatccatataacctgtccatactttttctcaaacttctgcatagtctgctgcagcttctttcttctgctcgctgatataacaacatatacactgttgtcactactctggacagaaacattttctataaatgttctgttaataagctctgcaaactcttctttttcaagctttaaatccattcttgcaagtacagtattaatacttccaagatgtccaactcctgctccttctcttataccaactgcttcctttgtgtcaacatcacatgcattactaataagagagacatttattccctgtctgatgaattcttccgccacagaagctgcaagacttattgcttcttcattaaccgaatcatatgtaagcattccatcatcctcaagattaagaagaatacatacattacggctgactgactcattatattcattaacacacagattacctgttctcgctgttgccttccagttcacattctttaggctgtcgttgcttgtataatctcttattcctctgaacacaaatggatcttcaagcatatatttcttacgttctgcttctcctgatattctgcttcttataaagctgaatctcttactatccacagtcttaggataaactgttatctcacaggtactatccactttgagaacattaatctcgttcataaatggtccggcaaatgtaagctgtacgcctgatattttgaacacacctctgtgattgcatttaacaggaattcttcttgtaattctctgattagccagaaatgagaacacatcattgcggtatgtaaggtctgacacacttgaattagtatctgttccaggaaattcaagttccctgtccacctgaaacttaagattcacacatggcagcggcagacgtttttcgttggatataacctcaacaacattaactgtttcgccatttacaacatgctttttctcaaattcaagagcgacacccagccccttattccagttataacgaaatacaaacttaattgccagatatactataagtacaccaataagcatcaataatacattcattatcttttccaatcttcagtaggaactgctgtgttattaacaacatgttctataatctgttctttattatccatattcatgtaacctgtctgtaacacaattctgtgtgcccatactacaggtgcaagtatcttgatgtcctctggtacaacataatctctgcctgcaatatacgcatatgctctcgccacattgagcataccaagagttcctctcgggcttacaccgattgatacattatcctcctgtcttgtcatccttgccagttcaacaatataatcaataagcactgggtgaacatatacatttttcacatcttctttcattgcaacaatatcttcacatgttgcaactgttgaaagttctttagaaggatcttcttttaagaatctgttaagaataagtacctcatcatctttctttggataacccatgttaatcttcataaggaatctgtcaagctgtgcctcaggaagctgataagttcctgctgtctcaataggattctgtgttgcaattacaacaaatggttcttctaacttagaatattcaccatccacagtaacctgatgttcctccatacattcaagcaatgctgactgtgttctaggtgttgccctgttaatctcatctgcaagaataacattagcgaataccggacctcttctgaatacgaattcaccctctttctggttaaacacatgcacacctgtaatatctgaaggaagcagatctggtgtaaactgaattcttgaaaattgtccatcaatgctctttgcaaatgctttcgccatcatagtcttaccggttcctggaacatcttctagaagaacatgtccaccggcaataatacttgtcagaaccagttctgaaacatttctcttacccacaatcaccttacttacattatctaatatatctgaagccttactcataatacctcctcgtaacacgaaatttaaactcagataattataacaaaaacactgccagaacagcaagtgtctgacagtgttaataggttaaataattatgaacttttggtgaatttaattatctgtaggcatctcctgattaacatcaatacctcttggagcaacaggtgttgagaacacaatctgtgtacttgttcttccgaacttctgaagctggccgataaatgtatcaagttccatggtacttgggaacataacttttaatagcattgaataattgcctgttacacagttacattcaacaacattagggcatgacttgataaatggatagaaatccggtttctgcacaggagcaacttcaagattaataaatgctgttatatgatatcccagctttaactgattaatcttaacttcatatccttcaataatctcttccttctcaagtctctcaattcttgctgaaacagccggtgatgaaaggaaaacattctcggcgagtgcctttaatggcattcttgcattctgctgtaataatgtaattatcttcttatcgattttatccatggcgtgaacctccagattataatattcgttgtaaatgctattaatttaacccaaaaggggacaatcctagcgttgttgctaaaatcgtcccctttgacttaaattattaacttatacataatatacaccttacataataaaatgacaagtgttttttctttattttcattgcttttatacataatatttgttagagtagagaaaatactaaagccattactggcagaacggagacattatggagaataataatcaggaatataacacagtaactcttatgcttgacgataacacagaatgtgaatgtgcaataatacgcatattccctgctggagataacgactatatcgcacttcttccacttgagggtgaagctgcagacaacgatgaggtatatctttacagatacaaggttgaaggcgacaacgaacctatacttgagaatattgaatctgatgaagaatatgagcttgtatctgaagcatttgacgaagaattagatgctatggagtatgaagatctgtacgaagaagaggataacgagcagtaagaagttcttctataaagcgtgaacgggttgtatctttgttgtacctctgcttggggtacagaagatacaacttttcttttgcccttgtcattgcaacataaaaaagtcttctttcctcttctatctgctcatcaagaactgccttattatacggtattatcccctcacatacatccatcaccatcacaatcttatattcaagccctttagagccatgcattgtaagcatatgcacaccttccaccgtgttgttcctacgctgagtatcacactgcttaaggtattctgtaataccatcaagccattgtgagaggctcatataccgcgacgccctgtgtgccagttcatcaagcacattatataattcttccttatcagccttatgttcatatatataatttcttatatattcatcgtagccaataccctttcttatataattaacagctgcaaatggagacatatttcttatcatgttaatatcagatgccagcttttccacctgttcactcatctgttcattcccctcatagcctctcttcaatgcattaatatctgccggctgtgtaatatatgaacggcttatatatcggagcggcttattaataatccgcagaaagtctattctttccctgctgccaagtgctatccttatatatgtaagaatatccttacttatccagtgctcatatatatcctgtactactgaataatcgcagcatggaattccatcactttcaagccttgacatatacatattcccaattacattagttcttgataacacagcaatgtcatcagcagctattccagtatcaatcagtcttcttatctctgatacaagaaatgctttctcatcattcagactgttaaattcatatacagacacagtatctccttgtgaattgtacgtcgttatatctttataataacgatgctcattctcctctgctacagcccttgaagcaaacacaatattgcccgttgacctgtaattaatacacatgtcaattctcactgcatcactataatacttattgaaatctaacattatctgtggagcagaacccctgaatccatatatactctggtcatcatcccccaccacaaaaagatttctgtattcatcagcaagaatcctcacgacatcaaactgtgccttattaatatcctgaaattcatctatcagaatgtacttatacttattctgccacgccctcctgtaatcttctctctgcatcagaagctcgcggcactgtacaatcatatcatcaaaatcaatcagatgttttcttacaagcatatcatcatatgccctatacattattctaaaactctgtggtggaatacatctgctctcatattcatctatattaacatcttcacccttaacacagcttatctcagataaaacaccagctacagcttcgttctcatcatcatactccagttcaagcctgcacatctggtctttcacgaattcatgctgtatctgcggcttaataatacagtgtgcagaataattatatgctgccttaagtattgtaaaaaatactgcatgaaatgtgccaaacgtcactgcagagtttctgccctctgacaaccccttaaacttaagcttcatctgttcagcagcagccttagtaaatgtaataacaagaatatctgatggattaacgccgtacctctcaatcagatatctcaccctgtgtgtaagaaccgttgtctttcctgaacccggtcctgcaattaccatgcacggtcctgtattatgttgtatagcctgaatctgtgcttcattaaactgcaaaagcggcaccccttataataatcttacacaaacaaatgtatactaagattatataagcatgccgccattatgtcaacttaataatatatttttttatttattaataacttgttatattatcatcagaatcatcagtattagatatactcttgataacaacataatattcaacctgtggatttacctgtacaagcaccctgtcacccttcttatgcccaagaagagccttgccaagaggcgactctatgctgatcataccgcttaatgaatcagctctgattgtagtaacaatcttaatagtctcagtactttcatcatcctcatacaatacctcaaccgtattattaacgccaacctcatcatctgctgatgaatcatcaataacagtcgcattcttaatcgttctctgcagatatcttattctgctttcattcttattcttaaatcttttcgctgcatgatactcaaaattctcacttaaatccccctgagcccttgtctccttgacatcatcaagtgcagcctttcttacctcatgtatcctgtactcaatctcttcttccatctttttgatatcattcttagtaagttcgtgtcccatatctatccttctttcttacatttaatcaatgaaataatacgagtatattttgcccttttaagatacattttgcaagtttattctgtctcgactttattacttgtcggctcatcaagaagcacgaatggcgcgtcatgtaaaatgctttagcaagcccgattctctgcttctctccgcctgataacatatctcccagttcaccgacattagtgtcgtatccatcaggaagctttgatatgaaatcgtgtactgaagcctttttgcacgcctcaattatttcctcatctgttgcgtcaagctttgcaattgttgatttaccgcttccgcttcttcctgaaattccaataatgcttgcttttaaaaccggaattgatacatcagaaattatagtttcctcaccatatgagaatgtaacattttcagtagctgcaccattaaattcaacttcctcacaacctgtgatatccttagttaccggctgttcatcaagaatatccaacactctgtttcctgctgcaaatgtgttctgcaatgtacttccaagattatcaagtgcaacaaccggtccgaaagaactcatcattgcaactacagacactaattatttatcaatagcctttatcgctgcttcagcttctttcacatcttctatcgatatccctaacatgtctgccgcttcctcatatgttcttcctgataggatattcactattaatctataatttctttcaattgctttgccagctctgctctccgcttcttcagcttttcgtttttcttcttcagctttttgtttttcttcttcagctttttgtttttcttcttcagcaagtttctttgcttcatctgccagtttctttgcttcatctgccagtttcttcgcttctattgcttcctgtattgaattctttgcatattctttagcataatcttctactatcttgcacatttcactctgacctccttctgtctccttgaaatagcttatcgcattgctaatctgtggaaacttatcattataaaatgcttctttattaagcattaactgcaatagttctgatttgtccgagccatcattaacacaagtgtttgcaaatattatatcttctccatctttcactggaacgtaactttcatcattcttcatacaccttgttacatgcgtcactgtctgattattctttaagacatcatactcagatatatatacaattgtaacatctggaacattcttaaaatcagcacctttaggtgtatattttgctgtcaacgctgccgcatgaaatcttgtccttctgatatcatcattggaatttcccttctgcacctcaacattgcaatatcttccatcttgtgtcatgcataacgcgtctaatgttatttctctttgaaagctctggaccacactctgtacagaaaccttcacaacctgtaaatgtggcatatcaagaagcgttcttaatatttcttcacatacacccggcttttctcccatcaatctaaacagtgcgtcatctataattctaagattagctgctgtttcttttatttcttttgaatattcttttaaattccccatactcttcccctttttacttacggcaggtaataccacatataaggatagagtgatttcatttgtcttatatatttattatatactactcttaaacctatttgcaatagcattcccaccttattatcgcattgcgtaatattatttatatagtatatatcatatattatttctaaagtcaatacagcagttatttttatcgtataaatatatataaatatattttattctttctcttgcacttcctcataaatacgctataatatataagtcacatttaaatatcggcgtgtggctcagtttggtagagcgcgtggttcgggactacgaggccgcaggttcaaatcctgtcacgccgacttataaaaagctcatgcagattgaagtaatcacatttaccacaatctgcatgagttttttatattatttatccaattattctatacaagattatttttaacatatgccagtgctttattaacaggaggtagggatataactacaagagttaccactgcttcaagcccaatatacgagccattgtaaacaactgaataaagtatcgcactattaaaaaaatccggtgtatacacggcaaagaatatccagccagacaagaatgaacatataaatctgcctataactcctataatatatcccttcacaagaccgtgttttgatttagaaaatattcctgacaacccaagtgctccaaagcctaatatataatcaagaagcacctgaggaatattcaggatatatggatcaagtaataactgcaaaactccatatgcaatagctgctgtcagaccagtctttattccataccagtatcctataagcactatgaataacatactgaacagtgttacagaacctcccattggcagtttaataactttaatcatggaagtcgcaaccgcaagagctatagccattgctgcaaatgcaatatgttttacattcagtttactattattatctcttgcaaaacatcctatagtcattaataagacacagacaattattaataccacatatcctgagcctgtaagaccatatgaaacgctaccatcatcaagtattttattaactaaaaaattcataatcttcctttcattatctctcaatatttttattccgtaaagaatatccacatttccactaaaagtcaagcattaaaaaagagagcaacaggtttttatcacctgttgctctccaatattttgtcaattactttttattagaacttaccgttcttagcagcttcctcaatggaaacagcaacagctacagtagcaccaaccatagggttattacccattccgattaatcccatcatttcaacgtgagctggaactgatgaagaacctgcgaactgagcatctgagtgcatacgtcccatagtatctgtcataccataagaagcaggacctgctgccatgttatctgggtgaagtgtacgtcctgtaccaccacctgaagctactgaaaagtacttctttccagcttcaagtctttccttcttatatgtacctgcaactggatgctggaatcttgtagggtttgttgagttacctgtgatagatatatcaacattctccttccacatgattgcaacaccttctgttacatcgttagcgccgtagcagttaaccttagaacgaagaccatctgaatatgctgttctagagatttcctttacttcgcctgttgaataatccatctctgtctcaacgaatgtgaatccgttaattcttgagataatcttagcagcatccttaccaagaccgttaaggataactctaagaggtttctgtctaaccttgttagccttctctgcaataccgatagcgccttcagcagcagcgaatgattcatgacctgcaaggaatgcaaaacattctgtctcttcttcaagtaacatctttcctaagttaccatgtccaagaccaacctttctctggtcagcaactgaacctggaatacagaatgcctgaagaccttcaccgatagctgcagcagcttctgaagcctttcttgcacccttcttgatagcgattgctgcacctactgtgtaagcccagcatgcattttcaaaacaaattggctggatacccttaaccatagcatatacatctaatccggcatccttagtaatcttttcagcttcttcaatactagctataccatagctgttaagaactgaagtaatcttatctattcttctctcatatgattcaaataaagccattctaattgtcctccttacttaacttcttcatctgttcttgggtcaataatcttaacagcatctgcaactcttccgtactgtccgcaagccttctcatatgctgttgtagggtcatcacccttcttaatgaagtctgtcatcttaccaaggctgacaaacttgtaaccgataatctggttgtccttgtcaagggcgatacctgttacataaccttcagccatctcaaggtaacgaggacctttctttaacgtaccatacatagtaccaacctgagaacgaagtcccttaccaagatcttcaagaccggcaccaactgcaagtccaccctcagagaatgcgctctgagttcttccataaacaatctgtaagaataactctctcatagctgtgttaattgcatcacagacaaggtcagtgttaagagcttccataactgtaagtcctggtaaaatctctgctgccatagctgctgaatgtgtcatacctgaacatccgatagtctcaactaaagcttcctgaatgataccttccttaacattaagagtaagcttacatgcaccctgctgaggagcacaccagcctacaccatgtgtaaaacctgaaatatcttcaaccttcttattctgtacccatttaccttctgttggcactggagctgctccatgatgaacgccctgtgctactggacacatattctctacttcctgtgtgtaaatcatcttattactcctttcgtaattcatagtgtttactataaatgaaacgacggccagaagccgtcgtccaagccttgactattttctcacaaacttttgcattagtcaatgtgagacacaacatttttacattaataaaacaaaaatttcacataattatctcttagttactacttcgccctgcttcttatatatagaacctgccggaataaagcctcttacgcttgaaagcggataaatattactctctcttccaacaattgttccaggattaagtacgctgccacagccaacctcaacattatctccaagaaaagcaccaatctttttgatacctgtatcaatattgcagtcaggtcctttaatagtaataagcttcttgtcagacttaacattagaagttatagagcccgctcccatatgagccttgaatccaagaattgaatctccaacataattataatgtggaacctgtaccttattaaaaagaattacattcttaagctcagttgaattaccaacaacagcgccttcacctacaatagcttttccacggataaatgcacagtgtcttacctctgcatctttaccgataattgcaggtcctgcaatataagctgatggaaatacatttgcagttctgtgaacccatatattctccccacgcttctcatattcatcttctggcagtgaattgccaagttctacaataaaatcaccaatctttgcaagtacttcccatggatatgtacagtcttcaaatacctttgctgcaatagtctcattaaggtcatacagattacttatctttaatgcatcattattcatatcaaatatcctctttatatcaattattcaacagtaacagattttgcaaggtttcttggcttatctacatcgttacccttaagaactgctgtatagtaggcaataagctgtaatgggactgccgcaaccataggcataagaagctggtctgcctgtggaagcttaataacaatatctgccactccatcctcaatatcaagctctggttctgcaataagcactacaaatgctcctcttgacttaacttccttaatattacttatagtcttttcctcaagattcttctgtgttgctattgcaattacaggcatctgttctgtaataagcgagatagttccatgcttaagctctcctgctgcatatgattcagaatgaatataagatatctcctttaacttaagagaaccttccatactgagtgcataatcaagacctcgtcctatataaagaagactgtctgcattaataagcttggatgctgcaaactgacacttactctcaagtgcaatggcttcttcaataacctcaggtatttcttcaagcatcttagtatatctgctgcattctgcctcatccatcttaccattagcataagctaattcaaatgcaattaaatacataattgatacctgaaccatatatgccttcgttgaagcaactgaaatctcaggacctgcatgtgtatatacaaccatatctgcttctcttgcaattgatgaacccttgacattaacaattgccatagtatcagcacctgcctgttttgcaagttcaagtgcagccttagtatcagcagtctcacctgactgtgatataacaatcataaggtcatcttcattaataagaggatctctgtatctgaattctgatgcaatatcaacagttacagatactcttgctatcttttctattatatatttaccgaccattccggcatgcattgcagtaccacaggcaacaatatatatattcttataattctttaacttatcaggattgaatccttctgcactgaaatcaggcatatcgtccatgattcttggcataattgttctctttacagaatctggctgctcatgaatttccttaagcataaagtgcgcataaccgcccttttctgcagcatcaacatcccagtcagcagtatttaattccttatgtatctcattaccatgaacatcgtatatcttaactgaatccttcttaataactgcaatctcattctggtcaagaaggtaataatctcttgtgtagtgaataatagccggaacatcagatgctatgaaattctcatgttctccaacgccaacaataagagggctgtcctttcttactgcaaatatctcatcagggaaatccctgaacataattccaagtgcgtatgaacccttaatctctgacagtacctttgcaatagtcttcatcgggtcaccatcataatagtaatcaagcagctttgcagcaacctcagtatctgtttcacttgcaaagctatatccctctccgacaagaaaatccttaagcttcttatagttctcaattataccgttatgtacaatagtaactctcttattgccatgtggatgtgaattaatgtctgatggttctccatgcgtagcccatcttgtatgaccaattccaacatgtccttgtggttttccttcttcatccatcttctcaacaaggttggcaagtcttcccttgcacttcttgacctttatattaccatgatcaaataccgcaatacctgctgaatcatatcctctgtattcaagcttagataatgcatctacaagtacatctgcgctttctctgtcccctacatatcctgcaattccgcacatatatttaattcctttcactcatttacttataattcttagcggtctcgttaaaaagtcctataagccccgcctgattccttaatgccataacagcccttgttcttctcgaaacaaaaccatcaagcttttccatatactcatctgctgtaatattcccctctgctacacctgtaagtcctttttcccagcttgccgtaagctccggattaagcagatgcctgatagaattatctacaacatcatatattatctcacctaaaaatgtaggtgtaataatctgtgtcttagaattaatagaaatatacttaatagtattaagttttttaaggatttcagctctggtagcacttgttcctattccactacccttaatctgggcacgcagttcctcatcttcaataagctgtcctgcattctccattgcaagaataatagaacctgaattatatctcttaggaggtgatgtttcaccttctttgatattaaacccattaaatgtgattgtagaaccttttctgtattttttcaatacctcaaataaagctgcatcacatttattatcatccttattatcggcactatcatcttcctttacttttgcgtcatttctcgcctttgcaaatgagttctttgctacgcccagatacccttcatctacaagcactttaaatgaagcatacagcttttcattctttacatcactggtaatacttaccttctgataaatagccggtggatagaatatacttaagaatcttcttacaattatctcataagttctcgcagctgtaactgacaagttctttaaattattaaacccctgtcctgtcggaataatcgcataatggtctgtgattgctttatcgttgcaatatcttgtcttttcaatccccttctgcatattattctgtaatatatgctcagctatctccttcacaggcggaaaattcctgagtcctcctatattcttatgtatttccttacttaccgcagtcgataacactctcgcatcagttcttggataagtaaccagtttcttttcatacagttcctgaataatattaagggtctcatcagggcttatcttaaacagcttgctgcattcgttctgaatctcggcaagattatacagaagcggtggattcttggtttctttctttctctcaatagaatcaactaccccctgtgccggcagtggatcagataagaacttaacaagttcctcagccttttccctttccttaaaaccattatccttatataaatatggcgtaccagcatacatactcttatcactcacacgccattctgcgtcaaatgttgaattctcaacctgtgcttgacctataaccctgtagaatggagttttaacaaagcttcttatctctcgttcccttcttactaccattccaagaacacatgtcataaccctgccgacagatacaactgccctgtcaagatgcagataattggcaatattgcgtccatatttcagcgtaagtacccttgagaagttaattcccataagataatcttccttcgcacgaagatacgctgaatcactcagattatcatattcagatatatccttggctgtattaattcctttaagaatctcttcctccgtctgtgaatcaatccacacacggcgttctttctttcccttaactccagcttcctgtcttacaagcctgtatatatactctccttcacgtcctgaatcggtacatacatatatatattcaacatcatcccttgtaagaatgtctttaactatattaaactgcttcgcaactgcaggtataacctcatacttgaattcctttggtatgaatggcaaggtgtcaaagctccatcttttcagattaggatcatatgcatccgggtagctcatagttaccagatgtcctacacaccatgtcacaatatggtctccaccctcaagatatccgtcttttcttgtgaagttcacatgcagtgccttggcaaactcctgcgccacgcttggtttttccgcgatatatacggattttcccattatatccctcatttctgtgtctattacacaattattattctcctgaagcatcaagagttcccatataagctggtatatattcttttataaaataatctgcttccggaatattcatatcaacaatagcctgatatattgtcttttccgcatcagcaaaatccatattaccagacttcttttcctctagacatttgatataagctgacatcttatcagccgcctttacatatttccagagttcttcttcctcttctgtctctgataacacacccttataatgtgctcttatatcagatgacagacctgagagcatctgctcctctgcaacatgctctacttccttataagcatttcttataaccggattgtaatactttacaggagtcggaagatcacccgtaattatctctgtaacatcatgatacattccaagaattgcaagcctttcagcattaatattcccaccatatatctcattgttgataattcccaatgcatgtgctatgaatgccacttcaagactatgctcgcacagattctcatggcgtgtattctgcataagcccccatctgttaatatatttcattctcgacagcattgcataaaaataattttccttcaatgtaaatgtcccctctttactctttaagtcgtttcataattttatatcataataggtttttaagcaagtaaaaagagatgccatctctgacatctcttttctggtatgtgtattagaatttaattattctgcatccttaggggtgatataaccctgtgccttaagaagttctgcaataagaacagctccacctgctgcacctcttaatgtgttgtgtgaaagaccaacaaacttataatcaaacacactgtcttctcttaaacggccaagtgaaacacccattccgttctcataatttacatcaagcttaacctgtggacggtcatcttcttcaagatactggatgaactgctttggagcacttggaagattaagttcctgtggaactcccttgaagcttctccacttttcaataatctgttccttagttggcttcttctcaaagttaacaaatacagctgctgtatgtccatcaagaactggaactctgatacactgacatgtgataaccggatcacttgcaggaacaatctttccatcctcaatcttaccccataatcttaaaggctctttctcagacttttcttcctcgccaccaatataagggatgatattctcaaccatctctggccactgttcaaatgtcttaccagcacctgagattgcctgatatgttgttgcaacaacaagctttggtccgaattcctttaatgcattaagagcaggtgtgtagctctggattgaacagttaggcttaacacagataaatcctctcttagtaccaagtctttctctctgatatttaataacttcaagatgctctgggttgatttctggaacaaccataggaacatctggtgtccaacgattagcactgttattagaaacaactggaacttctgccttagcatatctttcctctatagccttaatctggtccttaggcatattaactgcacagaatacgaaatctaccttagaaacaatttcatcaaaatccttatccatatcatatacagtcatcttcttaacgaactctggcattggtgtctgcatcttccagcgtccttcaacagcatcttcataaagctttcctgctgaacgtcctgaagctgctactaaaacaacctcaaaccaaggatgattctcaagtaatgttataaatctctgtcctaccatacctgtaccgccaaggataccaactcttaacttatcgctcatttttaactccttcaatatgtaaaatctaaaagacacttccctctgttctgtctttctgtgacggacatttgtttttgtgtctaagaaaatatatcacagcctataggataatgcaagccatttttaaatattttaagatttttcttaataaaaatatattttttaatgtaaaaatgaaaaagccccggcagttaaccggaagctttttctggaaatattaggagaagtaaattcttataaacttatttatcgaatgtcttctttctctttaattcaacacatgcaattcctgctgttaatgtcattgcagcaatataccataccatatggtatgaatcacctgtctcaacaccattattgtctgataccactggatctgtagctggctgctctgccggtgtctctggtttagcaggctgctctggtgctggattctctggttcgcctggtgttggattctctggttcacctggtgctggattctctggttcacctggtgtcggattctccggttcacctggtgttggattctccggttcacctggtgttggattttctggttcgcctgcagatgtaatctccttaccatcaacaacaagcttaacatctgaaaatgtcacatcagcacttcttgcaacatacattccaacatatacatattctgaatctacagaagttaatttaaaatcaaaaccacctgtaatagtttcttcattaccaaatgtacatgcataaccatctgtattactttcgattttaaggttatatgtctcaccagccttaatttcattagcacatgttccgccctgtgtaagagcgccactctttcttgcaaaacagttccatacagaatctttcttagtaagcttaagtggaccagctgcaacatagtcacccattgtactgttaatatactgatctacatacatatcatctcttgccataagaccgaatgatacctgatcattagatgtaaaactgtttacagtcgcctttgctgtaattgtaaaattactgtttgctggaactctgtaataatacatagcaattccatcagcagtacttgctatctttcctgctccattaacagcaatattaatattaccattgtcaagactctcaagcttaaatttagatgctatcttatcattgccgccaacatttccaaatacagttcccttaaagattcctgcattagcccataattcgctgtcttttaaatcatttgaatattctgactctttataatcaggattagactttaaaacatcactcttagttggtgctttagcatcaataatatgctctgcaagtcctgctacattaagttccttaattgtcttagtaacaagatatgcattatatgttccgccccagatattagtatgcgtattgtctacactttctggctttgatgatgtccatgcatgtaaattaactgtctcggctgctcctaatgaatcatataatttcttagtaagagaagtcatatcaaccactggaacattaagatcttttccaagattaatgattgcctgtggataacttcctccttcaaactctcctgaagcagctgtaacatgaagctgactgtcagaccagttgccatcagcagttcttcttacaatcggtgtacataaaacaactgttgttcctgctgcctgtgctggctttatataattctcatataaagaataagcaaatgaacctgctgttttataatctccattagggttagtatatcttccgctctccgctttttcatcattgtggccgaaaccaacaagaagaaaatctccctttttcattccagctataagctcaccatactccttatccgctgtatagcttgttgaacttcttcctgataaagcaatattctttacctcaaaagttccatccagatacttatcaatctgtgttccccatccatatctaggataataataattgtctgtgaaagcactgactgtcgaatctcccacaatccagacaacaggctttgatgaatctgattcctcagctcctgcaaatgttccaaatccaaagctcataacaagcaaaaggattgcactaagcagacaactgatcagccttctatttttgtttttcataacaaagaccattcctttcttttatttgttcaaattgtaaactatgaacctatgtcaaggtcaagtctttgtgtatattttaccataaaatgtttttgcaaaaaaatccccgcactatgtgcggggaaattctcaaaatattaatacgctataccattagatacttctacataataaatattaactccaccagattctgatacaatataatattcacctgcctcatctaatctgaatgatactgacttaagtgaagaaccaggtatcttagctgtacttgttacatcattaccattcttatcaataatcttaataagtctgcttgtatctgtatctgagcttgttgcatatatctttaccttagattcacctgctgtcttaaatgcaatagctcttgcagattcgcttcctgcaccgccaagcttgattctctttgtaaagctgatattcttgtaatccttattgctcttatcaaccgttacagtctttttgcttgttgcaacaatcttaagaccatcaactacagttgaactcttaatctttcctgttgaaacatcattagcattaagaattaatttttcaccctttgttgatactgaagaagcttctgttgcttttgttggagcctgtgtagcctttgttggagtctgtgtctcctttgttgttgcctctgtcgccttagttggagcctgtgtctcctttgttgtgccttcagtagctttagttgtttcctgagcctttgttgtctcttctggcttagttacctcagatgatgaattctttgaagatacactaatcatctgattagcaacattgaatcttgctcccattgaagcatagcttcctgttgtctcataaaggctgttcatgttaattgttccatcagcatttctaagctgtttatctatatttttgctcatatcgattgcattaacagtgttcttaaacattccagctgtcttagcagggtcagttacaacagttcccttcttatctccacttactaaagaagtaaacaaagagcctgaaagattataatacttacctgaattgtaatatattgaatcagccattttaccagtaaacttatctgaatcaattgcaccagctgatacaagtcccttaaatattgctgcacttgatgttctgtaacataagaagttacccttcttagcatactttccattgccccatgctgtaacatttacaattgtaagacctgttgggttattattatctgtaaatcctgttgcaccattgtcaaatgacagacaattcattacattatgtggagttccaacacctgaaccaccaagcttaaatccattcatatctccattagcataatgaacaccattagataatgttccgttgttaaatgcaacgcaatttcttattgtaattacacctataggacctgttgcactctttgcaaataaatcccatccatcatctgagttgctgtatgatatgcatccgtcaaatacattaccttcaccacatgtaagctttgcagcaaatccatctgcattctcacctgtaccgccctggtcagggaaatcacagttatcatgtgatgtacagttgataatcaggttatttgatggccataaatctttagtagcagctgttgtgtcatatcttgaaatctggagtcctgaatctctgtttgcttcaaatacacatttttcaaaaatgttgttattaccagcaagtaatactccgttatctccagcaccatagaaattaattccctggaaataccaataatctccatctacaactacacctctgttagctccgtcaagcttctgtgctgagaaatcaaacttaacttccttgccactttcagcctttacaataatataagagcctgattttccattcatggcattattaattacaattgtatcagagaacttatatgttccctcttttacaataattacatcaccagccttagctgaactgattgcattaagaatttcatttgaagatgatacatactttgcattcttgaaatctgcatctttcttcttactgatatctgtatacgcacctgaataagaaaggcttgtcttatcatatgatgttgttgcatctgaacccgttgtttccttttcagttgcctttgttgcgctttctgttgatttagttgttgcctgtgttgcttttgttgttgtctgtgtttccttagttgttgcctgtgtagcttttgttgtactctctgttgccttagtttcttctgttgttggatctggtgaaacaatctttgcattagtaccacctacagaaacaaggtctgtattcttgtaattagtaactgttgcctttaattccttatctatggcatatacagaatcatctttatcagagaatgtccatggaattactccaccgccaaggcttcctgctccctttgcagatgttactactaaaggtacatcttctgcattattaaggcttcctgatttaaccccgagatccttagttgtatcaaagttatcataagatgttccacctgctacagtcttatatgaagatggaactttctcatctgctgactttgcaaggtatgcatcaaatgatgtagcatttgcagaatcaccggtttctgaaacagcatttgcatagataatcttctgtgcgcctacgataacatttcctgatgctttaatgataccaccgttctcacctgagaatgtaccctcaccaagtgcatctgttccctgattagatgaaagcattggattcttgcagtttctgaaatagttattctgtatgaataatgaagaacccattgttgaaccagcaccatacttagcattgccatcatagtagttgttatacatatgcactgacattgttcttactcttgcatgtcttgaatcagagtgatcaaaccagttatgatgatatgtaatatagttaggaccagattcactcttcattccacataaagagcacttacctgagtcataaaaatgtacatatgaaactgttatatactgtgaattacctttaatgtcaattgaaccatcaccctttgcctggtcagcatctccacctgctttaccatagtacagatcaacattgtgaatccatacattgcagtttgctgtatcgagagaaataccatcatccatgaaattgataattgagaaatttctcatctcaacatttcctgcatttcttaagaggaaaccgaatccattgattgtcgcatcatttccgataccctctattgtcatattaagatttgaataagcactagctcctttaatctgtactccctcagatgaacttgaaaacttatccattgcagcatctgtaacacatccgattacacggacatcaagtgctcttgtttctatccccttgctagcactctttgtatatgcatcaattattgtctgaagacctgtatattccttctctccctttgcctcttttactgatgccttaatagtctttgcattatcgttagtaacataaagaacaattgcatctttcttaagtgttccatcctcattgtaagcacctgaacctgtcttatactttgattcagatgaaaatgcaaatccggatctgtcatatgaacttacattaagtgtcttagtaacctgtgctttgtcagtaacttcctttccgttctttacaggaactaccttaataacatagtcacctgccgcaagtcctactgcatcaatcctgtagtagttcttatactttctgataagttcattgtcgattcttgcataagcagaatctgactgactggctttcttgatatatgctgtatatccttctgcctgattatcaatggtccactgtgcatatgctgactctaaccatcctgccgcaccatcaataaattttactgttccaacatctgccttcactgtaagaagtgatgtaggaatcacgatactcacaaccataactagtgcaagtacccatgcccattttctacgggctgctttgctaataatagctttcatgttttgcttttcctcctcaatacattaatttgtgcattttgctttaacaagcaaggggcttgtgtcattatattagcaacttttactcaaaaagtacatgtatgttaagtaggaaataggtaccatattcataatttttatgtatttcatgtgaaaatatgttaaaaatatgtaaaacaccgtagcacatttgctggtaagctaatatgccacggtgcagattaaacatccggatattcaaatatatatctctcatacccattaattatcttagtattctcattatactcatattcctgcttaaacttcatctggtagctcttatggatatgaccatggataaaatacttaggcttatatttttccaacagataattaaagccctcaaaacccttatgcggttcgtcaggcccgtcacctattcccgctgccggagaatgtgtaagcaatatatcaaagcccttattcttctttatcgaaaaccacattttattaatcctgcggttcatttctttctgtgtatactggttctttcccttcttatatcttatagaaccaccaagtcccattatacggacccccttatacacatatatcttattctcaatattgatacatccatccggtggctgtatctcataacagtcatcatgattgccatgcacataaagaacaggtacttttgtaaatgatgcaagaaacgacagatactggggctttaaatccccagctgaaagtataaggtctataccttccagtttctgcttttcgaaataatcccataagtactttgattcaacatccgctaacacaagtattttcattaataattccccagccgccactacaggcagcgtgctttctattcttcttctttgataacaccctgaagtgccatttttaatttagcattatctgtaagctcatcataccgaggcagtctgccaaccacattatcaaggagccagtccatagtaattatatgttccggatcaataagtactccctcttcaacccttgtattaccctgctgatcctttaattcaccctcaaacactctgaaccttgcctccttaagttctttctcaaagagctttacaagcctcttagttgctgatggaaggctctctgaatatataagatcaacaactcctgctgacattccccaccagtaattaagtgcttttacattatctccgtcctcatccttactccatgaaccgctcataatgctctggataagcttttcataaaaaactccccagtgccatacaggcatagccagatgcttatctgaatcacttgctttatacaatccaaatcttctcttgctcttgcccggagtaatcatatcctgattagatataatgcttatattcttcttagcaagatttccctcagaatcattatcattaatactattccattcaaggtaaaccttggctcttggattaacaaactttactcccagtgcaaatgcattaatattcgcacacgctccataaaccggattatcagctatataaccaacattatcatcatcagccattgagcctgcaataattcccgttataaactttgcttcaaacattctcgcataatatgaccttatatatttatgtgaaatattaagtgaacaatcaagaatctttactgacggatgtgctattgcagcttttagtccggccatactcattgccgacgatgtcaggaatatcaggtcacagcctttctctataagtctgttgattgctgcctcatcactctgctccggtatcacattctcctctacatatgtttctatctggtcaccaaatgtatcatcaatatactgtcttccaagctcatgtgcatagcaccactctgaatcctgcggagtcttttcatacacaaatccgaccttaagcttcttaactcctcccattggaagcagatagcttaatatattcttcttaggtgctgcagccggtgtcatcttaagttccacttcactgttatcatcaagaagctcaaattcagcccatgttttggcaacattctttgccatctcatacttagtcatcttcttaacagcatcatatccgtgaatatgaatgaagcgtaaaaatgaatctcctgttgggaaatcaaacttatcccctcctcttgattcataagcaagcctgaaattaagatagcacgaaacaaggtctttcttatcatcctcatccattggttctcctggtgtaattccaaccagctccataagagttgtaaaactgccctctttactgaaatatatatcgtttaacttggtagatttataaaaatccatgaattcataatatatcttaacatcaggatcatcactgtatttaggtatctttcttataacctgtgcacttactgtcaccgccttaaaatatttaagtacactgactcttttattaccttcaagcacatagaacttattcatgtactcatatactttaatatcgtctcttattccttcattcacctgactgtcgctaagcgaagcccactttgctgaaaattctgttccccagtcaagtataggcatgaagttgtctgcaaatgcagtagttctacctgctgtacatgttccaaccacaagtcttaacggaatctggtcacttccaagactaacttctctgtcaatactgttttcatcaataatatcctccagaaccggaagatatgggtacgtacccttatttacacacgcatgatattcttttttaccaatctttactgcactaagataatcctgtactgacatatcttctacctttcctttctgtctgcattctaccgtttaatgttcctgtatgtaacatttgcagaccgccatatcttatttatttctacttacatatataaaactatcacattttcaccaaaaaatacaccttaaaattgacttttgttaattatgctagtatcttattcgataggcttgaaatttttctatatttcgggtctgaataaaatgcatgcagatacgcatttaaagaaatggagtatacatatgaatattgaattttctaagagagctgaccgctttggcagcaacatttttaatatacttaatcagaaaaagaatgacagacttgcacagggaaagccggtatataactttactgtaggaactcctgatttcaagcctgatgaatctgttatgaaggttgtttcagaggcagcacttgaccctgagaattacaagtactcacttggtgatactgatgaattgcttgacgctgtatgcaaatggtacaaacgccgttacaacaccgttatcacacctgatgaagtcgcctctgtattcggaacccaggaaggcatggctcatattgcccttgctttgtgcaaccctggtgatttatgcttagttcctaatccaggatatcctatattcgagattggaccattcctgtgtgacgcacagattgcttattacaatcttctcccagagaatgattatcttatagattttgattctatcgatgaagatactgcaaaaaaagccaaaatgatggttgtatcttatccactgaatcctgtatgtgctactgcacctgatgaattctacgataaactcatcgcttttgcaaagaaatataacatcattattattcacgacaacgcatattctgagattatatatgacggacagattggtggttctttcttaagccacgaaggtgctatggaagtcggagttgaattcaactctctttctaagacttataatcttactggtctgcgcctttcatttcttatcggaaaccgtgaaatcgtaagcaaattcaaaactgtccgctcacaattcgactatggaacaagttttatatatcagaaagctgctgttgctgcacttaacggtccgcaggaatatgtcgctgacaaccgtgctgaatatgagttaagaagaaatgctctcgttgctggaattaagaagcttggacttaaacctgctgatgttaaaggcacaatgtttgtatgggctgccattcctgacggctataccagttcagctgattatgttatggaacttcttaataagactggcgttttatgtacacctggaagcagcttcggaagccttggagaaggtcatgtaagatttgcccttgtacttccccatgaagaaattgagaatatattttctaatctgtaattcactaaaaaacataatatacgtacaaaaccccgtatcctataaaacagaatacggggtttatatgtatctttgctattaacaatcactggtgattagccacggatcttcttaacaagagcaacagcctctgctgtcatatccttaatcttgtcaaattctcctgccttaatcatatcacccttaaccatccatgaaccaccacagcagaagatcttatcgcatgataagaattcctcaaggttagctgtgttgataccacctgtaggcatgattcttacattagtgtaagctgcgcacatagccttgatcatcttaattccacctgcagctgtagctgggaagaatttaactcttgtaaggcctctcttaacagcctgagcaagctctgaaggtgtaacgatacctggcataacaggaatgttcttagaaatacagtaatcaacgatttctggatcaaatcctgggcttacgataactgaagcaccagctgctacagctctgtcaacctgctctgttgtaagtactgtacctgctgcaagtaccatatctggatatgcttcatgcataagacggatagattcctcagctgctgctgtacggaatgtaacctctgcacaaggaagaccacccttaactaaagcctcagctaatggaagtgcatctttagcatcattcaatactactactggaattactccaagttcttcaaatttgtctgcaatattgctcataattatatagactcctttcatatttccccaatctctgggataattttgtccgcaaatattctatcacactctcatcgccattacaagcattataaatgttgttattccctcagcaacagcatacgcaagccatactcctgtcattccaaaaagtgctgacattacaaaaactgcacctaaaatcagcacaaatcctcttgccacagaaacaactgccgctttaaacgcatcctctgttgcactgaatgcaccgccacctacaatattaattcccgcaaagaatattccaataaaatataacttaacgccttctgttgcgtaaagccttaacatttctgaaccttcactgttaaacactgcgacaaactgtcctgcaaatataaacaatatactatacataaccgctgcaagtacaaatgctgttgtatatcccattcgttttaactgtgtacatccatccttgtctcccctgccgaaacaactgcttataagtggctgacttccctgtgcaacaccattaaatactgcagttgtgacaattgcaatattagccacaactccgtatgcagctactccgacattaccagccagcttaagtattacgaaattaaaagcaagtgtaatgaccgctgacgacatctctcctacaaatgccgatacaccaagctggcttcctgccacaagttttcttactgaaggcttacacacaacaagcctgacactgcttttcttagagaagaaatgtatgctgcatattcccatacctataatcggcgacaaagctgttgccagtgctgcaccttccattcccagattcatcgggaacatgagaatatagtcaaacactatattaaacagactgctaaaaagtgttgcactcatagcaatccccggggctccgtcatttcttacaaatgcattagtcacatagttgcacataaacataggtgcaaaacacatgaatatcttagtgtaattattcccaactgctacaatatgttcatcagctcctagaacacgcatgatatctgccgaaaagaatattccggcaaaaacgaatagcatgcttgacaatatacaccatattaatgcattccagaaataatcatctgcatctgcatcttttttaatcttactaattgcataccttatagctgaaccaacaccaatcatctcaccaattgagaatattatactatataatggcataacaagatttaatgctgtaagtccgtctgctccctttgctatagatataaaatacgagtcagcaagaacgtagcatgaaaaccctatcattccgagaatattctgcgatacatatttagaaaaattctttctgttttcctccttgctcatcgaaatctccttaattaaataatataagttacaaaaacggctcccgttgggagccgcattttacacactatcatctctcttaacacaaagcaattacatgcccataattatttacttagttccgaagattcggtctccggcatccccaagtcctgggcaaatataagcatctgcgttaagttctctgtcaagatgtccaatgtatatctgaacatctggatgcgccttatgaagcttttcaactccctctggggcagctatgatacacatgaacttaatctgctttccgccaaccttctttatctggtcaattgcatcaactgccgaaccacctgttgcaagcatcggatctgttacaacaatagttctttcctcaattggatgtggaagcttgcagtaatatggtaccggctcatgtgtctcttcattacggtacattccaatatgtccaaccttagctgttggtacaagtgaaagtacaccaggaaccatgccaaggcctgcccttaagataggaacaattgcaagcttacgtcctgaaatcataggtgtcatacaagtctcaataggtgtctcaatctctacatcttctgttggaagatctgataatgcctcaaaaccttcaagcatagctatttcttcaacgagctttctaaattcattagttcctgttttcttatctctaagaattgaaatcttatgctggataagtggatgtgtaaatattgttatattcttctcattctcaaaatccatcattattaagtacctccaaattatataatataattactcaatgtatttactcagcctcttctggcttttcctcatcagagtctgtattcataacataaactccacggctgctgtcacctgctggattcttaccgaattcataatcattaccaggtaatatagcattaagaagaatacctgctatagcagcaattgcgagtgctgtaagtgttatagatgttccaccgattgtaaatgtaagtccatcaccgaagcctaaaccacatacaaatataacacctgcaataataaggtttcttgacttagtaaggtcaaccttgttctcaacaacatttcttacaccgatagctgaaatcataccgtaaagcatgaatgatataccaccgataattgctgttggcatagttgatataactgatgaaaacttaggtatgaatgaaagtataattgcaaatactgctgcaatcctgattactcttgggtcatataccttagaaagttcaagaactcctgtattctcaccatatgtagtattagccggacctccaattgcacctgcaaatgctgttgcaacaccatcaccgataagtgttctgtgaagtcccggatctgctaagtagttttcttcaactgtagctgaaatagctgacatatcaccgatatgctccatcattgttgcaatagcaatcggtgccataacaaggattgctgtaacatcaaatttcataaactggaacttcggaattccaacccatgaagcagatgcaattgatgagaaattaagtattgctgaaccatcaggattatgtacgccgcatgcattaagaataagtgcaaatacatatgaaattactacacccataagaatagggataatcttgaaaagtcccttgccccatatattgaatataataattacagcaagtgcaacaaatgcaagtaaccagttagttgaagcattagtgattgctgaacctgcaagtgaaagaccaatacatataatgataggtcctgtaactacaggtggaaggaatttcataactctgttgactccaacaagcttaattataagtgcaagtacaaagtaaagcattccggcaacaaatataccaccacatgcataagcagccttatcattagctgacattccagcatacataccgctgtcaagattagctactgtgtagaatccaccaagaaatgcaaaggaagatcctaagaatgcaggtactttgaatttagtacacaggtggaatatcaatgtaccaaaaccagcacagaaaagtgttactgatacagacagacctctggtaagttcctcaccacaggcagcctgaaaatatcctgataccagaataggtacaagaatagttgcgccaaacatggcaaacatatgctgaataccaagaatcagcatcttcgctttaccaagctttctggcatcacgaataggttcgattttcttttgttccataatacgctccaatcaatatatattttcatattattataaaacatattatgatttagggcaatgaaaaaatattccattttaaacatttcggggcatgaaaagctttcgctttccatgccccgaaactcgtgttatggtcagaaattggattatttctcttctgcaatcgcagcctgtgctgctgcaagtcttgcaataggtactctgaatggtgagcagctcacataatcaagacctatcttgtggcagaatgcgactgatgaaggatctccaccatgctctccacagatacctatgtgaagattcggattaaccggtcttccaagctttattgtcatctccataagcttgcctacaccattctggtcaagctttgcaaatggatcattctcaaatatcttagattcatagtatgcattaaggaactttccagcgtcatctcttgagaatccgaatgtcatctgtgtaagatcgttagtaccaaagcagaagaaatcagcttccttagcaatctcatcagcagtaagtgcagctcttggaatctcaatcatagtaccaacctcgtattcaaggttgattcctgctgccttaatctcttcatctgctgtctcaacaacagtcttctttacatactttaattccttaacctcacagataagcggaatcataatctcaggcttaacattccagtcaggatgtgccttcttaacattgattgcagctcttataacagctcttgtctgcatcttggcaatctctggatatgttactgcaagacggcatcctctgtgtcccatcattggattaaactcatgaagacttgcaataatattcttaatagtctctactgacttgccctgtgattcagctaacttcttaatatcttcttcctctgtaggaacaaattcatgaagaggtggatcaagaaatctgatagttacaggattaccttcaagtgcctcataaagtgcttcgaaatccccctgctgatatggcagaatcttatccagtgctgcttctctttcttctacagtatcagaacatatcatctctctgaatgctgcaattctgtcctcttcaaagaacatatgttcagtacggcaaagtccgataccttctgctccaagttctcttgccttcttggcatccttaggagtatctgcattagtacgaacctttaactttctgtacttatcagcccactccataactctttcaaactctcctgcaatcttggcatcaaccgtaggaatctgtccatcatatatgttgcctgttgtaccatcaatagatatataatctccttcatggtattccttgcctgcaagtgtgaactttttattagcttcgtccattgcaatatcaccacagccagatacgcagcatgttcccatacctcttgcaacaacagctgcatggcttgtcataccacctcttacagtaagaatgccctgtgaagccttcatacctgtaatatcttctggcgatgtctcaagtcttacaagaacaactttctcgcctcttgcattccactcttctgcgtcttctgctgagaaaacaatcttaccacatgcagcgccaggagatgctccaagacctcttcctgctggagttgcagccttaagtgcagctgcatcaaactgaggatgaagaagtgtatcaagattacgaggatcaatcattgcaactgcttccttctctgttctcatcccctcatctacaaggtcgcatgcaatctttaatgctgcctgtgctgttctcttaccattacgtgtctgtaacatgaacagcttgccatgctctactgtaaattccatatcctgcatatctctgtaatgttcttccagagttgcacacacatccttaaactgctcaaatgcttccgggaacttctcactcatttcctgaatatgcattggagttcttactccggcaacaacatcttcaccctgtgcgttagtaaggaactctccaaaaagtcctttagcaccagttgcaggatctcttgtaaatgcaacaccagttccacagtcatcccccatattaccaaatgccatagactgtacattaactgctgttccccaagaataaggaatatcattatctcttctgtatacattagctcttgggttgtcccatgaacggaatacagcttttatagctccgtataactgttccttaggatcatctgggaaatccttgccaatcttagacttatattcagccttaaactgtgttgcaagctccttaagatcatccgctgtaagctctacatcaagcttaacccctctctcatccttcatcttgtcaataagctcttcgaaatatttcttgccaacttccataactacatctgaatacatctggataaatcttctataacaatcccatgcccatcttggattgccggatttctgtgcaattacattaacaacgtcctcgttaagtccaagattaaggattgtatccatcatacccggcatagaagctcttgctccagaacgaactgaaactaaaagtggattctccatatctccaaacttcttgcctgtaatctgttccatcttctcaatatgttcgttaatctgtcccatgatctcatcattgatttctctaccatcctcgtaatactgggtacaagcttccgtagtaatagtaaacccctgtggaaccggaagaccaatattagtcatctctgccagattcgcacctttaccaccgagaagctcacgcatatctgcgttaccctctgtaaacaaatacacccatttctttcccataacaaaacctccataatttaatattcagttatttaagtagtatatttcttagcttgttaaaattataacatagtaatcgttttcgtgcaaccataaatgtatttattttaatacaattttatatacaagccttacatttacagaatatgcttaatatgggaaaatattcatgctgtactaaatagcacaacaatagagcaatcactgaaaacacaataaaaggaggatttttctatgcctaaagaccctgttatgcttttaagctttgtcaatacacaacttcgagacaattacaacacattagaggaactgtgcaaatcttatatggtttcagaaaaagagataactgataaattaaagacaattaattatgaatataatactgaaaagaaccagtttatctagttctgtataaatatgtcttaatctgattattgattcgttgttcatgatacctataggtagtcgcattatcacttgatttataggacatatccaggcagaatccttattcaaccttcactttttcttccaatctgcctatagataaacttcctcgtgcctgcctgataggtatattcctgcaatttcatgtatttctgcctgaaatttgcctatatagattgattatttattgttcttataggaacacgcagaagtaagttcctgaacagaaacagacttttccataaaataaaagcaatgccagtatccactcttcccagcattgctttatctttatatattatattgtcagctatcactccatatccggacacttgtatcccgcattaatcatattagctcgcagcttttctacacttacccctaacttttgtgcacccttttccatacttatgctctcatcttcgaccagtgaatatatcatctggttgccttcttctcttcctttctgaagtcctttctcaattcccctgtcttcaagtctctgcgctacatcacacatattgctcactccttccttatctgacaatatctcttgatatctgttatcccctgtcataactgataagaactttagtatctcatccacatgcttaattgttgtcttatcatctggtatgtaatctttgttctttctcttgttcacaaagaaattagcaactatcttataatcacttgtaaactttgctatctgttcatctgtcagccatgctatctcaaatacattagctttagtgtcattaacatacttatccagattatccggaactttaatcagagacttaagattctttggtgctgtccattttctgtctgtaccataatacagcactatcgttattaccggcactattgttttcttatcatattgtcctctgtatgaagcaccttcatatcccgatatccttgctggcattcttttctcaacctttgtctgattctctatgccatacaggactatgtctgtacctcctcttttccaatacttagcaatatcgcgttcctgttcatgaacttttccatcttcagccttatactgtgaatgaactgtcgtattaacaagttcattctcttcaacctccgactttccatcaaataacagcccattaacaatatccgcaaatatatcgttattatcttccagtaccttttgtgttatatctttctctttcattcacatacaagcagtctgtcatgaatctttaaccataaatcatttttaatatacaattaatatatatttttgtcaataccgcaattgcggtttgcctataaagtatgctgtcagaaattcaaagaataaattgttggtttgctttcaaaaagcctactaaacttgcattacacaatagtttagtaggctttttaatttcatcaatgacaactttcaatttcaaaaacctactaattcgcatatataccataatctggtaggcttttatttcaaaagtatcatctgtatttatattcatttagcaaaagtcaaaaattccaatgcccccaaaagaatcataaagtccttacaatatcaggccttatccctcaacagccctcgcagcggctctggctgtcagctttccatctacaaggtcaataacaatatcatcacctgtattgatattgcctgcaagtattaacttggctgccagtgtctcaactgtcttctggacatatctcttaagcggtcttgcaccatacattgggtcaaatccgttttcaactatgaaatccttggctgcatctgtaagaacaatctcaagctctttatctgcaagtctcttgttaacatctgcaacaagaagattgataatattgctgatattatccttagtaagaggcttgaacataattatctcatcaagacgattaaggaattcaggtctgaaatgattctttaaatcacccataacagcttcctctgcctctggcttaattgagccatcaggattgatgccttcaagcagatatgaagaaccaatgttacttgtcattatgattatagtgttcttaaaatccacagttcttccctgtgaatcagtgatacggccatcatcaagtacctgtaagaggacattaaatacatctggatgtgccttctcaacttcatcaaaaagaacaactgaatatggttttcttcttacagcttctgtaagctgtccaccttcatcataacctacatatcctggaggcgctccgataagtctggatactgaatacttctccatatactcggacatatcaagtcttactatattagattcatcatcaaacagactctcagccagtgcctttgcaagctctgtcttacctacacctgtaggtcctaagaacaggaatgaaccgattggcttagtcgggtctttaataccagccttagaccttatgattgcctctgttaccttagtaacaccttcatcctgaccgataactctcttgtggagctgttcatcaagattaagagttttctgtctttcagactcacttaacttgctaaccggaataccagtccatcttgatataatcttagcaatctcttcctctgtaacactttcatgaacaaggctcatatctctgttacttgacttcttttcagcttcttccaaagccttctgtgcctgtggaagtttaccatactgaagttctgctgccttattaagatcatattctctcttggcctgtgctatctgggtattaatctggtcaatctcttcctttaacttgcttacctggtcaacagaagatttctcgctgtcccatttagctttctggatattgaaatcagaccttaattcagataattccttctgtaatgcatcaagtctttccttactgaggttatctgtctctttcttaagagcagcctcctcaatctcaagctgcataatctttcttctcttctcatcaagttcggcaggcattgaatcaagttcagtcttaatcattgcacatgcctcatctacaaggtcaatagccttatctggcaggaatctgtctgaaatgtatctgtctgacaaagtagctgcacttacaagtgcgccatctgtaatcttaactccatggaacacttcatatctgtccttaagacctctaaggattgagatagtatcctcaactgtaggctcatcaaccataactggctggaatcgtctttcaagtgccgggtctttctcaatatactctctgtgctcatcaagagttgtagcacctatacaatgaagttcaccacgggcaagcataggctttaacatattgcctgcatccatagcaccttctgtcttacctgcaccgacaatagtgtgaatctcatcaataaacaggattatctgtccttccgatttcttaacctcgtcaagtacagccttaagtctttcctcgaattcaccacgatactttgcacctgcaacaagcgcgcccatatccagtgcaaaaagcttcttatcctttaagccttctggaacatctccccttacaattctctgtgcaagtccttcaacaactgctgttttaccaacaccaggctcaccaataagaaccggattgttcttagtcttacgggaaaggattcttattacatttcttatttcattatctctgccgataaccgggtcaagctttccgtccttagctctctctacaaggtctgtagcatatttgctgagagtatcataagttgcctccggattatccgaggtaacactctggttgcctcttactgtagcaagggctgacaggaatgattccctgttaattccatatgtcttaaaaagctgctttatgcccttgttaggtgctgcaatcatcgcaagcataagatgctcaacagaaacatatgcatcccccattctctttgcttcatcttcagcatttactaaaaccttattaagatcattgcttacataaagctgtacatttcctgaaaccttattcttctggctaagtaaagtctcaatatttttaataaatgtgtccttatcaattcccatcttctctatcaggctcgcgataagactatcttctatagttaagagactgtacagaaaatgttcctgatcaatctcctgattaccataatcgtaggcaatcttctcgcactggttaacagcctcaatagacttctgtgtaaacttattaatgttcatacgattacctccttctattacaatgaatgcttaacttcactgtttatctattgttttcctcttacaattgatgttatacatctcattgttagcactgtcaagaggtgagtgctaatgaatttattaaaaaaatataaagccagcaaaatactggctttacactataataaataattaaattatatatttttatcgctttatgtaccttatcaatctgatataagcagcacagaaacatcattaacatttgttcccgtaggacctgttataataagcccctctgttagtttcaatgcattataagcatcattattcttaagtacttcaaatatatctattcctttattctttaagactcctgctgtatcaccatcgctatatccacctgccgcatccgtaggtccgtctgttccatcactgcctatactgaatactgctgcatttgacattcccttaataccttctgctgctgataatgcaatctcctgatttcttccgcctttaccatgtccggtaatattaacaacagtttctccgcctgctatgtatgccagcttctttcctgacttacaatgtgtctttgctatagatgcaagaaaacttccggcttcttttgcctgacagcatagctggtcagtaagcattactggttcatatccatactgtaagcactctcttgaaactgcactgcataattcacgcacacttccattaataaatgttgttacgttatccagtttctttggagtttcaatatccataagtttatcagccgtctcactaagattcagattatatttttctacaatatgttttgcttcttcacatgttgtagtatctgcacacgccggacctgaagcaatcatatccaatgggtcaccaagtatatctgatagtactattgacaatacatgcgccggttcacataattttgcaaaccgtccgccctttacttctgataagcgttttcttatcgtattaatctcaacaatatctgcgccgcatgcaagtaactgattagttatatcctgcaattcttctcctgtaatcttcggcttctcaaataaagcacttcctccacctgaaagaagaaaaagcactgtatcattcttattgagtccgcttaccatctcaatagctgcctgtgttgctttaaatgaattctcatccggaacagggtggcctgcctcaaaacattctattctttcaatcggctcttttacatgtccatacttcgttattacaattccttcatttattctgtctcccagacagtcacttgccgcctttgccatctgccaagcggcttttcctactgctacaagaataacttttccatcaaatttcctgtctttaagtgttttcttaactgcttcatccggaagaactgctttaattgccgcatcaattatattgtctgcaaccgctcttaattctttattcataagattctccttcctgacattataataacctgtcaacaacatttataattttgtgtctgccagtttttcataataatgtataattgcactgtggtcgctgcttccgtctccattattatgcagatactgcattatttcctgaacctgtgccgtcatcggtactggagctccaacactatgagcacactcaagtgcattattcaaatctttaatatgtaaatctactctgaatcctggttcaacattgtcctctatcatcattggaactttggcattcataacagtagaccctgcaagtccgccttttattgcctcaaatacacgctcagggtctactccggctttttttgccagaatgaaactttcagaaactgcctggatattacatgcaacaattatctgattggcaagttttgttgtatttcctgctccaagttcaccacatcttgtaactgatgaacccatatgtgtaagaatctgtttatacttatcaaatgttttctcatctccaccaaccataaatgcaactgttccatctattgctttaggttctcctcctgacacaggtgcatcaagcatatcaattcctttttcttttaatacatcaccaatatatctgctgtcgacaggattaattgaactcatatctataaaacatgttccttttttcatataacccgcaataccattttccccaagcattacatcctttacctgaggactgtttggaagcattgttataactacatcactttccatgccaatctgttttaaatcagcacttctcgcacctgcctgtacaagttcatcgacattttccttatgatggtcattaacaatcaatgtgtatccagctctgcaaagattctttgccatcggttttcccattattcccaatccaacaaagcctataaccatatataatcctcctgatattgttctaaatgtattgttattataacctttcttttatataataatgcggccatactgataagtccatatagttctcataagtatagccgcattatgtaacatttatattataaaattaatgaaagaataaatatttcaaccattgctgcaatacccattattaatgtgcacactgtctgtgtcttatatccctgttcaggatccatgtcaccaaaattagtaactacccagaagtatgagtcgttagcatgtgatactgtcatggcaccagcacctatagccattacacaaagtactgtcttaacaggtgaagcaagtccaagtgcaccaagcagtggagcaatgatacctgctgtagttgtaattgcaactgttgaagatccctgtgctgtctttaatattgccgcaagaaggaatgggaagaatattccgactgctgaaagcacttccgcatgctgtgtaataaatgcaaccattgagcttgaagatataaccttacctaacacaccaccggctgctgttacaaaaagtatagggccaactgtttttaatgtctcattggtaatattgtaaaaatcggacatcttatgtgccgttgcaagctggattactgcaaatattgtaccaacagcaagagcaattattggtttaccaaggaactggcatgctatgtcaagtgcgccggtccagccagccattgatgaaattgaaccaagtgccataagaatgattggtacaagaattggagctaatgcattaaatccattaggaagctttccatactctgcaactaattcttcatatgtcttagtaacctctccattgtctgttacttcatcagcactctttactctctttccaataaacttagcatatacaagacctgctataagaggaaatattgaacatacaacaccaagtcccattacaagtaaaagattatctccaactccaagtgtattagcagctgctatcggaccaggtgttggcggaataaaaacatgagaaatataaagtcctgctgaaagtgctactgtcattgctacacttgaaactgctgttctttttacaagtgcttttcttattggattaagaattacaaaaccactgtcacagaacacaggaattgaaacaacccagcccataagttctattgcaagttctggtcttttctttcctactaccttaattaccatatctgccagcttcaatgctgctcctgttttttcaagtaccgagccaatcaatgcacctaatataataactataccgatgctgctgaatgtacctgagaatccagctcctataactgttggaattccagacacctttgttccgtctggttttacagtatcaacaaatggaattcctgcaatcattgcaagaataagtgataccgccataattgctaagaaaggatgaaccttaaacttagagattgcaactatcatcacaatgatagccaacacaaatgcaattatcaatgctactcctgtcataaaaacacctcatttctattttattgttgtacggtttgcacaaacctttgtgctttgtatgacacaataataacatgtaaagtttaatagtaaaatgttacacagcacataatatcatttttattttgtattatgtaacaataatggtaaatcatatttttcattaattaattcatcagtaattatgtatgccagatacaacgctggactttctgttggtttcctgacatcaagtcctgttatttctttcagttttgatattctgtattgtaatgtattcttatgaatataaagattgtctgctgctttctgtattgagccctgtgcattaaaatacgctttcagcaacgcaatattctcacatatatcattataatccatatctttgaataccttctttaaatattcaagcttaatctctgtcggtacattgcttattaaaagttcaagactaatatcctcatagcatataatctgttcatgtttttcagctgcagccgtccatgccctatgtgcttcaacataagcttcatgcatatcatagctctgggctgaatctataccaatattcagttcaaacttatctttttcccacacatatcctgccagattttctgcaaatttaaccacattttccgtatccatattatctatgattattatctgtcttgaagcattcctgaaatgcattttataattatttctctttaaaaatgcatcaacatcagtctcaaattttgcaatctgagactgtccctgctgtgaatctttaaggttgtccagctcatctatactggcaataaatactcttcttggcttattaatatctattcccaaagccattccacgatcttctaaatcagcattcttatatcctccatttataagccattcttcataaaaagcattccttacacgcttattcataagctgtctatagcttgcacgactctccatcaaaagaatttccgtcatcttttttaacagttttccagacgttataacctcttcatatccacctgtcattcctattactcctactatttcgccatcaagttcaagtggaagattaattcctttttttataccttttgataaatcgtcttcatcaatataatattcctcaagattttcagatataatcttatacgcaccataatgaaaatcccctattctggatttatcacaacttgcaattatatgtcctgtctcgtccataagattaatattctgtttaacaagttttgaaatttcttcaacaatctgagttgcagaattctttgatatatgcataacacgtacctcctctaattattttcaagacatttataatatctatacctgactttaggtcaataacatattataattttctttacatttttattataaatgctgattcccaatataagttttcccacatgctaggcatctgaatatccatgagaataagattataataatccacaggtttctctttaaccatatctatacatacagcaccatccttagccctgtcaacctcaaattctctctctttcagcaatgtaactgcaatctcagcattaaggtcattgtcttctgcaagcagaattcttcctccgccgttttctgattgtttaacggtatttttcttgtttgaatcagcagacttctcattttttgctatagaaaattccactgtaattgttattgttgttcctttaccaagttcgctgtctacctcaatcatcctatcaagaagtgccgtgaatccaataattgcattcataggcattcttatatcatgactcatattaaacaggaatcttgttttagcttcattgcattctgtgctttctttgctgctctctctatctcatctgcatatctggcatccttatagcggcgcatctgtgactgccagaatgcaagcgtaaccagaaatgcaagtaccgcacttgcaaatgtagcaactaataattcactcttggaaatccatcctccctctggcacaatatcaaaataccagcagtcattaggaacattacattctacttccagtgtatctttcagtttacctgttatactcaatgccttcaattacattgttattatcaagcatataaccagaataatggctgtttttattctgatatatttaatgttcatattcttcatattaaattctcccagaacgccttatcttttatgctgactttaccatatattctttcacattgacaatatcagcatcttaagctacactttcttatacgctaaagaatggagtatataacgatgaaaaaaatatatggtattataattgctatagcagcatgtgttctctgtgtctgcacatttttcgcagtcagaagccagatacagaatcagaacgagcttaataatcttgaaaaagaagctgctccttatcaggatgaaatcaacgacatatacgccgatcttcagtcaagaaagcagaagcttggcagctctgataactccaatgtaggagctactcttgcattcgttcctgcttctgccaatgatattgatacaatcaaagaacttatgactggttatgattttacaccaacaatcattgctgactgttctatcgacagcaaagaactggactctataataagaaagtcacagaataacaattatgacattctgctttcaggcatgaccttcgatgatgatatccttgcatctgcaataaaagtccgcaataatcttgctaagaataattataatcttaaagaaacatttttcctaagacatacatatgatacagacgatgcccgtaaatccttacttaataacgattacagacatctcgtctgctataacgaaacatttacatctggtactgcttctaatggaatgttatacatttcctacagctttatccgttcgtcaaatgcttttaccaatcttattaatcaggctatatcgactaataatgatgccgtaatgatatttgattttgcagatatgcaggatggaactattgatgattctactataacaggctttcttgaagaactaagcagtaagatcagtgaaggctctattaattcttataccctttcacatgcatttgaagcactcgagaatgaagaaactctctctcagattgccaatgatgaatatgaacagtataaagcagagcaggaatcaagaatagcagagcttgaatccaaagttcatgaaatatacggttctcgaaagaaataagcttctatagattgaataaacttaatatttcgggttcataattattactatgattcacatctaataaggaggattttatgagtaataatatggatctgggatatgatatgttctgttatcagtgcgaacagactgccggaggaaaaggctgcaccaaagtcggtgtatgtggaaagacacctgagattgccaaccttcaggatttacttatttaccagttaaagggaataagcttttatgcaaagcatcttcttgattcaggacttaatgttgataaaagcattgtcagctttattgaaaactgtctctttacaactcttactaatgttaatttcaatgtggacgaccatgtccgtcttcttaaacaatcccgtgatattaagaataatcttaagaatatggtaggcgcaactgaatatatcactcctgccgctgcctatgaactgccagaaactaaagctgatatgctgcgtgacgcgccaatggcaggaataatgtacgataaggcattagaccctgatatccgttcattaaggcagacaattctttatggtcttaaaggcatcagtgcttatggacatcaggcaagagaactttcatattacagtgataatgttgataatttctatatcactgcacttgaagcaatcactgataatactctaaccgttgaggagcttatccgcctgacacttaaaacaggtgatatggctatcgaaattatgaaaaaacttgatgaggcaaacactaccatttacggtaatccatcgcctcacacagttaatgtacacattaagaaaggtccatttataattgtttcaggacatgaccttaaagaccttgaaatgcttttaaaacagacagaaggactcggcattaatatatacacacatggtgaaatgcttccttcccatggttatgaaggtcttaaaaaatataagcatcttgcaggtaattttggcggcgcatggcaggaccagcagaaacagtttgataatcttcccggctgtatccttatgacaaccaattgtctcatgcgtccaagagacacatacaaagaccgtatatattctactaatgttgtaggctgggatggcataaaatatatagaaaagaagcctgacggtgaaaaggatttttctgaaatcataaaacagtctcttgaacttggaggctttaccgaagagcaggaagcaaaagaaattctagtaggattcggacatgaagctgctctgtctcatgcagttgaacttgttgaagcggtaaaatcaaaacagatacgacattttttcctgattggtggctgtgatggtgcaagacctggcagaagttattttactgattttgccactatggttcctgatgactgcatgattctcactcttgcatgcggcaaatatcgtttcaataagcttgatttcggcacagttgccggacttccaaggcttcttgatatcggacagtgtaatgatgtatattctgctattcttattgccaatgccctttcagatgcatttggtacagatgtcaatggacttcctttatctcttattgtttcatggtatgagcagaaggctgttgcagaccttctcgccctgttaagccttggcattaagaatatttatctcggtccgacacttccggcattcttaagccctaatgtattgcagtaccttgtagacactttccagttaagacttataagcaatccggaagatgacattaagacatgtcttggacaggctgtttaaatgtttctcctaaaaagactgccacaaagtggcagccttacatacctcattaacattcttataattccgccagtccggcaagtgcaacatatttttctgatactgtaaaccatgtagggaaatctgttattcctgactgtggcagattgaatatccgctggaactccttaaccgctgctgccgtctgctcaccatatattccatcagtacttagaaccggaattgaattataatactccccaataagattaagctgttcctgcaactgtcttaccttctgcccggatgaacctatatcaagattagttcccggccatgaataaggaattccgcttatctgttctgccgcattaatatacacatcctgaccataataatatcttaatatatcaatcgatgaataattctgatctcccagatacttgcttccccactgtgaaagcctgttaggacatgtcactctctttccatcacaatactgtgtaagtattggctgctttacattaggtctcgatatgtaattgtcaaatatatcatctactacctgtgatatactttcgaacacatttcttccattaacccatttctggtcatatgcagttgatgaagttattgtaaaatcatagaatttgtttctgtaccattctgtatatacccggtttaatgtaaatgacataatagcaagcacatttgcctcaattgtctgcctcggccatgttgaatatatctcagagcttgctacattcttaatataatccttataagtaacataataattatctgcctcagtatctttaggcggtccgtcatgtacaactacaatttcaggaacaacaactctgtcaagcacaatttcacccgactgtcccataggcttaatctcttcttcatcaatcttaggtgggtaatctccatataatgtgttaacaggtatgactatattattctgtgaattatcccttgcagacatctttacattctgaatgcttagctcccccgaaaacatatcactgcctgatatatttacattatcaaatcctggcgcacttacagctatgtcatactctgaaaatggctgcctgttccccggttccatgctatattcaattggaggcgttcttaagtcgttaaatatacttatcccgtctccgtctgtaccactttctcctattatattatcaggatttcctgtatacgacagtcttacagccgctcctttaattggcacattttcttcattgacaacatttaccttcaatcggcctttatcaatattattttctggcacttcaaatgtatgtacatatccaacgttcataatctgtcctctttctcatcttaagataaatatatgtgacaggtacgcttattatgtcttttgcatacaataatatgattaatgttatcggagatattatggctcaatataagatagctgtagatgccggacacggcggtagcgactatggtgcaacatataatggcagagctgagaaagatgacaacttaaagctcgctcttgccgtaggtgatatattagaaaaaaatggtattgacgttgtgtacacccgtactactgatgaatatgagacaccttttaaaaaagcgactgatgccaatgatgctaaggctgattattttgtttcaatccacagaaattcatcccctacgcctaatcagtacacaggcgtggaaactcttgtttacaataattccggtattaaatcacagatggctgccaatatcaattctgagctggaaaaggctggctttaaaaatcttggaattaccgaacgtcctaaccttgttgtactcaaacggacaaaaatgcctgccgtacttgtagaagccagctttattaacaacgataaagataatgaaacatttgataagaactttaaccagattgcaaatggaatcgcagatggtattcttaagacccttggaattaaaccaaagacaaataatactactgcacaggctgcttcaggtgaagtcccatcagtgaaatcagattctgccaaatccgctgaaatcatgcctgcagcatgcgaaaaaaagcctgcacctcctgctaaaccatcatgtaactgtgatgatgacctctctcctgagccactttatcgtgttcaggttggtgcctaccgcaataaaaataatgcagaccgcatgcttaattccctgcttattgaaggattcccagcttttatcatatatgaaaacgactattataaagttcaggttggtgctttcagacagctttcaaacgccattaaaatggagcagaagctgcgtaaattccgatacaacacatatattgtatactcataaatatacgctgctccattgaattatttaacactgtatattatgctctgtacttcatcatccttcataacgaacgaaagtctggtgttacctgattcatacagaagctgtccgtcagcttctgtataatcacttccatatgctgataaaaccttatctttcttatcgccaatacggacaccttctttagtcttaacagcatcatccataagtgttatagaataaagcttatcatttccgtccttctgatatccctgcagagttacgctatcatagtaatagaatttgtccattccttcaaatgcacagcttttagcctcatagtaaccaccagaaggttctccaagcttagatgtatattctgtaagatcgccatctgtctttaactctattccttttaattcaaatgaatacttactttccgtctgctgtgatgcaaccggcttgtcctgactattatctggcagtgttgatgcacttccacatgctgccatcataactcctgctgcaagtactgccgctaacattaaactcttctttctcataatcaatctccctgtttctcttcgtaatatttattaactattgtctgccatgcattcttatatgattcatcctgtctatggtcagtaagcctgaaattcttaacaagctgttccccaagatataacgacagcttctcagctccttctacattaagatgctgcccataatcaaatgtatcagtagtatagtctatacctatattttcagcctcatcaattgtattaagatacaatattccatgcccatccgcataatcactcacctgcttatcccattcatcataccagtgaggaaatacacttggtgccttcataagcacaagattaataccattatctttgcaaagtgaatatatcttatcaagatactccatgttcctgtcactgaatgtataattagcaagtggagcagcttttggtatggtcgtaactggtcttatacctttctgcataagataaccgttagttgtaacagatggtgttttccacatatatctgaaatcctctgatgacaattcactccatcttgagtgatatctaagcagtgggaatatatagctggccatattctcttcttctgtcattgactcccttacagaagctatcttatactttgaaagcttcatgccatccagtgtcattctgttataagcctcgcttttggcatcactttctgtcattgcaagtacatttacaataacaacctgcggtttctcatactttagtgtatcctctaaaagataatacgactgccatataagctgttccgcacttccacggatataacttgatattccgtaattctcccacattgtaacaggggatatattctcatacacttcacagtcaccaagaataagcacatcatgattcttttcactgttataatattccttaatcattgcaccttctttaatatctgatgcatatttaggaactaacagacactgtaaaagatacagacatactatcggtattatgacaactgcaatacctgtacatatcttctttctcaaaactatctccattccttagaaaatgttttctaaaactgattatatataaactggcttgattcatatccggttccatagattccaaacacagctataagcagaaaaatcacaagaaacactgtatatcttataatataattcttctttgctaaccggtctcttaccggacattttctctcaagcaggcttaccacaaacattataacaacgcctgcaaaaataactatataatcagctgctgataatcctatactccacattcccttagtaaacacagctacataattgacactggtaaacatcgagaaaaacatacggaatgcctctgcaatatctctgtaataatcaagcatctgcaggcagcatactatagcagtagttcttattatctcaaatactttgtagtattttaactttctgtaacctaacctgttatctgccttctcatataacggcttaagttcctgagaaacaagcataattatgctgttcaaaagtccccaaactacgaaattccagcttgcaccatgccatatacctgtcacaaaccacacagtaagacttgaaaaatacactggaaatcttgaacctactggctttccaacgtgcttcttaagccaccttgataccttattcatccatttagacattgataatggatagaaaagataatccttaaaccatgcacacaacgtaatatgccatcttctccagtattctgctatactctttgaaaagaatggtcttctgaaattctccggaagagtaataccaaacatctgtgcaacaccaattgtaatatctataccacctgtgaaatctgcatacaggtcaattgcatataacagcattcctacaaatgcatatgcaccataatacaccgaaacatccgactgtattgtggcaagtccaatggctgccctgtctgcaattaccatcttcttaaaatatccccacagaattctctcaaaaccatattgtatattaatccatgagaaagcatggctttcaagcagacttttcttcagatcattccacctgcttataggtccctgtaccagctgtgggaaaaaggacacaaacaatgcatatctgaatggattcttctctgcatctgcaacaccgcgatacacatcaatcatgtatccagtagactggaatgtataaaatgatattcccatcggaagtacaaaatcaaccgtattaaatgttgtaaatgtgactataaacatattggtgtatttaagtacagcaagtattccaaaattaataaacaaaacaatagtaagaaacattttctgttttcttaaagaaatgttcttaagctttttcttttcatctctggatatatcacctttatgttcttctatgaagcgtacagacctgtctttctccctgcatataagccttgcacctgcatacgtcgttatgatagttgttactatgaatattattccgcttaatccggcatacaaatagaataacatattcatacataacagtactatccactgaatacgtttaggcgcaacataatataaaataagtgcaatcagaacaaataaaataaactgataagatgtaaataacatttatcttactcctccctaatatgaaaactcttctgaaggagttgccggatacgcagacatatctcttctatatattgaatttcctctgttaatataatcctgcacctgtgaatctgtcagcataaagcattcaaatccatcatacattctagttgaatcaaaatgataccagcctgttccaagattacataaaagccagctatgatctccagaccttgcaccctgattatcaacccatatacactctgcccctattccatccaggagtgctctgtcaacagaagcatatgtgaaacagtcaccagctacatatccattcttcttaatcacttttaatgcctcaaatgcttcatcctgccattctgaactattcgtataactgttccctgtatatccaatcttagaatgtgcgtacttatatattgcccttgctttctgtcctttagacatagaattgtctgtaatatcctgaagaactgcagctacaacttcatcaagagttgaataactgctgtttactttaacttcctgtgtctcctcttcaataaaagtaaatgtaacttcttctatagtctcattaccatatgaatctactgctttataataaacaatataacttcccggctgtgaagtattaacctgtgatttatcaacctcaacatcaatctcctgccctgagaaatctgttgcatacacatctgtcatatatgaaactttgctgcctgtataatatgtcttatctgatataccatgaattaccggtggctcaacatgaatatctgacggcaggtcattaacatctgactcactgccctcttctgactgattatttccttctggctggacagcttctgtcttaatacttccttctgaaatattattcttgttgttacatcctgtcactgctgcagataacataactgtaacacttatcaatccatatacaagaactcttcctgcaaaatatctttgtttaatcattgttcacatgcacttgtataattcaaatgccattctcctttaatccgaataacaaaattataactcacaataatttatattgtcaacttgtaaaaccggctcttactataaaaatgctgataccagatatagtttcccatatctgataccagcatatacattttacatttagattcttaattaatcagtattattctgttttaccatcagtttcaggctctttagctgctgcactcatctcttctggaagacctgtgaaattaacgttcttagtagtctttgcatcatatgtattagccttcatgacttctgtcaggtcaaaacctgtagtttccttgatactctcaattgtcttagcaagaactgacggtacattaccactgaaagttcctactccgttctcacctgaacctccatcaataatagtaaccttatcaatgctttcaagaggctttgcaattgcttctgccatctgtggaaggactttaataatcatctctgtcatagcagctttaccatacttagccattgcctctgctttcttttccatagcctcagcctcagcaagacctcttgctttaatgctttctgcatctgcaagaccttttgccttaatgctttccgcttcagcaattccctgtgccttaacagcctctgcttcctgctctttagcaaatctgtctgcttctgcctgtgctttcttagcctctgcctgtttctgaatttcaaactgctttgcttctgcttccttctgtctctggtaaagttgtgcatcagccttctgctgtgttgcgtatttctctgcttctgcctgtttacggatatctgcatcaagtgttttttccttaacagcaatctctttctctcttaactcaatctctttctcctgctttgcaatattagcatcagcagttgtaatttcgattgtttttctctgttcctgctgctggatttcgtatgcagcatcagcctcagctttcttaacatctgctgctctctttaattcttgtttcttaatctcaagttcgttatttctttctgcaatagcagtctcagcttcgattcttgcatcatttgcctgctttgttgcattagctttggcaactgcaatatccctttctgattctgctcttgatatctgtgctgatttactgatgcttaccaccctgtcaataccaaggttctcaataacatttccctcatcagtaacattctgaacattaaagcttactatttcaagacccattcttgccatatcaggagcagcattttcctgtaccttctcagcgaacatctttctgtcctgaacaatatcttccagcctcatctgtcctataatctcacgaacattaccctctaatacatctcctactgagtttctgatataatcttcgttcttgttaaggaaattgcttgctgctttctcaagcatttccttagaagaaccaaccttaatctttacagcagaatcaatgttgacattgatatattcgttagtcggaactgattccttagtcttaacatcaacagaaatcatcttaagttcaagtttatcaactctctgtaagaatggaattcttaacgctgacttaccaataacaaacttaggattctttcttaaaccagaaacaatcaatgccctgtctgttggtgctttaatataacttgcaagaataaacacaacaaataaaatcacaactaccccaataataattgccaatttcatattatataccctcatctttctaattactcattagttaatagctgccattaaaacccaagtcttgcaccaccagaagaactctttccattaaacaattcattatatagcttatcactgaacacattagataaaacatttaaattcttcataagctcatatgccagtgttgtgctctgggtctctgtaagattagcaagattgtaagcacctgaataatctgatgcagaatattttaacttgctgaattctttctgtgttgcttcacctgaaagcttcatatctatattgctgtcatcaatattgctgttcacataaagattatcaatcttaactgttgttcctgatgaactaagttctgctcctgctttgatatactctttattctgagtcatctctaatgccagtgcagccttatcatcctgtgtctttactgtatacttcatattaatatcatcaacatcagcttcgataacaacatattcaaatggattgtcattaccaagaaatgagattgcaacaaatcctttttcgcttgtattataatctgctgcatcaattgcaagtcttacaatctcatcattcttattaatatacattgacaatgtaactggctgcatatcacttaatgaactctcaatactgctcttgatagttgtctgtgaaacgcctgccattgtaagaattgtcatataagaagaaagatctttacttgcatataattcatcaataactgtttcgcatgccttaataacagtctccttagttattgtaatgctatactcagaaaccttgatatctccgttatccgaattatatgtaaatttatcacccttcttgtattcacactcttctgcaaatgtgttaatccccttaactacacatttaactgctgcattaactggttctctgtataattcaatattgcttgtatctattgctgagaaatactttgaaatactacccaaacttccataagaaaatcccgaatcaatttcatcctcaaactgtgccagtgagattacgaatgactctgagaataactcaggcactttgaaatacatattattgccatctgaataaaatgtaactgtaagtgctgtagctgatccattctgtagcttaatctctcctgccatcttctctgttgaagcatccatctgaatatcatatgtaactgtatcagccttgatataatctgaatacttctcgccatcaattgttgcagtatcaagctttaatgtacctgttatctgattcttgtctgatacagatgtaagtgacatattatccaatgcactgcttgctgtatcctcaagacctgttccaagcttcttgatagctgctattgcatgtttatctggtgataacacattaggaagtactacaaatccgagtactgctgccgctaccgcaataactgctattatagcaacaacaattggccatttcttctttttcttcttaggctgtggctgcataggaggtacttcctgatatcttggtacatctgcattcactggaggaactgcccctgactgtggctgagttccaaactgctgctgtacaaccggctcactctgtaccgtctgtacaactggttcgttctgtacaggtgtttcctgtactggctgtggattcaaaggatttccacactttggacaaaacttagctgtccctgcattatatccgcattttgtgcaaaacataacatttctcccctctcttgtttttttattatagtatcaaataaaatgtatattttcaatgaaaaaaatatgcaagaaacttttctatcatatccgtttctgcacgattcaaatcataatttacattttacagtactttttaaattcgtagcacaaatcaaagtatgtatgttcctcactcatctgtgtgactttccattctggtatcttatccagattaggaaaatgtgcatctgcatcatatttataatcaacactcgttatatgtgccacatcgcaatatggaagaaactgttcaaatacagattctccgccaattacatatacatcctctgacttatatgatgcaaccttttcaagtgcctcttctactgaatgtactacaacaactccgtccttcttatatgacaaatcattagtaagaataacattatatctgtctataagtgctgttctgtctgtaatctgttcataagtctttcttcccattattgcagcttttccagctgtttccattcggaaaagcttaatatcttccggaatattaacaagaagatgtccctgttttcctattgcccagttcttatctactgttgctatcagattcataattacaacttcccttctatctccttaggaacataggcaagcaccttaattccatcttctgtgtactcttcactttcaagctgtccaaactgtcttataagctgtatcttgcctgcttcactgtaaggaaatactctttcaattcttattctgctcttaagaataatttcctgtatgcactctttaaatgcttcaaggccattgcctcttatggcagatatattgtatgtgtagtctgcgtgtaaatctttagctgccggtttctccggcaaaacatcacatttattaaataatgtaataacaggctttccttcaacacctaactgctttagtgttgcatatactgttgacatctgctgttcatagtccgggttggatacatcaacaacatgcactataatgtctgcatactttgcctcttcaagagtacttttgaatgcttcaataagattatgtggaagctttcttataaatccgactgtatcagtaagcaacactttctctccattaggaagttccatacttcttgttgtagggtcaagtgttgcaaaaagcttgtcctccgacaacacacctgcatcagtaagcttgttaagaagcgttgatttgccggcattggtatatccaactatagccgcaacaggtgttgaggtcttagctcttttgcttctctggacatctctgtgctccttcatatccttaaggtctgctgagagctttgatattctgtctcttataagtcgtctgtctgtctcaatctttttctctccgggacctcttgttcctattccgccaccaagtcttgacattgatgttccaaaacccgcaagtcttattgaacggtactttaactgtgccatctcaacctgaatcttaccttcacttgatgtagctcttgccgcaaatatgtcaagaataaccattgttctgtccataactttaacaccaagttcatcctcaagattcttaaactgggcagggcttaattcgtcatcacatataattcccgtagcatcaagctcatcaatcataagtcttaattcttcaatcttacccttgccaatatatgttgcagggtgaaagttatctcttgtctgaatcatccttcccacggtctgtgcacctgctgtcttggcaagctctccaagttcatcaagagagcgctctgtgtcgtcatctgtgtcaaatgctactccaaccagaataactctctcaataatctcatctgtttcataaactgtcatatatatatttccttttattttttatttctttctgataaataatcactaagatagtctgttacttccttctcagttgccattgacataaccttatctgttacaagtccggcttctttaagtgaccagtctgcaattgtctttcttgtctctaatacctttcctgttgatactgagaattcatccagaccaaatgataacaatatcggtgccattaaagcatttgcagctgcctctccacacattccggcttcaatacctgcattatgagcacattctattatccttcttataagtcttaacactgccggattgaatgcagaatacagatatgctacattttcattgcatctgtctactgcaattgtatactgtgtaagatcattagtaccaattgaaaagaaatcaacctcctgtgctatagcatctgccataatagctgctgccggagtctcaatcataacgcctgtctggatattcttgtcataactaattccattatggtcaaggtcgctgcatattttcttaatcatatctttaacctgtctcacttcattaactgacgtaatcataggtatcataattcttatagagccatatgcactggctcttaatatcgcacggagttgtgttgtgaatatatcaactctgtcaaggcagaatcttattgcacggtatcctaaaaaaggattggtttctttcgtaagtcccatgtacggaatatccttatctccaccaatatcaagtgttcttattgtaagcggcataccttttgtcagcactgccgccttcttatattcctcaaactgttcttcctctgtcggcagcgcattcttattaagaaaaagaaactcagtcctgaaaagtcccacaccttcagctccagctttaacagccttagctgcttcatcagctccaccaatattggcagcaagcataacctttttcccatcagctgtctctgtgcttttattaataaatgtcttcaattcctcaatgtgttcttcatatttcttctttttcttttcatatatagaaaatgtacgctgtgttggattaataaaaacttctccataagctccgtctattattatagaatctccattttttactttctgaagtattcccttcacactaagtactgccggaatctcaagtgctcttgcaagaattgaagcatgtgccgtatcgccgcctttttctgcaacaatacctgcaacatgtgctatgtccatggaagctgtcatagatggcttaatctcatctgcaacaataacagtattatctggaagattagtaaggtcaaacgctttcgttccctgcaatatctgtatcattctttctctcatatcctgaatatcagtaacacgttgctgcatatctggattatccattgaagaaaacaattgaatcagcttattacacacatcatcaaaagctgcttctgcacatatgtgactattatcaattgcagcaacgacttcattctctgttgttatatctcttgcaagatatatctgattcttaagcaccagtgcatccttgtcagactcaccaagttttttctccagttcagataataattcttccgtctgctctataaatgtttttcttgcctcaaagaatcttttcttctcttcttctgcgttataatgcgttcccctgtttacaacagcactggcattataaacaataagaacatgtcctattccaattcctcttgaagttcctattcctctttccatacatatgcccccattctactgattaaacacataccttatcatgttaacaatagtttctgatgtatctcttgaatatattgtctcccttgcaagaaccggattatctgtgataacgccgtcaacgcctttattagtcaggttcttgatagaatctttattattaaccgtccacgcatacacttgtttacctgaattatgaattgcatcaatagttctctttgataaaaatgctgcattaacactaaagaaatctatattcttcatatcataataatcgccatacgccgctgataatatatatccaactctaatattttcatcacatgattttgctgccgataaagctgaactgctaaatgatgttattacgcaatcattctccatattatatttttcaataagagcgaccgttttccttgcaagttcttctccattatcagcaggttttaattctatattaagctttatctttccctgtgcaagttctagtacttctctaagtcctggcactttctcacctttatattcatctgaataccatgaacctgcatccagccttctaacctctttatatgtcatatttacaatattttcatccacacctgttgtacgatatgcattagaatcatgcatcactatgacttctccatcacttgtaagctgtacatcaagttcaatataatctgccatatcatctatagctttctggaatgcggccatcgtattctcaggtgtctctgttgaagcccccctgtgagccataaccttagtctcatgaaagatagctacattttcaaatggattattgttaaatgtcattattagataaaatgcatctgcaacaacagcagcagttaaaacaatactatatattatctttcttctttttgcaggaccttcctgtatatctgtgaactcaaatgtaatatcgtctacatcagtatatttgtaatacatatgtgaaatagccgaaaaagacagtggtattgctacacatacaagaatacattttataattagtctttctgtccttaatgcagacagaaatatagcatttccaagatatgccatattaagaatcttaacacctgcaacaagaaatactgatataagcacataagttattccaataattgcaagcataaccagattatacacaacaagtgctgatattgttcccattggatgcttcttaaccatacgggcacttttcttatatgcttccctaaatcccagtccttccatcatgcatatattcattgcatatattcccggaataacaattgcgtatataataataaacacaaatataacttcaaccttaatataccagtgattcctaatgatatacattttaattaaattagtattagtctcactgtataagacattaaaccatacagttacattggaagccagaattgatatgaagtaaaatatactcagtccaacatgccttggcttaaaaacatttttaaaaaccttataagaattataaaatatatcaacaagagatgcattacatgatgttctctttgtctcaaaacagactgaaagatatgtcatctcataagtgcaatagaatacaaatataccaatagcaagaaaaattgcaaatatgactacaggatgtgtcattgctctctgaatatattcattagtaagatagttcactcctgctatcttcataagaaaattaattgcgaataaaacaatggggaatataacagcaaaagcaacaagcttgtatgccagttcaaatgtccatacatgcctgctgctgtcaattaaaagactaaaattgtttcgtaactttttaaaaatcatataattatccccgaatcaattgtcaataagatgctgattatctgtgaaacatcttaataaactttctcatctccgctctgatatccatattctgcatattaagactttccgaaaaactctgcataaaatccgcagtatatgaaaagacaagaatcattgccataacgctggcaatcctgtaatcgattgagaatacaaaacgctccacaaatttattcaaaaatccgaatataaatacggcaacaaacccccaggcaagtgttgactgtaagcatatgatgcctttgtaattaaacttaagatgatcataattccaccacacttcaccaaacagctttaacataacccgtgctgtaagatactcaaatgctgtagcacatatacatccgaatacataaagtgcaatataattatgctctataggcttaaaaatattaaaagcaattagtgttccaaatccgtatattatacagaaaggaagcttggcaaaccctctgttttcccagtacccaagctgctttctgataactacacattccatacaccagccaagaaagctgtatatgaagaaccatataaccagctggcttatattcatgcttctaaatgttatacccaataaatgtgacataacgcccctccatcattaaatggaaaccaacggacttctaattaaagaagtccctcaagagtctgccttactgcactgatgaaatcctgtgtattaagtgttacaggattctccattgttgtaataagagcaagatcctttgtcatctttccatcttcaatagtcttaatgcatgcacgctcaagagtatcagcaaattttccaagctcaggaatattatccagctctcctctttttcttaaagcgcctgtccatgcaaatatagtagcaatagggttagtagatgtttcttcacccttaagatgcttataatagtgtctctgtactgttccgtgtgcagcttcatactcatagtatccatgaggtgatacaagaacagaagtcatcattgaaagtgagccaaatgctgtggctaccatatcactcataacatctccatcatagttcttgcaagcccagatatatccaccctctgaacggataactcttgctactgcatcatctataagtgtatagaaatatgttattcctgcttcttcaaacttagtcttatactcagcatcaaatatctcctggaatatgtccttaaatgtatggtcatactttttagagattgtatccttagttgcaaaccaaagatcctgctttgtctcaagtgcaaaattaaaacagcttcttgcaaagctctctatagaatcgttgagattgtgcattccctgaagaacacctgcacccttaaagttatgaataagctctcttgtctcttcaccagcctcattagtaaatacaagttctgccttaccagcttcagaaaccttcaactcagatgccttatatacatcaccatatgcatgtcttgcaattgtgattggcttcttccatgtcttaacatatggctcaatacccttaacgataataggggctctgaatactgtaccatcaagcatggctcttattgttccgttaggactcttatacatctctttaaggttatattctgtcattcttgctgcattaggtgtaattgttgcacactttactgcaacaccgtacttctttgtagcttctgctgaatctatagttacctgatcattagtctcatttctatgtacaagacctaaatcatagtattctgtgttaaggtcaataaaaggagtgagcagctcgtctttgataagcttccacaatactcttgtcatctcatctccgtccatctctacaagtggagttgtcatcttaattttgtccataatataaagaacctctctttctttttcttacctgattaattattataatttatttcaaatgttttgtaaacagaaactgacttgtattagcctgattactttgttataattcataagtaatttttacacactacatttaacaatgcacagattgtgcagtcataattatggaggtacagatacatgtgtggattcgcaggttttactggatacttggctgatggtgatgctgttcttgaacgtatgatgaacaaaattattcacagaggccctgacagtgctggtaaatacattgatgataaagcatacatgggctttagaagactttctatcattgaccttgataacggaagccagcctatgtttaacgagaataagaagatagtaataacatttaacggtgagatatataactatcaggatttaagaaaagaccttattgagaaaggtcacgtatttgctaacaattcagatactgaagttctcattcactcatacgaggaatatggcaaggacatgcttaataagcttcgtggaatgtttgcattcgtaatctgggacagcgagaaagaaactcttttcggagcaagagacttcttcggaattaagcctttctactacacagttgcagacggcaacatgatatatggttcagagattaaaagtatcttagagcatcctgcttataagaaagaggttaatcctgttgcacttgagaattatctcacattccagtactcagtacttgatgaaacattcttcaaaggaatattcaagttgatgcctggccattgctttacattccacaagggtgagcttaacattgaaagatattgggagccaacatttgatgctgatgagagcaagtctttagatgaatttgttgatgaaatcgacgatgttatgcatgattcagttgaacaccataagattagtgatgttgaggttggttcattcctttcaagtggtgttgattcaagctatgttgctgctacatttaacggtgacaaaacatttactgttggatttgattatgaaaaatacaacgagattgactatgccaaagctttatctgacaaaattaagattgacaattattcaaagcttgtttcaagtgaagaatactgggctgcaatccctaaaatacagtatcatatggacgaacctttagctgaccctgctgccattgcactttactttgtaagccagacagcagccaagcacgtaaaggttgccatgtcaggtgaaggtgctgacgagttcttcggtggatataacatttacagagaaccacttgaccttgcagaatttcagaagctccctaagggcttaagaaaaggacttgccaatattgctaacgctgttccattcaaattcaagggaaaaagcttcttaaacagagcaagcaagacggttgaagaaagattcatcggtaatgctttcatgttcaacgaaaaagagcgtgccaagatattaaagaatcctaccggcaagtatgaccataaggaactcacaaagcctttctatgataaggttgctgataaggatgatgttactaagatgcagtatatagatattaatttctggctgataggcgatatcttacttaaggctgacaagatgagtatggctcattctcttgaggtaagagttcctttccttgataaggaagtattcaatgttgcccgtactattccaactaagtacaaggttaacaagagtaataccaagtatgccatgagacaggctgcccatagacatcttccagacatggttgctgagaagaagaaacttggattccctgttcctatcagaatctggctcaaggatgagaagtactataatatgattaaaaaggctttcacaagtgaagctgctgaaaagtatttcaacactgatgagattgttaaatatcttgatgatcacaaagaaggtaaggccgataattcacgtaagatatggacaatttacatgttccttgtatggtatgaagatttcttcggcaacggagttaaagaagctgcttaagatatttttcgtcgcttttttcgtcgctttttcaacgaaaaaagcgacgaattattttaatctatacaacttgccttttgttttcccattatcaatgagtttatcaagtgcaattaattcctttaacaattcctttgtcctagtatcctttaatcccagattatcagctatttcagctgttttgtgccattcaccatcatttaataattttaagattttttcatattgttctatctttttctttgatgattttttcgtcgctttctcatagctatctggcagcaaaacttcatcatccgcttccaaaaatgccgggtggattggaattcttattctcatagctcgtctatcttcatccgtaaagaactccgctcttggtgagccattcttttcaagttcttcctgtatagttggtatacctgaagaatgaccttctgacaaatccagttcttttaaaaactcgccaagtcgtctatttctataatacctagaaacaaatctctttccctcagatattgtcttctctgaaatagatctgtctatccccggaaaattcattatatttatgcaatccggctctatctctatagttactggttcaaaggacatataatctctgtgataaaaggcatttacaacagcctcctctatcgcctgatatggataattgaatatccttaacgcctccatctgatttggtactttaattaccttctctcgaataatcaaattacgaaatctttccattgttgcctgaatcatctgtggcaccgaacctgtaatattagggaaatcttcactaatacttggattttcaatgcttcctttaggaaaagaggtcatctgtacataagtatatccaaagaatttttctggatgctcacagaacatcataattgccacattctgaatatatctgagttctggaggaccaaccaatagctgcatatcattaagtattttctcaacaccacgttcccttacctgtttagcaagcttactaccggtttttctcaaatgatcttctaacagcaccggtgaaatatcctcaaatgttgccttatggtttgctctgcaatcaaacggggtttgatctgacatattaatcagttctcgctcctgttctctatttgccttaacagaacttgtctgataacgaatataataattgtacttcttttctttcttacttgttacatgctctggtgatttataaggtcgctgctgtcctgttctaacaacaattacaaaaatccattttccatctacttctgctggtatcccctgtggaaagtagggtggagaaatcaaattattgtaccccaacatatctttctgtattgaatccaacatatattcaggtaagccctttaccggacgcttggcaacaccattttcttcctcaacgcctacaacaatataaccgccgccatcattattataatcatttgcgaatgcacagacactatggtagatatcgtcaggattccacccagtcttaaactctattcggtctgattctaattttcttttgtttaataaatcctctacatccatttcaagttccatagcgtcatctccattcctacacagctatattctaaacataattatcatttctaattttcttagtatcttatttgatttttatttccaaaacttatatttactatctcttaactctctctgtctcttctcttcctttgattgaaaataattatttatatcggcttcgcaatactcaccttcaagttcaaaattatattcatgcatagacatatcataaactttaatatctttacgttttgccaaacaatacaaatactctctattatccctatgcattctgcatccaatataaattgcctttatcgggaagaatggtatcatattgtcatatattttacatatatccacaggcagcaaaagtcgccattcattttcatatttccacgatgaagattttgtgataaatgacagcattaaacttttatcaagttccatctgttcatatgctgtaagcgggattttgtttatatacttgtatatttttcttttacttaaaataatctgttttgctccatattcgcaaggcaataatccccctagaatcattgcattttctcttgaatctgcaataggtcgtgttaaatcgtactcaacacaaaaaccttcatgattttgtgcataatgtgcccataattccatataagaagtcaacttaaaatcatcaatattagcaaatgaagttacttgtatcatattttttcttagctcttttagtccattttcatattttatcctatcataatatagtttccgactaatttcatcgcttcctttacgttcttttcttaattcaggatcataacagatatgagtaacaacactatcaaaagtattatatatacttccattatgctgttcccaatcaccgcaataactatgttccaatttattcaattcatcttgtgataatatctctcgtccaacagcgtccgtttctttcagataatccaataaacagtatttaagaaattcattttcatttgcgcacaataagcaatcaaatggatcattaaagttactagggttattcataaaaacagaattggtttcaatacattttaaactattatgattaaatggaaaaaatttaaacaaacttttgggcatatgttctgttttatctatataaccttcccacatcgattcatataaatctatttttttatctgaagcatattggattctatcttttatccaagctttttcccatttacccttataaaatttactcctataatcggacttatcgtatgctgatgtttctcttctatactcccatcttggattttctctacgcatcaatacgtactttcctttctatttactacaactctttaacaatcctcataaactcctcataagaataagctccattatatccaggattctttgtttcaaacaccatataatacttatacattcttccagccatctctgcccactttgctccggtttcggctttttctctggattcagaattttcaagctgatcacctttagtttctattagtaatagtttaccgctttctgttctcaccataatatccggatatgcgtttacagcaccatttatggcaaatccttttcttgccatatttctatgccaccatttaatattgtttaatgaggataattccatgactacctttctttcatattcggtatcaaacttttcctcttcgttatatagtgattttggaatcgatgcaatagtatttgtcggtgatatctctcttggtaatttatatgatggctggcaagaaattttgtcttgttccacccattcataaaacattttcttagcatattcatttaaaagtgaattaacttttttattaattttcagaacatagatacctggtgtctgttccatatctgttaattgatcctctgtaagattctgaataatcctgtctacatatacctccaaatctctatcatttatcgcattattctttgataatttctttattatcatatccttgcacagacgcatttttctatctgacggctgttcatcaaaccactgttttacattttggctatcaaagccctgcaatttccatgcttttggcaatgcatctgaatcatcaatatcaattcttgcaatttctgaatctatgctgtcaaaatcaattacagtatccttatctaataatgaaaatcctgcatacagattttcttttgttaatacttgatgctcatgttcagaaaatagagatctgcctgtttctatcataaattgaggtatctctaactgtccggcttcactagcatataactgatttattttgtaatgcttcatcttatttccaacctctggtggtactggcagatattcttctgttttctcaaagtcttgccaatataattcattctgtgtttttgcatggtcaagcatatctgttaccgcatcattaaccttagattgactctgtgattccatattttcattatttacgaatggtgatatttgttccctcacaaagtctacatttaaagaatctatctcatccgaaacattatttgtatcatcagttacatcattatctaactttaactctgtctgtatattaccagcttgttctactggaaattcagtatcctgttccacataatcgtctatacgataatctttacttgtaaagccagccgcattaagtcctgctactaccttgtcaagtgttgcataaaaagcatttgatgatgtaataacatacgaaaggttcaatacctctcttttattctttctcgtattaggaagtctgagaattcttcctaaaatctgttctacatctatgcttgatgttctatttgcgactgttgccaatatatatgcaaatggacaatcccatccttcctttaatgcattaactgtaatgatatacctgatactacaatcgtggctgcttaaatctatattttttaactcatccctgtccgcagtctttattgcaatttcagattctggtatccccatatcaataagagtatgctttatcttatcataggttgtactgtcatcattggttctaggctgagcctgaaataaaacaattggtctgatatatctgccaccatttttctgttcttcaaccgcttcattttctaattttcttcttaatgaaatggctgatacaaagacatcctcctgagattttctgttataaacaattacaggtaatttaaccatattttctgctttaagctgtcttgcatctacaaatgagataatattacttccatttttcggtgtagcggtcaaatcaagtacaaatgaaggattgaaattctgtaacatttctttactgagcttacttgtagcatgatgactctcatcaacaataacaactggattcaatttacggataacttgtatcaaagctgtttcatccgtatcttccaacaacgaaccactatcctgtttaaatctcacaaatggcaacaaactaccattctcttgatacgcttttcttccatcctttttgctcgtccgaaatgaatcatagctcaatacaaatactgataaattatcactaaccgaagttggattaaaattctgtccatttaacaattgctgcttagaataaatctcgaccttattaccaaaatcaacatctattttcttcctataatcatgattcttatccgttaatgttctatatgtctgagtaagtattgcatctgatggaacaagccatactactgctttaggatgtatatgtggcatagaatcaaatattggcttaattgaatttgccgccagaaatgtttttccaccgcctgttggaactttgaagcacacctgtggaactcctgctaattccgttttgtatggtggcattccatctatccccacattcactcctttttcattccataaagtgctgtatgctgaacttatactctgcttctctataagcagctctaaaaatcgttctaaatctcttataacctgtatctgataatttttaagttccataccttgtcctttctagatatgctcaatatctcttggtattttcttaaatgtaatattccacttctgtaaatcaatatctgataatgcgcaagaatcagcatatataatatatgcctggttctttacatttaccgttgccaaaaaagaatagtcaagtattgtagccttgtccttttcataataaaaataatatgctgtatcattatgagagccaatataatatttctcctgtttgttctcagtatactcaagcccattggtttctgtataccagatatattttctaatttcagctgtatctatatcattgttgatagttccatcctgcaaaaacaatggacttcctaattcataatatgagaagttaccacctgttccatctactgcattctttccttccccataaccatcaatcactctttttacacgttcggctgttattgtgtcagcataatcctctacctctatcataatataagataatttcaaatctgattgcatcacagcatgtgcagtagttgccgaaccagcaaatgagtcaagtacaatatctccatcatcgcaaatgattctcaaaatctgattaataagacgtactggcttaggtgtagcaaaaaaatccgttgaagcatctaatattttttttaattgttgttttgcctcttgtgtatgtccaacatcaacatgtttccatatagtctgcggtattataccagacttcacatctgctaaaaatttttttcttcttggttttgaatttccatttgccccaaaccacacttcattattttttatcaatgccatcatttcttctttaggatgtctccagcttgttccaggttgtggcttgtacaatttaccttgcggagtaggtacctcataaacactgttatctctatgttccattcttagcaaatccgtcgaaatccatggtccccttggatcattatctggatttttatatcgttctaactgtttttcacttttaggcaatgcttttattttcagtttttcaatttccgcagcatatactaaaacatactcatgttctgatgaaaaatactttgcgtcatttttagtcgcaaatgtcctttgccacaccaattgtgccacaaaatttctagcgccaaaaatttcatcgcatacacattttaaaaatgcctgttcattatcatcaatgctgataaaaatagctccatcatctgccaacaatttttgtaacaacacaagtcttggatacatcatacataaccatttatcatgccttgataaatcctctccctctttaccaacgacttccccgagccacttccttatcttgggatcatttacgttatcgttatatatccatccttcgtttccggtattgtaaggtggatctatgtatatacatttgatttttccttcatactgtggaagaagcgacttcagggcttcaagattgtcaccatgaattatcatgttattgctgtgaatatcctctttgtgcataccactctcatcaaaactatactttctttcaagtactttatacggaacatctttatgatgattaattactttgtcttttcctatccagtctaatgtaggcatatattgctccttatctgtaactactgtaatgtttctattgtttcaattatattctctgctttatccgtcaaaacatattttcctcttgttttttgctctatataatcttgcttttgcaaaatactaaacatactgttaatcttcatcttgctacattttaaagttgtcgctatctcctgctgtgttaatggaatcactttttcatccagaatcacgacttcattatcatgcataaactttaaaagatcataataatcattcagaaataatttgatacccatgttttctccctacattacaaatcataatctatttgtaaattatatcatatttttgtgatgttataaatatcatttttttgttatctatttatccttaacgactaaaagcagaggaatcaccttcctctgcccctattccacaacctatcttcaacctttactttatcaacatttctaataacactctcatcataaatcctcttgaacttctcataaagtttttcactatccagtttcatcaacagcagttcttttaaattcataactataacaaataaaataccctccttactggtttatccagtaaagagggtacatatcacatatcatatgtccgtgccttatttgatattatgagtaaaatattacgctgtaattgttgttcctgtctttccagcaagaccttccttagccttctcaagattagcaataatagcctttctttccttatctgctgttacgaatctaatagatgcgtcaaccttagggaaagttgtaactgctgggaagtgaccatccttaatatactggtgaagatctgttgcagaaactgtatcaaataccttctcctctggtgttccctttcctatagtaagcttatcatatgctgtaaggaaaagtaatgttcccgctccaacaagctctgctaacttggcagctgtataatccttttcaataatagcacttgcacccttaagatgtgaaccttgctgtaatacaggaattccaccaccgcccgctgcaataacaacctgatctgcatcaagtaatgccttgacagcatcaatctcatatatatcaataggcataggtgaagcaattattcttctgaacttacctggctcttcttcaactacataatttcccttctcttcttcagcatcagcttcttctttagacatatatctaccaataaccttagatggttcactgaaagcaatgtcaaaaggatcaactcttacctgagtaataatagttgaaactgtcttatatattcctctgttaataagctcttctcttatggcattctgaagatcatatccaatataaccttcactcatggctccgcatacagacataggagcaactgttctgtcatcaggctcaagtcttgcaaactcagtcattgctgtctgaatcatacccacctgtggtccattactgtgcgtaataacaacctgatacttagcttctacaagatcagctattgccactgctgctttcttaacattctgctgctgctctggaaatgtttctccaaatgcatttcttcctaaggcaactacaattctcttattatccataacataaacctctcatacacgattattattgatgtaaatattatattccatgaaccgccaaaaagcaaattatttcaacatgtatatagccattatggcattatagaattagcaccatcaacaatcacactctgtcctgagaaataacatgaatccggacctgctaaaaatgcaatgacaggagcaatatctatctctggatcaccaaaacgcttcataggattaaggttaacctgcttcgcatattcctctggaaatttctcagcccatgccttagctgctggtgattccgctcctggaagaacgatattgacacatataccatactgtccccattccttagctgcaatcttagtcatacctcttaatgcttccttgttagaaccataagctaactgtcctgcaataccaaacatacctgttgcagaagcgaagttaataattcttccttcatgctgttccttcatataagggaatgcagcctgcatatagttaagagatccgattacaccactctgccatgccttaagcatattatcataagaagtttcttcaactggagcagaaggaacaatagcctgtgcattattaactacaacatcaactgttccatacttttctgcagcagccttaacaacctcttcaactcttgctctgtctgctgaatcacatgtcatggcgaagccttctcctcctaattccttaatttctgcaattgtctgctcaattggctctgctctacgtcccgttgcaataaccttaacccctctttttgcaagacaaagagcaattcctttacctattccctgacctgctcctgttacaatagcaactttttcctttaactgtttcattaaagtacctccataatttttatatttaaattatatcaattttttataaaaaagcaaatgaataattagtcacatctaatccctgtaatataaccgcactaaaccatctaatctgaatatactaaaatataaattatgttctgaaaataattattatgaataaattaatcactgttgctgtaatagattcaggaatatatcctcatatagatttcaaaaaccgtatagtagctttcaaggactttgtcaatggcagaaaaaatgcttatgacgactgtggacatggcacccatgtaagtggaattatcgcaggcagcggttatgcaagccacggcagaataagaggcatctgtccttctgcctgccttgccggaatcaaggtattagacagacttggcaatggcaggattgaaaatgttttagatgctgctggctggataatctcccatcaaaaggatttgaatataagagttgtcaatatatccttcggtgcaaccacatttggcgagaaggaaaatctcattgctcttgaaaaagcaattgaaaagctttgggacaataatataattgttgttgcagccgctggaaatgaaggacctggacgacagactgttgcaatccccggaacctgcaagaaaattatcacagtcggttccccggatggcaaagatttctattcaggaagaggtccaaccagtgaatgtatagtaaaaccagagcttattgtaaatggttcatatatcaggtcgtgcaataattccgttagcggatattctgtaaaaagtggaacttccatgtctgccccgattgtttcaggtgcaattgcagatgttctgataaaaaaagacatgtctcctaaagagataaagaaaagactccattcctgctgtactaaaaaagccctgccagataatctgcagggctggggattattaaatctttccgaattcatgaatatatgaactattttgtgttgactgccataagaatatcaatcataaaatactgtataagaataagtacaagtgcaagcactacgataacaacaagcggaatccacttatgcttctttaatccctgtcctttctgattctgttttttaaaattacgactgtctaccatcagactgtacctccaatccattccttaatattattgtcaagccagcttacccattcttcaaagccttcgccagtcttagctgatacgaaaaatacctttgccaatggatttctttcgtgaattctttcaacaactgctttgtcatcaaaattaaaatactctttagtatctattttattgataagaactacatgacacacctcgaacataagaggatacttaagtggcttatcatcgccctcaggatacgaaagaataacaacattgcatgatgcacctgtatctgtctcagccggacatacaagattaccgacattctccataacaagaaggtcaagcccgtctgtgtcaaattcgtcaagtgcctgcatagtcatatgagcgtccatcgcacattctccgcctgtatgcacctgaattgaagcaacccctgctgccgccatcttctcagcatcaacagaagaatcaatatctgcttccattacacctatacgatatctgtctcctaacatattagctgttcttatcagagtcgtagtcttacctgctcccggacttgacataagattaaccataaatgttttctcttccttaagccttgcccttgtcttagcagctatctcatcattaactgcataaacactctgatgtacatcaattactcttacattacccattctggttctctcctaaatattgtgctgcattgtcttttagccattcgcaccatgcatccattccttctcctgttcttgcagaaatagggaaaattactgcttccggatttctcattgcaatattatccttaaccctatccatatcaaaatcaaatgccggcatggaatcaatcttattaataatcacaacctgacacttctcaaacataagtggatacttaaacggtttatcatctccttccggaactgaaagaattgccacattaagacatgcgcctgtatcaaactcagccggacacacaagattaccaacgttctcgagtataataaaatcaagtgtattatctgcttcagcttctaacgcagccattccctgtcttgacatatcagcatcaagatgacacattccgcctgtgtgcagctgtactgctgacactcctgccttagcaacagtaagtgcatcaacatccgaatcaatgtctgcttccattacacctatattaaaatgtttcctaagtctttcaattgtaccaacaatagttgtagtcttacccgaaccgggacttgacatgacattcatatagaatacatttttcttctttaactcttctcttaatctgtcagcatcaacgtcattgtcatctaaaacagttttcttaaggtcaattatcttcatgcttctttcattataactattattcataacaactccaattagtaatccttagccatctgcacataaccgagtctctcaaatccagccttcttgtatgctttcactgctctttcattctcttcttcaacctcaagtctgaatcttacagcttcttttccatacatattgtcaagatgttcaaagaactcacctgcaatattctttcctctgtaatccggcttaatatatatgtcctcaacccacacacaattaccgccacattcagtagaatagctgtgtgcaatcattgaataacccatgatgacacctgtgttattctcgaacacaaaacactctataaatggattatctccaagacaatctgcaatatcccttttcataacatcctctgaagggtctgaaagcagtgctggtgaggcataaaacaccttcatcatctcaaggacttctgaagaatcctcttctttcatgcttcttataataatattatccatatgaatcattcctttattacataataattaatgatatcatagtatttatttattggcaaattaaaagacgcggactgccaaactgacagcccgtgcctttcttattataatttattcattttttaacgtacactcacgaacccgtgctttcgcactctttcgccctgcttcgcatggccgttcgttcgttaatggcacaggaaaagtaaatgtctgctctgcagacgcttacttttcctatgtgcacattatattaggaaaaaagatatttattacaccaatcccaaaatcttaggtaagaacattgaaattgcagggatgtatgtaaccagtaataatgctacgaaaatgatagcaaagtacggtaacatgtacttgataacactttcaatagtaactccaccaacacggcagcccgtgaagaggattgttccaaccggaggtgtaattgttccgattgataagttgaagcagagcagaataccaaactgtattgggctcatgccaaatgctgtacatataggaagtaaaataggtgtaaagataagaattgccggtgttacatccataaatgttcctactacaagtaacagcacatttattaaaagaagaataagtatcttgttgtctgtaagaccaaggattgctgttgcaatcatatcagggatttctgtgaaagccatagcccatgacatgatagatgaaagaccaatcataaatgtaatgatacctgttgtctttgctgattcaagtacaattcttggaatgtcctttaacttaaatgacttataaataagtgaaagaactgttgcatatactacagcaattgctgaaccttctgtagctgtgaacacacctgcaagaataccgcctattacaattatgataagtaaaaggcttggaattgcctgccagaatgtcttcattgcaattttaaatgttactctttcttctgcctggtatccacgcttcttagccatgatacctgcaagaatcataactgctccaccccagagaattcctggaatataaccagccatgaaaagtgctgcaatagatacacttcccgcgatacttgaatatacaatcattgtattacttggtggaataagcattccaaccggagctgaagctacatttacagctacgctgtagttcttatcataaccttctttttcctctaatggtccgattgtgcttcccatagctgcggctgcggctgcacctgaaccactgatggctccaaataacatgttagcaactacatttgactgtgcaagtgctcctggcattctaccagcaataaccttggcacaattaacaagtcttgttgcgataccgccattgttcattatattacctgcaaggataaagaacggaatggctataagtgaaaatgaattcgaacccgcgaatattctctgtgctgaagttgcaaaagaaacatttgccggaatcatgcatatcattgaaactgctgatgaaagaccgattgctacaccgataggagcaccgattatcagcaatataactaatattgtaaccattactaaggctacctgtaatgctatactcatgcgaaagtcctcctcataattattgcttatttgctttgagttcaagtccaatattataaatgctgtagaagattataatcacaccacatattggaataattgaatagatgacacctgttggaatatgaagaattgtatctaactgtacaagattcatttttgcgattgtaaaaccaccatataccattacaagtccagcaaagcagattgtaacaagctcaataattatgctgactatcatcttaggtgttttaggtaacttatccttaataactgatatattaatatgctctctctgtccgaacatatatgttgctgatattataatcagccatacgaaacagtatcttgtgagtacttcagtaacgctgcttgggcttttgaagaaatatcttgctatgacctgatatgttaccataagtaccattgcaataaatattacaacacttgaatatgatgtaatcttgtctaatacttttttagctgctgtcatattatttctcctctcttaaagcctgtactttatcgtatattttcttagtaacctctgactgtccggaaatactgtcaagaagcggctggcatttttctctgaataattctgtatcaggatacacaaaaattgcaccatttgcctcagcatccttctttgcttcctgtactgattctgcaaatgcatcaaattcgtaatctgttgaatctgcaacaagcttgtcaaatatttccttatcagcagctgacatactgtcaaggaagttagtacttgctataactacatcaggatgaacaatatgctttgtgtatgaataatacttagcaacttcataatgcttaaagtctgtatatactctctcactgttctctcccgcatcaataacgccctgctggagtgctgtgtaaacctctgactgtgacattgctgtaccaacaccacccatgtacttaaccatgttaagatatgttgttgagtcattaactcgtacaatcatacccttaaggtcatctggtgtattaattggcttgtttgcataaatatttctctcacctgctgtatatacagtaagaacttcaaaattgaactttcttgttgacttgaaaagctcatcaaatgcacctgataatgtagttcttcttaaatgatccatatcatcataaagataaggtgcacctacaatagcaaaatccgaatcgtatccttctggaactgaacatggaacaatagccatatcaagtgctccggttcttatgaactctgccatagacccctgttctcctaacacaccgttaggataaataaccatcttatatcttccgttagttgcttcttcgaacttatctccaagttctctcattgccttatactgagggtgatcctcattctgattgaatgcaactcttataatcttaacttcatgtccatctgctgtagtgttagtgctacaccccgttaatgcagaacagactaataaactcatgcataaaaataatgcaataaactttttacccataaaaacctccctgaaattatttcaataattcagtacttaccttaactactacttttcttactgtcataggctctccatcagcacatgctggtctgtgaacatctgttgggaaaaatacacagaaacatcctggtgttgatgtaataaatccttcattttctactgatttgtagaaaataagatctctttcatcaaatttttcatcaacctcataattgccagtatcaggagtaaatcctaacttttctctacctgaagctaagaactgtacatcaaggtacttctcatgaacctctggtcttttctcatttacagaaccagtctctgcatcaaatacctgcgcgtacataagctttccttcaagttcataaacccccggttccatattaacaaaatcattttcctttaaatacttaatcgctctctgtactgccttcggataactggtaaaatcatcctttgaattaatagatgaaaatatcattattttgtctcctttctgtctctgtcttccatagcgtgaaccatgttgacaatcattctatgtgttggaacatctactccggtcttttctccggctcttacaacagctccacttattgtattaacctctgtgcgtcttcccgccttaaggtctgcatatatagaagtctttccttctggtgaactgatagaggtatttctcactctttcaataatttcctgctcatcaaactcaagtcctaaagctttggcaactgccagtgcttctttaataagagttacagtcatgctccatgcatattcatctgctgcaataaaaccgattgggacctgaagaacccctgtaagagctgaaagagacacatttgtaaagagcttatcccatataagctgctggatattatcataaatgtgtgtatcaaatccacatgagtcaaagctttccttaatctttccaagcattccgttgctgtcaggtacgagcattccgatattagtctttccttttccgcctcttcttacatagccgaaatcaagaattgctccgttatcctctgttgtacctatgataattctttccttaggaacaaactctgaaagaatatcctcatgacctgctccgttctgaagagtcattacatatgtatgttctccaataatatgtctgttttcttcaagtgctgctttagaaaaaagtgctttaacaaaaagtattacaaggtcaacttctccaagattagcactgtctgtcattgcctcaggtctgtaaattacatctttatcattctcaaaaagcttaagtccgtcagcattgattttgtcaacaatttcctgcttcttatcaatcatatagacatcattgtgtaatgaaagatgtcctccatatattgaacccatggctcctgcaccaagaactgcaatcttcataactgtatctccttattattctaactaattatcttgcaaattcagcaagtccctcaatagcataagcacggataggacaagaatcaagtccgtaaattggaagtggtgaatatgacatgaagaatgtatcctgtgtaagcttgtctaagttctttaatacttcaaggaatacaatgttctctgccatacagatatcatggaatggcttaacatcttcgttgcagttttcaattgaaactccgtcaccgaaaccaacacatttaatcttgtgatctacacaccactgtgctgtctcaccgttaacaagtaatctctgatccttgtctgtattagtatctggagtaaatgggtcaatcttgtaagaagaatcaatgataagaatatcaccttcttttacccatccttctgttgctttgtcaaggtctgctgcacttatgtgctttctatgaggtaatgtatccttgaaatcaacatagattgctcttcccataaatgttgtaagtggaagttcagcaactgatggccagttatcatcatgatgataaggacactcacaatgtgttccaaggtggcttgtaagatccattgctgtatggaagtcagggattggaccgcctgtgttatatctaataaggtggcatcttcttgactcagtctttggatcaagtggctttgttaaatcaattacttttaaatttcctaattcaaatgttgtgttcattctttttcctcctgaaaaatgatttattgttttcttgttgattgcagtataccagtataccggttaagaatcaattattaaaattagtcaaacttttcacaatatcattgtacattttcaacaaatccagtataccggtatacagatttttaattaattattgaccaattgtatttttttgtttattattttattaataaaaatgtatttgaagggaatttaatattatgcagcttatgtcatcacttcagcaggaagcttataattatattaaagatttaattcttaccaacagacttgatgtaaacagtctgtattcagaaactaaattatcaaaagaacttggaatatccagaactcctatgcgtgaagcactacaatgtttaagtcaggacggatatatagatgttataccaagcaaaggatttcgtatcagacagcttaatcagaaggacatgaaagaaactattcagataagatgtgccatagaaggtttctgtactcattgtcttgcaaatgatatcaatactgcaagaggtcagaaaactatcagagaacttggcaatattcttgaccttcaatataaaactattgaagatcatccagataatgacaattatgaagatttcatcagttacgatcatcagtttcatctgctcttagtaaaatacataaacaatgatgaagtcaatcacatttttcaaagactaatgtatctgataaaacttacttctcagtcagctcttgaggttgatggacgtattactggtacattagatgaacacaagaaatactttgattatctcaaagctggtaatggtgataaggcttatagcatccttatagatcatcttatgatgcctcttaatgttgttaaacctgaaaaataagttaaaatctaatatattatagacttcttccatatctcaacaagtttccccaatgaatatgcagcatttgcaggacttgttgatggaagaatgtctggtttaattcccagatatttcatctgatatttttcataatattttcctgatgttttcccattacatattactttttcaatcttagaattatctataatgctttttaaatctgttggcacaacattcttaatactactgtcactagaaccaattatgtcacagctgtatatcgtatcccacattgcaatattatgctttaacataaatgccttcttttcttctatcgtctgcggaactgcctcttcaaatactccactaatcattttccagaatctgttctgcggatgtccataaaaaaacatctgctctcttgacttaactgaaggcaggctcccaagtataagtattcttgattcactgttatacaggggtggaaatgggtgtactatatgctcatatttagattcattcatgattatctcctcatcattattattatatagttttagcaacattgtaattaatccttttaaatgcaaaaaaaggattcaagctgaaattcaacttaaatcctttaaatagcaggggatgagagaatcgaactcccaccaaaggttttggagacccctatcataccatttgaccaatcccctatctttaaggagaaggattgttccttcaaaactgcacattaaatatatcataccatatctgtctttgcaaatactttttcatccgattactcttaagaataactctctttgttctatccaaaccgtcttaacattttaaaattctcaaagaatttcaaggttgtctttctattcagttatcaaagatctgtatcactcaaacccagtatttatctggtgttttaagtcttatttgttaccgcttaccgcggcgacttgtatataatatcatcaggtgtacacattgtcaacaacttttttcaattttttttaaaaaagttgtaatttattttaaacacactatatataggggtttccactacatttatatacaagttatatatgcttttcttctatattatattcccttgctttgcctgattctatcttttttattaccttacatggattacctactgcaatactgttgtctggtatatcttttacaactacgcttccgccacctattacaacattattacctatagttactccaggcattacttttaccccaccacctatccatacatcattacctacattaataggataagcatattcccatccttcattacggcttgcagcgtcaacagggtgtcctgctgtatagaaaccacaatctggtgctatgaacacattattaccaaatgttactttggcacagtcaagtattacaagattgtgatttgcgtagaaattgtcacctgcttctatattatatccgtaatcgcaccagaatggagctgttataaaacaattagctcccaccttaccgaatattttcttaatcatagcagactgttgttctgtctgtaatggtcttaatgcattaaagtcatagcactgttctttacataacattctgtcattaacaagttcctttactcctgacttgtataattgtccactaatcattttctgtctctctgtcatattccacatttcctttataactttacaaatattgtgaataacttgtcttcgctaatgctcattatatcatgaactttgttcatgatagtcattcgccgctcgggatgagtatgcaggcatgttccccctctctaacgctcattatatcatataaaagaaaaagacagccagaagattctgactgtctttttctttctgtcaacggagcaggagggatttgaaccctcgcgccggttgcccgacctacacccttagcaggggcgcctcttcagcctcttgagtactactccagattccatgaatgcgagccctaaaccatatatgtttaactcataatatgaaattctgcgtcaaacgcatttattattctaacaaagccccctgatattgtcaaggggctttttatttaatattattattcttcttttttcttcttgtatacaactactgttgttgtcatggctgtaccaactgataacataagcattataaaatacatcatattgcttctgtctcctgtttttacagaggtctttgctataacctcctcttcattagcagctacttccggagtcctgatgttttgagatgtaatctcatcattctgagaaactgccggagtttctgtctgtgtaggtgttcctgactcacttggtatttctttctcactcactgtttccgttggtgttggtgtctccttttcacttactgtctctgttggtgttggtgtctccttttcactcactgtttccgttggtgttggtgtctccttctcacttgctgtttctgatggtgtctctggctgcttaggaatcacattaatagtaacttttgctgatttgatatattctttaccatctataacaagaactacattatattcaaatgtgtcttttccactaaagcccttgtctggaatatactgaaatgttccatcttcattaaatttaatttttccattattcacatctttttttatttctgtcttcaattgaaggtttctcttaggattattgactatcttattattatcattgacaagaactgtactggcgtcaagaacttcgttctgattaactgtgtattcatcatcgacggcattaggcaatattactgctgccggagtctcttcaaactgctgcgtataggtaagtccgtctattgttccatcaaactgacagccatcgttagtatatgaatatcctgtatctccgtcttttgcctttattttaactgtaactgtctgatctgttgcagaaattttttcagggtatttcactgtaaatgttccatctttgttatctgtaacattttcctgacctgcaacaagcacaaaatgtttatccagtgtgtctgttactgatgatgtttcaaattgcagactggtcatttctgtcattatctgtttaaatctgttatttaactgctctgcatttgctgctgtatagaattctttagcatatcctccatctgaaaatgtaaaataagttttttcccatgatttttcatagtttaatgatttatttcctaatgatacttttacgagatcagttatatctgattccttactcataagaactatcgtgtatatatcagcaccggcagcttttaactcttcaccggcctttcctgcataatatgaaccgtttacttcatcccgtggtttattatatctattaatttcattattattttttatataataatatccacctatttccccattatcgtatctgttagctccaccatcagtaaaaagtattactgatgcacctgttgtatcaccagcaatttctgatacctgctttaatccctgctggatattagttgctgaaccaagtcccctgcctatctttgtaacatcatttctcttataataacttttataatcattattatacatttcttcatcgtatattaaatttagtttactcataatatcatttttgcttgatgttctggttatctctgttcttgctgaaccacaatatgaaataaccgatactttattagatgtgccttctgacagaaattcatctaagaatttttcaactgcatttattgtaacactccatcttgtcttttcataagtcggtgccattgcgtctgagtcaacatcttcgtcaactgagcatgccatactgaatgacctgtctaatacaagtatcacattctgattttcactttttattgatggaagattctgcgattttgcagaaaactgaagtgtatagtaaccattttcgtctggtgtttcactttgtatagatttttcaagatataatgttccctgataagaatacgatttggcatatattacggtattttctgtaattgcttctccattttcaattccacctgcaattacaccatagttcttattgctggatttcagctttacagtattgccattttttatatatacatctttggtctggtcgcctattttaaatgtgactttactataaccgtcttttgctgtatctgatacttcattctccgttacaagtattatattatctgaaagtacattttctgcggcgagcgtcttatttgtcataaacggtagtatgcctgtcactatcaggataattgtaagcattcctacaattatcctgagtgtcattttctttttcatgacttttcctcccatttaatcttaaggccgtaataacagcccttaatataaattaatattaggagtatttaccatttattccatatttatactctgcaatattcttttatagctgtttcatacaggttgtttccctcactgtcaattactacaattacaggaagattttccacttcaagttctcttatagcctctgttcctaagtcatcataagctattactgtggatttcttaatacatttactaagaattgctcctgctcctcctactgctgcaaagtacactgcaccatttcttacgattccatcaattactgcctgtgaacgctttccctttcctatcattccctttagtcctaaatcaagaaggtctggtgcatatttatccatacggcttgctgttgtcggacctgctgaacctattggtcttccttctcttgccggagatggtcccatgtaatatattatattattcttcatgtctattggaagtggctgtcctgctgacagagcctctgccattctcttatgtgctgcatctcttgctgtatatattgttcctgttatgtatacataatctcctgagtgaagactctttgcatcctcatcacttattggtgcattaatatatttatccatgattagcctccctgattatattaccctgtgtgaatgtctgtttacatgacagcaaatgtttactgctaccggaagccctgcaatatgtgtaggatatgtctctatattgattgcaagtgctgtctgtgttcctccaagtccaccagggcctattcctaacttattgattttctcaagcatttctttctctaagtcacggacatattcaactggtgattcttcattcaaatctcttgttaatgccttctttgcaagataagcacatttttcaaatgttcctccgattcctacaccgactaccatcggaggacaggcgttaggacctgcatcctttactgctgtaagtattgcttcctttacaccttctattccatctgccggctttaacatgaatactctgctcatgttctcgcttccgaatcccttaggtgcaactgttatgtcgaccttgtctcctggaactatgttaaaatgtattactgccggagtgttatctttggtattctctctgtagataggatcttttacaaccgactttcttaaatatccatcaacatatcctcttcttacaccctcattaattgcatctgtgatatctccgcctgtaagatggacatcctgaccaacattaatgaatactactgccattcctgtatcctgacatataggtatcatgtcctctcccgcaacttttaggttttcttcaagctgcccaagaacctgctttccaagtgcagactcttcgttttttactgcattttcaaaaacattcttcatatcatctgtgagaaaatgatttgcctctatgcacatttctttaatgttgtctgttattattgatacattaacctctctcattcccaattcccttcttgtattttaattattaattaatccagtaaatactaaaaacctttttaattcttcacgccagaatttccattcatgtccgattttttcaatttcatcgtatacataattgtattcaatatggctcatgaaataatctctcaatatatgattcatgtctatccatggatcaagttctccgcaggcatggtatatttcaggttttacacttttctgctctattaatctgtctgcctgatatgtgattccgtattctgttttatgcaggtctccatcaccataaagctctattcttcttattgacttttcacttccatcattaagaaattctgaatcagctttgtcacctgctgaaaatgctcctacagttccatatttttcaggatatctgagtgcaatatgaagacagccgtatccaccattagaaaatcctgatacgtaattattctctcttttatcagaaagacatggaaacatattcataattatattgaataattcttttccaacatatgactcatacttatctccaatattcatattaacatagcatgaattctgcacatttggaagtactgctgcaaacctgccctcatcaacatattctgttattggtgaatgatacagccatacagtattatcaccactgcttccatgatataaccataatacaggaagcttctcatcatttttcatatctgatgggagaataactgtgcattccatattacgcttaagatatatagaaaaatgattaatattcattactgttgccatatatatcctccatcctgtacgactgctcttttattatattaactgtctcatgtatgcatttatcccagaaaataaaatcatgattaccagcagtttcataataattcactttaagtcctgcatctgatgcatatttattccattgtctgctcattgtaagtatctgatcatataatccacatctaatgtaaaattccggataattttccacatttgtcttgaaattatcctcttttaaacagttcattatatcaaatcggttatctgataattttcccctggctccaaatatctgatatgtgtttattccctgtgggttgtcaaatcttttctctatatcaagcagtcctgaatatgagaacaccttgccatatacatcaggcttaataagtgcagcatgtactgctccatatccacccattgacattcctgctatgtaacggtcttttctgtcacatgataatccaaaccagttagtacaggtttctataagttcttctgttaaaaatgtaaaatattttcttccatgtacattatcaacataacatttgttatcacctgaaatcattatgaccgctatatcagtattatctacataatctgccactctggatttcgtaatccatgttgtataatctcctcccattccatgaagaagatataaagtcttataactgcctcttccctgaggaataattgcattaatcataacgggcataccaagtgtttttgattcataattaatattaattaaagccatgttatctcctgctaaaaaggaaaccgtcacatatataaatgtggcagtttccttaagattaatcttcagattctactgttttatctgtgtcttcttcaaagccctctgcatccttaccatcttcatcagcaggctgcttccttactttggcaattgttgctactttaattccttcatcaaggttaataagtttaacacctgatgttattcttccaagattagatatatctgaacactgaagtctgattataattccttctgttgtaataagcattacttctcttgaatcatctacagccttagctcctacgacattacctgtcttttctgttatcttgtaacatttgacacctttaccaccacgatgctgaactgtatattcgtcaatgtctgttcgcttacccataccattctctgaaactataagcatagtatctccctgggtacttacctgaacaccaacaacttcatcctcatccataagactcatacctataacacccattgctgaacgtcccgtaggtcttacatctgtttccttaaatcttatacactgtccaagcattgttaccataagaatctctgcctgatcatctgtaagtttaacttctataagttcatcatcttctcttaagttaattgcctggattcctgtctttcttatattggcaaaatctttaacaggtgtctttttaactatacccttcttagttgccataaacaggtaatctgtatcctgaagtgtatcaattttaacaggaactactgctgtgattgtctcacccggtgctaactgtaaaagattaattattgcagttcctcttgaagttcttgatgcttcaggaatttcataagcctttaacttataagctcgtcctgtgttagtaaaaaatgtaagtacatgatgtgatgttgtcatgaataaatctttgatataatcatcatcaattgtctgcattccctttattcccttaccaccacgatgctggctcttaaagttatcaggtgtcattctctttacataacccaagttagttcttgcaataacacatggttcatctggaataaggtcttccattgaaatatcgtattcatcatatccgatagaagttcttctgtcatcaccatacttgtctgctatctctgaaatttcagtcttgataactccaagaagcaacttcttatctgcaagaattgccttgtattctttaatcttttcatgaagttccttcaactcagcttcaagcttgcttctttccagaccggtcagagctctcagacgcatatctacgatagcctgtgcctgtgcttctgaaagtgcaaattcagcaattaagctttccttggcaatctgtacatttgcagaacctctgattattgatataactctgtcgatattatctaaagcaatcattaagccctctaaaatgtgggctctttcttctgccttattaagatcaaactttgttcttctggtaacaacttcttcctgatgaagaaggtaatactttaacatgtcatacaggttaagcacctttggctggttatctactaatgcaagcattattacaccaaatgtatcctgtaactgtgtgtgtttgtataactggttaagtattatgttaggattgacatctcttcttaactcaatggcaattctcataccctctctgtcagattcatctcttaaatctgtgattccatcaatcttcttatctcttacaagctctgctattttctcgataagctttgctttattaaccatgtatggaagttctgtaactacaattctgttcttgccattattcattggctcaatattagttacagctcttacctttatcttggctcttcctgtacggtaagcctcttcaattcccaacttgccgatgattgttccacctgtagggaaatcaggacctttaactatatcaagaatttcctcaattgttgtgtctctgtcttcttccaccttattgtcaatcatctttacaacagcacctataacttctcttaagttatgaggtggaatattagtagccatacctacggcaatacctgatgtaccattacataacaggttaggatatcttgatggaagtactgtaggttctttttctgtttcatcaaagttaggtatgaaatctacagtatctttgttaagatctcttgtcatctccatagatatcttgctgagtctcgcctctgtatatcgcatggctgcggctccatcaccatcgactgaaccaaagttaccatgtccgtcaacaagtggatatcttgtattgaaatcctgagccagctttactaatgcctcataaattgatgaatcaccatgtgggtgatatttacccattgtatcaccaacgatacgggcacattttctatgtggcttatcaggaccgttgttaagttctatcattgaatatagaattcttctctgtaccggcttaagaccatctcttacatccggaagtgctctggaagcgataacactcatggcataatctatataatagttttccatggttttctgcatatcgacttcttgaactttatcaaagatatgttcatccattattataattcctttccgtgaagttattaattaacgcaatgtgtaaatctggaatacgccatgcgtaaatcctaatcacgcgcattcgtgaaatctacatacgccatgcgtaaatcctacggatttacttatgtggctaatcgccacatacaactcaaaattataaaatatgcccatgtatgcaagcatacggtcatatttataatttttccttgtgcatggcttgttagatatccaaattctttacaaacttagcatttgcttctatgaaatctcttcttggctctaccttgtcacccataagtgttgagaatgttacatcaagttctgaatcatcatcttcattcatattaactcttaataatactctcttgtgtgggtccattgttgtttcccataactgctctgcgtccatctcaccaagtcccttataacgctggactttattattctggtctcttccaatctcagtcatgattgcattaagctcatcatcattataggcataccacacttttttattcttctcaactttataaagtggtggctgtgcaagatatacatgtccttctcttatcagatcaggcatgaatctgtacaggaatgtgagaagaagtgttgcaatatgtgcaccatctacatcggcatctgtcataataataatcttgtgataacgaagcttgcttatatcaaaatcttcatgaatacctgtaccaaatgcagtaatcatcgctttaatctctgcatttccaagtattctgtcaagtcttgctttctcaacgttaagaatcttaccacgaagtggaaggattgcctgtgtagcacggcttcttgcagtctttgcagaaccaccggctgaatctccctcaacgatatatatctcacaatttttaggatctttatctgaacaatcagctaacttgccaggaagtgaagtgctttcaagtgcagtctttcttcttgttaagtctcttgcttttcttgcagcttctctcgctcgctgtgcaagcaacgatttttcacatatagattttgcaactgcaggattctgctcaaggaagtaagtaagttgttcacttactatactgtcaactgctccccttgcaactgtattaccaagcttctgcttagtctgtccttcaaactgtggatcttcaatcttaacagatacgattgctgtaagaccttctcttatatcatcacctgaaagtccctgatcactatccttaagaatcttattctttcttgcataatcattaaaagtcttagtcagtgaatttctgaaaccagtcagatgtgtaccaccttcaggtgtcttaatattattaacaaatgaatcgacaacctcattgtatccatcattatgctggaatgctacttcaacctgaacattgtctttcacaccttcacaataaataatctggctgtataaaggttctttactcttattaagatactgaacaaattccttgataccaccttcataatggaatactttctgctgctcaagaccttctcttaaatctgtaagagtaatcttgattcccttagtaagaaatgccatttctcttaatctgtgcataagaatatcaaattcaaatacagttgtttcctgaaaaatctctgaatcaggaagaaaagtaacctgagttcctgtatcctcaatatcgcagtcacctactatcttaaggtcataacatatctttcctctttcgtatctctgctgataaatgtgtccatttctctttacctgaacttcaagccattcagacaaagcattaactactgatgcaccaacaccgtgaagtcctcctgacaccttatatcctccaccaccgaatttacccccggcatgaagaacggtatatacaacttcaatggcaggtcttcctgtcttatgattaatatcaacaggtacacctctaccattatcaattacagtgatagagttatctttattaatcataacctcaatatgtgtacaaaaacctgctaaagcttcgtcaattgcattatcaactatctcatacacaagatgatgaagtcctcttcctgatgtacttccaatatacataccaggtctttttcttacagcttcaagaccttcgagtacctgaatctggtctccaccataattcttctctgcattctgatctgccactttaattcctccttgttttacaaagcaaaatgtaattaattctcattaactacatgaccatctgttactttaaatattttgttgatattcattctgttattaataaattcttcaagtccggtgcatgtaacaatcgtttgtatatctccaatgctgtttatcagaaaattctgtctgttactgtctaactcagacaaaacatcatcaagaagaagtaccggagtatctttaattacaagtttcacaagttctatctcagataatttaagtgaaagtgcagctgttctttgttgtccctgtgaaccatattttctcacatcattgtcattgattaaaaatataagatcgtccttatgaggtcctttacctgtaaccttgtatttaatatccttttgtcttgaatttcttacttcttcttcgaaatcattcacatcaacatcaggaacataacatactttaatattctcaataccaccagtaagtctggaatgaatatcactgattattgtgttaatcttttctatgaaactttttctgcctttaataataaggcttccatacttaacaagctgcatgtcccatatatcaagagtctgcatcagctgttctgatggtgaaaatactatatctttgagaagcttgtttctctgattaagtactttgttgtaattaacaaggttactaagatatatcttgtcaagctggctaagttccatatccataaatcttcttctctctgaaggaccattttttataatattaagatcttccggagaaaagaaaacaatattaataattccaaaaagttcaacagctttttttataggaataccattaactgctatacccttggttttattcttcttaaggtgcatgtctatgcggtatttcataccatgctttaagacatttagtttaatatgcgattcatcttctccaaatctgactatttctctgtctttactgccacgatgtgacttagaagttgaacacatatatattgattctaatatgttagtctttccctgggcattgtcaccatatattatgtttacatgctcattgaaattcatatccagaaattcataatttctgtaatcctttaactcaacagattcgactatcacattaacacctattttttaataagaatactggaaccgttgtattctacaacttctccgccaaaaagtttttttccacgctgtgtttcaacaacgccattaaccttaacttcaccatcctgaataacaatcttggcttcaacaccagattcaactaatccggcagctttaattgcctgtccaagtttgatgaaatcatctcttaaaattatttcttccataactttcctttctcttgttaagctgtgaagttaacaggaagtataagataaatatatttctcttccttgtctctgataaagcaaggtgatttatgattaactaaatacatagtcacattttcatcatcaataacccttaatgcatccataaggaacttaggattaaaaccaatcataatatccttaccttctttatcaatatcaatatcttcgttaagagctccaattgcagagttaacatttacctgtaataaaccatttaatatattaataataattggcttcttatctccttctcttataagaagattagctctgtcaatagaatcaagaaattcttttttattaatagatactttagtttcataatcgttagaaagcatctgactaatcttaaaataatcaccctctataagtctagaaacaacatgagtctggtcaaattcaaataatacatgattgttagtaaagtaaatattaacaaaactttcagcatcagcattaagaatcttgcttatttcctgaagagtcttacctggaataactactcttacgtcatcagatctgccttcaagcttaatattacggatagcaattcggtgaccatcaagacctacaactttaagtgtaccttcatttacttcaaaaagttcacctgtcatcattttattattatcattaatagcaatagagaatattgtctgattaataacttcctttaactggaactgggaaagtgtaatcatcttatctttaataatagccggaaggtaagaaaaatcatctccggattttcctgctatattaaacttacttttttcacatgtaataagtgcattattatttgaatcagtagttaaagtaatatcattatcaggcagctttcttacaatttcagaaaaaagcttagcatctatggcaatcttgcctttttctataatttcaccttctactatagtttcaatgccaagttccatatcgttacctgtgaacttgatttcattagtagtagcatcaataagaatacattcaagaatattcatagtagttcttgtaggtacagctttcattacgatacctacagctttgtttaagttagatttagtaaaaactaatttcatgttgataacttcctttcgataaaattgtagtggagaagagctatatataaatatataaatgccgtagccgtagtcttaggggttgttaaattgttaaaaagtatgtaaagccttaaaaacactggatatatgaaaataataaccatgttagaaaacacaaaatttaatgttcaatgtatgtgaaaaattaaagtttaaaaaaatgaacataaatctaaaaaaaagttataaagaacattcaacataaaaataacatctaattaacaaattatcctaaaaccattgtggaaaactttttaagatggattaagcttctttattaatatatcaatagtgctcttggtagtttcattattagctgtttctttagcaatcttttctgaaccatataatatagtagaatgatctctgccacctaaagctttacctatagcttcaagaggagtctgtgtcatctgcctgcacagatacattgcaatatgtctaggaaaagctatatcagcacttctcttatgagatattatatcttcaggcttaatgtggaaatgttcagcaactacatcaattataagttctggtgtaatctctttcttagagtaaggagatataagatccttaagtgtattctcagcaaactctgcagtaagaggtgtgtgggaaagcttagaataagctgaaagcttggtaagcgctccctcaagctccctgatacttgaagtaatattagttgcaacataatctttaacttcataaggaaaatcaattcctaaagcctcagacttcttattaataatagccatcttagtttcatatgtaggaatctggatatctaccggaagtccgctttcaaaacgtgttcttaatctgtcaggaagagtttccatttccttaggtggtctatcagaagatataacaatctgttttcctaaaagataaaggtcattaaaggtattgaaaaattcttcctgagtagaaacctttcctattataaattgaatatcatcaataagaagaacgtcaatattacggtatttatttctgaattcagtgttcttgttagtcttaaccgattcgataagttcattagtaaatgtctcagaagttacgtataaaaccttcttagatgggtcacttgcaataataaaatgtgcaatagcctgcataagatgagttttaccaagtccggcacctccgtatatgaacagagggttatatatctgtccaggtgtttcggcaacagcgagtgatgctgcgtgagccagattattattagtacctattacaaatgtgtcaaatgtgtaattaggattcagattctgtgaagcaagactattatcagtagaaactgaagatgtctttttctttaattcatcttcctttttctcagcagatgacataataattacctgatattctttgttcattacttcacatacggtaacttcaagaaacttgaggtaacgtttttcaatatatacaatgctcctttcatcagtagaagcgtcatcttctaaagatgagaaagtaagagtaagaacattgccgtcaagtttatatattttaaggggtttaatccatgttttaaaagaaacatcaataatttcgtgttcttctttaaaagtagagagaattaaatcccatttatcaatcaatgtctgtaattcatccataaattctaggcctttctggcttgttaattagcctgtccaatcataaaaatacattcctttatataatatatcatttagaaaattatttcaatatttgggcagattaagccctgtggataattttatggataaaaatgtattaacatgaatgtggaaaatattataaacgcgaaaaaggtcgaaaataggcactttttcaaaaatatcgttaataactaacgtaattataaagagttttccacaagttatcaacattttgtggaaaactcttttatattctttttaaaaaatattaaaaatgtcctatttatgcggattactggattgtgaaaaacctgttgaaagcgttttttatagaattagtatatataaaaataaatacagtaattatcaagtttttcttgactttataatgtttacacaatataatcagttctgtgttttgaaattttttatatgaaaatattcttaccataataaactacaatggtaatgaaggaggtgcatagactatgaagatgacatttcagccaaagaacagacagagatctaaggttcatggattcagatcaagaatgagtactgcaggtggaagaaaagttttatcagcaagaagagctaagggtagaaagaaactttcagcttaattaatattttcttgattttgttggcagatgggagtttctcatctgcttttttcagattatattaatattaaatttaagcaacattttaattaataagaatggtgaatggtatgaaatataaggattttgaaacattaagaagtaatcaggaatttaaaaaggtgtacaataataagaagtcttttgctaacaagaatcttataatgtatatttctgagaatggaacggatactaaacgattaggtgtatctgtgagtaagaaggtcgggaatagtattgtccgacacagactggcaagactgataagagaggcattccgccttagtacagactgtatacccgatggatatgattatgttgtcgtagccagagccagtttgaaagataagggtttttttgaaactaaggaatcaatgattcatttattgaaacttcataagctttataagcagaattaaataggcggttaatatgaaggatataaagattaagttaaagaatgcgggcaagttcatagttcttaagatgataagattataccagctcgcaatatctccttataaaggaggaaaatactgcagctttattccaacatgttcgcaatacgcaattgaagctattgaaatgtatggagttttcttaggtgggtggttggcacttaaaagaatattaaggtgcaatccatttaataagaacgcttatggctttgatcctgtgccagtaggcagatatgggaaaagaaaaaagcaataaacaactgaatatttggatagtgctatattatgcggaggtgacaatttgagtattattaagccaattgcacagttacttggttacattttagacatccttttcatgggtcttaatgcaataggaattggtaatattgcaatagcaatcattatttttactctgcttgttaaaatgttaatgctaccattacagattaagcagcagaagatgactaagttacagtcagttatgaacccggagataaaggctattcaggagaagtataagggaaagaacagtgatacagtagctatgcagaagatgcaggcagaaactaaggctgtttatgaaaaatatggtgtttcacagtggggaagctgtgtgcagcttcttatccagatgcctattctttttgcactttacagagtattccagcagataccactttatatttcacagattaaggtacttttccttaatatacttggacttaatggtgctgatggtatctcatctgtttcaggatatgctgatactcttaatgagatatacggaaagactgttgactggagcaatacaagcacagctgtaacaacacttaattcattcactgcagaccagtggacaaagttaaaagaagcatttccagcattttctgatatgattacacagaatcttgataagattaaccatatgaatactttcttaggcgttaacatgtctcagaatccaggttttggtcttcatatagctatattaattccaattcttgcaggcgttacacagtttatatctgttaaggtttcacaggctggcatggagcagcctgacagtgataatccagcagcagcatctatgaagatgatgacttatttcatgccacttatgtcagcatttcttgcaataagtcttccttcaggtcttggtgtttactggattgcaacagctgttatacagacaattcagacaatcttcattaacagatattatgataagattggaacagataagattgtagaaaagaatgttgaaaagcgtaacaagaagagagccaagaagggacttccagcagaaactatcgttaaaggtgcttctgtaagtactaagaatgtgaataataataagaattcttctgcttcttcaagtgctgacagagcaaagaagcttcaggaaagaaaagaagctaacgataagaagatacaggaattaaaggaagccgcagcagcaagcggtaaggcagctaaaccaggaagtcttgctgataaggttggtatggtatcaagatacaatgaggtcaacgataaaagaaaatagagagggttaagtaatggaatatattgaagttacaggaaaatctgttgaagaagctataactaatgcctgcactaagcttggtattccaagtgataagcttgattatgaagttatagacaaaggtaattcaggatttttaggaatatttaattctaagcctgctaagattaaagcaagagaaaaacaggaagaaccagaagttaattctgttgagactcctaaaaagtcagaagcacctgttcatgcagaaaaaaaattcgaaaagaaggcagatgatttcaagaaagcagaacctaagaaggaatttaagtctgaacctaagaaagagttcaaaaaggaacacaagcctgctgataatcacaagaatgcagaagttaaggaagcacctaaggttgaagcacagccacagcctaaggaagagccatttacagcagaacagaaggaagttattaagaaggatattaaagaattccttaataatatgtttggtgctatgagcatggaagttaaggctgatattacatttgacgatgaagaaaatagcgttaatgtagatctttctggagataacatgggtgttcttatcggtaagagaggacagacacttgattctatccagtatcttacaagtcttgtaattaacaagaacagtgagaagtatgtaagagttaaattagatacagagaactatagaaagagaagaaaagaaactcttgagtctcttgctaagaacattgcatacaaggttaagagaagcagaagacctgtttcacttgagcctatgaacccatatgaaagaagaattatccattcagcacttcaggcagataagtttgtttctacaagaagtgagggtgaagaacctttcagacatgttgttgtttatcttgaaagagagaataataacagatataacagataattagatatatgattttattaaatgctgtggtattattatcacagcattttttatatggaggatggaaatggaggatacaatagcagctatatctacaagtacagtgtcaagcggtggaattagtattgtaagaataagcggtcctgatgcaattattattggagataaagtttttaagtcaaaaaagaatattaagcttgcaaatgtacagagtcatacggtacattttggaaatatatgtgataacggtaatgaaattgatgaagcacttgtaattgtaatgaaagctcctaacacttatacaagagagaatattgttgagattgactgtcatggcggtattcttgttactaagaaggtgttagaggcggtacttaacgctggtgcaaggcttgcagagcctggtgaatttacaaagagagcatttcttaatggaagaattgacctgtcacaggcggaggctgttattgatattattaatgcaaagaatgattatgctctgaagtcatctgttaatcagttagatggtaagttatctgaaaagattaagaatataagagagataatattgaataatgttgcatttattgaggctgctcttgatgatccagaacattttgatatagatgctaatgtagataaccttaaaaatgatgtggaaaactgtcttaataatgtggataacttgttaaaaacatgcgataatggcagaatcatgcatgatggcgtgcgtacagtcattttggggaaaactaatgcaggaaagtcaagcctgcttaatgtacttgcaagagaagagagagcaattgttactgatatagaaggaactacgagagatactcttgaagaaatgattaatctgtctggaattactcttaatcttattgatactgcaggaatcagaaaaactgatgatgttgttgaaagcattggtgttaataaggctaagaagcttgcagaaatcgctgatcttgtaatatatgtagttgattcttcaagagtacttgatgataatgattatgagattatggaacttatcaaggataagaaggttcttgtaatacttaataaagctgatcttgcacaggttacaacagcagaagatattaagaaaataatgaattgtgagacagttactatatctgcaaagcaggagacaggaattgaagaacttgaggaaactgttaagaatatgttctttaatggtgaagttaagttcaatgaagatgtatatattacaagtacaagacataaagaacttttaaagaaggctgagaacagcttaaagcttgtacttgatggaattgataacatggtaagtgaagatttccttactattgatttaatggctgcatatgagaatcttggtcttataataggagaggagattgaagatgatcttgccaacagaattttttcaaagttctgtatgggtaagtaatgcaggttgataaggagaagtaatatgcctaatattagagaagaatatgatgtagttgtagtaggtgctggtcacgcaggttgtgaggctgcccttgctgcttcaagaatgggacttgaaacaattatatttacagtaagcgttgaaagtatagcaatgatgccttgtaatcctaatataggaggaagttctaagggacatcttgtaagagaaatagatgctcttggtggcgagatgggaaagaatatagatgctacatttatacagtcaaagatgttaaatgcatcaaaaggccctgcggttcattcactccgtgcacaggctgacaagtccgattacagcagaagaatgagaaatgtgcttgagaatactgagcatctgcatataagacaggcagaggtttcagagattattgttaatgatggaaaaattggtggtgtaaagactgtttcgggtgcagaatacatagctaaggcagttgttttatgtacaggagtatatcttaaggcaagatgtatatatggtgatgtaagttatcatacaggtcctaacggattacaggctgccaatcatcttacacagtcacttattgataatggaattgaagtgagaagattcaagacaggtacacctgccagagttgataaaaggtcagtggatttttctaagatgacagagcagttcggtgataagagagttgtgccattttcatttgaaacagaccctgagagcatacagaaagatcaggtaagctgctggcttacatatactaatgaagagacacacaagattattatggataatcttgatcgttcacctctttattcaggagatatccacggaacaggcccaagatactgtccatcaattgaggataaggttgtaagatttgcagacaaagacagacatcaggtattcattgagccagagggcttgtatactaatgaaatgtatcttggtggaatgagcagttcaatgcctgaggatgtgcagtatgcaatgtatagaacagttcctggtcttgagaatgtccgaatcgtaagaaatgcttatgctattgagtatgactgcattaacgctgttcagttaaagtcttctcttgaattcaagaagattgaaggattatttgctggtggacagtttaatggaagctcaggatatgaggaagctgctgcacagggaattgtcgcgggtatcaatgcggcacttttcgttaagaaggaagaaccacttatacttgaccgttcagaaagttatataggagttcttatagatgaccttgtaactaaggaaacagcagagccttacagaatgatgacaagccgtgcagagtacagacttatattaagacaggataatgcagatataagacttactaaatatggttacagagtcggacttataagcgaagaaagaatgaaccgccttacccgcaagattcagcttatagatgaagaaattgagcgtgttaagtcagttaatataggaactggaagtgaagtacagaaggtacttacagataacggaagtacagagcttacaacaggtgctacacttgcagaacttataagaagaccggagctttcatatgatgttcttgctccaattgataagcatagaccagagttgccttgtgatgtatgtgagcaggttaatattaatctgaaatacgagggatatatagacagacagttaagacaggttgaacattttaaaaaacttgaaaataagcttataccagacagccttgattacttaggaataagcggattaagaaaagaggctatgcagaagcttgataaattcagacctcgttcaattggacaggcttcaagaatatcaggtgtttcacctgctgatatatcagtgcttcttgtttacctggagtctcttagaagaaagcattaatcgttgataaggagaaatgtatgataaatgaaacatttaagaataatctgaattctataggtgttgagcttacagacagacagtacgagcagtttgatatgtattataagctgctggttgaatggaatagctttatgaatcttactggaattacagattacgaagaagttcttttaaagcattatgttgacagtcttgtgttagatattgaaaaaatcggacataaaaagaaagagatttctcttattgatgttggaacaggtgctggttttccgggacttccgttaaaaatagcacatccacagcttaatgtagttctgcttgattcacttaataaaagagtaaagtttcttaatcaggtaatagaagaacttggacttacaggaatagaaacagttcattcaagagcagaggatggtggaagaaataatgacttaagagaacattttgatgtaagtgtttctcgtgctgttgctaacttagcaactcttgtggaatataaccttccattcgtaaaggttggtggatattttgtggcatataagtcaggagatattgatgaagaattagtaaatgctaagaaagcagtcagtgttcttggcggaacgatagaagaagtgaagaaattccagcttcctggtactgatattgaccgttctttagtatatatcaagaagattaagcctacatctggaaagtttccaagaaaagcgggacttccttctaaagaaccagttgcgtaagcagtatgtatacacattatagtataaagaaaacccacattattcacataaaatgattagtaaatcatcatattgtggataatatgggtttattttatatgtgttgttgattatctggatttatctaatagtggttaatttagaaatatctcagcctgtcttacaaattcagccggctgttcaacctgtggaagcttcttggcatcctgaatcataacattttcaattgctggattgatgtggatatattcatcaataacgtcattattattgtgcataccgttaatcatgtatatacagttatcaagctcagaaagtgcttttgagatagtaacagtagtaaagttacattcagtgctgataaacagatatttggctgaagcatcaccaagatgtgcattctcatggcatgcattgatataatcagccggaattcttccatctataaaattttttgaaagaagctttctaagagatggtctgttaaacagaatgttgtatacagaagttccaataacaggcacatttaaaatgtgtcttcttattccacttaagttatcaggccctttaagagcatcttcaactgataaaggagaaacaagaataatcttattaaacagtgcatgattattaaatgcagccattatcacaattggtgttgagcctgctgtagcaacaacatcagttttggaacgaataacattgagcacgaaatcattgataagctgtgtatacataaatgttgtataagtaagattaggtttatcagaatgaccacatcccaataaatcaatagcgtaaaccttgtgattcttagcaaaactgtttatagtctgttcccattcgtagcttgaactgtaagaattaagatcgtgtataagtaaaagtggagaacctgagccggcagttatatatgcaatattgccgaacttccactgataattgcttcttattcttttacctgtataattattagcggtagataatttgaatattatgctgttaatcaggtgtgtagtagtaataacagcagttcccatacctactgccagtcctattttttgccatttattcataatagatgcctcctgaaatttccgaaagaaaatgttctaacgcacttttagataaaattattatattccattattttgtgtgtggcaatgataatttgtgttaatgcatcttctaaaatatatattattaccacttcttgagatgttttttaaataaattagtactttatagtaaaaaagtactttatttattgggattaatagagtattatcatcttaaaagtttctgaaatatcttattaagaatatttatataatattaaaaattgattatctgtatataaataaagaatggagttagtaatataatgtcaaatttatgtaaacagtatgttgaaaatgaattaaattgttataagaaaaaattatatgatattactaatgaaattcattcaacagagattgagctaaaaactgttgataagaatcttattaagttaaataaagaaaaagactggtcagaagatatatttcattcattgatttcattaaaacaaactgataatattaggttacaaacattacaggattcaaaatatgaattgaataataaaattattattttaaataatcagaaaaacgatgttgaaactaaaattgaagaacttattaatattttgagagatgatgattccaatgtttcacgtgaaacaatgagtgattctatacatgataatgtcaaactaattgattttattgaacttgaccgaaaacgtatatcaagagatattcatgatagtgttgtgcagaatcttacagcgttaatacataagcaggaatttatatctcaaattattaatactgatattacaagatcaaagctcgaaattaacaattcagttgtattgataaaagaatcaattaatgagttgagaaatataatatatgaattaagaccaatgagtgttgatgatcttggatttaagaatgctattatgaatatggttgataaatttaatagagaaagtaatgtaattacatattattcatcaataaattttgatgatgaattaagtatcgattcaaatcttattatatcaatacttcgaattataaatgaattaaatagtaatgcaattaaatattctaacgggacagaaattataattaacgttactcttaaagataacaatgtgattattgaatttaaggataatggaaaaggatttgattattataatactgtttatgatagaaataaaaattctggatttggattaacaatgttaaaagaacgagttgcgttattaaatggaaatattaaatatatatatgataatggttcggatttttttatagaaataccagtttggtaagaaaggggtgtaattatggcggttaatatattattagctgatgaccatagaatggtaagagaaggtttaaaacaacttttagaaactgattcagagataaatgttgtggcagaagcaggagatgggtatgaatgtctcaatcttactaataagacaaaacctgatattgttttattggatattaatatgcctaatatggatggaattcaggttcttaatataatgaaacaacaaaaaatgttatgcaaggttattgtacttacaatacataatgaaattgaatatctggttaaagcattagaaattggatgtgacggatttatattaaaagattctgattttgatacattaaagaaagctatattttctgtttattctggtgaaacatatattgaaccttctcttatgccattacttaattccagtcttgcagaaagagatgtattaaaagaaaaagtatcagatcttacaagacgagagatggaagtgttgaaaatgattgcatctggtgcatttaataaagaaatcgcattgacacttaatataagtgaaagaacagtaaaaaatcatgtatctaacatatttaagaaaataggtgtttctgatagaacacaggctgcagtatttgcaataaaaaataatataattagtataaagtagtttgaatattaatatttatattacatattataattaaactaaaattatgaaaagatatatatatttcaaaatagaaatatatatatctttttttatgtttcacgtgaaacataaaaaatacaattttttataacacattgtaataatgtgtgctataataaaaaagataaaaagttatttattaaataaaatgatatgagattatgtttcacgtgaaacatagaacatatggaataagagggtaatgtgggaagaataattgcaatagcaaatcagaaaggtggagttggtaagacaacaacagctataaatttggcggcatgccttgcagaagcaggacagaagattcttataatagatattgatccgcagggaaatacaacaagtggttttggattgcctaagacagacattgaaaaaacagtttatgaggtgttattgggagaatgtaatattaaagatgcaatagtagaaaatataattgataatcttgatatacttccatctaatgtgaatcttgcaggtgcagagattgatttaattgacgtagataatagggagtatattttaaaagaaagtatattagaagtaagaaacagatatgattatattatacttgattgtcctccttcattaagtatgcttactgttaatgcaatgacggcagctgatactgttttggttccaattcaatgtgaatattatgcattagagggattaacacagcttatacatacgattaatcttgtaaagaaaaaactaaatccacaacttgaacttgaaggtgtagtatttacaatgtatgattcaagaacaaatctgtcattacaagtagtcgaaaatgttaaggataatcttaaacaaaatatttacaaaacaattataccaagaaatattcgtctggcagaagcaccaagtcacggactaccaataaatctatatgatccaaagtctactggtgcagaaagttacaggttattagcggaagaagtaatggaaagagaagaataaatataatggaggattgtaatagtatgccaacaaagaacactaaaacaagtaaatcaagaggattgggaaaaggaattggtaatctgtttcaggaagaagatactaatgatcagaaagtagttgttaaggaagtggtaaaagaggttgttaaagaagttccggttccggcagaaactaaattaaagatttctcagattgagcctaacaagaatcagccaagaaaagcatttgatgaggatgcacttatagaactttcagaatcaataaaacagtatggagtgttacagccacttcttgttaaaaagatggataaaaattatcagattatagctggtgaaagaagattcagagctgcaagacttgcgggtgttaaagaagtaccggttattattaaggactattcatcacaggaggttatggagatagctcttattgagaatatacagagagaagatcttaatcctatagaagaagcacttgcatatcagcagcttattaaagattatagattaaaacaggatgaagttgcagaaaaggtggcaaaatcaagaaccgcaattacaaattcgttgagattattaaagctggatgaaagagttcaggaaatggtaatcgaaggaaaattaagcagtggacatgcaagagcaattataagtattgaagataaagaaaaacaatacatggttgcacagaagatatttgatgaaaaactcaatgtgcgcgatgttgaaaaacttgttaaaaatattgataagttagataaaactgtggaaaagacaaagccagaaaatgattttgtatatagagattttgaagaaaaattgaagaaaatcatgggtacacaagtagttatcaaaaataagaataataacaagggtaaaattgaaattcagtattattcacaggcagagcttgaaagaatatatgatatgttaaagaaaattaatgaataattaagtttatatataatgtatactatataactaatttgataatatattaataagctaatatacagaaaggaaaaattatgttagatgtatttggattatttaaagtggacacactttatgtagttataggtctgcttgtaataacaattgcagcaatagttcttgcaattgttgcaatatgcaaggcttgtgctatgacgaaaaagtatgagatgatgatggaaggctctgatggaaagagcatggagaaaatggtcagaaaatataccgatgacattatcaatcttcagaagacaagtgaagataatacagaagctattaaggacatatatgaaaagatgcagcttacattccagaaggttggtgttaataagtatgatgcattccatgaaatgggtggaaagttaagctttgcgctatgtatgcttgataagaaagacaatggatacgttgtaaatgtaatgcacagcaatgatggctgttttgcttatattaaggaaatagttaatggaaagtcttatattgaacttggtaaagaagaggagaaagctgttaagcaggcactggccggacgtatgggagacgaggaattaagtaaagaaattaacgatttaatgcagaaagacaaaatgtaattgaaaatatacagaaaaaggtgcataatagcatttggtaaatttgataaaatagtgtcaatgataggacacggaaatgaggagtaatgttagatttaaaatttgtcagagaaaacccggatattgtaaaacagaatattaagaataaatttcaggacagaaagcttccacttgtagatgaagtaattgagcttgatgctaaagctcgtgcaacacagacagaagctgatgaattaagagcaaacaggaacaagctttctaagcagataggtgctcttatggcacagggaaagaaggaagaggcagaggcagttaaggcacaggtaagtgcggatgcagcaaagcttgctgaattagaggcttctgaaaaggaacttaatgaaaaggttaataagattatgatgactattcctaacatcatagatcctagtgtaccaatcggaaaagatgacagcgagaatgttgaaattgagaagtttggtgagcctgtagttcctgattttgaagtaccatatcatacagatattatggaaagattcaacggaatcgatatggatgcagctggtaaggttgctggtaatggtttttattaccttatgggagatattgcaagacttcattcagcaattatctcatatgcaagagatttcatgattgacagagggttcacatactgtattcctccttatatgataagaagtaatgtagttaccggtgttatgagctttgatgaaatggatgccatgatgtataagatagaaggtgaagatctttaccttattggaacaagcgaacattcaatgattggtaagtttattgacacaattacacctgaggaagagcttcctaagacacttacaagctattctccatgtttcagaaaggagaagggtgcacatggtatcgaggaaagaggtgtatatagaatccaccagttcgagaagcaggaaatgattgttgtatgcaaaccagaagagagcaagatgtggtttgataaattatggcagaatacagtagatttcttcagaacaatggatattccagtaagaacacttgagtgctgttcaggagatttagctgaccttaaggttaagtctattgatgttgaagcatggtcaccaagacagaagaagtacttcgaggttggttcatgttctaacttaggagatgctcaggcaagaagacttaagataagagttcagggtaaggacaagaacaagtactttgcacatacacttaacaacacatgtgttgcacctccaagaatgcttattgctttccttgagaataaccttcaggcagatggaagagttcttattccagaagctcttcgtatgtacatgggtggtaaggcagaattagtaccagttaagtaatatgaatactaaatagatattattaaaaatgtggataaaacatatcaaatgaatatgttttatccacatttgttttatgttatccacaaattttgtggataagtgtgttaattctgtgggaaatccattaaaatgctgttaaaaaccagtattttaatgtggaaaactttgtttatattggtatgtggaaaacttttactggaaatctacaacatttatccactgattaagaagttctttttcttcttctttattcttagtaagtcttgctgctgcaactaatggaagccattcattaacatatgaacgttttgtgttagttaattcacagaaagcacttatgtacttttcaggaatatcactcttgtcaccaaactgtaatttgagaagtaaaaatgtattcgcaatatcggcagatgcattaccctgtgtagcatgtacccagtcaactgctgtgatttctttgatatttcccttggcatcagcagtaacaataatattatcaggacaataatctccgtgacaaagcttagtatgattcttcatggaattaagccttgtaagaagttcatacttaacgctgttatcaagttcttcaatagagttaatctggcggttcattttatcctttaataccagaagaagtgggttagacttcttctggaaagatatctggtattcaaccattttcttaatataatcatcagccttgtcagggtatttttcaattaattgtgtaagagtaggaccttcaacatattcacttgtgatagaccatttaccgtcagtaacagcaacctctaaaagctttggaatattaacgcctgcgtcttcaactctagaagtattaagagcttcatataaaacatctgatttgttgtaggtcttggcaaagaccttagtagctttgccattctctacatatactgattttaacttagattttgctaaatattttttcatatgacatgtcttcctttcttaaaataataatgatgattatttaccatagtaagcctttaagtacatggctttcatttcactcataagaggatatcttgggttagcaccagtacactggtcatcaaatgcagcttctgtcatctcatcaagagttgcaaggaagtcttcctctttaacaccataatctgcaatagttttcttaattcctacctttgcctttaattcttcaatagccttgatgaggttttcaaatttctcatcatcatctttaccctgaattccaagaaagtcagcacactcaacataacgtgctttgcaatgtggatacttatactgtgagaatgttcccatcttggttggaacctctgcagcattgaatctcattacatcagtgataagaagggcattagcaattccgtgtggaaggtggtgatatgcacccagtttatgtgcaagtgagtggcacactccaaggaaagcattagcaaaagccataccagccatagtagaagctgttgccatcttttctcttgcaactgcatcatgtgcacctaattcataagctgctggaagatattcaaatatattcttcatagcctgtaatgcaagaccatctgtatattctgttgccataatggaagcgtatgcttcaagtgcatgtgtaagtgcatcaataccagaagctgctgtaagtcccttaggctgattcatatgcatgtcagcatcgataatagccatcttaggaagtaattcatagtcagcaagtggatatttctgaccggttgtttcatcagtaataactgcaaaaggagttacctctgaacctgttccagaagatgttgagatagcgacaaagtaagctttctcgcccatcttagggaatgtgtatattctctttctgatatccatgaaacgcatagccatatcaaggaagtctgcctcaggatgttcatacataacccacataatcttggcagcatccattgcagaaccaccaccgattgcaatgattacatcaggttcgaaaagtctcatggctgcggtgccttctttagcgcatgcaagtgttggatctggtgctacattatagaaagtagtatgcatgattcctaaagaatctaacttatctgtgacacatttggtataaccgttcttataaaggaactggtcagtaacgataaatgctttcttcttacccattacagttccaagttcatcaagggcaacaggtaagcagcccttcttaaagtaaaccttctcaggtgctctaaaccaaagcatattctctctcctctcagcgacagtttttacattaagcagatgctttactccaacgttctcagatactgagtttccgccccaagagccgcatccaagtgtaagagaaggagccatcttaaagttgtagaggtcaccgattccaccgtgagatgaaggtgtattgataaggcagcggcatgtcttcattctttcagagaattcagcaatcttgtctgcctgtgtttcaacattaatataaagagatgatgtatgaccaaatccaccatctgcaatcaggtgttcagcttttgaaagagcatcttcaaaatcttctgccttgtacattgcaaggacaggtgataacttttcatgagcaaattcttctgagaggtctacagatgttacttcaccgataagaattttagtttcttcaggaacagtaacgcctgctaaagcagcaatagtatgggctttctgaccaacaatcttcgcattaagggcaccgttgataataatagtctttcttaccttttctgtctcgctcttattaaggaagtagcagcctctgtatgcaaattcttctttaacagccttgtaaaccttcttgtcaacaattacagactgttcagaagcacatatcataccattgtcaaatgtcttagaatgaataattgagttaacagcaagtattacatctgctgattcatcgatgatagcaggagtattaccagcacctacaccaagtgcgggctttccagaagagtaagcagctttaaccattccaggtccgccggtagctaagataatatctgcttccttcataagtgtatctgtaagctcaagggaaggaacatctatccagccaatgattccctcaggggcacctgctgcaacagcagcttcaagaacaaccttagctgctgcaattgtcgatttcttagctcgtggatgtgggcttatgataataccatttctagtcttaagtgaaataagagttttgaaaatagctgttgaagttggattagttgttgggattacggctgcaacaactccaataggttcagcaacctttttaattccatatgccttatcctcttcaataacaccacaagtcttagtatctctgtaagcattataaatgtattcagaggcataatgattcttgataaccttatcttctacaattcccataccagtttcttcaactgcaagcttggcaagaggaattcttgctttattggcagcaagtgcagcagcagtaaatatcttatctacctgttcctgagtataagctgcgaagatgcgttgagcctcccgtacaccggcaagcctttcttcaagagcttcgactgtgtcaacaattgggtaattctcagttaaattctttgacataacatttcctccataacttgattcgtgtaatattgattgataataatttaacaatgtcaatataacactaatataattataagtcaatattcattgtaatattaattaaaatatgctatcttttacctagtaactgggggactaataaatcttttgttaaggatggagcggcttatgaaacaggttagtgttgataatcttaaagaaaacgatatattagcttttcctatattgtcgcattcggggactgttcttattcatgcggatgttgctctgacagaagaacttattgaaagagcaattaatcttggagtaagaactgtatacataaaagacgaaaaagagggaattgtcagggagaatacttctgatagtgatacggcacgggaagaggaagaatatccatacagacttgaagaaactgccaataattcaaggcagatagtaaaaaaaatattagaaaaacacatttataaacataatgaagaacttaagataattgttaatgaggcacagagaatacttgatacagttattgcagagccggaggttgtgaataatattactgaaatcaggaatgtaagtactgacatgtatacacactgtattaatgtatgtactttgtcaacaattatggcattaaggcttaaaatgagtaataaacagatacataatattgcgatgggagcaatacttcatgatataggactcagatatattaatgttccttatgttaatgttagtgagaataagatgactaataaagatgctgttgaatataagaagcatactatatttggatacagctcactgcaggacgaggaatggcttcctgacgtggcaaaggagattattctctttcaccatgaaagaattgatggctcaggatatcctttccagcataagggtgacaggcttaaaccagaagttaagcttgtttctatctgtgatgattttgacagtatgataagtggcataggcagtgagaagatgaagatatatgaagctattgaatacatcaaagtgcattcgggagtaaaatatgaccctacaattgcttcaaaattcttagactcagttgctgcataccctgtcggctgtacagtttacacaagtgatggcgaaaaagctgtagttataagacagaataaggaagctgctgacagacctgttataagaatgacagagcatgcagatggaacaccttatactgaaaatgtagagtataacttattaaagcagcttactatgtttatagtagatacagaatagagcattggagcagctatgaatttatatataagaacccttggatttgataatatgacatcagaggcagaggcaaaatttataaaaacaggaattagagaaagcataaaagaaggatttgtgatacgccacgagaaattagatcgtggcgttattatcttgcgccttagcaactcaaccggattgtatgtgtatggaagatatgaaaagaatgtttttaaatatgagtattattttccgtttgttgtggggaagactttaagtgacaatgaggagatgactattgagagacatcttgacaaggaatcctatgcagttatatgtgatgaattaaagacaggagtaacgcttatattttatcttcagaatgtaatggattatcttgattatctgtacagtggtaaggattttaatgcggatgattttaatcctgacagaaagaacgaaattggtaaagtaccaatcagaaacaaaaaggtggcacttacaggactgtcgcttggtggaattattatgcttccggtgagaaaggaaagaaattctaagaaaagcagacaggatgaaattgcaagaaagaatcttattcaggcagcaaagaatggagatgaggatgcaattgagagccttacaattgaagatattgatacatacaatgaactttctaaccgtgtcatgaaggaagatatatttactatagtagactcaacatttatgccatgcggtgtagaatgtgaccagtattccgtcataggagagattcttgaactgcgtgaagaggagaatatatacactggtgagaagatatatattatggttcttgaatgtaacagtcttattataactacagcagttaataaggaacatctgcttggagaaccagccgtaggccgcagattcaaaggacagatatggcttcagggaaatgtaaggtttactgactgatattgttgttaaatatatgatttcataataaattgtatttaatatagaaatttacatatttttacaaatgtggtattataatataaggcatataagaaaacggaaatgtcaactaaatattattaattatcaacgaggaggggaagctatgaagtttttcagaaaattaggctttcagcttgttttattttttattgttgccattacaattcctattgtaatgcttatggtaagttcaattacaacaacttcgtcttcaatggaaaataacgtgaaggtaacaagtgagcagactttgaatgaagcacagaaacagtttactacatatcttaagactctgtcgcagccggtagacctgcttacaagaaagaatgaagtaaagcatcttgaggatcagggaacattaagtgataatgttaaggcagtaagagattctcttattgcatcagttaaggttactaatggtgcagaaagagcgttctttgctactaatactaatcttgagattacaggttggggagaatataacccagagactggtaagacacttagtaagggtggtcttgagaatggtgtagacagaactaaggaagtatggtacacagattgtaaaggtcttaaggcaagaaacagcatttatgcttatttttcaaagccatattacagcaaggattttgataagacaataattactgtttcacaggaaattaagcattcagacggaacgaattatggtactgtaggtatgcatattgatttttctgagattacagattttgtacagggtattggacttcttaatacaggatttgttgtccttgcagatgaagatggtaatatacttgttaataatgataataacaagtatgtaacagattcagtatcaggactgaattgctggagtacagttaaaggtcttacagagaatgattatgataaagcattttcatttgatgaaaacattaatggtgaaaaggtacatgtagtaacatctaaggatgctgttacaggatggacacttgttggttttatcagttctaaagaaacatctgttacaactaataagatgattagcaatactgttatattcagtattatagcatttgttattggaattggtattgcactttcagttacagcttctatgactaaggagattaagaaggtttctggtcatatgaaggatgttgccagtggtgatttaacagacagaattgatgtaaagaagaagaatgagtttggagaccttgagaataactttaacaacatggttgagaacatggcagttcttattaagggcgttgaggaaaagagtggagttatagtagatgcgtctgctaagattgcaggagtatctaagtctactacagagactgtaggtcaggtttcagaggctatacagagtgttgcagttggtgcatcaggtcaggcagacagtacacagacagcaacacaggaagtagaaaatcttgcagacagattaaaggaaactaaggcttatgtaactgatatcagtgagatgtctgttgaaacacagaagttaagtaataagggacttacaattgttgatgaacttattactaagggacagcgttcaattgataactctaagatttctaaagcagttgtatctgagatggtaagcagtatagaaaagattaatttcatatcagatgccattacagaaattacagagcagactaacctgttatcacttaatgcttctattgaggcagcaagagcaggagagagcggtaagggattcgcagtagttgctgatgagataagaaagcttgctgaacagtcacagcagtcaactgacgagattaaacaaattgttaatgaaattactattaagtcacagcaggttgagcagacaatggatgagtcagtcggtattatagaggaacagaatgtttctattaaggatgctaaggaactgtttaatacaatttctgattcagttaacggacttaaggaaggtcttgataatattacacagctcaatgaagctatggatactaacagaaataatgttgtgagcaagatggaagatgttgcagcagtagcaactgagaccgcagcagcctctgaagaggttacagcatcagccgttgatgttgagcagacaatgcacgaccttaatgaatttacagttgaacttgataatattgcagaggctcttaaggaagctattgataagttcaagttgcaataattaaactaatccgataaatgtgtttatggaagctgccactctggcgattgtaatcgccgggtggcagcttctttttaatctttttaatctcagggtatcattgaccttgctgatgttttgtgataaaatctctcttggtgtttagccaagttgttctcatagttaagtggatataacggggacctcctaagtctcaatccccagttcgactctgggtgggaacatttatattaagaagtgataagcagtggcggtgagaatcgttgctgctttttgtttattagtaacgagactataataacagaaggtacagactaaaacaatctgacgcataatgcatcagaataatttaggcggtaccttcttttaatttgcttgaaaatgaacaataagacagtaagggtattgaagacaccaaagacagaaagcagtgcgcgaaaagtattcatcccaaggtctgttgcacaatatctgatagaattgaaacaggaataggatgagataaaggctgccctggggaatgagtatcatgatgaaggtactgtcaaatccggaaatagcagcattgctcaattccctggcaaagacaatgaaagtataagactaataaaaatagcgatattgtatggatgaagtatctatacagtgtcgctatttttaggctaatatatagagataagaaggatgttttgaagcgttttaagatacatagggaaggggaaagtaatgttaacaataaaccagttaatgaaatatttgaggagcaaacacaatattgctgttaaaagtaatcaggcacaggatttacgaaatatgggatattatcatggatttaagggatatcgttttattcgtgtaccgagtcagagaatttcatttacatctttagatgaaattattgcattgaataaatttgatatgaagttaaaagctcttttttatcctaaggttatgtttattgagaatgcactaaagatctatgtgatcgaatcaacattgaaaaatgctaaatcggagaatttggtactttttttcatgtgcaaattcggatgttaaattgtatacatcggcgacattgcacctcccaagtaatcttgatgcagatgggaaaataacagaatatattatatatgagcttaaagatcttagaaatgcggttgcacataataatattattttgatacaagatttataaatttgaccatatggtatattatagctatgaattgcggtgggcgtcttcggacaacaccttgaaagagcttgatgcgtcgggctctttttttattgcattatcaataattttctaaatatgtgccacaaatcttgaaaaaatcttgatttgtggcataataaatatatattttgatttggagatgatgttatgtatataaagcgtgaaagatatctaagcaaaataagaccattttatgatgtggatttaattaaggttctgacaggtgttagaagatgtggaaaatctatattgttagagcagattaaagaagaatttattgaaaatgggtttgatagagcgcatattattaccattaattttgaagatttgcaatttgaaaaaataagaactgcagaaaaacttaattcctatgtgaatgagcaaatcaaggatcatgacaaatacttgatttttttagatgagattcagcatgtcaggagctttgaaaaggttttagcttcctttcgggcaacattaaattgctcaatttttattactggaagtaattcgaaattgctatccggcaagatggcaacattgttggttggaagatgtgttgaatttagaataatgccattttcctttgccgaaagctacgaatatgctacagctataggaagaaatatgtctccggatgagtttatgattgattatatcaattggggtggcttccctttgcgtttttcgtttacaaaagaaagtgatattaagagatatttggaacagacatatgaaggtatcttagataaggatattattactgacagatcaaaggttaatagacaaaactttgaaagagtagcaacatatattatggcgaatgcaggaaaggaattttccagtaaaaacatagagaactattttatacatcaaaatgcagatactttggataaaaagacgatatacagatatcttgataaaatggaaaaggcttgtctaattgatcgtgtaaaaagatttaatattgtaggaaaacaggcaatgtcgtatatagaaaagcagtatgcggtagatactggttttcgcatgataaatacaaacttagtaaattttgaggataccttttttcttgaaaatataatttataacgagctaaaagcaagagattatgaagtatttacaggaaaaacatataagggtgaaattgattttgttgcaataaatggaagaaagaaatgttttattcaggtggcatattatttggctggcaaggcaacgattgaaagagagtttggtgcttttaagccaattagtgatgcatcaccgaaatatgtgttttcattagatcgatttgattattcaagagatggaattgcacatatcaatattgttgattttcttttgggtaagaaggatattaatttatcataacgccacaaattaagaaaaaatttaaaattgtggcatgattagtcatacaaatagctacggcaactttcaatttgccggactcacaaacaatttaatatttattttacaaagcactttagcctaaaggttaggaactgttgtacgtcacatagacggttgtaatgtttgatatagttatgtcaagaacattgttaatggaggagattacaatgaaacagtttttataaaggcaaatggaaatgcgactcctgcaacaccggaagaaattatatcactttcaaagagaaaatatggtgtggataatgagacaagcgaagtggcatatactgataatcagtggtcagtataccttaatctttgtaaggaatacagacaagataaatctgctccaactataaagaccagctttcaggaggggaaagtatgcagggaaaagaaagaacattcacaccagaagtcgaaaaagtctggaacaaagattaccagtgtgagtattacagaggggttataatagatggagaggacaatatagttgagcgttgcacaagaacccatgcaagctatgatgctgcattagacgaggcgaagaagaaaacaatagttattaaaagaaaatgggtattttacaacgaccttatggaatatatacacaattatgccgatattagataataagaagcatttgtaaaaatgtggtttcagggggcaggcatgaatatatctaatgtaatgggaagcgcagataccagtgttgttgcggcttctaaaaagaataaatggaaactgacagactctttaaaagataaaattgctgaaatggcgaaaaaagatgcacagaacaatgaatatatgggaaatgaatttaagagtttaagaaagtcagaaataagcaaggttgcgccagacagggctgctttgattggaaaattcagctatctgacaggttctggcaatgcatctgtcatgaaagaagtgcaggaagcggataaaagatggctgtgcatgttatttggagagccgtatgaggcaaagtgtcagggaaaaggctttggttcagcagttcatgtatataatgaagatggagaagagatacttacatatacaggcggtgttggctggcaggcaaaagaaacaaaggcggagacaaaggttaattctgctttaaaaacaacatattatgaagcttattcggcagaaagaaaggcattaaagagcaaagaaagtgataatatagcagcaggagcagataatacatttgatgcaagagcgtagcttattgcaatatcttcataaaatattatcgacatacgcccatatacacgctataatatgtttgctttaatatgtagatatcacgagattagaataagtaacagaggaaaatgtttatgaattatattgttatggatcttgagtggaatcagagtgccaagggaaaacaattttctgaggatcattttccttttgagattatacagataggtgcggcgaaggttaatgagaagcttgatattgtagatgagtggcagtgtaccattaagccacaggtgtatacaaagctgcagaatacagtcaagaagatattagggataacagaaaatgaccttgctaacggaactgatttcgtatcgggtgtaactgaatttcttgaatggtgcggtgaggattatacatttgttacatggggaagcatggatattactgaattaagacgaaatatgaagttttatgatgttccggagaatttcccaaagccgcttctataccttgatcttcagaaactttacagtattaatttttcagatggcaagacacgcatgaatcttaaatctgcaattgatgagcagggaatcaagggagatgagcattatcattcagcaatgagtgatgcaagatatacagccaagataatgaagaagctggattttgacagagttaagaagttctgcagtatagatacatttacaattccagagtcaagaaaggacgaggtatatcttaactttggaacttatgagaagtatatttcaaagggatttgcgacaagggacaaggctgcaagcgacagaactgtacgttcctgcaaatgctttttatgtggcaggactatgacaagaacagtcaagtggtttgccactaattcgaaatgctattacggcttgtttacatgtgatgaacacggacttataaaggggcgtttcagagttaaacagaccgaagaaggcagatattatgcagtcagaattatgaagcacactgatgaaaagggtgcacttaagatatatgaaaagcagataaaagagagagagcacagacgcaggcggcgtcaggcagagaaactttcagaacagaaataatggcatgtcagaaatccaactgacatgccattttaacatatttaatatcagaacattaatccatatattactgcaagaccaagaattacctggataattgtgaatctaaaaacaacctgcgtatctgaccagtctttattctttctcatatggtcgtggattggtgtacgaaggttcttcattaggttgatgtgaagaaatctcatgaaagaaaccttgataagaccaagtccgccatcaagaataattacaagtgccattggaatataaagcagcggtgcatggagcttgaggaatgtaaatgctataaatattcctattgctctagaacctgcgtcacccataagaagcttgcttggtgatgcattgaaccacaggtagccgaggatacacacaatcataataagaacggtgtgtctgtaagctgattcaatattaaatgacttaaaaagaacatacactgaggcaagtgttacaacagagagtgtaccgcataagccgtcaacaccatctgaacagttagtaacattgatacttacccatataagtataataataagtattgcatatataattggattaagagttactgtctttccaaagaatgcaaggtcaaatgtgttagggttgtaatgcaggtaagtaactgccgccataactgatattgcaaggtcaataagacctttctttaaattaccccatggtgatgaagcactgtcatcaaggtatccgctgagcattgtggcaagcacaagtataagataaatgataagttcggcacttaagtttacgaataatgcacatgtgactgtgaatgtaagaatgaaaatcatgccggcgcctcttggttttccaactgatttacttccgttgatagcataagctcttccggcatctcttggaagaagattcttgccaagagcaattgcagctattgtaaatgcgaaagcaaacaggatgctgacaaatgccattatgttagtgaaactttcgttaacaatatagtatatcataagaatttaatactccttttcatctttctaacttatataaagcatttatttcaatgcgatttacagtataacataatatatgtgaaatgaacattttttttgctaatgaaatgtagtaattaatttgctaatgtggtaatatactattaattagtgggatatctgaggggacccataagtgtcgtgtaggataataataatataatggaggattttatgaagaatatgcaaaaatacgagcagctggcaatcacagaactggatgcatatctttttggacagggaactcattatgagatatataacaaaatgggtgcgcatgttggagtaaaagacggaaaagaaggtgtgtattttgctgtgtgggcacctgctgcaagagaagtctatgttataggtgagtttaataactggaatgcatatggttatgatatgaagaagatttcagatggtggaatatatgatttgttcataccgggagctaaagcaggggatatgtataagttccttattatttcccagagtggagaggctctttacaaggcagatccatatgctaatcaggcacagttaagaccagagacagcatcaatagttgccgatctttcaggttatgaatggaaagattctgaatgggttgagaagaagaagacggagaatcatcttaaagctcctctttctatatatgaatgtcatcttggctcatggaagaagaaagatgatggaacagaggacggattctatacatatagagaattggcacctgagcttgcaaaatatgtttcagatatgggatatacacatattgaacttatgggaattgcagagtatccatatgatggatcatggggatatcaggtgactggttattatgcacctacagcaagatacggaacacctaaggatttcatgtattttgtagattatatgcatgaaaaaggaattggtgtaattcttgactgggtaccggcacattttccaaaggatgcacatggacttgctaatttcgatggaagctgtgtatatgagtatgcagaccctagaaagggagagcatcctgactggggaacgaaggtatttgattattccaagaatgaagtggctaacttccttattgctaatggaatgttctgggtggacaagttccatattgatggtttaagagttgatgctgttgcttcaatgctgtatctggattacggaaggacagaaggaaactgggttcctaacaaatatggtgacaacggtaatctcgaagcaatcagctttttaaagcattttaacagcatgttaaagaagagattcccacaggcaataactatagctgaggagtcaacagcatggcctatggtaagtggtgatcctgacaatggggaatgtcttggctttacatttaagtggaatatgggctggatgcatgatttccttgaatatatgaagcttgatccatattttagaaagtttaatcatagcaagatgacattttcattgatgtatgcttacagcgagaatttcattcttgtgctttcacatgatgaggttgtacatcttaagtgttctatgcttggtaaaatgcctggtgacagggaggacaagttcaagaatcttaagctggcatatgcatatatgtgtggacatcctggtaagaagcttttattcatgggacaggaatttggtcagtggaatgagtggagtgagaagcgtgctcttgactggtatctgttagaggatgaaagtcatacagaacttaaggattttacgaaaaagtgtctgaagcttaataagaattatccatgtctgtatgctactgattacagcagtgaaggattcagatggattaatgccaatgataaagataatagcgttttatcatttatgagaatcagtccggatggaaagaagaatcttctctttgtacttaattttacaccagttgaaagagacagcttcagaataggagttccgttcaagactaagtataagctggttcttggagataatgaagctgaccagaagaagactcttacagccgttaagggagattgtgatggatatccgcagtcattgcttattgacttacataagtatggaatagctgtgtatgagtttaacggtgatgtttctaaggttcatgctacgaagatataggagaataatatagagaaagggagctggtttggatttttattaattctgaatcagcttcctttttatttgctataatatatgtctcaattatcccaccatatctgccgaaatatttattatatgacaatgagtgattgtttcagatagtaaataagaaaggcagcagaatatgacatatacagtttcaggcgcgaattttaataaagatgttgcggcacagggaacatctattaattataaagaaaataaggcggttaaaagtgaaggtgtggcaggctcatttgcaggagtggtaatctctggcagtgtgacagctgcaaatgacaatacatatgagggacttcttaaggaggcagatgatgtaaagagccagattatggcgagtgcttccagtgcaaagataagccttaaggcattgatgatgaagttatcaggtgctgatgcggtaaagctagatgaggacggctttaatcttacagatgctacaccagatgatatggttaatattattgagaaaattaagattgaacttgcgatgcactctgatgattatgttaattatggcacagcagtttccaaggataagattgagagtgtgactggaagtgcagcaacagcggcaagtgtcgagagccgtatgcagggagcagatatagctgtcaatgatgaaagtgttgctgaggttaaaggcacacttgaaaagagtaaagagttaaagccattatcagagaacacaaagaattacatggttgctaatcgcatagagccttcaattgctggaatatatcaggcacaggcggcaacctcatcaagtatcagtgcggatggcgttacaataggaaagtgcgcagatgcaatatctgacgctgattttgaagctttaaggccgggaattgagaagataattgcttcgtcaggtcttgaggttaatgataatacacttgcggatgcaagagcatttattaatgcacagattcctgttactaaagaaaatcttgaatataaagcacagcttgattcgatagacattgatatgatacaggctgattcagaggagctgcttaataaaatatttgataatatgaagcttggaggcaaggcagagaatacgctcgttacaggttcgccagttgatgatataaggacagctcttgatactattaacagggcagagtattcagatgttgcaaatgtggtatcaaaaggggaaacatttacaatagcaagccttaagctggagatggatgcaagaagcttcagaattgaatacagtgcagcatcagtaagcacaggaaatagtgaagttagaaatcaggcatctgatgtacagcaggcagcagataaggcgtatgacacgcttgtaacagcaagggttcttatgagtgcgaatgcgtccatatatctcgttaagaataacatttctattcttacaactccgatagatgagcttaattcaatgcttatggaatatgaacaggcggatgaaatgtatgaagaagcgcagattgcatatacagatgttcttgaagcaagaaagacattgaatgagatagtaagaaatcctgcgcgtgtatttgccagtatgtttgacaagatgaatgaaacttatgaggcagtcggaactcagataagaggcgatttaggtgattcattaaagaaggcagtacagggaagtgcggatgatattattagggagcttggacttgagggaactgatgaggacaaggaagcaataaaggtactggctgctaataacatggatatgacaaaggaaaatgtagagatagtcaaatctgttaatgcaatgattaataatcttattaagaatatgaaaccggagacagttcttaatatgataaaagacggagtaaatccaatgaatgcttcaattgaggaagtcaacgaatatcttacagaggctaatgataaagcatctaaggataatgaggagaagttttcaaagtttctttataagcttgaccgtaccaatggtattactaaagagcagagaaagcagtttataggaatataccagatgatgaatatattcaccagagatgccggagtggcagcaggtgcgctgattaagcagggagctgaggtcactatgaataatcttatgactgcatataattcaagaaagcattatgacatggacgctgttattgatgagaatacaggaatggcagaggtaagcggaattgctaactattacagtgcattatttatggcaaatggtggattagttaccccgaatacattaaagaatgtggataactcatccggaatcggagaacagtccgttgaaatgtttattgaacagttagaggataactatgatgcggcagccgaggaacaatattatgaggaatatcttaaggaacagcaggcagcagtgcaggcaggagctgatatattgaggcagataagaaatgcagatacagaaataaacagtggtaacatacaggctgttaaagcatttttagaatccggacagttcccggatatcagaggtgttaagacaacacgtgattatgcaagggattcgattgaaaaaatcggacataaagaaaaactgtcacttatgtatgaagaaatgaaagatgagacagaggaagaacttcaggaggttctttccaaagcaggagaccttgatacacagatagatgtcaattacgagggatttctggatttaagacttaaggacagaacaatcggatatattaagaatctggcattaaggcatgattacagaataccgtatataacagactcaggaagtacaggtatgctgaagcttactttggttcaggatgacgacaataaaggtcgtatatctgtaaacatgctaagcagcgtattaggaaaagtttctgttgaggctaaggctgacagagaaagtcttggtatgtacattgtcagtgacacagcagtttcagatgaaggaagccagcttcttgaggatatggaagaaaatttaaaagaaggatttggatttacaaatgtgaccgtcaacattacaaaatcgtcagacgtgccatatgtgacttatgaagcagcggctgacagtgtggcaacagataagctgtatgaaattgcagcacagattgtaaaactgcttgcaggctaaagatttgcacagaaagtccgatatatagagcatgaacaggtaaattggacagacagaaaggttaagatatgagaataggaactaatgtggcagcgattgttgccaacaatgcattacagaaatcacagaataatctgtcaacatcaattgaaagattatcatcaggatacaagataaatggctctaaggacgatgctgcaggatgtgctatttctgaaaagatgagagcacagataagaggtcttagtcaggcccagaataatacagctgatggagtttctgttttaaatacagcagaaggtgcaattacagaaatccagagtatgctcacaagattaaaggaacttagcgttcaggctgctaatgatgttaattcagatgatgaaagagaagctatacagaaagagatagaacagattaataacgagattgacagaatatctgatcagacagaattcaatacacagtctcttattaacggtaatctttcaagaagagtatattcagaccttcagggagttaatcagctttctgtatctgacagctatacagcaggtgtatatggaataactgttactgaggacgcaagacaggctatagcggtaggagcaggaagtattactatgtcatcaacagcttctataacaaaagaacaggaaggaacaataagcataaacggttacaagataagcatttccgaaggtgatacacttgataaggtgatgggaaagattattgacggagttaacatcacaggtggttctgcatttacagttaaagaccttaataatgatacagcagctaatggtactgattatgcaggttatgtgccaacagccgattatgctggttcaacacttgttattatgactaaccagtatggaagcgaccagaagatgaatataacatgcgataatgcagagcttgcagatattttgggaataccacaggcagcaacacaagatggtatatatgtagaaggaagcgatgttaaggcagagattgctacaggagatgatggaaagcgaattggttttgctgattcggcaattctttcaacaaagggaactgtaattacagtaacagatgttaataacaaagagttttcaatggatgttccaggtaatgcggcaggtactgtatttgacgatagtaacaatgatggacagtcagctgcaggtgcaggtacagcgagaactataagtcaggaagtcacagacgttggaactatgagcatacatgtaggtgctaatcaggatcaggttattgttattgatattccggcaataacaacgtattcacttggcacggagcatatgaatgtcatgactcagtatacagcatcaagggcgatatctactgtagatgaagctattaataagactaataaaatacgttcaagaatcggtgcatacgagaacagatttgatcatacaactaataaccttgaggtttcaagtgagaaccttaccaagtcattatcaacaatgatagatactgatatgtcagaagagatgactacttatacttctgaaacagttcttacacaggcagctacgtcaatacttgcacaggctaatgaaagaccttcacaggtattacagttattacagtagtttaagattcaatggttatataggaaagggatgctatgactaaagaaacaattaagacatttcagtatagaattacacaggcaacagcatcacagcttgttgtgattctgtatgatatggctatagaatatcttaatgatgcatgtgagagtgatagtgctaagcaggcacataataatatatatatggcacagaaggttatagaccagcttatatgcggacttgatatgcagtatgagatatcagctaatcttttcgtaatatataatcatatgaagaggtcacttatttcagcatctgtaagtcttgataataatgagattaacagaattacagggcttttaaagaaactcagggcatccttttatgaggttagtaaacaggatgattctgagccgcttatgaagaatacacaggctgtatattcaggccttacatattcaaaaggtggaattagtaatgaaacacagactgataatatagaaaacagaggattcagggtttagctccgaatcctctgtttattataatctgcgtcttcttctgttatagtgtcttctctgtctttttcttcttgcccgttcttcaataatgtagatgataaaaagaataacggcaccaattccaacaagtatccatatattaattctgatacatgtttttggtttataagatgatgaaacatcattattaatgtatggcagcaggcttccggtatctgttccggcagcagatatattaagtgtagttgtgccgacagtattatcattgtataagaacttaagatgtgttgtcataacaccattctcattggtcatgtcataattatcatcaaccgtcattgatacatttgacaatgaacttttattaggtattgtgataaatgaagcgtttagtccaaagtttagtgaaagagttgagaaaacagccgagttgtaatagttgtcattagagaacattgctccgagctggcttccggttgttgttgatttctggaaattggcaaatccccagtcaaaaagggttcttgtatcaacatatcttatctcatctgtggcttccttaaatacaacgcatataagacgcataccgtctttttctgcaaatgtaacaagtgtattctgtgattcatcagtatatcctgttttgccccccttgcagtattcataatagtaggcacgaccctttaacatcttgtgtcggtgtcttattgtacgctgtgcagacatgttagttgcaggaattacatatgcatcggcagttgaatcaatgctgacaaaagaagcattgttatagcaccctcttgcaatcattgccatatcatatgccgttgtgtagtggttggtattatataatccgcttgcattggcaaaatgtgtattcaaagcaccaagttcttttgccttggcattcatcatatcgacaaatgcatctattgagccagccacatgttcaccgagggcataagccatctcgttggcagaatacagcagaagtccgtgaagaagctggttgacagtaaattgctcgcctgcttttgaacttaagttggcatcctcatatacattaattgagttagcagctgactgtgaaaatgttacaacatcgtccatattacagttctcaatagtaaggagccctgttaaaatcttggttgtgctggctggataacatttttcatgagagttcctctcgaaaagaatggaacctgtatcagcatcaataagaatgcagctgcttgagttaacatcaggtgcatccggccatacagcctctgtgctggttgtgtctgtctcgctgtagactttgttgtatgctgcagcctgggtatccgctgcaaaagttgagaataccaaaacagtggcagatacagcgctggttatctttataagtaatccttttaaaaattgctttttcattatagagataattcctccgattaataaaatatacaaatacattgtagcccaggattgtacataagtaaaccccgcttggcaaaaagtgatatttatggtaaataatatataggaaactcagatttcggctatgtctgtgtgcggcatgtgctttcaggatgacttcgcttagcatgagtaaatgccgccatctgcaaagtctattacagtgcgtgaaatcaaacgcacttcgtttggacgtgctttcacgcactgaacttatgcagatggtggcattaactcctgcacagcttgtcatattcaagcgtataccgcacacggacatagccgaaatctgagctaatatataagataggagtaatgtatgagacttagaaatgtacccggagcaagggaagtaatgatagagaatgaatatgtgtttacagagccagaggggatgaaaggcacatggtcacaggttttcggtaacgataatccaatccgtattgagattggtatgggtaaaggcacatttataacaacattggcagcaaataatcctgatattaattatgtgggtatagagaagtattcaagcgtacttttaagagctgtagagaaacaggatgagcttcagcttcctaatttaagattcatcagaatggatgcagaggcaatatgtgaggtgtttggagcgggagaggtagacagaatataccttaatttttcagatccatggccaaaagacagacatgcgaagagaagacttacctcaagacagttcatggcaagatatgacattatattaaagccggacggacaggtggaattcaaaacagataataaagatttattcgatttttcattagaagagattaaagaggcagactgggagcttcctgttgtcacatttgacttacataatgactctgtacttaacgagggtaatgtaatgacagagtatgagacaagattttcacagatgggcaatcctatctgtaaacttatcgcagtaagaaatcattaataataaatgcatatactatataaaggcttttggagaattgttgtgaagaataaagcatttgcaaggaaagtatcagaagtgatgtatgtgcataaaggtgcgaattacagagtggtaagatttaagaattccctcgacgatgtcgtgagaattcttaataccaaaaaataatctagaggtcatcgggcgagtcataaggctgcacggtgacttttcttttgtccagaaaatgctgcactgtaatgtttaacaggtagcttaatacggcaaatacgggaactccaaggaacattccaattacgccaaacagcgccccacctacggttattgagaacacaacccatacaggcttaagacctgtagtactgccgatgatacgaggtccaataagcagaccgtcaacctgctggatgcagacaatcatgattacaaatatgataagtttgatagggcttgcgataacaataatcacaccgccaatcacgccaccgatgtatggtccgaaatacggaatcatgttcgttatgccgacaatcacgcttataagaacagcatatggtagcttgagaatcagcatgataataaagcagataatcatgacaataattgagtcaaatgatttgccgataatataattaataaaaatgcttgcacaattcttacagatgatgcgtgtattgtctgctgttttcctaggaagcacggcatataaaaatctcttaaaatgataaaagatattcttattatcagaaatcatgtagatggacacgataattgcaataacaaggtttaacacacccgaaagaatggccatggatgtattaagaatgtaaggaaccatattggtaagtgcaccagtcatgtagtcaacaagtttaggaagagcatcttcaatcttctgattaatgaaattgtaatcaatagaagaattggcgtgcttatcttcaaactcagtgaaccagttgcggatattctcgtaccatacaggagcctgattggcaatctctgtaatacttttgtatatctgaggcacaacaaagcctattaatactgcaaatgcgccaactgctatcaggtaagcaacaagaattgaaagcattttggcggctttcttggacttgatatggcatacccccatgaagaacctgttataaagggccttgataaacggataaagaacaagcgcaatcatgccaccaataagaaatggtgacagtatatggaatatattgccaaatgacttgacggttgcaggccagttaccaatgaacttatatataagaattgcacctagcacaaaaagcagaccatatataacaattgtaaagtatttgctgttaggctggaatacattcttgccaacagctttgtcaggttttggcggctgttcctgttcagaatcaagattaatagcctcaattggaatattgtcaacgtgttttggctgttgttcgaatttttttaacttcatatcaactctcttttcttaataaatgtatattaaatataaatattttctcttaaaattgggaatataatagaattataaggggtataaaggcacatatcaatataaaaaacatggtaaaatgatgaaaaaacaagaaaattataaaaaaagataaattgttcttaaataaatacaaaaaagtgcttgcattttattaaactatgctatagaatatcacttgtgcttgagacaacacaaaagcacagaacaaaataagttatgcaccgctagctcagttggtagagcacctgactcttaatcagggtgtccagggttcgaacccctggcggtgcactggaaggtcttatgatttagggaatcctaggttgtaaggcttttattttttttatacagtaaataattgcagtagcagaaggaatatttacacaggaagcgttgagagtttatttcattgcagatggtgtgagtattccttttagtatatatgcatataaatatctgtgtagatataggtatgtgcgcaatactgtctttctgataggcggattttgcattatgaatttggaaatattgagatttataatatgatacctataggtagtcggatttttacatttcttataggaagattctgtgagaaaattccgtattttatgaaaaattcctataagcagttagctaatgtttgattgataggttgaatattgggtattgagtgtgtggaatgcctggaaagggagattctctgcctataaggatataataaatgcaagtttgataggttgagagtttccagaattataggatagcagggttgtaatcataaaacaatgttaatatcttgacaagatgatatcaaaatgatatcatacaaatatcaacaaagacacctttaaaagaataatcgataacaagatgaataatcagagtgtctaggaggtatttttatatggaagaaaaggttttgaagaaaagcaagaatggtcttgcaatggttacactgtttatattactttacgcagcagctatagcagcaattattgtcggttcgattatggttgaacaggcagagactaaagccggatggatagtacttatcgttgcaggcggtgtatacgcagcaataggctggatattctttatcggtcttaaggtattaaaaccacaggaagcacttgtgcttacactttttggcaagtatgttggaactattaaagaagcgggattttactttgtgaatcctttttgtgtggctgttaacccggcagcgtcaactaagcttaatcagagcggtgatgtgacaggagaaggaaataagcttgatctggctagcatggcaggtgttgcaggaatggcaattgcggcaggaaataattcacagtcagctaataagaagatttcacttaagataatgacactgagcaacagtagacagaagattaatgactgccttggtaatcctgttgagattggtattgcggttatgtggaaagtgacagatacagctaaggcagtgtttaatgtagataattataaggaatatctttcattacagtgtgacagcgcactccgtaatattgtccgcatgtatccatatgatgttgcagaaaatgtagatacaacgggagatggaattgcagatgagggaagccttcgtggttcaagtgaagttgtagcagaaagaataagaaaagaaatccagggcaaagtagcagatgccggacttgagataatagaagcacgaattacatatcttgcgtatgcacctgagatagcagcagtaatgcttcagagacaacaggcatcagcaatagtagatgcaagaaagatgatagttgatggtgctgtaggaatggtagagatggcgcttgagagattatcagaaaaacaggttatagagcttgatgaagagagaaaagcagctatggtatccaaccttttagtcgtcctttgtggaaacaaagatgcccagccagtagttaattcaggaagtctttactaatggcagattcaggtaagaaacaggttcctctccggttatcagctaaactctatgatgccattgcagcgtgggcagaggacgatttcaggtctgttaatggacagatagagtacctgctgaccgagtgtgtacgacagagaaagaagaacggtgcgccagttccgcacgagctggatgttccaccagagttagatatcaggtagaattaaaaaaataaatatataactattatatattaaaacctccccataccgacattataaatgctggtatggagaggtttttaaaatatacaatattgaataaatcggtcatcatatatgcatatccgttatcagaaattctaaccgcgagaattaaacttacttgtcataagtgaatataaatcatctgatgagttagaggcgacacctgatgatgtatatgagttggtaacataattaatgttagcctttgcaagtgatgatacattagagccaataattccaagcctctttgcaaattctgatgatgttccaaatgctttctttaaagtatctgtatcagctgctttaagtttattttcatcaattgaaagagaaccatcgtctttaagcgcaattcctactgcagataatgtttcagagttctctttaactgcttcctttaaaaggtcagaacacatagtgttgatagaacttgatgttttaccaagggtgttgtagagcttattataagaatcaactacagatttgatatccgcatatattgcagaataatcaccggtcctttctgcatcagcaaaaagagtagatttctcatatgtgaatttagctgcattctctgtaacagaatcagcatcatctttaatattcttgtaagcgtctttctgtaatttcttagtaagtgaagatgttgaagtatcaatttttttggaaagcagacttgtaaggctgtcattgtcatcattctgaatgtaatcaagcaaagtctttgatgaaggctcaatgcctgctttaagctggttagctgccagcatctgtgatgtaatccgcataagtttcctccttatatatcaagtgtgattgaatacacatttatcagctgaatattatatcggataaaaccaggtgaaacttaacatactaccttcgaaaggaggtggcataatgtttccagcatttgactataatcatgaaaaagatgagtacagaaacggatacgataatgggcagggcgataaaggttatgatgacggtgagaatgaatttgccagcaatcttgacgagagtgatgtaatgcgtccagtcaattcgctagatgattatacaagtttccttttgtggggaactgattttgatgacaagaataatatctaaaaatagtattaataatttattaatctttgaaaggctgattgactgaatattttcaatgttatatgataagcgaaaatggaggtatgagtttagtatgtatgggtatatagttgttgatcagccagaacttaaattcagagaatttgataaataccgctcatactattgtggtctgtgcgattcgctggcagaagcgcatggattgaaggggcagatttccttaagctatgatatgacatttctggttatacttcttacagggttgtatgaaccggaaactatatactctgaggaacgttgcgtcacacatccattaagaaagcatcctgtgaggcgtaacgttgtttcagattatgttgcggatatgaatgtccttctgacatattacaaatgcatggacgactggtacgatgagaaaaaggtcttgaaaagaacttatgccggagtattgaaaaaagatattaaaaagcttgagaagaaatatccgcagaaggcagagattataaggaaaagcctttctaagttgtcagaatatgaaaaagcacaggaaactaacattgacaagccggcagagcagtttggcatactgttaggtgaagttgctgccatgaaagatgatgagtggagtgatgagttaagggtgcttggcaataatcttggcagattcatatatctgctggatgcatatgatgatttggaaaaagatgagaaaaagaacaattataacgtatttaagtatcataaggatgtagaggattttgatacatttgcagaaaacatacttaaagcatatatggcaggatgtgcaagagcttttgagagactgccgattcttgctaatgcagaactgttaagaaatatcatatattcaggtgtatggacaaagttctacgccgccagaagaaaaagaattgacactgccggtaagcagttggaggaacataatgacagatccatataaagtgttgggagtatcaagggatgcttccgatgatgaagtgaaaaaagcatacagaacactgagccgaaagtatcatccagatgctaacatcaataatcctaataaggatcaggcagaagagatgtttaagcttgtacagcaggcttataaccagataatgcgtgagcgtgagggcggatacagtagtcagtcatacagccagacgcgttatggtacaggccgttcagatcattatggctatgatggtgattatcagaaccagtcacagggcggatatggagatttcggaagcttctggggatttggtccatttggatttggtggatatacaggaagctatggtggcaatggatatggcagtgatagtctcaatggcaatgatcctacaacagtgcatctgagggcagcagctaattatattaataactctagttatgatgaagctattaatgtgcttaacaacataactgaccgtgatggaagatggtactattacagtgcgttggcacatcttggaaaaggagaagaagcaacggcattggaagatgccaagcgtgcgttggattctgatcctgacaatatgcagtatcagttgctgtatcagcgtattgcaagcggcggaagctggtatgcaggaagaaggacgcagtatcaggggccgtcatctacaacatattgtacaggctgtgctccgtgggttgcactctgcctgtgttcaaatatatgtatgcctatgtgctgtggctatggttcaggcggctattatccgggtggaagtatataaataaataagggatgttaccagactattgtgttaaggtaacatcccatttttaatgttatttttcttttttaatccatgcatcaaggttgttaaataatatatcaaactgcacaggacccatgtcgagtatatattgatgaaaatttttaagattgaatttgtcagaaagctcgctttgagccttagtctttaactgctcaaatcctaacattccaagaacgtatttgcaatagttgcctgggtcagagacaaatgcgtaatacatttcgtgggcgactgatttatcatcaaaaccatactggctgatgaatcggtaaacatcatcttcactccatccatagtaattaacgccaatatccccttttgcataaaggcacaggacagtggcataattagcagcatacattttgttaagtgcatcgttgccggtctgtgcataattataagaaagaacttcaacatatgatgcccagccttcaacatatccgcctggtgcaagaatgtatcttatccagtcagggttggttgcggcaaaatactgtgtctggtacatgtgtcccggataaccctcatgtgcaagtgtaggatataattcactcgcagaagtgccagaagaattgatgtatattgaattgacatcaaggttatctagctgcggaataaagtacatagccggactggtgtagtcctcaagcgcctttgacacatatttgatattataattcacatctggaatctcaggaaaatcatcggttattcttttcttaaggtcggtaagaataccaaccgggtctgtcatattgaatgaaaatgtgtcaaatttatcaagaatagaggagtctttaagcgcaagtgactgcattttaagcatatatttcttgaggtaagaatcaaccagcttatcatattcgtcaacagatttgctccagccaagtgttgaagagagtatatattcaaaataccgtgaaccatcaggataattgcataaaccgcctgaatatctgttagagcctttcaatgaagtaagcgcatttacaagggactgatatcctggaattacatgttcattgactgcggacacatttttagctttataatctgcaatatcctgtgaagaaagtccgtcaacagaagcaagcttttcgttaaaggttgatatcattgcaccatcttctaaaccggcagtttcaaggaatgatttgcagctttcaattacctcatcggcaagggtatcttccataaaatatccgttgtcagcacgaagcttctcaaatgcagccatattttcaaaatatccgtcaacatcacatagaagctcaatatattcgtcaatatccttcttttctgcaaatgtgtattcagcaaaaagaagtggcagctggacatgaatacctgtagttgtctgaagctgtgtgttaaacatgtacaaatcactgtattccagctcattttccatatacataagaagctcatcaagcgtaatctgctgtttagcggagagtgtgcttctgtcaaatgatttaagcgttgatattatgtcggtgtaatctgaggtgtcatcgggattgtcaaggtcgtagcggccaagagtaatctcataatcgttaattccgaaatccctggggtgttcgacataggcatgcaaagataccatgtcggcacttaacaggtcagcaaacaggttgtttacatattccgtgaaatcagcattatcctcggtggcagatatagtagtttctgatatctgcttctgattccagggcaggctgcagccagacaggataattactattataaaaactatcagcaggctcacagccttgttaagaaattgatgtaaaaggcaaaattgtttattatgcatactaatcctcatttctgtcttaattaatattataagaaatactgatttattattcacatattgtatcatacttaatacagacttgacacttattgtaaatttttctatgataaagtttacggataaatgattcacactacatttgcgttatagcgatgaattagaataatagattatggaggaaatgatatgccacagagtaaaggtccattttatatgacaacagctattgcctatacatcaggcaagccacatatcggtaatacttatgaagtcgttcttgcagacagtattgcaagattcagaagacaggaaggctatgatgtatttttccagacaggaactgacgagcatggtcagaagattgagcttaaggctgaagaagctggaattacacctaaggaatttgttgataatgtttcaacagaaatcaagagaatatgggatcttatgaatacttcatatgataagttcatcagaacaacagatgattaccatgagaagcaggttcagaagatttttaagaaactttatgatcagggagacatttataagggttcatatgaaggcatgtactgtactccatgtgagtctttctggacagagagccagcttgttgatggaaagtgtcctgattgtggacgtgaagttaagccggctaaggaagaagcttatttcttcaagatgagcaaatatgccaacaagcttattgagcatatcaatacacatccggaattcatccagcctgtttcaagaaagaatgagatgatgaacaacttccttcttcctggacttcaggatttatgtgtatcaagaacatctttcaaatggggtatcccggttgactttgatgacaagcatgtagtttatgtatggcttgatgcccttactaactatattacaggtatcggatatgatgctgatggcaattcttcagagcagtacaagaagttctggccagcagaccttcaccttatcggtaaggatatcatcagattccatacaatttactggccaatattccttatggcacttggtgagccacttcctaagcaggtatttggacatccttggttattacagaatgatggtaagatgagtaagtctaagggaaatgttatctatgcagatgaccttgtagacctcttcggcgttgacgctgtacgttactttgttcttcacgagatgccatttgagaatgatggtgttatttcatgggagcttatggttgagcgtatgaactcagaccttgccaacacacttggtaaccttgtaaacagaacaattgcaatgtctaacaagtactttggtggagttgttaataagactggcgtagaggatgctgcaattgacggtgaccttaaggctgttataacagcaacaagagataaggttcaggcaaagatggctacacttcatgtagcagatgctatcacagaagtattcacgctctttaagagatgtaataaatatattgacgagacaatgccttgggctcttgcaaaggatgaggcacagcaggacagattagcagaagtgctctataaccttgttgagagtattacaatcggtgctaatcttcttaagtctttcatgccagagactacagataagattcttgcacagctttacccagctaatccagaggcaggagtaagagattttgatgaccttgctacatttggcttaagagaaacaggacttaaggttactgagactccagagattcttttcgcaagacttgactttgagaaggaccttaaggaaaaggttgaagctattcaggaagcacagaagaaggctaatggagttacagaatatccacaggttgaagttaagcctgagattacatttgatgattttgaaaaggttcagttcagagttgccaaggttcttacatgtgaagctgttaagaagacaaagcttcttaagttcgagcttcagattggtgatgagaagagaactatcgtatcaggtatccagaagtactataagccagaggagcttattggtaagaagttagttgtatgtactaacttaaagccaagaaagatctgtggtattgagtcacagggaatgattatctcagcgtgggatgataaggataacttatcagttcttacacttgagaaggatattattgaaggcgcagagattggctgatagatatgaagatatttgaaactcatgctcattatgatgatgaaagatttgatgaggacagagatgaacttataagcagcatgcttagtgatacaggggagcttgattacattgttaatgtaggtgcaagccgtcagggctgtgaggcttcccttgcacttgctgcacagtatgaaaaggtatacgcagcgattggtttccacccggaggatattgtaagattgaaagaatcggacattgaatggctggaaaatatgcttggtgaatctaaggcaagaaagattgttgcgcttggagaaatcggacttgattactactatgtgtcagatgatgcagatgttgcggcggctgaaaagaagcagcaacgagaatggtttgcagcacagatggatgttgcgtaccgcacacacatgccggtaatgattcattcaagagatgcatgtcaggatacaattgacatattaaagagtaatcacggacaggatacaggtggaataatccactgttattcatacagcagggaagcagcaagagattttcttaacatgggcttttctataggaatcggcggcgttcttacatttaagaatgccaggaagcttgtggaagcaaccgcgtatataccgatggatagaattgttctggagacagacagtccatatatggcacctgagcctaaccgaggtaaaagaaacgacagccgcaatataaaatatgttgcagaaaagctggcgcagattaaagggcttgatgcgcaggaggttattgatgttactaaccagaatgcgagaaggctgctttttggggagtaaggtttcgaggactttgccggcaggacagcccttttattgtgtaaactgggtgaaaacctataaattataataaaacggctatttagtaggtcttttaacgtggtttttattgataaagccatgaaaacacctactaaatagtcgttttttgttgttgtataggtctttagtctggaaataacctgttttacgtgaattttgctgtaaaaatacctactaaagcagcgaaaatgcgactacttataggtatcacgttattttgcatgaataattaccccaaacatccggttggaaaagcattggggaggtaaaacgtccggttagcaaaacagtggattggcaaaacgtacagttgacaaaacatctggttatcagattctttataccagcaggttgctaagctgtgcaaactgctcaagtgtaagggcttcgccgcggatagtaagcggaagtcccatagtttctaatgcgtttgtaagagcttcttttgtgatgccgatgccggaattgccgatactgttaagcatagtctttcggcgctggttaaatgatgctcttattatcttgaacataagatgttcattcttaacatcaacaggtggggttttgaagcgctcaagacggataaccgctgaatcaacattaggacgaggcatgaagcagctagcaggcacattaagcacaaccttaggcttggcgtagaactgtacagcaagtgaaagtgcgccataatctttagttccaggaccacattgcatgcggtcagctacctctttctgaaccatgatagttatactgtctaatggtacatggctctcaaaaagtcccataataataggtgttgttatatagtatggaaggttggcaacaaccttgattggtctgccttcattcttctcatctgcaagcttcttgatatcaagctttaagatatcttcattgattactgttacattgtcataataagaaagtgtgtcctctgtaaggataggaataagcttcttatcaatctcaacggcaacaacttctctggcattctcacacagaatttgagtcattgttccgattccagggccgacttcaacaacgaaatcgtctttcgtaacgcctgcttcacgtacgattttctcaacaacattttcatctataagaaagttctgaccgaactttttcttgaaatcaaaaccatatctgttaagcacggcaatcgtgttagttgggttgccgaggtgcataacattattatatttattatcgctcatattgcctccaatctataagaataatgttatgaaacttaataaaaaatgtcaagctgcaataaaaatgtagtgcaaaagtaacttttgtatgatactatagtactacttacaatcgagaacatattatcaggagatatcatgagcattaataaaaaagaatttaatctggaacaggttgttaaactatgcgtggttgttaacatatcgttgtttttatttgttgcatttatgctgacattatttgtatattttaatataacaccaatgatttattacagtgtaatagcactgattggttatgtgttatattttatgctgttaaaaaggcagaaagtgtgtgcatatatgtggtgtgtgtatgcaacaattataatttatatggctattgcaacaatatgtcttgggtataaatgtggatttaatctttatagcatgtcattaatacctataatattttattcacaatacatatcaaccaagaccgatacaaaagacccgaatccactggctgtgtcgatagcaatagttgctgtaagtataatatcatcagcaatagctataattaacggaccattgtatgaaattaataaaacaattatatctgtgctgcttgcatgtaatgcaataagtgtatcagcatttttaatatattatactaagatgatagtcgatcttgttattgagtctgagaagaagcttaattcaattgccaacattgatcttctgacagacctttacagcagaagatatatgattaattatcttgaagaatatgatgcggacgatgaaggctggcttgcaatggcagatgtagatgatttcaagaaaataaatgatacatatggacataactgtggtgattatgtgttaaatttcattgcacagaagatgaaaaatatatgcagtaaatgtgtgatttcaaggtggggcggagaagaatttcttatacataatggaacccacgacagcacacatgaagtattagaaaaattgaggagagaaatagaaaactctgaatgtatttataaacagcagaagataaatatatcactaacaataggagtggcgcagagaaatgccgatggtgatatagaagaatggataaagcgcgcagatgacaggctttattacggaaaaaataacggaaagaatatggtggtagattaagataaaacctccctgatggaatattttcttaatgcatggcataaggtgcataagagagttaatcatcagggaggtttattgtggattatcagcgtcttgtttcatacatatattcatatccggaaggagtaaaggggagaaatgtaggatttgcgaaggcattagttcatcaggggcagttcaagttaagcatcagtttaagaggcgttaaaacagacagtccggaaatgtttggaatatatatgatggttactgacagcggctacaggcttataaagttaggggaatgtcttgtaaaaatgggacagatggaatacagtggtgtatttaaccctgataatataaatgacacaggttacagcttcagggatatatgcggacttgcggttgcaatggaggacgcaagatatgactgcatgctttcaatgtggaaagatgaagatgtaactcctgatatgcttgtgttctcaggaatggacgcaaagaagcaggctgaggccgagattgtcataaaagagcgcatgcggcagagtgatgaggaagagaaacgacaggagacagcagagtcttcggtggtcagacaagagatggctggatacaatgcagcaatgaaggaacggggacagtcagaatcaggcggacaacagccggttcagtcagaatctgcaatgttggcgggaaaatcagaaatggttcagacgaaacagattgtggtggaagaacagcagatagttcagacaaaacaggcagaggtggctgccgaaagtgtaaccatgccggagaatataaaagctgatggagcagcagctaaaatacctgcggaaacacaacatttgcagcaaaaagcacacagagccaatgcaacgcagacggatccttttgaaaagctttttgtgcgggctgattatatagatgcatttgacgatgattacttctatgattgtatagaagtgtcgccagagaagttaaagtgtcttaaccagaatgaaattgatatcgcgggaaacagcttcctgctgcatggctattataatttcagacacatactttttggaagagtgcgcgataaccttgataatactaaatatttcgttggcgttccgggaatgtactgcaaccgtgaacgttacatggcttcaatgtttggctttaataattttaagaagagtcacaggagtgactatgccaatccatatttcggatactggtatcaggagatatagacgaatcttaaatgatcctgccatgagccgttaagctttacataggagtaggcggttccttcagatataaagccaagagatttgacaagattaatagaggagatgttttgagggtgaatgtaagcttcaatcctgtgcatctccttttcgtgtgtaagaatctcaagcatatgtttaaccataaggcttccaagtcctaactggcggtaattcttatcaatcttatatcctatgcggcaagaacggttaatgcttgtaacaccaaaaaaagatacagagccgagaatttcacctggtaagtcgtcagaaaaaaggaaaaatctgccgaattcaccctttagtaaagcagcatattcagctttaagtgtggctgcaatatattctgttgtatagaaattatctggcttggcagcttcgtatctgtcgaattcctcacggttagagctgtaaaattcaagtacttttcctgcaaatgtttcatcaagtactttaagcttcatgccttcaaaagtgtattcaaatttcataattattctccatcagtagtgacagtagtattctttttcttgcttttacgcagttccttgaaaaatgttgtgagcatttctgaacattcttcttcacatacacctttagtgatttcgcattggtgattgaatgtgggaatctgtaagatattaagtatagaaccggcacatccggctttgggattcatggaaccgataacaactcttggaattcttgcctgaacaatagcacctgcacacatctgacatggttcaagcgtaacatataaagtgcagttctcaagccgccagtcgttcatgtagcggctggctttcttaattgcagtaatctcggcatggccgagagaggttttatcagtgttacggcggttgtagcctcttcctataacctttccttcatacacaatcacacagccgataggcacttcattgagtttataagccttcttagcctgtgtgattgcctgtttcatatatctgtaatcatctttttcaaaaaccacctgagtattctccactagattatcctccacaaaatattataaaaattttaacttttttgtgaaaatgcgtcaacttatcaggaacatttttcgtattaatagtaaaaggagggaacgtgcgcagaattatgattgcactggcacagagtagtagtataatgattatataagcaggcagtatgggggtatcaaaagtcttatacttcatgcatcggtaggacaattcatggttgtgcgctatatgacagagctggtatgtgagtttgtaattatgctggttatgatgaaggttggaaaatcattaggaaagagaaggtacagggtatgaaattagaggtaaggaatttaaagaaaacttatggtacagttcaggcactgaaggggattaattatacatttacaccgggagtatatggcattcttggagctaatggagcaggaaagagtacgatgattaatcttatcactgataatgtatcaagagacaagatgaatggcggaagtattctttttggagaggacagtgccgaggaagatatattaaagcttggcaaacagttcaggggtctggttggatacatgccgcagcagcagggattttatgaggatttttcgcctaaagcatttcttaaatatatggcagagattaagggggttaagaagattaagactactgatgacaatggcaatgaggttgttaagacagtcaaccagcagattgacgagctgctggaggtagttaatcttactaaggttgcatataagaagattggaggattttcaggaggaatgaagcagagagtgctgcttgcgcaggcacttcttggtaatcctaagattcttatacttgatgagccgacagcaggacttgaccctaaagagagaatctcaataagaaactatattgcagagctgtctaaggacaagataattctttttgcaactcatgttgtaagtgatattgaatgtattgctgataaagtacttcttctaaagagcggagaaataattgcgacaggaacacctgttgagcttattgaaagcatggctggaaaagttggtgagataacatgcacgcttgatgaggtcggcgagctgcagaaggaatacaagattggcaatatcagacagagaaagaacggtcttgcgttaagagttgtaggtgatgagctgccagaagaagcagtaaaagttggagataatattgaccttgaggatgtatatctgtattattttgagtagaatattggaatatcagattgtcagggagaaatatcatggaacttattaaaggaagacctgccgatgaaacaggaagactagaaaaagaaatcagagtatatgatttgttggataagcttggaatggaatattacagaacagaccatgagcctgctacaacaatggaagtgtgtaatgacatagataagattctggacacacttatatgtaagaatcttttcttatgtaacagacagaagacgaatttttatatgcttatgatgccgggtgacaagccatttaagacaaaggatctgagtaagcagattaattcagcgagactttcatttgcagatgaatcatatatggaggaattccttgatataacaccgggttcagtatccataatgggacttatgaatgatacggataaccatgtgcagttactgatggataaggaagtgcttgagggtgaatctctcggatgtcatccttgcattaatacatcaagtcttaaattaaagactaaggaagtgatggagaaattccttccggctgttcatcatgaggcggtgatagttgagcttcctaggtatgaagaacaggaataatatgtttggagtaatacgtttaaggtaatggtttaaggcagcttctgcgtggattgcggaggctgtcttttttgtgtgtggagattgttaatttcgtgggggttgatggttacagcgtgttgaagagggaaagacctacgcaagcttcacaatatgcagaatgggtgggttgaaattatgagaaaaagacgtgttgggaagagaaaaacccactaatcaagctaatacagtggaggtagtaggtctttggagaggtaagagtatcattaaatagaagaaagtttggaaaaagacctacgaaaaggcaagaatataatgattgagtaggttagcaagaggggatgacagtctcacagtgcttgaaaagacctacgcaatagcgaagttgatagaggatagtaggttatggcaagtttctggtgatattcgggagtggtaagaagttggttttgccgcctgttctgacaaggattgctaaagccagtccttaggaaatgattcttagggactggcttatttagctgtcttattttgtcaacgcttcacaccttgacaacaagcatatataacaagtataattaaaataccgtgcagccggggtagtagcggcaccttgaacctgcaatccgctatagcaggggtgatgttcggcagagggctgatatttatggagcagcccggtgtaagtggtgttgacatttgggtctttcacgacggaaatccacgaaccatgtcaggtcaggaatgaagcagcattaagtgggaccttccgggtgttgaaagggtgcctggatcgagctaactgcatcggtaacgtctgtggatatcagttcgaagccggacgcacggcttttgttattaaaatgttactcgtcgcagctaatttaggaatgtcaggcagattcgtcatgcttgcatgtaagaaactgtatgatattcctaaattatcctgcgaagcaggaacttaaccgacataagtaaaacataagctgcgaagcagcggcagacgccggaggcggatggttttacgcatgaggttaagggctgcgaaagtaaagacagcgcagagggaggtaaccatgtcatatcaggctttatacagaaaatggcgtccggacaattttaatgatgtcaaaggacaggatacaatagtaacaactctgcgaaatcagattaatgcagacagaataggccatgcatatctgttctgcggaacaagaggaactggtaagacatcagttgccaagatatttgcgaaggcagttaattgtgagcatccggttgatggcaacccttgtggggagtgtccgacatgcaaggcgattgcggctggaacaagcatgaatgtaatagagatagatgcggcatctaacaatggtgtcgataatataagacagataagagaagaagtacagtactcaccgacagaaggaagattcaaagtctatataattgatgaggttcatatgctttcaataggagcgttcaatgcattgttaaagacattggaagaacctcctgcatatgtaatatttatacttgctactacagaagtggcgaagattcctattacaatcctttcaagatgtcagagatatgacttccacaggataacaatagagacaattgccgcaagactgtcagaacttatgaaggcggagggactgaatgtagaggataaggcaataaaatatgttgccaaagctgcagatggttctatgcgagatgcgttaagtctgttagaccagtgtctggcgttctatctgggaaaagaccttaagtatgaaaatgtgttagatgtacttggggcagttgacacggcggtatttagtaaaatgctctcaacaattctgtcaggagatgttgccgtgtgcatgtcacttatggaagatttgataatgcagggaagagacctttcacagtttgttacagattttatatggtatcttagaaatctgcttcttattaagacaactaaagatgcagaaagaattgaagatgtaatagaagtatcagcagataatcttgaagacctgaagaaggatgcacagaatgttgatatagatacacttatgtactatataagagtgttgtcagaattatcaaatgacctgaagttctctacacagaagagagttaagacagagataacatttataaagctgatgcgtccggcaatggataacagtcaggatatcggcgatgttgtaagccgtgtgacaatgcttgaagggcagttacagaaagtacttgatgatattaaaagcggcagacttgtaaatgcaggtgctacgggtggtcaggcagcagtacagcagcagactccaaagaagcctgtagttaagcgtgtatatgacgctgttccggaagatgttaaggcaattgcggcaggctggaaggatatcattgcaacgatagatgatccggttaatcagacatttttacaggctgcacatgttacattagcagaagatggaattagtcttgaaattatggtagaatcacttagtgcctataattcactcagcagacaggaagttatggagagcatagagaatgtaattgaggagagaacaggagtaagggtttcaattaaagtgactaagcttaacgatgatgaggatttccacagcagatttgtggattttaaggaactcgtaggcatagatatagaagtagatgataaggaggaacttatataatggctaaaagaggtggttttccaggaggaatgcctggtaatatgaataatctgatgaagcaggcacagagaatgcagcgtcagatggaggagcagcaggcagagcttgagaataaggaattcagtgcgacagcaggcggcggagtagttgaggtaactgttacaggtaagagagaagtatctaaggttaagattgaccctgaagcagttgatccagatgatgtagagatgcttgaggacttaatcgtagcagctactaatgaagctttaagaaaatgcgaagaagagtcacaggcacagatggctaagattactggaggacttggaggattaggcggaggcttattctaatggacatctacagtggtcatattaacagattaattgaagaattgtcgagattaccaggggttggggcgaagagcgcccagcgcctggcatttcacattataaacatgcctgagtctgaggttaagagccttgcagacacaatgattgatgcaaagcagcatatacactactgtaaggagtgttttacacttacagatgaagaactgtgtccgatatgccgcgaccagaaaagagaccataagacaattatggtagttgaacatacaagagatatggcggcatatgaaaagacaggaaagtacgagggcgtatatcatgttcttcatggagcaataagcccgatgcttggaatcggaccggctgatatcaggttaaaggagcttatggtaaggcttcagggagatgttgacgaggttattatcgcaactaattccaatctggagggtgagacaacagcaatgtacataagcaaaatgataaagccaacaggaattaaggtgacaagaattgcaagcggagttcctgtcggcggtgatcttgaatatatcgatgaggttacacttttaagagcgctggacggaagaaccgagctttaaatttggcgaagaaccaagctttaagcttaatgccatggcgcaccgggcattaagacaatatgtgtaaaatgcgtgcgcagaaatgaagaatactatggcagagaatatgacaggtgatatcatatcggatcaccgtgaacgaatgcttaatctgaagaaatattatcctttcttcagactgatagacacatcattttctaatttcaaggatggtaaatacgaaatacttgatatgggctatatagttatggcggttctccgtttctttatagaggagaataattttaaggaaaaggatgttacatatcccgaatatctcgatttcttaaggctgatacttaagagagatttcgggcttgatttgaatgaacaggacagcaaggagattgctgattatatatttgacaagataaagaatgatggcaggccatttgaattctcgtattttgatccggtggacaggaaaaagagagtatcaagaatgaagataatcgagagttcgataagagacaataccgtgtggtattcgataagccctgatgctattgaattctatcttgataccaaggaaatcaaggacgagagcaggataagcgtatcccagcttcttcttgaaaaaatgattaattcacagaacttccgtggcggagttgaagtggttgaaagaatcaacgaagaggtcaaccgccttaagttaaagaagaatgaagtgctgacaattctgtcgggtgatgtatttgcaggaatagaggcttatgaggaattcgtcaagacaggaatgaaatggtttgatgatgaagaaaagctttttaagaagaaccgtgatcttattgcaaaatcaatcgagaagcttaatgcatcgggcagcacaggcgaaggctattacaggacgatgaacgaaatatacagtcttgagactcagcttaagcaggcaatgaacaggcacagcgaactgttaaaggattgtacagaaatgcagaagatgaccgatgacgcagtaagacgcgccaagcttggcagattaagaagccatatggatttcacatcggcactttcagatatgattaagagggataatgcagatatattagtcacaatgttaagtccgcttctaaagccgaacataagaaagacatttgacctgataagcattgatgatgcgcttatggtgaagcctccaagatatgaggagaaagagcttataagcaatgaaagaccggaagatattgaattcgcagatgagattgaagaaaagagaattaaggataattacatattccttatgaaaaatctcattatgtgtttgaaaaaatcggacattataacacttggtcagttcgcagatgcaatgaagagggcgtatggtgagcagattctaagaaatgcagatttcttctctttctttgttaatctgtgccagaaggatgagtaccagcttggcggtgatgcgggagaagatacatttcttgatgcatacttaggggaaggctttaaagatacggaaagctttacatttgcaataagaaaagggcttggcgggcaggttatattgtcggataactgtatgatggcagatgttgaattggtacgaaaggaagcacatggagaatagaaatctagataaggcgctggacatagtttccaagcttatcacaggggaaaatgtgtctgagaggggcgagaatgcagctctttatcaggaatacaataataatgcagaagtgtatgacatcgttcatatgtcacttaagaaacttaatcttaacatatatgaatataacaatggtctgtatgtgagtgcaggtgataataacagggtgtttggatattccaacgaggaattaagaaatgtacttgggttaagagttaataaagaattatatcttgcgtatttcataatctacaacataataacagagttttattcagatacaatgagttcaacttatgctgagttcataagacttgaggacatcattaaaaatgttgataagacaacaggtggtattgtcgataagagcgcagggcttgtgcttgatgaggttgaggagaacagctttaagcagatagcacttacatgggacgagcttccggtgacaacagtagaggatcagacaggagcgagagcagcaagaaattcaaagtcgggtatggtaaagcttgtgcttaatttctgcgttgcacaggaacttttagttgagagtcaggacagatattatccaacagacagattcagaagtcttatagagaattattttgatgattacagaggacgatttgccgaacttatgaatggaggacgcgatgccacagattaacagaatcagagttaataatgttaaatataatttcggtacacaggtgtacgacgatttcgtgatgcgcttcaactgccagaatactatatatgaccttgccaatggcggtggtaagagcctgcttatgctgcttcttatgcagaatatgcttcctaactgcacacttgatgacaagcagccgatagagaagcttttcagacagggaagcggtaatacatgtattcattctttggttgagtggaagttagatccatgttatcagaaggatggtttcaggttcatgacaactggtttctgtgcaagaaagggaagaggcacagacgatgagaatcaggatggacaggaacagacagctacaccgacagcaagtgttgaatactttaattactgcatattctacagggagtttggcgataacgatattaagaatcttccacttgtaagtaatggagagagaattacatataacggacttaaggcttatcttcgtgaccttgagaagggcgggtacaaatatgttgttaagatatttgacagaaaaggtgattaccagagcttcataagcaactacggaatatatgagagtgcatgggaaattgtgcgtggaattaacaagacagagggacatgtaagaacatatttcgagtcaaattataagacaagccgtaaggttgttgaggatctgcttatagaggagattatccagaaatccttcaataacaagctgtcagttgataatgatgagggcatgatggctcagactcttatggatattaaggacaagttagtggagctttcaaagaaacactcacagcttggagcatatgacagccagattgcagctatcgacagttttaaagaatatctgtcgacatatgaagcattttacaacagaaaagaagaaatagagaagcagctatatgacctgcttcttgttgctatgcgggaaagtgataagaaggataaggaacttaagagtcaggatgaccttatcactaagatgtatgatgagcttgcacacgagaaggaagctatagcagttgcagaggttatgtctgaaaagaattcgatggcaggagttgagagccttgttaatgagacaagaaaggcacttgaactcaagaacgcggcaattgaagaggcaagaggaaagctttctttgatggagtctgcgggcgattataaagattatgcagaatatgagaagtcttataaagggcttcggattgcgatagataacagattaagagaagatactgatataacagcagagttaaagatacttgctgcaggttacagaaaattctatgagacagagaccagaagacttaaagaaaagcttgatatagcagctaaccgtgttaaggctctggaagtcagattatcagaggctaaggataaccttagaaatgctgacaaagaggcggcaggtcttggcagtctttcggataatcttgagaatgagatacaggaattacagacacagcttggagcagctttatcagaggcaggaactgtcgtatgtgaaaatgcgtctgaagaatatgacaagtcattcagggataaagaactgttaaagaatgaagagacaagaatgtccgaaaaattcaatgatgtgcagcagcagttaatgtcacttaatgagacaatatctgccaataaagcgcttattgatatatttactgagcagtcagaaaagcttgaaaaggctgatgaagctggtaatgcagatgccgagcgcatgggcaaaatccgtgaaatatatagtgcagataatgacgaggcaatgctttcggttattcttgagacttaccagaagatgcgaagtgaatatacagaagagtgtaaggcagcacaggaacttgagaactttattgacaatgcaagaaagggaacatatacctgtaagagtcctgaaagagacaggcttaaggaataccttgagagccagtacggttcagatgttgttgagggacatgagtggtttgcagccctgaatgcaggacagaaaagagatgtattaaagagaacacctttcattgagtacgcatttataataaagaacgatttcgagagaatcaaagcagatgagatgcttaaggattttggcaagggtgcggctgcttatcctgttataagcgagcaggtgcttattgatactaagttagagattaacaaagacctgattgtattcgcattaaaggatatgtcgttcctgcgtgatgaggcaaagcttgagacacagattaagcttgcacaggaggagcttgagtcgcataaggcgcaggcaggaaagctggccgacagaatggagcttgtgtggaatgattatacatttgcacttgtatataatgctgagtctggaaatgtggatgcgtccgaggcagaagcaatcagattaaagattgctgacagcgaggctgcaattattgaggctgagaagaagagaagtgtgttaaatgaggttaaagagcagctttcaaggaacctcgcacagacaagagatgatatagaagagaaggaaacagcatgcagcctgctctcgcgtattatggagatgaattcttctatagataagaagtatgagcgcttaaagggactgaaggctgatgtggacagtgcaaggaaccgcatatatgagtgcgaggaggcagcagcttctgctaattctgagtatgataccgcgagagatttcgaggacagtacaagaaaggcatatgatgaaatcattaagtcatgggaggagcagtacgcaccttattatgatgaaaatgtttcaatagaaatcgatgacgatacataccgtcttgataaggatgaaatagagagcagattcaccggattaaagacagcactttcacagaagaacagtgactttgcagataagcaggcgctgatgaaccatctgtctgcatctatgaacaaatgtcgtgatgcaatagagtacagaggttatacatttgacgatattaaggcaaagtatgaagcaggtgagattatggcagcaggttcacagcagttaaggaatgccaaggatgctcttaataatcttgtgaagagcagtgattctgtaagggaagagcttgagtcacaggaagcactttttaatagacttgagggaagtatcgcacatggtattaaccagattgagaataattatggaagctttaatgaattcccatgcgatgacccagatggattcattacacagcacaaggtacttatcaagaagttagaggataacactaaggttcaggaaaagacacgcagacagatgtctgattcattaaaagacattcttgtatgcagaaaagaccttgaaagaatcgtgtctgatgcgggcatgcatgttccagaagaatttcgttctgaggatgcacagggaattacagctaatcttacagaatatgaggctgttcataaagaatatgcttcaattaccagattagagtataagaaggttgatgaatttaataagaataaatctaagcttattgacctgcttaacgggtttaatgcagtcgagcttgctgatgaagtaaggatatcgcttaatgttcctgaaaatgtggctaagacaagaagtatgattgaatcgttaaatgagacgaacacatttatacagttagaaaaagaccgcattgccaagggtatagaggatatgcagatgattaaggataactttgaaaatcgttgtatccagacatgcagtaatattaagactgagcttgaccgtctgccacagttgtctaatatcaatcttgacggagaacagattgcaataatcagtttgcagattccttatataaaggaagaattatataaggaaaagatgtctgaatatattgatgaaactgtattcatggcggaaagttttaaagagcctgcggaaagactcaagtatataagaaacagactgtcatggaagagacttttctcagttattgtcacagacatgaattcaatcagaattaatctgtataagagagagagaatcaaggaccagagccgttacttaagatatgaggaagcggttggctcaacaggacagtcgcagggtatatatatccagttccttattgcgattatcaactacatatctaatatgaattcttcaggcaatgaaggtgttgagggtaagacaatatttatcgataacccgtttggtgcggcaaaggatatatacatatgggagccaatattcaagctgcttgcaactaatcatgtccagcttattgttccggcaagaggtgcaactcctgctattacaggaagattcgatgttaattacatacttggtcagaagctggtagattcaaggcagcagactgtggttgttgattattacagcagcacgaaggaatcagaattggaatacacaagaatggattacgaacaggctacatttgattttttgtaacatatttgtaacaattctgtgaactcggtttacaatgaacttaggctgtgctaaactttaatgagttgtaaaatacgacaattagattattcacaacattcaacgagtaagcattggaatgaggaatatatatttatgaataaatacgaattaggaattaagatagaccagattaagaaactggcagcgaaaaaagaatatgcagaggcagcagccatagctaaggatattaactggaccaaggttaaggactggcaggcacttgccacagccattaatgtacaggaagcagtcggggattatgaagaagcaagagatatggctattcttgcttataatagaaacctcggaggaagaaagcttgtatataagcttactgaattctttattaaagttggagattttgataatgccaacgagctttatgaagaatacagcaaatcttcacagcatgatgtaagcagattcattctgtattatgacctcagaaaggcacagaaggcatcagataatgaacttgtaagtatcttagaggattacagggatcatgagattgatgaaaagtatatgtatgaacttgcaagactatattataagactggaagaaaagaagaatgtattaagacatgtgataatatcgttctgtggtttcaggacggtacatatgttgagaaggcagtccagttaaaggaaaagcttggtgttgttcttactaagacacagaagggcatcttagatgatgtcatgaagagaaagagcgatgatgaagctaataaggaagagctttttgcaaagcagaaggagcttgctaatcttaagagagatgaagttgaagatgttttccgtgaagaagatgagaaagaacagaaagcatctggtaaacagcctgcaccagaggtaagtcttaatgttcctgaatatgataaggagcaggaggaaggacctctttcaatagaccttgtacagaacgaccagaatgatgatatcaaagcatttttaatgaaagctctgaataaggatgaagatgcagataatactaatgacagctctgttgttatgtctaagatagagactcctcaggtggagaagccagaggtttctgagacacttagcaaagatggagagaagaatttctcaagcgagattaataaggcaaatgtctcacttaaggagcttattgagaatgcaaagcagaagttagctgataactatgagcagatcaataaagaagacgaagctgaacagagaaaagaagctgaggaaagaatcaataaggaagcagagaatatagatattaatgttcctgtacctgaatataacaatttatatgatacaagaaatcttcaggaagagcttgctgccaagatgagtgacttgttcggtgatgaggaagaagatgccgatgttaagacatttgtaccagcttctaagaataaggaagaacagcctgcagaggaggttaagactccggctcctgtagctgaacaggttgttaatgatgatgcagaagctcaggaagatgatgaccagattgaaggccagatggatataacagagtggatgcagtctgtaagagaagaaaagtatggcaagcaggatactaaggaattttccaagtcagagcttgagcgttatcttgatgagaaagacgagaaaagtgcagcttatgaaaaactcgtagagcagaagaaagcagaagcactggctgatggtaaggagattgataaggaagaagcaaagagagcagctcttgcacagatggcagttgattcagcgagaatggatcttgcaataagaacaggtaaggctgcagtgagactagagcaggcagcaactgctatagagaatgaagatattcctttagttacagcacagataccaactgtgtcagaatcaatgatttcagatatcaattcaattatgaatgaagatattgataataaagacaataaagaagaaggtgaggaggctgttgtactagatgaggtagctgcaggtgttgagccggaagaaacagtaattccattcaccagacaggaagaagaacagccattgactatggaagaagagattgaagaaactgagcagagagagaagaagcttacaggagagctggcaaagatattcagaaagtacagagatatgccaggacttgaggaacagttagctgatcttttcgatacaattgacgatgaaatgcagatgaattcatcagcatcaggaaatattcttatttctggtaattcaagttctgataagacagaccttgcaagaactataataagagctattaatactttatatccagaccagccaaagaagattgctaagacatcaggagagagtattaaccagagaggtattgccaaggcaatgggaagacttaagggaacagctcttatcgttgaaggcgcaggaacaatccagcctaagagaattaatgaactgcttaactgtcttgaacaggatacagaaagaatgattgtcatatttgaagattcagatacagacatgaatgttcttatcaactttaatcctgagcttaccaagacattcaatcacagaattgttcttaagcagtacacagttaatgagcttgttgagatggcgaagagattcgcaagaaagagacagtatgaggttgatgatgatgcattactagaactgtatcttaagattgacaaacttcataatgtgaatgataatattaaacttgatgatatcaaggaaattatcaatcaggcaattgtcaactctgaaagaagagcatcaagaagattctttggcggacttaagaagaagagaagcgagaatggtgatgttatattcttgacagaggcagattttaaagacagataacttataatattatgcacagatgtgcttacacagggaggaaaatatgattaacatcgatgaaatgtcaattaatgcaatcagggtattgtcagcagatgcaatccagaaggctaattcaggacatcctggacttccacttggaactgcaccaacagcttatgaattatggactaaccatatgaattacaacccggctgatcctaagtgggagaatagagacagattcgttctttctggcggacatggatcaatgcttctttattcattgttccatttacttggaattggcaatctttctttagatgatgtgaagaatttcagacagatgggttctaagacaccaggtcatccggaatatggtcatacagttggtgttgaagcaacaactggacctcttggacagggtatggctatggcagtaggtatggctatggcagaagcacatcttgcatcagtatttaataaggatggatacaatgtagtagaccattacacatatgtacttggtggagacggctgtatgatggaaggtatttcatcagagtgtttctcacttgcaggaacattaggtctttcaaagcttattgtattctatgattctaacaatatatcaattgaaggaagcacagatattgcatttacagaaaatgtaatgaagagatttgaagcatttggcttccagacaatcgaggttgctgatggcaatgatatcgaagctatcggcaaggctattgaggaggctaaggctgataaggaaagaccttcacttatcaaggttaatacacttatcggatacggttgtcctgcaaagcagggtaaggcaagcgcacacggtgagcctcttggtattgataatgttgcagcacttaaggaaaatcttaactggccatgcaagggtgattttgaagtaccacaggaagtatatgaccattataaagagatagcagcaagaatggctgagccagagaaagaatggaataagctctttgctgaatactgtgagaagttccctgagatgaaggaactctgggataaatattacaatggatgtgatatgtccgatttattcaattctgaggaataccttgcgaagccagagaaggcagaagcaacaagaagttcaagtggaacaattcttaacatgattaagaatctcatgcctaaccttattggtggttcagcagatttagcaccatctaataagactaacatgaaggatgcaggagatttctctaaggagaattatgcaggaactaatcttcactttggtgtaagagaacaggctatggcagcaattggtaacggacttgcacttcatggtggattaagaccattcgttgcaacattcttcgtattcagtgattacacaaagccaatggcaagacttacatcacttatgaagcttccacttatatatgtatttacacatgacagtatcggagttggtgaggacggacctacacatgagccaattgagcagcttgcagcatttcgttcaatgccggacttcacagtattcagaccatgtgacagaacagagacagcacttgcatgggaatatgctattgaatctaaggacgagccaacagctttagttcttacaagacagaaccttccacagatggctggttcatcaaaggaagcacttaagggagcatatattcttgaggattcagataaagagactccggatggaatcatcattgcaagtggttcagaagtaaaccttgctgtatcagcaaaggcagagcttaagaatgcaggaatagatgtaagagtagtaagtatgccatctatggacgtattcgagaagcagtcagacgaatacaaggaatcagtccttcctaagagtgtaagaaagagagttgcagttgaggcactttcagacttcggatggtacagatatgtaggacttgacggtaaggtaatctgcatgaagacattcggagcttcaggtccggctaaccagttattcgagcatttcggattcacagtagagaatgtagttgatactgttaagagtcttttctaagatgatagaataataagaaaattaatataaaaaatcagggatttcggttattaaatataactggaatccctggttttttatattgtcaagtgcagaatgtgccatatattaccgaatgtgccaaaactacccgatacaaatgtgacgtatattaccgaatatgccatacatatattgcagaatatgccaaaattattgcatgatgccaggatgctgtattaatataatatatttaaaataacggtctttctcatcgtacgaatatttcataattccatcgtaactgtcaacaattcttttaatgcttagagttccaagaccatgattaatagtgtccgctttggttgtatgtaaagtcccatcgggggcaatcggattattactgcatgagttggtaacggtaataagatccgcattgccattctgtataagtgagacattacagtcaataaatgcatgcggagtaccacttgcagcggcaacagcattgtcgagcagattaccgaacaatgaagcataatcattagcagaaaaatattctaaggttctgtatcttatgtcggcagcaaaactgattctctcactttcgcaaatctctgcataatgtgacagaattgcattaaatataggattccggcaatatgttcttgatcttttaagtgcatcactgtcagaaagctcagatatataatcagatatttctttcgtatgacttccatcattaagggctgcaattgtattaaggtgttctttgatatcatgaactaatatccgctgtttgtcataattatccctaagagaattataatatgctacattgtcagattcacgctgcagttccagcagcaggcgggcgttttcagcattttttctgatgataagctgctgtatataaaatgtgaacatgttgattatcagtaataatatgacagatataataaccaaaaaattgaggtgtttaggtagttgcagttgcatattaagacatatgaagacaagacaaagcataataatgatagatacagcaggtataatagaaagaaaaaatgtgtttttatcagaatatggataggatgcctgtttcttctttaagattaaacatatacattgagaaataaaaaggtatactgttttactaagtataacataaaacacggaattgtcattcagtgtatttaactcgcgatagaataagatgtaaatattaggaataagagctgtaaccagcagttctgataatcccataataaaggtaagcataataccatggaaaacagcagaaaaaatagaaaccttatatacagcaataattacaacgcaagtcattaagacaaaggatatggcattgaaaataggattgtttaacatgcatactggtattaataatacataaattacaagtgtcagaagcagagcagtgaaattcttatatcttgctttgaacagattattacaataaagccataaaataaatgcttcgataactgaaacaataatgtaatatgtaaatgaattatccataaatctcctttatctagaaatgtgatgtaatatagttaatgtagttttctttaaatgcagcatatttctttgctgcgacatctgcacacaggttgtttacaagatatatattgcgggggttgtgagtggttacatatttcaggttaataataaagcttctgtggcactgataaaaataatcataatctaacagggctttcacatctgtaaaggacatagtagttttataatctccattacatgtatatataatagtctgttttaaagaagcttctaccattataatgttcggtatgttaattgttctatagtcagaaccacattttacagatattgtagtacagcggttattatactgttcaagtgcatcatgcatatttctaaacaatcgtgttttatcaataggtttggttatgtatctaaatactttaaaacgcatagcgtcatcaagataatctataaaagaggttattactataatgatagtatcaggatatttactgtgtaatgcattgccaacagttatgccgtttaattcaggcatctgtatatcaagaaatactatatcaggctttatgtcagaagatagcagagcctgaccatcattatatatgtggaaaacaggtgaagtgtaattataattggtaaaaaagtctgatacgagagaatgtatttcgtcacatataagtggattgtcatcacatataataatgttcatattagctccatagcaattaaaaagatagatatattatacaataaagagagaagaaatatcaactacaataatagaacattggcatattggatgcttttcgttcccgaaaaacggtcattcgttccaagtgtattgatttatttaaaatatatgatataagagaaatatagagttttggttgtgcacataagagagaggagggagttatctatggagaaaggttctgcaaagaaaatggttaaactgcttgacaaggtattaaaaatacaagcaaattcaacttcttgtatattagcatatgaaccgaagacaccagcagcgttagacagatataagaagataaagtaatggaaaatgttagaaatttagtaatcaactggctaataaagaacagtgctatatcagaggaaaatcatgagctttatgaatatgctgtatatagtgcagaattattagtattaccagttattatggcaattgtgattgggtggttgtcaggaagtcctgttaatggagttctgttaattattccattcatgtttctgaaaaagtatagtggtggatatcacgctaagaaattatcaatatgtatgataatatcgactatattattgactgctatgataaggatatcaatatgtgatataaaaccagcatatatgtatataacgacatgtatagcttttatagaattgtgtatagtatcgccaatacaatcagacaataaggtattgaatgaaaaagagatgaggcattacaaaaaagtagtggttatgcagttagctgtgtattcaataattataatatgctcaagtatattaaattgtatgattgtaacaaagtgtatatgtcttggaattatattagcatccataatgcaattgccatgtattgtaacaaggagaacgagtatcagataattatacggtaaatgaaaactacaacttaaactttataaatgtataacatctgatgtagttaactgaaaaagtcaatatttgataaattgtcacattaaattagcggaggaatatttttatgacaagaaaaagtgtattaaagaaattggctataccagcaatgacaacagttttaatggtaggaagttgtatagttgtatcggctggaacaagcagagattctgtatcatctggggatttaactatggagtattttgcaacagcaacggataacagtgcgtcagcaggtgcttcagtgaatacatgctccgatttatatgttggggggacagcgtataagaagagaccatggcagaaagatgaagaaatgcatttaggtaattcagcatcgcagacggatagtgtatatgcgtcagtctcttcagagtggtcatattttacacatatagatgcagaatttggagctgtaagtaatgacgatgatgaggtgaaagcaacaatttcagcagattattaattgacatgacatctatagttaattaaactaactatagatgtcataattttaagggggattgcaatgagaagaatagcatcaggattaattgttataatgtcagttttgcttgtgtcatgtaatgggaaaacaggtaatacgataacagtaggaagcgacaagcttgataatacgcagtcatatttttctgaaagcatgcataaggcagcaagatgtgattcaggatattattaccttgataaatgtggcgcgtcagctgataatcttatgttttatgatgataagtcagaagaaagcattgtgttatgtaataaaccacaatgtgggcatgatggagaagagtgcatggcatatatttcaggaagcgagtttaaaagtgagttgtattactataattcgtacatatatatgataagttccaagggaaatcttgtacagataagtgctgatggaacacagagaacagaccttggaagcatatgcgtcctgagtggacaggatagtgtgtcaatgtgcttcaatgatggatatgcatatgtatctcaagagataacgggagatatagaaggtaatgtaacagtaaggctgtacagatttaatcttgatacgggttcgagcgataaaatatatgaagaaacgggatatggtataggaattaattcacttaaaacatatggcagtgacacattttttttaaagacatctgtttcaaaagatgataagggattatattcgttggaaggaaaaggaatattcagaattgcaggggaagatattgaatgtctgcttgacaagaatgtgtatagttactgtatagatgcagacaataacaagctatattacagcggtcttggagatggaacgatatatgaatatgatcttggcagcggcaagtcagaaagtatatataaaagtgataatgatacaggatatttttatataacatttgacggaaattatatctggatggatgatgaaggatataagaatatggcaatgtattttaacaaacagagcagttcacttgattatacattatatcagttagacagagatggaaagcttgcagcaaagaggataattccagacgaggaaaagatattttcaattatgcatggggatagcagaagaatgtttatgttttcatttgtgaacaacaaaattgtatatattgataagagcaacattgaaaaaggggatattaaggagcttaggtagatgaaggaactggggagactgcttaatagaaaaacaatattgctaattctggctgcggcatgtatatgtgtcgtggctgtttttgcaggggacttttcagactgtggaatagataattataagattaaagtaagagagtacaactggctgattaatgggcatacagatgaacagatacagcagcatgctgacgaactggcacaggatgatagaagaatatttaagagacttgcaaaggaatacaaggaaaagtctgattatattgatggatatacagaaagtgttaaagcagttattacaaatgcctcgaatatgaaaaaattcagtgtgttcggtacatcagaatcaatagccaatatcaataaaacggaaaatgattataaaaggattgaaaatgtacaggttagggaattaaacagcagggcagttgagcagtttctgaagaatgatatttctatctatatcgttcttgcgttgatgatatatattatttataacatttacgaatacagggataatggaatgtggcagattatctatactgctgtcaatggaagaatgagacttgcagttaaggacactgttgcagtcggattgggtgctttatttgtatcactgattatgcagttatgcggtcttgtctctatgcttgtggtgtatggtggctgggattttcttaccgcacctgtacagtgtctgacagggtataataatttcacttatccgataagcgtaatgacatatctttttataagatatatgattatatctttgatagttattgcaatagtgcttgttatatcactggtattttcgttatgcaggaaaagaatcagttcagttgtgctggtgggtataattgccggagcggaagcatttgcataccagaatatatcaatgcagggcaggttaagaattttcaagaagattaatataataaatgtgatgaatgtaagcaatatacttaggaagtatgataatatcatgatagcaggtgttcctgtgagcatggtaaatgtgctgtgcatggtgtgtattattatagctgtaatatcagcaatatttcttgtattacttggaaagattatccgtccgggaagaagtgctggctttataggaaaaatgattgaaaaaattggacatggagtacaaagggttttgtccagacttccgcatttctggaaagaaatgtacaaatttttaataacagcaagaggctggattgtaatatgtgttgttgtgtttataacaatatttatatgtaataaccagaaaatagcatattctgaagatgaaaagaagcgtgatgaatattatcagcagtatggtggcagggattacagtggatttaccagtcttatagagcagagacaaaatgatgtttatgaggcacaggcaaagttagatgctgcaagagaacagtatgagaagggagaacttagtgaggatgatgtaagcagatatgtgtacaacctcatggatgctacgagactgcttgataacatgagcgaatatatgcagcagattgaatatgttttacagataaaagagcagtacggaatagatgcgtatgttatgtcacaacggggatatgaccagatatttggcagtaaaggagcaacgagaaaactgcttatatatattatactcggatttggagttgttcttattgcagagactgaaagctcagtggaatataaaaacggaatgaatatgcttattggctcgtctaagagagggagaagatgggaacatacagttaaggctgctgctgtctgcatattggtgggggtaagtgcatttttactgtatataatcgaaatgataataatgtataaggcttatggtatgccatatattaatgcaccgcttataagccttacttatatgaatacagcaaaggtattcagggatataacgataagccagtatatgcttattctcatggcagaggagatactattcgcagtagcagtcggacttgaaacagtattcgcttcaaggcacatttttaaaaagaattcagggaaaggaatacctctgattatagttataaatactgctgttttatgtattattatgtgagggggatgtatgagaattaaacagtttgtaataatgatgatgattatatgtggctgtgtatcagttggatgtaagaataaagaagtacaggagagtgacaagacagcaagtgaaagcagccgtttagccagacaggaggtggagtatcccgaaaaagaagatacatatggagactgggcacaagtgggtgaattcaaaataaacagcaggtctgtagaacaggatgtacatgacacagatacatcatatctttatataatgggattttcgtggccagtgctgtatgataaagagtctgtaaagtttatagaatacactgcgtataatgcacgtgtgcagtttgaaaagagagaggtgcagcttaaggaattccttgataaaaaggttattaagacgcaaagtaaaaagatatcgggagcagagcaggaagaactggatttaatattgtatatggaatttccaacaagtacatactcatggtatatgaataaacaatcaccagatacggtacgcaaggaaagaaatgacatgcttaacgccatacttatagaggcagaagttatatatgatgatggaacagaggagacttgttattataagattcagactggaacagcagacaattatgtgttgtttgagagaaatttgtagttgaaaataaaaacttttttgaaatgcttttcgcattttggcagtgtcaaatagcatatgaaaccagtgcataagttggtaaaaagcctactaatgctgctaaatgagatgaaatagtaggttttttgagaagaaattttgatgggaattaaggttgctaaagaaaattgcctactaaagttgtgatttatgcgagaatagtaggttttttagctgacaagatgtgactaatattacagatgtatcagaaaaagacctactaaagtgtgagatgtgacatatttagtaggtatttaagatggaaagaagcattataaaccaactgacaatgtaaaaaagacctaccagattgtgaaaattgatgaaatagtaggtttaccgggtaactttggaaagcggtaagagtacccccgcttagggtattaggctgtgtgttgaattgacaagataattactatcagtgatggcaggattgtaagtgataataaaaatatataattgttcatggaatatttacaaaaaattataataaaatttacttgaattattatacgggcaagcatataataagagcatagggtttgtttataatttaacaatcaaatatttatgtacggaggttttattatggttcgatttactttaccaagagatttgtatcatggaaagggttctttggaagccctcaagacacttgaaggaaagaaagctatcatctgcgttggtggcggatctatgaagcgtaacggtttccttcagaaagcagaggattacctcaaggaagcaggaatggaagttaagcttttcgagggtatcgagtctgatccatcagttgagactgttatgaagggcgctgctgttatgacagagtttgagccagactggattgttgctatcggtggtggttctcctattgatgctgctaaggcaatgtggattaagtatgaatatcctgatacaacatttgaagatatgtgcaaggtattcggtcttcctaagcttcgtaagaaagctcatttctgtgcagtttcatctacatcaggaacagctacagaggtaacagcattctctattattacagattatgagaaaggtattaagtatcctatagcagatttcgagattactcctgatgttgctattgttgatcctgagcttgcagagactatgccggttaagcttgtagcacatacaggtatggacgccatgacacatgcaattgaggcttatgtatcaactgctaactgtgattacacagatccactggcacttcatgctatggagatgattaaggctaacctcgttaaatcatacaacggagatatggcagcaagagattcaatgcataatgcacagtgtcttgcaggtatggcattctctaatgcattacttggtatcgttcattcaatggcacataagacaggtgcagcatttgaaggcggacatattatccatggtgcagctaatgctatgtatcttcctaaggttatcaagttcaatgccaaggatgagacagcagctaagagatatgcatttatcgctgatttcttacatcttggtggcaatacacaggatgagaagattgacaatcttatcgctatgttaagaaagatgaatgatgaacttaatattcctcactgcatcaagaattatggtgagggtggtctcccagcagagacaggatttgtatcagaggaagaattcaaggctaagttacacgacatcgcagccaatgctatccttgatgcatgtacaggttctaatccacgtcagccaagtcaggaagagatggagaagcttcttacatgctgctactatgatacagaagttgacttctaataattacatataagaataaatgttaagccttctggtaataatacggttgtattaattatcaggaggctttttattatggcattgaatgaaaaagaaaagactacgattaaggatttacagactcaggagcagacctgtatcaagaagtacaagaagtatggacaggatgctaaagatcctgtgttaaaggagctgttctctacattagagaagaatgagcagaagcattatgacacattaggacagattcttgagggaaaagttcctgaatgtgactgcaacgactgtgagggaaaagagtatgagcctgaggcaacttatgatgtgatgagtaagtcagaggataaggaaagcgatgcatttttagcaacagacagtattggctctgaaaaacttgtatcgggagagtataatactaatgtgtttaattttgccgatacagccatcagaaagattcttgctgatatccagattgaggagcagaatcatgcagaaatgctgtataaatacaagacagtaaacggaatggcataatttatgcaaatttttttgaaaaatgttacaattatttaaacttttttgaaaagtattccgtataaagatatgaacgggacataagactttgatttatgttccgtcagtacataccaaccgggggtgagtagatgggtttgctgtcaaagaaccgtgattttagtttgataagcagaatcctgaataataatgacagagatgcagcagacgagctggttacgcaatattataaggctgtgtataagcacatttatattaagctgaaggatgaggagttaagtatggatcttactcaggaaacatttatttcagcgttgaaggggctggggggcttcaatatagagaaagcgtcatttaagacatggcttacaaggattgcagataataaggtcactgattatttcaggagcagacagtatcatgagagtattgttacacagattatggatgataccatacaggaacctgctgatgagagggctggcacggagacgagtgtgcttgggaaactttcttatgaggagatggagaaaatgtatggtcatcatcagaataaggaatgggaaaccttcaggcttaaagtgtatgaaggttatacatttggcgagataagtgctaatcagggggttgatcttagcactgtcaagagcaggtattatgcaatggttaagagagtaagaaaggagtgggattatcttgagtaaggttaagtatccggataaggaaaaaatcagaatacagatagatgaaatccttgacaagtctgaattgtttgatgctacagaagataagtcgtctacatatacgaatgataagatagtacaattgaaaccagtaaaacaacacctgccagtcggaaagtatatttcggttgcagctgcaatagcggcaattgttatatttgttatatcagtaaagaattatcagacagttggcagaggagagcagagcaagacaagtttcgtgccgttagcaaccagcagttcagaggcagatatgcaggagagtactgcggaggaagcaacagttaaacagagcgagataagtgatatgataattgaagattataacagctatgaaatgttatattcgaaacttaatgttatgagtgaaggaacaataaatattgagaacagaacagagtatggatatacatattctgtaagaactgacaatgttgcaacaaggaataatgtagtactttatattgatgttccttatgatattaagtataatgataaacagttggatggaatggacgaggcggcagctgatacattaaaacaggtgattcagacatatattgataagaatggtcttaatagcaatataaagatttcatgttatattatgaataattctcttgagttctatagtggggatactgtatatggaagtctgacgctttctacagaataattggtgcttttgggggattaaatgaacgagaataattattacttaaagaaatctaaagcagttttaagagaggtaaggaagtctgtcattggaaaagatgatgttatatgcaaggtgtacatggcaataatcgcagggggacatgtattattagatgatattccgggagttggtaaaacaacaatggcacatgcatttgcaaatgcactcggactgaagtacaacagaatacagtttacaccagatgttatgccatcggatataacgggattttcgatgtataacaggcagactggcaagtttgaattcaagcagggggcggctatgtgcaacctgcttcttgctgatgaaataaacagaacatcacctaagacgcagtcagcgttattgcagataatggaagagtctaaggtgactgttgacggcaatacatatgagcttccagacccatttgtagttatagcaacacagaaccctattggttctattggaacacagaagcttcctgagtcacagcttgacagattcatgataaagctttctatgggatatccacagattgaggatgaagtagcaattatgaagagcagacttgagaacgggaagaatacacagttttctgcatgtgtacttgaaaaaggtgatatagaagggattcgtgaggaagttgcgggtatctatgttgatgattctatatatgaatatgtagctaagattgcagctaagacaagaagcagggagaatataatacagggggtttcaccaagaggaagtatcgcagtaattgcaatggcaaaggcggaagcatttcttcgcggcaataattatgttcttccatcagatattaagaatattgctgttgaaacatttgcacacagaatagttactaatgttaatggagctgcaggtacggaggcagccagaaaagagattactgagatattaagaaatgtaccggttccagagatgaataagtaagggtggcagtatgcttaaaagaaggattttgtattttatctgcctggcagttgttttcgggattaatatattttatgtggaataccagatatttatattgcttgtcctgatgattgcaataccacttgtttcatggattatgtatgctatatcggatgtcagcctggggcttagcctgcaggtcaataagaatgttgtacaggtgggaaacaggattaagataagaatagttaagaagaatgcatgtaatctggcttttgttaatggcagcataaccataaaatatatgtattgtcatacgggtgatgaattcatgataaatgtgcctataaaacagggcataagaaagagtgctggaattgcggacatttctgcggattactgcggtaatatatgtgtgggggttgaatccatagaaatatgtgactatcttggactttttggaaagaagaaacaatttgcaggagttactaaagtatctgttatgccggaggaaacaattgacagatatatggaagcagacagagctaatgcttattatgatgaagagaatgagatgtatgtaaagagtgcatctgatgaagtcagtgaactcagagaatacagggatggagacagtccaaggaatatccattggaagagaagcagtatacttgcagagaatgactttattgttaaagagtacagcacgaacattaataagacggtattcatcgttgttgacacggactggagaggagaaaagtcatggcgtctttcaagaatgagccgaatatatgctgagatgatgtcgcaggggctggcatgtgcagaggctggactgactggacagtatatagtgtgggatatggctaaagcagatattgtaagagttacgttctatgataatgccagtttgaaagcggccgttaaagtggttatggatatacgttgtggtgaaggtacggtcaataaagcatgtcaggcattatatgaagatgacaggctggagattacgactgaaccagtgataattacagagaattgataataatgtgacaagagggtattaatgaaaaagggacagcttatacatacagacaacttaatacttagaataatagtgacatttcttggaacatttggtgcagcatccataatagagacgattacatatccgcttgcagatatgggatttattggatttgtttcactgatattcagtgttgtgtatacattgatgctgtcctgttacggaaagaatgcaaggcttataaggattatgggaatggctgttttgccggtggtatatctcgtaattaatataggctcttttattaatggaatcacaacatttataaatgtgtttatatcaagggcatcttttacaggacctgtagatagcagtaatgtactaacggtagagagtgctggtgcggcttccgtaagatgcgtatgtgtggttgttgttatgattatagcagtccttgcagctttggaagttaatgtgtttcctaatatgctagtgagtctggcaataactatgcctctgcttagtgtatttattgcggcggttattgttcctgatatcataagcattattttctgtgttctttttatctttgattcaatggcactaaggaataagaagataaaaactaaccagggtgccaaaacggctgtaataatatcagcagttatagcggcagttttaacatttattattcctcaggaaacatataagagaaattctttctttgatgatgcaagaaatatggtaacagatgttgtttatgacagatttggcatagaccttcagggaaataaatcagagacagaggatgataaggcgaaggttaatgcgactgtaggaataggaaatggtgatgttggacaggttgacgaggtctactatggaaatgtatacgcaggagagcttaatacaatgtctgatatcggaattgcctatgccaaggtatttatgggaagggatttcaagaataacagctggcagcgatggtcggatacaagggaaactcagtattcttatgagagtgctgtgtccgagtttgcacttaatcttgtgaaacgaaaaatatatacgcttgatgaagacgaacaactgcttgctgacagatttttctattatcagcagacattcagaagtaaagatggcaatgtatatggttcgtcacttgattaccgtatagcacggggaagctttgaggattactcccgcatggggcagcttatgaagaaatacagaaactctgctattgttaattcatatgaaagctatgcacacgggcagtatcttgatgtatctgaagatgacagaattgttgtagcacaactgtttggaaagagaaatttacagacagtagatgaaaaggttgaatatatacagaaaatagtatcttatcttaaagataattatacatatactcttaaaccaggaagagtgccggagggaaagagcgttgttgagtatttcttaagagaaagcaagagagggtattgtacatattttgctacctcggcagcagttatattaagatgtgcgggtataccggcaaggtattgtgcaggatatacggttaataccaatacaggcgcatattatactgacgggcagagcaataagtatatgaaatatgatgtctatgacaatgcagctcatgcatgggttgaggcatatattgatggatatggatgggttattgttgatgcaacacctggctatggagaagttgaggatactgagcaaagttccacacaggatgaaagtgagagacagagccagtctgacaatagtaattcatcagttgatgaaaatatgacagttgatgatacagatgagccgggtactgaaagcacaacacaggaagttgtctctgacactgacagcttctctggtgagatacatattaattcagttctgattgtggtatgtacagcaatattggcagttcttatattaattgcaatggctgcaatcaggatagtatcaagaatacatttattaagaagcagttcagtagatgaagtaaagcttatgaaaatgtattcttatcttgaaaagcttcttgcttgtctgggatataagagagaacctggaattgattatgaagaatatatattagaaataactgcacaggatgcgaatcttaagaatatgggacttgagaaagcagtgcagacaatccttgcggtcagatttggtaatgtaaaatgtgttgacaaagctgacataactgggataataaatactataagacaggtgcgaagttacgcacttaagaaagccagaggattgaagaagcttgtagtatgtttaatttagaagaagagcttaagaaactcccggcaaaaccgggagtttatattatgcatgataagtgggacaatataatatatataggtaaggcgaagattttaaagaatcgtgtaaggcagtatttccagagcagcaggaataagtctgccaagattgtgcagatggtgtcacatattcagtactttgagtatattatcacagattctgaacttgaggcgcttgttttggagtgcaatcttatcaaggagcacaggcctaagtacaataccatgctaaaggatgacaagagttatccttttattaagattaccgttggtgaagagtatccaagggtactttttgcaagaaagatgaagcatggagcaggtaagtatttcggtccttacacttctgcggcagcagtcaaggacactattgaacttctatgcaaactgtataaggtaagaacctgtaacagaaatctgcctaaagatgagggcaaggacaggccgtgtcttaattatcatatcggacagtgtgatgcaccatgtcagggatatgtaagcggcgaggaatacagaagaagaattgatgaggttgtagctttcttaaatggtgattacaagaagattatggacaggcttacaacgcagatgcaggaagcgtctgagaagatggaatacgaggaagctgcaagatacagagacctgttaatgagtgtcaagcaggttgcacagaagcagaagattacagcagatgatgttaatgacagagatgttattgcgtgtgcaagtgacggtcaggacgcagttgtgcaggtgttctttatcagacagggcaagcttcttggaagagatcattttcatatgaaggttgctgaaggcgactctaagagcgacattatttcggaatttatgaaacagtattacggcggaactccatttatacctaatattattatggtgcagtatgagatagaggatgcggatacaatagcacagtggctcagtgcaagaaagagccgcaaggtaagtattgtcacacctaagaagggtgacaaggaaaagatggttgagcttgcatataagaacgcccagcttgttcttacacaggatgcggagaagattaagcgtgaggagagcaggacaacaggagctatgaaagagattgccggctggcttggacttgggacacttcacagagcagaggcttacgatatatctaatacaaatggtgttgaaagtgttggctcaatggtcgtttttgaggatggaaaaccaaagaagaacgattatcgcaagttcaggataagaacagtaaagggaccggatgattataagagcatgcgtgaggttttgacaagacgttttacaagggggatgcgtgagcgggaaggactcgaggatagtcacggattttcgagatatccagaccttattatgatggatggcggacgcggccaggtgaatattgcacttgatgtacttaaggaactggggcttaatattcctgtgtgcggtatggtaaaggatgatacccacagcacaagaggtctgtattataacaatattgagataccgatagataagcacagcgagggctttaagctgattacaagggtgcaggatgaggcacacagatttgcaataacttatcacagaagcttaagagataaggcacaggtatcttctgtacttgattcgattgaaggaatcggacctgtaagaagaaaggcacttatgaagcattttcttgatatagaaaagatacggcaggcatcagtggatgagcttatgaaggctgatggtattactgaaaatgtggcagagaatatatacaaattctttcattgataatacttttataatagcatttagagcttgtctgtgataaacttaggatatatgaaatcgtaaacatgagtttggaggcagagaatatatgaataatggtaaagagagggtaaagttatctaaagttatccaaaaaatgaatcttgttaatcttacaccacagatagatgtgtcaggaatctggcttaatctgcctgatgtgaacagaccggctttgcagcttacaggtttttatgaccagtttgataatgacagattacagattattggtaatgtcgagcatgcttatcttgcgagtctttctgagcaggagagatatgaaagatatatgcagcttttgtcaagtaatattccatgtattatattctgcaggagtataaagccagagcctaagattattgaacttgcggttaagtatcagatacctcttcttatgacagaccaggcaacatcttcatttacagcagaagtaatacgctggctgaaggttcagcttgcaccatgtatcgtaatccatggtgttttagttgatgtatatggtgtaggtgtacttatcacaggtgagtctggtattggtaagagcgaagctgcacttgaacttataaaaagaggacaccgtcttgtaactgacgatgcggttgaaatcagaaaggtcagtgacgagactctggttggaagcgcaccgggagttaccaagtattttatagagcttagaggcattggtattattgatgtcaagacacttttcggtgttgaaagtgttaaggaaactcaggaaatagatatggttatcaagcttgaggactggaacaaggacagagagtatgaccgacttggacttgaggaagaatacatagaatatcttggcaataaggttgtgtgccatacgctaccggtaagaccaggacgtaatcttgctgtaattgttgagtcagcagcggtcaaccatagacagaagatgatgggatataatgcagcgaaggaattatacagaagagtacaggaaaatcttatgagaggcggggaggatgacgatgagtaagattatatttggaattgatgttggaggaacaacctgcaaatgtggtacattttctgaagaaggtgaactgttaagaaaagaagagattcctacaagaaaggatgagggtggaagcctgattctgcctgatataagtgagtatatcaagggcgttcttgcagatatgaatatgacaacagaggatgtggcaggaatcggaatgggacttcctggtgcatgtcttgaggatggaactgtcaacaaatgtatcaacttgggctggggagtatttaatgcagccaatgtattgtctgagcttacaggtattcctgttaagattggtaatgatgccaatatggcagcactcggagaattctgggtaggcggtggaagcgaatacaacagcatggtaatggtgacgattggaaccggtgtaggcggtggagttattattgatggaaagcctctttatggatttaacggtgcagcaggtgagataggtcatcttccacttgttgaaggtgagactgagagctgtaactgtggaaagaagggatgtcttgagcaggttgcttctgcaactggaattgtaagaacggctaaccgtatgcttgcagaaagtgacatgccttcatctttaagaagtgtgccatacatatcggcaaaggttatatttgacgaggctaagggaggagatgcccttgctatacaggtaacagagtatgtatgcagatatcttggaaaaggacttgcatgtgcagcgggaatggttgacccggaggtatttgtaattggtggcggagtttctgccgcaggggaatattttatcaatcttattgataagtattataaggaatgtgtgttccatgcgagcagacagactaagatagttaaggctgctcttggtaatgatgcaggaatgtatggagcagcaaagcttattcttggaaattagtattaaggatagtgagattatatggataataaaatgttatcagaagcattaatatcaatgcttggtgccgggaatgtaagaacaggtgaactaatgaagacacatactacattcagaatcggaggtgctgcagattattatgtaacaccacaggcagaaaagcagatagcagatgttatcgcatttttgaaaaaatcggacattaaatatattgttattggaaatggcagtaatattcttgtgagtgatgaaggcttcaggggagttgtagttgagcttggcgatggtttttcagattatgagtttcttcaggattcacaggataattcagatgaagtgcttgtcaaagcaagtgcaggcatgaagcttacaagacttggcaaccagcttgctgctaatggaattgccggatttgaatttgcaacaggtattccgggttgcataggtggtgctgtaagaatgaatgcaggtgcttatggcggggagttcaaggatattcttgtcagtgcaaaggttattgatgatgaaggtgttatcagggagcttccagcagatgaacttgagcttggatacagaacaagtattgtagcgaaaagcaatatgattgttcttgaagcaactttgaaattaagaaaaggtgaaccggatataataagaaataatatctcagagctggcagctaagagaaggcagaagcaaccacttgagtatcctagtgccggaagcacatttaaaagaccggaaggatattttgcagcaaagcttattgaggatgcaggtcttaaggggtgtgcaagaggtggcgcacaggtatcggagaagcatgccggattcgttgtcaataagggcgatgcaactgcgaaggatgtatgcgagcttacggattatattaagagtgaagttatggaaaagttcggtgtcgggctggaactggaagttgtaaaggttggattctaaggcttgttataattaaaaagaccagtaattaaaggcagataagaaagagaagatgataagatgaagatgattattgttacaggtatgtcaggtgcaggtaaatctacagcacttaatgtattagaagatgagggatattattgtgtcgataatatgccaatctctctgattcctaagtttgcagagcttgccaatgcgggagaagacggatatagcaacatagcaattggtgtagatataagaagtggtcacgcacttgctgagctggattcagtgcttgatgatatgcttaataagcattttaactatacaattctgtttcttgaatcaagtgatgaggtacttgtaaaacgatacaaggaaacgcgaagaacacatccgcttgcaatggacgatcatgacagaatagataatgtaataaagctggaaagagatgagcttaagttcttaaagaaaagagcagatgtaataatcgatacaagccagatgcttacaagagaacttaaggcagagcttgagggcatattctttgatgataagaatttcaagaatctgtttgttacagttctttcttttggtttcaaatatggaatacctgcagacgcagatcttgtgtttgatgtgagatttctgcctaatccatattatattgaagaacttaaacaccttaccggtaatgataagcctgtacaggattatgtgaagaaagctccggagacaacagaatttctggaaaagatagatgatttattgaagttccttctgcctaattatgttaaggaaggaaagaacagccttgttattgcaattggctgtacaggaggaaagcatcgttcagttactcttgctaatgaaatctataagcttataagcaggactgagtatggatgcaaggttgagcatagagatattgagaaagattctaagagaaaaggttaagtatgtcattttcatcagaagtaaaagaagagttagttaagaaaacagattccgcgaggcattgccagattgcggaatttgctgcgtttatgggaatgtctggcaatgtaagcgagacagataatggagaattatgtctggaattcgttacagagaacgaattgtcagttgagaaattcagtgacctgttattgagaatatttagcattaagatggatgctgatacgaatgaaatggttaagaatggcaaggaaactattataaggataaccagacagagtgatgttgctaagatattgcagacattaaaatggtgcgacgacaggtttacacagattgaaccggtgtttgttgacgcaagaattgtagctatggactgctgtaagaaagcatttataagaggagcttttatggaacgaggttctataagtgacccgaacaagttctatcactatgagattgtgtgcaaatatgaggaggacgctgatattcttatggatatgctgcgttttttcggactcgatgccaaggttattgtaagaaaaaacagttttgttgtgtatatgaaagaaggcaataatattactgatacgcttaatcttatgggagcggttgtatcacagatgaacctgtacaatgtcatgattcttaagggaatcagtaatgatgtcaacagaaaggtaaactgtgagactgctaatcttaacaagacaattgaagcggcggtcaagcagattaaggatattgaacttataagagatactgtcgggcttgacagtttaagtgacagtctgatgcaggttgctcttttaagactcgagaatcctgacatgagtcttcagggactaggtgagctgttagaccccccggttggtaaatcgggtgtaaaccacaggctaagaaagattggcgagaaggcagatgaattaagacagagcatgggaatctctgtctgattaaatatttttaataaaattttacattttcttttcaaatagggattgacaagaagtgtataattgaaaatatgagataaaagggcagtcatatactgcagaaaggttgattaagatgactaaagtagatataatttcaggctttttgggagcaggtaaaacaactcttataagtaagcttttaaaggaagccttaaagggagagcaggtagttcttattgagaatgagttcggtgaaatcggtattgatggaggattccttaaagattctggtgttgagataagagagatgaattcaggatgcatctgctgttcacttgttggtgatttcggaacttctcttaaggaggttgttgataagtatcatccagacagaattattattgagccttcaggagtaggcaagctttcagatgttatcaaagcggttaaagaccttcacattgagaatgaaatcgttcttaacagtgcttcaacagttgcagatgcatctaaggttaaggtatatatgaagaattttggtgaattctttaataaccagattgagcatgcaggaactgttattttaagcagaacacagaatgtttctgaagagaagttaaagacagctattgagcttattaagagtgttaatcctaatgcacatattatcacaactccttgggatgatattgacggaactaagattcttggtgcaatggagaatgttactaaccttgagttagacatgcttgcagaggcagcgcagaaggcttatgaggagcatgagaaggagcaccaccaccaccatcatcatgaagatggagagtgttgctgttgcggcggacatcatgatgatgatgacgagcatgagcatcatcacgaccacgaccatgagcacgaacatcatcatgaccatgagcatgatcatcaccatcatcatgcagatgacgtatttacaagctggggaacagagactcctaagaagtatgagagggcagagcttgacagcatattaaagaagctttctgagagtgaagattatggtaaggttctccgttctaagggtatgcttccttgcacagatggaacatggatgtatttcgaccttgtaccagaagaatatgagattcgtgagggaagtgctgatttcacaggaagaatctgtgtaatcggttctgaacttaaggaagatgcacttaaggaactttttgaagtttaatcagtgtttaatagaagaacacatttttacaacgcatttataatgaaatgatagcgcaaatgcgcggaaatgaggataaatatggcaaatgaggaatatcagattccgattttcttgattaacggtcagcttgacagtggtaaaacaagatttatctccgatactatagcaatgggacagtttgcagacgctaagaataaacttcttattgtgtgtgaagaaggtgaagaggagtatagcgagaagcttcttaaggacaacggagtagatatggttgttgtagagaaggaagattttaatatcaagactcttaatgaactggacaagaagtatgatccatggattgttattgttgaatataacggaatgtgggatccagcacttattcttggaagtgagaagccaagaggatggcaggtataccagtctataactttagttgatgccaatgcatttggcttacagtgggctaacatgaagtctattattgcagagtctgttaaatatgctgatatggttatctttaacagatgcaagtcaggtatggatcttggcagctacagaagaagcatgagagcattaaatcctgcacttcagattatcttcgaggacgagaagggtgaccaggttgctatatctgaacagcttccatacgatatcaatgctgatgttattcaggttgatgacgaagattatggtatctggtatatggatgtgtctgaaagaccggaagtatacgcaggtaagaaggtaagattcaagggacaggttcttaagaacaagtactttaaggataagaatttcgttccgggaagaaaggttatgacatgctgtgcagaagatacacagtttattggttatatcagcttctacaacaacatagcttctcttgagaacagagaatggatatgggttacagctactattaagtatgaattccagatggcatataagaagaaaggtcctgttctttacgttgaaagcgtagaaaagacaggtgcacctaaggaagagatggtgttcttctaatatgatacaggatatatggccaaaacatctggacaaccagtataagaatcttaagccaggcaatggggatactgtgttttattttcagggttcctcattgcttgcaagaccatcaggacattttaactcacagaatcctgaagaaaatgtattaatatatccacagtatgatgagttcgttcaggggataaagtcctcttacggagacaaagctgtggataactttgaattcatatatctgttgtcaattgatgaggaacattttttcctcgcaagaaagacaggaagcctcgaaagaggcacattcttgggagagatggctgattcagctgtacacaaggatatgtattctttcgtcagaggatatgaattcataggagtcgattctttccgtaaggcacagccaagagagcatgcttatgcggctattactgcatttcatctgtatggctggtacagggataatcatttctgcggaagatgcggaaaaccactcaagcatgatgacaagcagagaatgttacgctgtgactgctgtaagaatattgtatttcctaagatatgtccggctgttattgttgcagttacagataaggacagaattcttcttactaaatatgcaggaagaacttacaggaattatgcgcttattgccggattcactgagattggtgaaacaacagaggaaactgtaagcagagaagttatggaagaagtaggtgtgaaggttaaaaatatcacctattataaaagccagccgtggggactcagcggttcacagcttcttggttacttctgtgagcttgacggtgacgacacaataactcttgaagaagatgagttatcggtcggcacatgggtcaaggcagatgatatagatgtaattgatgaccatatcagtctcacaagggaaatgattgagaaattccgcagtgagcatgtgaatcacaattaattgtaatctttaaaactaatattaagatctatggtattaccactgacaccgtctaacttagctgattcagtgtattgccatatagagaattcatatgggaagtaaggtgtgtctgaatagtaggcaaaccacttctcatatttttctaagcgggtaaggtcaagtcttccaacgaatcccttgaggttggaatatatcattggcttatagcctgctttttctatcttgtcgcagaatgcgattatgatatctgtaagttcttcagtagtcagattctcctgtctgtatgaatcgcccgaaatctcctcaaagtcaataactacaggatatgtaatcctgtaaggcttgataatatcaagaacataatcagcctcttctatagcttcctgtttcgtaattgcagatgagaagaagtatgcgccaatcttaatattattctttattgcgtcttttgcaaatgtatcaaatgaagaatcagtgttcaggattccattgccatagcttctgaaaccacatcttaacatggcaaattcaacgccctgttcttttaatttcttaaagtcaatattcccctgaaacttcgaggcatcaacacccatatgtgttgtaactttaccgtcttcattgtatgtaataattcctttatcatcctgcttgaaattctcatccttataattattcttcgcaagttcaggaagtatctgcgcaaatacatactgattcttattgttcacatagactatattatcagggaaatagctcttaagtatagaaagagaaccttcaccgttagtgaatcttaacttcatatcagaaagaagatcctctttttcttctgactttagtttctcaatctcgtcattgctaagcttatcggtattagttgcaacggttgattttcggtacttaataatgacaccggtggtcagaagaccgaacattacagttgtcataaagaatattaaagttgttatcacaaaaggattggttttcttcgatttcatagtgcatcacctctataataattaattatgagttattcataaaaagtatttcttgtataaatggtatattagctttcgcgaaatgtcaattagaattcatatgattttttaaataaaaatatagaaaaggtattgacaatttattgaatagaatatatagtatctgtacaacacaacaattcttatagaatcagaatccagacgtggataactgagattcttttgcctttgcaagaaggtaattgtaccgtttctgttctgaattaagctggtagatataacagtctatcaggtcaggatcagtaacattatcaagattagaataggcagtatacatcgcctttttagtcatcataagttcctgtaacagatatttttcatcatatgtagcaggactcttttttttaccaaacattttcaatagaattactccttaatgcacaagattaggggcatcatatgcctttattagaagtataggcagtaaatggtaattctatacatgtttttttgaggaggtggataagtgccggatattatatcagtcattattgcactggtattagttattgtagcagcagtacatgatctgagagaattcagaataccgaacaggcttattgttgcaggtattgttgtaggcgtgagtgttattgttataagagcttttacaggtgaatatataggaaattatattcttggaactctggcgggattagcgggaatgacatttctatatataatcagggctgtaggtgcaggggatgtaaagcttttggcagtaattggaatgttgactggattggaatttgtactacagcttatggttgtatctcttattacagggctttttacgggaattgttgagttgtttttaaaaaagaccagagaggtcagtatggggagcaatggaataaaggcgcatgggtttcattatgcagtgggggttctggctggatatgttgttgtgttggtatacaggtgtgttgtggttttatgaatgatattacataggaggtgaacagatggggaggaataacatttgcgttatatatgactcggacgaaaattatgcgaaacgacttatgtctgtgattaatgatgataatgatattccctataatgcacaggtttttactaaggaacatgaacttgataagtatctgcaggaaaaagaagcggatatgcttatgatatgtgaaggagcatatgggtataacgcatatagaacgggaactaagactgttgtgttgtgtgaggaggagcgtgaagcagatgagattaattcaagggaagaaaaaggactggttggaatatgtaagtatcagccgtcatatcagcttctacagtctgtaatgagatatgagaagaaagaccgggctcaaaaaaggggaagccttaaagtgaccggtatatatggatttaataatactgcaagaatgatgttgtcactggcagttgcaagactgatgtcagagcatgggaacacactttttattaattttgaaacattttatgggtttaaaggaatcctgaaggatgaagagaatgaaaatctttctgatgcattatatgcattcagacaaaatcataatcagtttcataaaaatattgttaatgccataagtcattatgaaaggctggattatataccggatgcgtcctgtgcagaagatattgatgatataaaacctgaagaaattgggacatttattcaggcaataggaagggaacttggatattcgaatattgtaattgatattggggatggaatacgcatgccttggaatatgatggattgttgtgatgaaatatatatatgtgaaacaggcaattatatagagaatatgaggtttaagaattttgaaaaatatcttcttgagcaggggttggataatattgcagcaacttttaaaaagatacatgttaatgaagatgagaacattaataatgatgatatatgggggcggctgcctttttgcagtttttatgaagaattatgcagaacagcaggaatagaggaaatataatggacgaactctacattaagctaagaaagcatgtatatgaaagactggacattggcagagatgttgctgacagtgaactatatgaggtgatagatgcctgcatatatgatgaaagccgtaataatgtgatttcgataaggcagaaggaagaacttaaacagcgcttatataactctattaaaaaactggatattttgcaggaattacttgaagatgacagcataaccgaaataatggtgaatggcagtgacagtatattcatggagaggaatggttctatagaaagatggaacaaaaaatttgaaagtgagaataaactgtcagatgtggcacagaggattgcagctatgtcaaaccatatggttaacgaagcatctccaatagctgatacaagacttgaagatggctcgagggtcagtattgttcttccaccagtggcaattaatggaccaataataactataagaaaatttttcaataagcctatcacgatagacaggcttattgaattggaatctattactccagaggcggcacagtttttagaaaagcttgttaagagcaagtataacattttcatatcaggtggaacaggaagtggaaaaacaacatttttaaatgtgttgtcagattatgtgccagatgatgaaagagtaattacaattgaagattctgctgaactacagcttcacaacattaataacattgtgaggcttgaggcgagggtggcaaattcagagggaactaatgcagtgagtataagagatttgataaaagcaagcctaagaatgcgtccggatcgtattgtagttggagaagtaagaggaccagaggcaatagatatgttacaggctatgaacacagggcatgacggaagtctgtctacaggacatgccaatagtcccaaagatatgctgacgagattggaaacaatggtacttatgggaatggatatgcctgtgtcagcaatcagggcgcagatatcatcagctattgatattattgttcatcttgcaaggctaagggataagagcagaaaggtggttcagattgcagaagtcggaaattgcattaatggtgagattgcacttacgccattgtttaagtttgttgaaaacagtcaggataagaatggaaaagttattggtacgcttgtcaggcagaataatgtgtttaacagaacagagaagcttgaagctgcagggtttagtgaatggtaacgaaaggtacatattagaggggataattattgttctgattgcagcatacatattttatgaaaatgtttttatggcggttattctttcaccgtatgtgtatattcattacaggcagagaataaaggaaaggattgttcatgataagaagaactttaagaagaaatttaaagatggaattattgcagtgtcatttgctttaaatgttggatattcaatagagaatgcatttggacaggctgtagatgaacttgctcttatgtatggggatgattctgatattgttgtaaagttcaaacttatagttataaggcttgggcagaatgagaatcttgaggatatattagatgattttgcggaggaaagtaaagtagaggatatcatgtattttgcggagatattcagatatgccaagagaagtggtggagatttaatggcagttataaagaatacagcgcagattatacagcagaaggaagaggttatgtcagaggttgacactattataagtggcaaaaaaatggaacagagagtaatgagtcttatacctgctgttatcgttatatatttaaaggtgactgccaaagaatttatacagcctttgtatggtaatattgctggaataattattatgacggtgtgtctggcggtatatgttgtttctgatatgtgggcaaagaggatagttaatattgaagtttaaaaaagaaagaaaggtattattaataattgttattagtgcagccatggctgtaatcagtatgtttatgacggacaattcagataagttgttttgcagtatagagcgtcctgaacctggagaagagacacaggtaaagagaattaatgtcgtaggtgaagatggagagagcataacatctgttgatgttgaaatcgcaccaagaattatgtcacaggatgaagctgccgtatgctttgaaaaggcatatgaggagatagctggaattatgtgtgggagaaataaaaatcttgaacatgtaactagcaatcttgtattaccagaaacggcacagagaggtgtagtttctttgacatggtattcaggaaattatgaacttattaattataacggtaatgttaataatattagtttttcggaaaatgagtgtcagaatgtagaacttaagctgattatggaatatgaggattataaaagtgaatacgattttacagtaacggtatattcaccagaatatggtacaggagataggagaaaaatacaggcacaaaaggatatagaagcagctgtcagtagtagcagaatggatggaaatattaaccttccacagtatatagcagatagcaaagtatactatgaggaaagtgaaaagcctgtgtctccgttattatttgtccttcttggaggggcagctatattagtagtaattatagctgataaaaagaaagtaaaggacaatgctataaagagaaaaaaggaactgttatatgattattcagaagttgtatcgaaattgacattgcttcttggtgctggaatgactacaagaatggcatggcataaaatagcggctgattataaggataacatagaacatggcaaggcggtacgcagacctgtatatgatgagatatgtaagactgattataatattcaggcaggaatatccgaattaaaggcatatgaacaatttggaaaaagatgcgatacgagagaatatatgaagcttgcagcattattgcagactaatatcagaaaagggactaaagagttacggcgtcttcttgaagaggagacggctgatgcatttgaaaaaagaaagaatatggcaaagataaagggtgaagaggctacaactaaactgcttatgccaatgatgatgatgcttatgatagtaatggcaataattatgattcctgcagtatggtcttttcagatttagctggtaattatggaggttaagataatatgaagaatgcgataaaaaagttttgggatagtgaagatggcatgggtgttgtagaggttgtgttgataacaattgttcttgtgggactggttgttgtattcaaaaaacagataacaagtctggttaattcaattctttctaagatgacaaatcaggctaataaaatctgataaatggaggctgttgttgaataataagacatttaaggcgcagataacggtaatggcagcattgtcaatgacaataatattttctttgatatgtacatgtgtcagatcagcatcagattgtttttataatacgcagatcaaggaagcgtgcatgttatctgtggaaggcgcattttctgcgtatcataacgatatgttgagtgaatatgatattctgcttcttcaatatagcgataatattaaggcaagaattgaacaatatgctgaagaaaatatatattcctgtgggaaaaatgtctcattaatgggggttgatgtggataatgttgagtacataactgatcagggtggaatatatcttagaaaagaaattgcttcatatatgcaatatggattgttttcagagatggcagatgttatgagacagtcggaaaaggaacttcaaaaagtagaaaaaatcaaggagataacatcggatatacaggattgtgaaaaggatttgtgggaggtggacttaaaaatacttcagctcattaaatatgttgaagggattgagacaacagatacgggaattgtaataagaaggggggaacctgtatcatcagggggatattttgccaaatcggcagttaatgggattgtttcaatggattcagtatatgttgatgagaaaaaagtatacatgagtattgacaactcggaacctggctacacagatgtatcagcattattagatgatatgtatgaagatgccagtggtgttgcagctagtgaagaaaatcaaaaagaggaagattatattaattcatattcggatgtatataggagaaattatataaagctgaaagctgtacttggaggaactaaagagcagacagagaaagctttagaggtgcttggtgaatatgatgatgcaaagtcgggtgcagagaataaactgggtggatgtatggaaaaggtttctgctgaaataaagactcttggtgaagaactttgtaatgaattaatagaggatcttaagtctatgaaagaagacaatgcgtcagacaagaaaacaatgtgtgatatgcaacaactgagacaggcactttcaagaaatctaattgtgcttaatggggtatgcagtcagattgaaaaacttgaagaaaatcttaattatgacaatagcagagatgttatgtcgtcagtagtcagatgcaggcagttgttatatggattgtccgcaaagggaatgaagtttgattattcaggagtggatttttctatagaatcttccggtctgtctgctgtaagaaaagtaagacagctgattactgatggcatactggcgttagttatggatacagataatatttcagaaaagtctgttaattatgcaggtcttgcaacagatatgtcagggaaaattgagagtatggaatcaaaggcggaagaaataaaggaacagtttctgatgaatgagtatctaatgatgaagtttaattgttttactgattatcttgatatggatatcgatgaaagtgccggtattgactatacgcttgaatatatactgtgtggaaaaagcggtgataaggaaaatcttgaacagacaatgctggaattatcaggaataagaacgggtatgaatctggcatatcttataacagacaagtcaaaaaaaatgcaggcgtattcatttgcagcaggagcattaggatttacaggtaatatggctcttattaaagccgggcaatatctgataatgtcggtgtgggcatatggtgaagcaataatggatatgagggatttgtatgcaggaaataaagttgctcttgtgaaaaacgaaaaaaactggaaattatcattggaaaatctgttaggtatgaagtttgattccgacaaggatacagacgatgatggtttggaatacagggattatatacgaatgctacttatgttagaaaggagtgaacataagaattacagaactatgggggcaatggaaattaagatgataagtatgggacatgatgatttcagaatgagaaattatattgtgagtatggcgggaacagcagtgtttagtgttattaggagaggacagccatatgtacagataataagctgttcttatatttaatatggtttagcggcatatgcttctaaataacggttcgatgcaggaataattacgaagagaggagagcagtcaatgacatactttaaccgaaaattgatgaaaagagacattcctgcatcagcaactgtagagggggctttgattatacctgttatattatatgctgttgcggcagtaatgtttttgttgcagttaatttcaataaggatgcatgtaaatgatgcattatataatgcattaagaaagtttaatacatattcttatacaagtcaggttatgacgggagaaatatgtaagtctacattttttgctatttttgtagatgaaattggcagcgattatgctaagaaacattatatagcaggcggtaatacagggtggaacttttatggttcagatatagcggatgataattctaccgtgaagatttctttaaaatatactgttaagaatccattcaatatattagggaaaaggcagattacaatatatgaaaaaagaataacagatatatggttaggagaggaaaaagatggatttgagttaaataacaatgacgaatctgagtatgtttacataacacagtatggtgaagtatatcacatagagaagatgtgtagttatctggtaagaaacataaaagcagcatcgctggctgaaattacagatttaagaaatgcttctggaggaaagtattacccatgtagtttgtgcaagggtgcatcaaaaattgtatactacacagattatggtgataaatatcatgcatctgatagttgttatgcattgcaaagaacaattcttaaagtgaaaaaagaaaaaataaaaggaatggaatgttgcaaaaaatgtatacattcataatccaaagggggtatatgggaagtctgattatgttaacggggctggctataatgtcttttatggatataaagagaagagcagttccagtatatatgataatagtgatgagtattctggcaattggcataaagatagcagaatatatatttggatataagaaagtggatgtttatgaaatgtttattatattggttgttacaacagtatttgttgtgatatgtgtaattagtcatataatgggtgcggctgatgcacttgttatgggaataattgcaattgttacaggcataaaaaaggcaacatcagtattttttatggcattgatgtttgtaagcataatttctggggtactgcttattataaaaagattaaaaagaaaagatacaataccatttataccttttatatttatatcttatgtgggggtgatgatatgtggttaagggcatcatatacagtggaaaatgcggttattacaccattgtttatgttgataattattgttgttatgagagcaagttgtgatatacatgataatctcattcagcgcagcgttaacagtcagtttgttatccatacagaattagggggatttaatgatgaagatacggacatgtatagaataaaaacggaggaatatcttaagagaagagtgattttttcgaaaaaatacaaaatagaaccagaagcatcaattgtaagaacgagttctccagaaaaaactataagaatagtcaatgcacttaaagaacttaagaattaggggaggattaatattggggaaggaaaatattaatataaaatatgagcatcagaacaacagcaattatcttgtgatagaagataatgttgaatatgatgattaccagtacaaaatgcttaggcgcaataaaccagagcattttttaagattctcaatgtattctgttaatggcagatatggaatatattacgacattacatcaagacagcagctgagtaagtattatgaatatgggaaaatgacaatggaggatgttaaatccatatgtgttaatatatctgaaatggtaagaatagcagaagattatatgttagatatagatcacgtgaagatagaacccaggttcatatatatggatgttggaacaaagaagctgcagtttgtgtatcatacaaaggttaatggatatagttttaacgaaagcctcaaaatattgtttgaatttatattggaacattttgatcatagtctggataaggagagtatcgtacaattatatgaagtgtatcagaaggtaattgttggagattatgatccatttaaccttatgagaatgtttgggattaaaaaagtaaaaaaacaggaagaatctgttatacaggatatgccagaaaaacgggataaagaaataaaaactgttatagctgaacagatgatttcggataaagaagaaaaggcagatgaatcagatgttaatataagaagagttattattggtgtagtaagtatggcttttggtctgttaggtatatttgtgccaggattaatacctttcagaattccatctgtcctgagttttatatgcattggtgccggaataggaatattagtattttgcaaaaaagaacataaaaaactgcagtctgttatacttacgcagaaacagtcaattccatatgttgtgaagaaagatacagcacaggtattatataatgagagtgtcaatgtaaacaacaaatgcatagaagaaaaaacggtttcgtatgacgatatatgcaatgagacaatgctgttgtctgaatatatgccggaaaagaacagtagaaaagaattaaaacttgtattgcagaaagaaaatcttataggagaagtgcttatatatataagaggggttgagaatgaagacatggtaatatgtatggataagtatccatatgtaataggaagttttgaaaagatgtcagatgttgtaataaaagcacaggtagtgagtcgtatgcattgctgtatatatcatgaagcatttaaagatgatgaatatctggttgaggatcttaatgctaccaacggaacatatcttaatggagaacggcttggcaatcatgaacgtaaaaaactttctgatggagatgtgttaaaaattgcagctatatccttcaaggttgaaataagctagattttatgctatattctgactggtatatcacggtaagtgacaatatttattttttgatatatatggggattataagatgaatattaatatatattatggtggaagagggcttgttgatgaccctacaatattagttattaataagatacaggaagttcttgatgagcttaatgtcaatgtgaacagatataatctgtatgagatgaagaatacaataacaacactgtcacagactgttacagaagcagatggtattattcttgcaactacagttgaatgggtaggaatggggggatatatgcagacatttcttgattcctgctggctttattctgataagtcacagattttagataagtatatgtttccagttgtaatggcaagaacatatggagaaagggaagtgacacttgcacttaataattcatgggaaattattggtggaaagataggaccggcacttagtgcatatatagatgatactactgattttgagtttaatgataattacaaaataataatagaaaaatatgctgagaatgtatatagaacaatttcacaaagaattatgcagcttccatcaagtagtcagactattaagaacaatatgcttaaggatactattaagcttacaccacaagaaagtgaacagctatcaaaatatgcttctgatgatgcatttgttaagacacagaagcaggatattgaatcgcttgcaagtatatataaggaactccttaatgatcaggaaaatggtggagatgattattatcttaatgtttttagagataattttaatcctacaacaggatataagagtacatatatgatatcaataagtgataaagataagcttataagtatttatgtagatggaagagacataaaagtaacattcggagagaataagagtgctgatgtcataggaaagctttcaaaagaaacatttgaccagatagtggaaggtagagaaacattccatcgtgcatttatgacaggagcaatgacagcacggggaaaccttaagactctcaggatgttagatgaaatatttaattttcagaaataataggaaaacgtatgcataatattgtctttccgtctgattcagtgagtctggcataaccgttacctgataggcatatctgatgtattattgacagaccaactcctatatgaccagattttgttgaatagaaaggtctggatagtttaatgtaatcagacaggtatgaagaatcatcgtgtgatggcagacccccattattaataatttctgtgattacataattgttactctttctggttataagggtgatttcaccagtgcagtctgatgcttcacacgcattctggacagcttctgtaagcagggttttgagctggtcaggatttatgagaatatcgggaatattatcaagacagaaggtaaatgtacatgtattatcgattacgtcatcaattatgtctggaacttcatacataatatcgttgatattaactggttttttgtcagcttttttcatgctgtatctgtaaagagttgttctttccatgtgatatataagctgtgacaggacatcttccatacggattatatatttgttttcagacagttcaggagatttcttttttaaaagctggaaactggtttttaaatatgccagatgattctttatatcatgggaatcgatggataattcatcaatagaaaacatagacatgttgtcaaagacagaaatcatgtcgggattttcgtttattaagcaacatagatttctatattcatcatagtttaacattttataagaattcctttcgaacattaatttaataagttttttctatgaggttgtaattgaaccttctttaagttatcatataaaagtatatacgtattcgaaatacatgtaaacaaaagtatttcgacaaatttcgcgcaaagtgagggaatagtatgaaaaaggatgattgtattttttgcaagctggcaaacggcgagattccaacaaatgctctttatgaggatgatattgtaaaagttattttcgatgcaagtcctgccgctaaaggacatgtacttatattgccgaaggaacattttgacaatatatatgaacttgatgatgaaactgccgcacatgtatttaaagtagcagctaagatttctaaagcgtataagaaagcattggattttgatggacttaatattgttcagaacaatggagaagtagcagggcagacagtatttcatttccatatgcatattattcctagaattaaaggtgatacagttaatgttggatgggttccgggaactgcagataatgacactatagcatcaatagtggaaaaagttacaccttatctttaatgtttgtatatgttatataatgaggatatgaataacggatattaagcgggaaaccgtaatgatatatagaaagaggagaaagcatgattaaattaagtgatggaggagcatatcttatcaacggtgtcgatattgttgaggatagtgcttcggctgtgaatgaagtagctgccaagacaggatgttcagtaacaaaggaagaggctgctaagaatactattgcatatggaattcttgaaaaccataacacatctggaaacatggagaagttaaagattaagtttgataagatgacttcacatgatattacatttgttggaattatacagacagcaagagcttcaggtcttgagaaattcccaattccttatgtacttactaactgccataacagtctctgtgcagttggcggaactattaatgaagatgaccatatgtttggccttacatgtgcaaagaaatatggcggaatatatgtaccaccgcatcaggctgtaatccatcagtttgcaagagagatgctggctgaaggtggaaagatgattcttggatcagatagtcatacacgttatggagctcttggaacaatggctatgggtgaaggtggtccagagcttgttaagcagcttcttaataagacttatgatattaacagaccaggagtggttgcaatctacatgacaggagaaccggcaaagggtgttggtcctcaggatgttgcacttgctattataggtgcagtatttggtaatggttatgttaagaataaagttatggagttcgttggacctggtgtttcatcacttagtgctgatttcagaattggtgtagatgttatgacaacagagacaacatgtctttcatctatatggagaacagatgatttggttaaggaattctatgatattcacggaagaagtgagagttacaaggaacttaaccctggaaatgttgcttattacgatggtgttgtatatgtcgatttaagcacaatcaagccaatgattgctatgccattccatccaagtaatacatatacaattgaagaacttaatgctaacctcgaggatattcttcatgatgtagagaagaaggctcttgtaagtcttgatggacaggttgaatataagcttacagataagattaagaatggcagactttatgttgatcagggaattattgccggatgtgccggtggtggctttgaaaacatatgtgcagcagcagacattcttaaaggaaagtcaattggtgcagatgaatttacacttagcgtatatcctgcaagtacaccaatttatgttgaacttgcaagaaatggaagacttgcagatcttatggagacgggtgcaattgttaagactgcattctgcggaccatgttttggtgcaggagatacacctgctaataatgcattctcaatcagacattcaacaagaaacttccctaacagagaaggttctaaattacagaatggacagatatcatctgttgcacttatggatgcacgttctattgcagcaacagcagctaataagggataccttacagcagctacagatgttgatgtagagtttacaggaccagcataccattttgacagctcaatctatgctaacagagtatttgacagcaagggtgttgcagatccggaacaggaaatccagttcggacctaatatcaaggattggccagagatggttgcacttccagagaaccttattattaaggttgtatctgagatacatgatcctgttacaacaacagatgagcttattccatcgggagagacatcatcattcagatctaatcctcttggtcttgctgaatttgcactttcaagaaaggatcctgcatatgtaggacgcgctaaggaagtacagaaggcagagaaggcaagagaagcaggacagtgcatgggagaagctttaccagagctgagagacattatgcataagattaaagaaacatatgatgtgcataagtctaatgttggtgttggaagtactatatttgcagttaaaccgggtgatggttcagcaagagagcaggcagcatcatgccagaaggtacttggcggatgggctaacattgctaatgagtatgcaactaagagataccgttcaaatcttatcaactggggtatgcttccattcataattgataagggagagcttccgtttgagaatggagattatatctttattccagagattcaggatgcaattaagaataaagtatctacaatcaaggcttttgttgttaataaagatatgaaagagttcgaacttaagctggatgaacttacagatgatgagagacagataattcttgatggatgtcttattaattattatcgtgagaacaaataataagatgaaatattagtgtatacggaagttggtgagcagatggcagaacagaatatactgaatggtaatcagaagaagcttgaacagattattggcgacgttaaggaacataatacgaagaaagacagacttgaaaagcttgcggaaagcgttaaagatatttctaaggaattagataacgcgagaaaagaaaaacagaatgaaacagattccaaaattaaagcgagtacagatgctatatgtgccgggtatgataagtcaatagaagctgataaagaaaaaattaagactgtttctgctgaaagagataaagccaagatggcaggcgttaaagaaagaataagcgcagagacagcatctttaagagcgcagaatgatgatcttaaagatcagattaatgaagcgtttatacatgagaatatctctaaaatatataacagtcagttatttatatcggtgtttaatcccaggcagcttttggattatgtgattgatatagctgtcatggtgggattgtttgtggctgttccaatagttttattcttattgccggtgattccgcaatggattcttcttatatattgtatagctgtatcatttatatgtattgttgttgtaaaggctgtctttagaaagattgtgctgaaacattctgaaactataatggctgcccagagtacaagaacgcagataaaagataataataagcgtattaagaagattgagaagaacatcagaaaagataagaatgaagatatgtatgggcttgaatcatttgattctcagattaaagcattgtatgatgacatagcggagattgaagatgagaaacagtcagccctggaggattttgaaaagaataccaaggctgatattatctcggagattaatgaacgctatgcagataaaatatgcaatatggaaactgagcttgaaaagaaaaaagtggagtatgatgaacttgatgatttggttaagaagcagagaatatacatatcatctaattatgaagcgtatcttggtaaagaatttattaatgtagataagctttcagaacttaattctattatgaagtctgactcagcagatacgatagctcaggctcttgctgtatataataatcgtcattaaatgttcttaatgccagaacgatagcatcagctatctggaatataattgacaaacgggttgtctgaagtgtggatgattccatgtcatgggaagagttaactattcctgtgatatgaagatctccaacttcaggcaacttttttttcactccaagaccgggtttaagcggtccgcttcccagagtcatcatgccaatatgatcttcttttccaagagatgcatcaattgcaattataaaaggattatcaaatgttttttgcatagatttaatacagtaattaagatttgcagcatgaacaggctggttaaggtcgccaagcagatagataccaggagaaatgaaatttctaaactgatgacctattataggaccaagactgtcaccagtagagcggtcgcttccaatgcacagaattacaatttcctggtgaggaagaattttttgggtaaccatatcggtgagtagtcttcccatttgagcgggagctttagggttttttgaatcaaaataataaatcatgagtttgcctccaggtcattttagtagcttagacaggctctttataatgtgtacgcgaaaaagagattaaatattaccaaaaatgtttctgatattttttaaatgaatgacaaaatctgataaattttttcgtaatgtagtgatattattcaaaagagtaataatataaggaggcaccatgatagaaataatatgtaatgaagaaaattcggacaagtcaaaacaagttacaagaggtgcggccataaggagaccgaaaaatattaaacagataggcgaagtgagttctgataagaaaatatatatagaggattatgcttttacatatataaattcaattgcttacaataatccgtcagactcacaggcgggagtactcttgggtgaaaatcagactgatggggatgaaaaatgtgtttttattaagggaataataaaagcaaagctggggacagaagttgaagaaaaaggagtatattttaacgaaagtgtatggaatgggatatattcagatgttgaaaaatattttccagatttagcagtagttggatggtttgcagcaattccagaggttacacctgaaagaatgatgaaattaaagaaaatacatcttgataattttgcaggtacaatgaaaacattttatctgattgatacggttgagaaagaagaaaatttctacttatatgaaaatggtgaactaaagaagcagaaaggatatgtatgcttttatgaaagaaattatgaaatgcaggaatatatgcttgagcggcgtgaaagaaagtcaagtgaagacggaccggataaggttatgaaatcaatccgtaatataataagagaaaaagaggaattacatgaacagaaaaagaatgcaagatttatgtatggagtaagtacttttatggtaattgttattcttgtcattggaattaatctgatgaacaattatcagaaaatgaaaaagtttgacaagtcaataagcagtcttatggttcagatgtcaggaaatgatacagcaacacaagaggaggtagttcctgttaataaacttgaaggtggagtatatcctacagaagtggagacaacaagccagacagctggtacgggtgcagtttctactgagaatgttacggtaacggctgctcaaccggtggaagaacagactgtagctgcaacggtaaatgaagtgaagacatatacagttaaagctggcgacacaattatgggaatatgtaaaaaatattatggtgatacatctaaatgcaatgaagtaattgcatataataatataaaagatgagaattttttatatataggacagcagataaaacttccttgattaaattccccaatattgtataattaatttaatgcgagatgcaatagaaaaggggaaatatatggcagatataatatctggtaaatccagatttaatggggaccgaaatgctcccgtaaagaaagtgattagtattaacagggaaatggcagcatcaacagaagataatgaagatgttctggatgaagctgctgtaaaaagaaaaataaggagacataagagcagggttgcagttgttgttactattataattgtagttattctggctgcagtttacatagtatcaagagtaatagataactatgattactcatcttatgaaataaccaattcggtaaaccgggaagatatagaatcttcgaaatacatagcatttgcagatggatatgtaagatatagtaatgatggaatttcctattataagaacagtggcaaggtgatatggaaccagacgtattcgatgcagaatccaaaggtcagcatatgtggtaattctatagctgttgcagatatcaatggaagcagtgcgtattcatttaatacgagtggacaggttggtaaagcagatacatcaatgccgatacttcagatagaagtatcagacagtggaaagatggcagcagtccttgaggataataatgccaattatattaatatgtatgacacaaatggcgagaaaatatacagcgttaaaacgacattgtcaggagatggttatcctatagatataagtatatcatcagatgcgaagaaactaatagcttcgtttataaaagtgagtggagatgagattaaaacaaatgtagtgttttacaatttttccgatgttggaaaaaacgaaacagaaagagttgttggtggctttaattatgacgatattatagttggagatgtaaaatttgtaaatgacacaacagcagttgcggttggtgaaaatgtagtgagcatttataagataaaagaatatccaagtctggaacatactattaatatagataatgaaatacaaaaaatattttgcagtgaccagtacataggtcttgttcttgataattcagaatcgggagatccatataagcttgttgtttataatatatcaggaaaacatatatttgacacaacatttggcatacagtatacagatatgcagtttgatggcaagagcgttgtaattagtaatgcatcaacatttgtgctcctgaatatgagcggtaagaagctggcagatattagttttgatatgccagtgataaatgttttgccaactggagcaagaggcagctatacaatagttaattcaaaatacatacagtcaataaaactgaaatgataaggaggacggcgaaatgctgttagcaggagtaatacttatactggtaatatttgcacttataggctggagaaaaggtgtaataagacttgttttgtcacttgtatcaatgataataacgataatggcagcagtggtaatagcaccgatggcgaccacggcaataaaaaataatactaatatagatgaaaatatagctcagtcaatatatacagttctttatgagaataaagaagtagatgagtattttgaagataaacaggttcttacgggtggcattgatataagtcaggtagaatcacatatacagacagtaacggatgtggtggctgaggtcggggataagattaatctgccagagagtcttacggaagcagttaaggcaatgccagactctgaacttatgtctgtaatcagagaatatggagaagcatctgttaaagaaattactataagattaattgcattaaggttagcggatatagtgttgacagctattgcgtatttagtcataatggtggtggtatcgatagtacttagagttgtagttgcagcgacagggttaataagaagacttccggtaataaaacaggcagacaagctgggcggattaatagtcgggctggtagagggaattgcagttgtatggatattctttaccgttgtgacagcaataagtggaacacaagcagcttctaatatattagtgcagatacatggtaatgcaattttagaagcgttatataattgtaatccaataacaagcttactctttagtacaataagataaaataagggaggatggaaatatgatatgtaaatcatgtggaagagcaaatgaacttggagccagattttgcaaaagttgtggggcaccgttagaaagcgatgaaagtatgcagcagaataacacatatcagtcagaaaacgtataccagcagaataatcagtatgttatgccggaaagtttgtattcaggtacaacaagaatgacaaagaaagagtttaatgagtgtgctaatattaaatcaattactaagaatataactgcagcggctataattgcatatgtaattggagctataacattcatagttaatgtagtaatggctggaaatatagcgggtcttgttgatgtcatgattgtggtggggcttgggcttggaatacatctggcaaagagcagagcatgtgctgttattattacagcatattcaatatttaattttatatatatgattcttcttgctggggtgccaggaggatggcttattatagtttgtggggtatattctattatatatacatttaaatatcagaatgcctggaataaatatcagcagacaggacaaatataatctataataaaaaaagacactttattcttgatgtatgcacttagaataaagtgtctttttatttttgtaccatatactacataagaattgtaaaaatgtcttactagatatagtacaattacaatggatgaatacatatatattgtgataaatgctattgtgatataaaaaacaaaaaaaatagaaaaaaagttaaaaaagttgttgacaatgtgtgtacctgatgatattatatacaagtcgccgcggtaagcggtaacaaataaggcttaaaacaccagataaatgctgggtttgagtgatacagatctttgataactgaatagaaagacaaccttgaaattctttgagaattttaaaatgtcctttcaattatgtttttgtgtggtaacttaattataactgaaagatgagctctcggctcttttttatataaatttgtaatttacaccattatatggactttatcgaatagtaggttttttagccagcaaaaaacatctaatattatagatgtataagaaaaagacctactaaattgtgaaaattaatgaaatagtgggtttaaaggacaagtttatagaagagggaataataatgaacaaaattgctgagtttataaaacaaaatagaaaagccagtggacttacacaggaagaatttgcgattcgttcaggtctgggattaagatttgtaagagaattagagcaagggaaaaaaacagtaagaatggataaagttaatgttgcattggctatgtttggaatggaagctgtgcctgggagaaaggaagaataatggagattttaaggactgcctatgtgtatggagtcattgttgccggaacatttaaagaatgaatttgtagagttgttggaaaaaagaataagtgtgttagaaaaataaaaaggcagggacttaaaaatttcaagtccctgccttttttcgttagatattaagtaaatcactatatacttttaaagcaccatctgtatcatgagcaagtaccttcttggcaagtactttaccaagctgaacaccttcctggtcgaagctgttgatgttccatacgaatccctggaacataatcttgttctcgaagtgggcaagtaaagcaccaagtgtcttaggagtaagcttgtctccgataataatgcttgaaggtcttccgcccttgaagttcttgttaaggttctcatctgactttccgcatgcaaatgcgacaatctgagcagcaacatttgcacaaagcttctgctggcttgtgctgtcctgaattgtaacatctgtttctaactggttgttcttaaatccgatgaactgtaatggcacaatgtcagttccctgatgaagaagctgatagaatgaatgctgtccgttagttcccggttcaccaaagataacaggtcctgtaggataagtgacaggctcaccaaatctgtttactgacttaccgttagattccatatcaagctgctgaagatgagcagggaaacggcttaaagcctgtgaatatggaagaacggctgtacaaggataacctaatacatttctttcgtatacaccaataagggcatctaacatctcagggttcttgcgcatatcaggattagctgataacttgtcctcctctgcagcaccatcaaggaattctgcaaatacttcaggtccgaaagcaagtgataatactgcaccgccaactgatgaagtagaagagaaacgacctccgatataatcatccatgaaaaatgcgtctaaataatcatcactcttggcaagtggtgaagtctcgcttgttacggcaatcatatgcttagaaggatcaagtcctgccttctttaatgcgtccttaacaaatgattcgttagtaagagtctcaagtgttgtacctgacttggaaacaagtacgaatatagaatgtgcaacatcagtagaagcaagcactgcggcagcatcatcaggatcaacattgctgatgaacttagcttccatcttaaatgcattgttcttcttagcccagttctcaagtgctatgtacattgcacggggaccgaggtcgcttccgccgataccaatctggacaacagttgtaaacttctcgccggctgcattagtaatctcaccgttatgtaccttgttagcgaattcagcaattctttcctgctgtgtcttgtaaaatgttctcttatcaacgccatcagcttcaactgcgtcacctaactgacctcttgtcatgtgatggagaacaagtctcttctcaccagtgttaacaacttctccgttatataaagccttaaacttgtctgcaagctgagcctcatcagcgagcttttcaagtgcagcaagcacattttcattaacctgcttagatgcgtagttatatgaaagtccggcagccataggtacgctgtaattcttaacgcgttctgcaccattatcaccagacataacctctgtaagacaggctggcttaacatctgctaactccttgtaagatgaaagtgtgtctaaattgttccatgaaaccataatccatatctccttctctacaaatatttaattacacaataaatcataacaaaattatactatttaagattgtcgaattcaaggaaaaggagaaattaaaaagaggaataagttcaaaaacttattcctctttgaatccttatattatgcgattctattaaggttacaattaaccaaagtatctcttaagaagtccctcgaatgccttaccatgtctagcctcgtcacgagccatttcatgaactgtatcatggattgcgtcaaggttagcagccttagctctcttagcaaggtcagtcttacctgctgttgcgccgttttcagcttcaactctcatctcaagattcttcttagtgctgtctgttacaacttcgccgagaagttcagcgaacttagcagcatgctcagcttcttcccaggcagccttctcatagtaaagaccgatttctggataaccctctctgtgagcaactcttgccatagcaaggtacataccaacctctgaacattcaccttcaaagttagctcttaaatcagcaacgatatcctcgcttacgcccttagctacgccaacaacgtgctcagcagcccattctctttctcctgtctgtgcagcaaacttgcttgcaggtgccttacatactggacagacaaaatctgctggaagagattctccttcataaacataaccacaaactgtacatacatacttcataataataatctcctttcgtttataaacataacaggcatgagcctgaaatctacttatcggaacttctgaaaatgtttcatcagttcgtaactagaatataacagaaataaatcagcttgtcaataaaaataggaatgattactgttttttattttgctgacttgtaaaaatgttaattatccgaagcacatttttcacacaatccatagaagcagactgaaccagcctcgattttgcccggaaaatgtgatgaaacattagctccgaggttttcaaggatttcattgtcagatggattggtgatatcaattaaacatttacaccttctgcactgaaaatgcagatgcggcttcgtattggcatcgtaatgaacgaaaccgtcctcacatggaacagtaacggcttcgccatgctccacaagaaaggaaaggtttctataaactgttccaagacttatgcttggaaaatcatttttgacaaatgtgtatacaacatcggcagttgggtggtctttgcgtgacataagaaatgttttgatagcgtcacgctgacggctatgtttaacagcgcccataaaatcacctccggattattatttactattatctttaattaaattcataattttgtcaatagaatcctgctgctcacttttttccatattaatgatgtactggtgtctgtcagcataaagcttgcggactgcggcaagtaaggtatccttattcatatcttcctccgtaagaaccatggaataaccatgctccttgaaagaattggcattaagaatctggtcgccgcggcttgcattagcagaaagcggaatcagaagattaggcttcttgagagcaagcagttcacatatcgcattagcacctgcacgcgagataacgatagaactgattgcgaaaaggtcgcgcatctgctcgcttatgtactcgaactggacatagccgggagttccattgagtgattcgtccatcttgccttttccacacaggtgaacaacctgaaaatccttaagaagctcaggtaaaatgcttcttacagcctcatttacatggacagcgccagtacttccgccgacaacaagaataataggtttgtcagttgtgaagttgcaaaggtcaagtccggcagctttgttgccaagcaaaagctcctgtctgataggagaacctgtaagaactgcttttccttcaggaagatacttgagagtttccgggaaattgcagcatattttagttgcttttctcatagcaatcttgttggcaaggccgggtgtcatatcagattcgtggataattactggaatatgacggcttccggcggcaagaacaacaggtacagacacaaagcctcccttagaaaatacgatatcaggtttgatttttttcataagtctcttagcctgaaaaagtccatgaagcacacggaatggatcagacagattcttaagacttctgtatcttcttaatttgccggatgaaataccataataaggaattccaagatcttcaataagagttttctcaataccggtatatgagccgatatagaaaacctcgtagccggcttccttaagacttggaagcagggcaatattaggtgttacatgtccggcagtaccaccaccggtaagtactatttttttcataggtcattctcctgaaaatataataaaatgtccgatttgttcaaatgtatcattacattttatgagcaaatctttccttaaagctgcaatgcatgcagagcggttcgaccgcagtctttttcttgaatccatccataaatgcgacgcttcgtgggcatgaaaggatttcctcaagtgttgaatcaagaatattgccaagagccatcactccattaccgtcaagacagcacggaacgacagtgccgtcacacagaatagccatatgctggcggagtccctgacagaatccgcgctcattgcaataagtgctgttcacatcaggccattcaaacggagactgaacattaatataaagatgtctcttgattgtgcagttcttctcaccaaacagaaatggctctttcttagtattccagagtcttagtgaaatctctgtttcagtcttatcaagaagcgtctcgcaggattcaaaaagattatgaatataagaatccatgtcaatgcagtcgttatcgtcagcgctgtgaagcgacacattaatctgatgtacaggatactccagtaaaaccggaagcttctctttaataagagtggcattggtagtaagatttactgtcatatcagcatcctgacatatcttaagaatttcaccaagctgtggatgcagaagcggctcacctttaacatgaagataaatgtaattagtataatgtccgattctttcaatcactgtgcggaattcgtccacactcataaaatgtggttttctcagagtttcctgacagaaagaacagtgcaggttgcagctgcttgttatctcgacataaactcttttaaatcgcgcgacactattcattatctttcttatattcctttaaggctttagcaagctggtcaggacatgatgtgtccttatagccacatttgataccgtccattcttttgatagcttcgtcaatgtccatgccctcgataagagcagcaacgccctgagtattgccagcacatccgccagtgaaatgcacattaacaacctttccatcaacaacatcaaaatctatcgcgcgtgaacatacgcctgaagtcttaaatttcataaaaatctccttacttatctttcttacattattagttattcggtatatgtattgttgtgagaaattgacagattagcgcagagtgctttggagtcgccggcacttagcgtgctatgcgataatctgtcaatttctcacaatgttagtacacatatctaattacagtataacacttttacatgatatgaaaaagcataagttgttttattgcaaatgttcaattataatgtatgcagtttgaaatggatatataaggaggatttatgataggcattattggcgcaatggacgaagaagtagaacagcttgttgaggtaatggagattacccgcgaggaaactaaggcatgcatgacatttaaagcaggaaagcttgccgggaaagatgttgttattgtaagaagcggaattggtaaggttaatgcagcggcatgcacacagattcttgtcgatgacttcaaagcagactacattattaatacaggaatcgctggttcacttaaggcagagattgatattgcggatgttgttatttcatcagatgttcttcatcatgacatggatgcgacaggatttggatatcctttaggacagattccaagaatggatacactttcatttgcagcagacgaaagacttattaaacttgctggcgaggcttgtaaaaatgcagttccggaaatcggagtacatgtcggcagagttgtaagcggcgaccagttcatatcagacaaggctgttaaggagagaatcagcagcaatttcgatggcttctgtacagagatggagggagcagcgatagcacaggtttcttaccttaataaagttccatttgtaatattaagaactatatcagataaggctgatgacagtgcaacaatggattacccggcatttgaaaagctcgcaattgctaacaatgtcaaagttatgaaggaacttgttgcaaatatttaatcagacggtggttcgacaatatctgctttaattaagttgtataatgcggtagtattcaatgtcttttgggaggtttatatgcagactgtattaatagcaatcagaaattatgcagatgatgacagcggaaatgtcgatatacatagcaggctgactgtaaaaccatttaagaaaatgaaaggtgcaggacgactttttttactaaaaaatgtagacagggaacttgtgaaactaaataaacagtacagggaaattattaaaaatgtacgataattatgcaaaaatgtgcagaaacggaggattattatgaagatacttatgttggaaactatgacatacggagatgatatttcgcttgagcagtttaacaggcttggcgaagttgtgacatacagcttaagttcttatgaggaagctgttgcaagaatgaaagagcataatcctgatgtcgttattattaataaaactaacatgaacgcagagtgcatggcagccgcgcctaatcttaagatggtggcagaggcagctacaggctacaacaatattgatatagaatatgccaaagcgcatggaataagggttgccaatgttgccggatattcaacacagtcagttatacagcacacatttgcacttgcattttatcttatcgagaagatgagatattatgatgacttcgtaaagagcggtgagtatgccgagtggccttgcttctcacattttgcaaatgtgttccatgaacttgcaggaaagacatggggaattgtcggacttggcaatataggaagaggcgttgctaagattgcggcagactttggctgtaatgtaatatactattcagcaagcggtcacagctatgatgtgccatacgaaagatatgagcttgatgaatttttgaagaaatcggacatcgtgtcaattcatgcaccgcttaacaaatatacagaaaatctgtttaattatgagacacttaagaagatgaagagcagcgcagttcttctgaatcttggacgtggcccgattgttaatgacgcagaccttgtaaaagcgcttaatgaaggcgtgattgcagcggcaggacttgatgtaataactactgagccagttgctaaggacaatcctcttcttacaattaaggacagcaacaagcttatcgttacccctcatgttgcatgggcgacatacgaggcgagaacccgcctgatggacgagatatatcttaatatcaaggcatttatggctggggaagagcgaaatgttattgtataatgtatggtaataaatatatatgagatggatgcggattccggttggagtccgcattttcactataattagatgttaaaaagaagaatgttttttaaaacgcaatatatcaaattaaattgatattcttcgcacgaaattgatatattgcggatgaaagttgatattcttcgcgcaaaaagtcaatgtatttctaatcttcctcaataacctcaatttccatataagcaaattcgatatcttcaacaaagttatctttagtgaagcgtactttcgagtggcgctggaattctgaaacattggaatcgagccagattggctcggcaaggtcgaattcatagcatgcgtcatgaatagcagcgaatattttgcgggttctgtttaaatcagaatccgcatttttaattacagtgtctttgataagatgccctctgtcgtcaaagagcttacaccacattctaaacatatcagaaatcctcactatctatcagtattgtgaatggtccgtcgttttcaaggctgaccttcatatcagcaccgaatctgccggtttcaactttaggaacacgttcacggcacattgcgacgaatttttcatagagggcgttagccatatcaggcgcgccggcattggtaaagcttggacggttgcctttgcggcagtccgcataaagtgtaaactggcttacaataagcagctcgccactgacatctgccagcgacagattagttttgccattctcgtcttcaaaaatacgcattttgcatatcttgtctacatattttggaagcatttcttctgtatcgtcctgaccagccccgaaaagaatcagaagcccatgtccgatatttccaacaacttcgccatctatcttaacatttgcatgattaacacgctgtattacgaatctcatattaaactccttaaatgtgtgaataactgaatattatacgcttagtggaaatgtgtcaacttgttaaggaacattattattatatgagttttatcttctgtctgccgatttagccgccgtttcctataaaatttaaaaataagttaactttataggtggaatttgagaaaaataggtgtattttgaaaaaaatgttgtgaaaatgcagaaaaagacctataagatgactttcaaaaacagaatttataggaacattttgctgtgtagacagcttaaatgatagaaaatggctgaaatgttcctataagaaaataaaaaatgcgactaccgataggtatcatgttgcaatcaataatcaacagatgatacaatctaagcaacagcaacagcaacagcaacagcaacagcaacagcaacagcaacagcaacagcaataaggtataggaggcatgagtatgttaaagaatattctggtaggtcagtcaggcggaccgacagcggttattaattcatcattatatggagtgattgaagaaggacttagaaataaggaaaagattggcactgtgtacggcatggtgcatggaattgagggatttctggcaggcaatttcattaatctttctgaagtggcagataatgagccgattgatagattaaagataacaccggcttcttttcttggaagctgcaggtatatgcttccagaagatttaggggataaggtgtatgataaattgtttgatacatttgcacagatgaacattggatatgtgttttatattggtggcaatgattcaatggatacagtgtcaaaattatcaagagtggcattattgaagaaatcggacataagatttataggtgtacctaagacaattgataatgatcttgtaatgacagatcatactccagggtatggttcaactgcaaaatatgttgcttcaacattaaaagaaattatacttgacgcaacatgttatgcacatccgtctgtgacaattgttgaacttatgggaaggcatgcaggctgggttacagcggcatcagtacttgctagaacagagtatagcagaaatccttatcttatatatatgccagagcatgcatttgatatggaagaattcaagaagtcacttaaggcggcacttgaacaggaaactgcagttgttgtgtgcgtatcagaaggaattgcggacaaagacggcagattcatatgtgaatatgcagatgcagcatcggttgatggttttggacataagatgcttacaggctgtggaaagtatcttgaaaattatgttaaagcagaattcggaatcaaatgcagaagtattgagcttaatcttccacagagatgttcatcacttcttgcttcagcaacagatattgatgaggccgaaaaagcaggaaaggcagcggttgtagcagctcttgacggtgaaactggaaaaatgattacgtttgtaagagatgatactaacggatatgagattaattacggacttgcagatgtgaacgatatatgcaataaggaaaagaagttcccagcagaatggataaccgcagatggaacagatatttctgatgagtatattaagtatgtaagaccacttattcagggaactaatattgcggagtattcagatggggtgccggttcatctgaagcctgcttattacagataacattaaatattaaataaaaataaaaatgacagcacgctattgacagcatgctgtcatttttgtaatatatcaaagctacttaagaattatattaaaagaatggcaggttcgtatgccgttttgttacgaagggagcagatatgcagcgagagtcactccattgtggagagcttataaagcgtcttaatgatattcttggaagatgttccaatgaggagttaagagcagatgacatgacatcttcacaggttaagatgcttatgataattaatgaaactaaagatgaatgtattacgcttaaggagcttgagaagcactttggtgtagcccaggcgacaatagcgggaacagcagcgaggcttgaaaagaagggaatgatagaaagcttctatgacccttcggataaaagagtcaagcatgtgagaataacagacaagggcagaaccatgtgcgttcatgcaggtaaggcaatgcatgacaaagaaaaatggtttctttcatcgctttctgctgacgaaaaagaagaattacaccgtctgttacaaaaagtatacgatgatgtgaataactgtgaaaggaagtgtaagaaatgttaaaaactttatcagcatatattggtgagtataaaaaagtctcgataaaaacgccaatatatataattgttgaagtgcttatggaaatacttattccgtttgttacggcaagtattatcgataagggtattcaggcgggagacatgagcaaggtgttgatgtacggtggacttatgcttgtgcttgcatttataagtctatttgctggaattcaggcaggaaaatattcggctttggcctctaccggctttgcatgtaatttaagagagggaatctattcgaatatccagaatttcgcattctctaatatagacaaatacagcacagcaggtcttattacccgtatgactactgatgttacaaatgtgcagaatgcatatcagatgattcttagaattgcggtaagagcaccacttatgatgatatgcagtatggttatgtgttttattatcaatcctacattaagttttatattcttaggtgcgcttattcttcttggatttgtacttttctttattatatataaggttactccaatatttacagaaggttttgctaaatatgatgatttaaatgcgagtgttcaggagaatgtcacaggaatcagagttgttaaagcatttgtaagagaagaccatgagaataagaaattcagtaaggctgccgggaatctttacaaaatatttgttaaggcggaatcatggcttgcattcaacaatcctattatgatgtttgttatatacggaagtattattgcactttcatggtttgcagcacattttattactgatggaactatgacaacgggtaacctgacatcaatgttttgctatgtaatgagcatgatgatgtcacttatgatgctttctatgatatttgttatggtttcgatgagtacagcgagtgcaagacgaattgctgaggttcttaatgagaaggctgatattactaatccggagaatccggttatggaagtacctgatggaagaattgatttcaaccatgtgaacttcacatacaagaaagacagcgacaaggatgcccttgaagacatagatatccatataaatgcgggcgaaacaatcggtattataggcggaacgggctgcggtaagtcaagcttcgttaatctgataagccgactgtacgatgttaaggatggttcggtatgcgtaggcggaattgatgtaagagactacgatcttgaaactcttcgtaatgaggtttcagttgttcttcagaaaaatgtgcttttctcaggaactattcttgataatttgagatggggcgatgaaaatgcgtctgaggaggattgcatagaagcctgccgtcaggcctgtgcagatgaattcattgagagaatgcctgataaatacaatacatggattgagcaggggggaagcaatgtttctggtggtcagagacagagactttgtatcgcaagagcactgcttaagcacccgaaggttcttattcttgatgattcaacaagtgctgttgatacagccacagacgctaagattaagaaagcatttgcaacaaagataccaggaactaccaagattatcgtatcacagagaatttcaagtattcaggacgcagacagaatattggtgcttgagaatggctgtgtgagtggttttgatactcatgaaaatcttgttgagaacaataaggtttaccgcgaaatctacgaggtccagacacagggcggcggtgattttgacgaggcaggagaataggaggcagcatatggataagaatattgataagaagaataagaagaataaagaaaatccacttcctcttatgaagaggctgcttggatatattttaaagaattacaagttttcgtgtatagcagtgcttgtgtgcattcttgtttcagcgcttacaacactgatagcaacgctgtttatccagaagcttattgacagttatattattccgctgacacagtcagcagtacatgattatgcaccacttgcaggcgcacttatcaagctcgctgcagttcttatggtcggtgtattatgttcatattgctacaacagaattatggtaaatgttggtcagggaactttaaagaagttgagattagagctgtttactaatatggaatcacttcctattaagtattttgatactcatgcacacggcgatatcatgtcagtatatactaacgatatcgacacattaagacagcttataagtcagagtatacctcaggttatcaattcatgcattacacttgtatctacatttgtaagtatgattgtgcttgatattccgcttacaatcgtatcggttgtgatggttgttattatgctttatgtaacttctaagctgagtgcactttccggaaaatatttcgttgagcagcagaaggatatcggtaaggttaacgcttatatcgaggaaatgatggaaggacagaaagttgtcaaggtgttctgccacgaggataaaagtattgagcagtttaaggagattaacaacacgcttcgtgagagtgccaataacgctaacaaggttgctaatatcacaatgcctgttaatggtaatataggtaatatcagctatgtattatgtgcaatagttggtggtattcttgctctgagtgatttttcaggacttactattggtacacttgttgctttcttaagtcttaacaagagctttacacagcctgtaacccagataagccagcaggtgagcagtatcgttatggcgatggctggtgccggaagagtatttgagttatgtgacgagaagccggaggttgacgaaggtttcgttgagcttgtaaatgtaagatacaacaagaataatgagcttattgagactaaagaaaatactgagatgtgggcttggaagaagcctgcaaaggatggtaacagtgcagagtacacaagacttgctggtgatgtaacatttgacggagttgactttggctataatccggacaaaatggtacttcacgatattaaaatgtatgctacaccgggacagaagattgcatttgtcggaagtaccggagcaggaaaaactacaattactaatcttatcaacaggttctatgatattcaggatggtaagatcagatatgatggaattaacatcaacaatattaagaaaaatgatttaagacgaagccttggtatcgttcttcaggatactaacctctttacgggtacaatcatggataatatcagatacggaaggcttgaggcgagtgatgaggaatgcattgcagcagcaagacttgccaatgctgatggattcatcaagagacttccggatggctataatactgtgcttcatggcggaggtgctaatttaagccagggacagagacagcttcttgcaattgcaagagcagctgtagcagacccacctgtacttattcttgatgaagctacttcatctattgatacaagaacagagcgacttgtccagaagggtatggatgcacttatgtcaggaagaacatcatttgttattgcccacagactttctacagtccgcaatgcagactgtattatggttatggagcagggaagaattatcgagcgtggaacacacgaccagctcatggaagagaagggcagatattatcagttgtatactggtaagagcatatcagcgtagagacagaaacaaaaaagcaggtggggaaaatcctacctgctttttattatgtaataagattattattatgcattaatattaagatgtcttggaagaccgtctaccatgattggtgaaagctcagcctggataagtggtctgatgtagtggatgaggtcgtctgttacgaagtcatcatctgtaatccactcaagaggaactttcttctcgatgttagcaatctggtgaacatcattagtctctgtgatgcacatatatggatcatcagaaactctcttaagaacaacaaccttacctgtctcgccttcaaatgcagccttaacagcagcaccaccaacgttgtatgcttctgtgatatctgtacggcttgtcatatgagctgcacaacgctgaagtgttgaaagctcgatagcacgagtcttgatgccaagttcagcaccaatcttgttagcaaggaatttagctgagccagcaagctgcttgtgaccaaatgcatctacgaattctacatgctctgaaagctcgaatacatatcttccgtcagcaaccttaataccttctgaaacagcgataaccattgaacggcccttagctgcaatttctttaactcttgccatgaaatggtcgatatcaaatactttctctggaaggtagataaggtctacaccttcgcagtcatcactctttgcaagagcagcagcggctgtaagccatccggcattacgtcccataatctctacaatagtaactgtaggataatcatatacaagaccatctctgatgatttccttcatagtagctgcgataaacttggcagcagaaccaaatcctggtgtgtggtctgtaacagctaagtcattatcaatagtcttaggtacacccatgaatttaatatcgcttccggtaacgattgcgtaatcagataacttcttgatagtatccattgagtcgttaccaccaatatagaagaaatatttgatatcaagatcatcaagaatcttgaaaattttatcaaatgtttctctgtcttcgcttatctcagggagcttgtacctgcatgaaccaagataagatgaaggtgttctctttaataaatcgatatccattgtagagttaatcttctctgaaaggtcaacatactgaccatcaagaagtcccttaataccgtggagcataccataaactttcttagctcctctgtctatggctgtcttatataccccagcaagacttgagttgataacagaagtaggtcctcctgactgtccaactataacattaccatccatattatattctcctccgaatcatatttctgcataaaaatgcaagtgattatgtgcatagtttagcacaatttctataatcatacaacttaaatgttgaatatattaataattatatttatgcaaatgtacaggcatttatgatataattctttctgggtatttttaatttcgtatacacaagtttgcgtgcctgtgtgggcaggcaggaatggagaactatatgtcagttaagattaattcttacaaaggaagaagcattagaccggtatacaaggcgagaattaagaaagatgaatatactaatgcgatagacaggatatgtaatagatataagttaggacacattaagcagaatgagtctggcagggaatataagaacaggatgaataagatgttttcagatgatgtgatacagagtatgaagaaatattcgcatcatggacgtacaagccttttcgggcacagcgtacatgtttcttattataattatcttgtgtgcaagaaattacatcttgatgagaaggcaggagctaaggcaggacttttacatgacctgtttctgtacgactggcacaagtattcgcctgggaagggtgagagacttcatggttttgagcatcctacaaaggcacttaagaatgcaggaaagtattttgatataacagaaaaagagggagacatgattgcaaagcatatgtttccattgacagttacaccaccaaaatataaagaaacatttgttattgtacttgtagataaattctgcagctttaatgaggtgctggatgatttcatacacaggaagttctgtggagcaaaggatacaagaattaaatggtttggtgcaggtaagggagagaaacgatgaaatatttaagtgaagagcagaataaatgttttgtgggaacaggagaacttaataaagctggtgatagtctggctgttttccttgacaaatacgaccctgataaatatcagaatccatgcaacactgtggatacgcttgtatttacaaaggaagattcacaggttaagaggattcttcttataaaaagagaaaatcatccatgtattggattgtgggcgtgtccgggaggctttgttgagtttaaagagaatctatatgatgcggctttaagagaacttcaggaggaaactggtctgcatgatattgaagcagaacagcttaaatcatatggcgattatgaccgtgacccaagaacaaggattattacaacagcatttgttgcattgatagatgaaggcagccagaaggctcaggctggtgatgatgcaagagaggccggatggtttgatatatcagatgaactggttaataagacagaggataagtcacttgttaaggaagaatggctgtgcaggctgtccaatgcagataagaatattaatatctgtgcaagagtggaagttacctatagaaaaggtatccttaagaaccgcacatataaggttgttgacggcgatgggctggcagcagatcatgcggctattatactggaaggataccatcatgttaaggaggcacttaacgcatgagtgagaagataaagaagaacgagaaagctaagaagcagacatggagggctggtaatatgctctatcctgtgcctgctgttatggtaagctgtgcaagaaaaggagagaagcctaatattattacggttgcatgggctggaactgtatgctctgatccggcgatggtttctatatctgtaagaaaagaacgctacagccatgacattattaaggaaacgggagaattcgttattaatcttacaacaagaaagcttgcgagagccactgattattgtggagtaaaatctggcagggacgttgacaaatttgcagatatgcatcttacatcagtaccctcagttaagattgaagctccggcaattgcagaaagccctgtcaatatcgaatgtaaggtaaagcaggtgttagagcttggaagccacgatatgtttatagcagaggttatggctgtaaatgtagatgaaagcctgttagacgagaagggaacactgcatttgtcagacgcagaccttatcgcatattcgcatggaagatattatggacttggtgatttcataggtaagttcggatattctgtgcagaagccgtctaagacaaaatcttccagaaagaaaaaatagggtttacaaaccaaatatcatatgttagtataaatgttacgaaattgttacaaagatattacaagaagatgactatatattaatacaatatttggaggacattatggaacgcttgtcaagatatggcagacgaatgagaataacactcattaagacaatgacggttgcctgttttgtatgtattattgctattccatttttatcaaagaagttattaaagacggaagctaattattacagtattacaattaacggaatcaaggttggagcagctaatacggaagaagaggttattgttgcgctggcatcagcaaggcaggaacttagtgcacagtatgaagaaattgtgtacatggatcctgatatagagattgccaaagagaataaagcagttgcacagagaatgagtgtggacgagttgtctggtgcaatatatagttacatgtttgataatgttatggatgttgatttccatatgaattatacagtaagacttggtgatttcgttgtaacattggaatcaaaggatgcagttgtttctttatttgagaagcttattgccaaatatgatcccaataatgcttttacagtatcacttgatacggttgatgcagcgacaggtacttatggaataagtgtgaatgaaaaggctacggaaactacagcagcagagattgtatcctcagcaattagtggtacagcgatttcacaggacggagagacagtggttaatggagatggtcttactggaattggatttgatgttgacgtagttgttgtggaagttcctacggataatgcaactgtaacatcagtaaatgacgcttatgagagcattactaaagaacacgaagaaaagacagtatatacagttgaagctggtgatacattatcggttattgcacagaataatggacttacaatgtcacagcttcttgagcttaattctaatcttacagaggacagtgtaattgcaccgggggattcaattgttgttacagttcctaaatcagagatatctgttcttacaacttatcagatgacttatgaagaagattatgaagcagagcctgattatgaggatgacaacactaattacagaggaactaatacagttatttctgaaggaaccgttggtcacagatctgttatagcagaagttacctacactaatggtaacgaaacaggcagaacatatgttaaggagactattattaaagaatccgttccgaagactattgcagtcggaacgctaacacctccaacatatttaagaccgatatcaggaggaaccttatcatccgaatttggttacagatggggaagtttccacaagggtgttgactggtatgttacgcagggtacaacagttacagccgccgctgcaggaacggttaccagagccggatggtatggcgattacggatattgtgttgatattacacatagtaatggcactatgacaagatatggtcacttaagttcagtgaaagtaagcgttggtcagagtgtttctcagggacaggctattgcagcatcaggtaatacaggctatagtacaggcccacatcttcattttgaaatatgggttggaggaactgtagtgaatccgctcaattacgttaataagaattaataagtattgaataggctgccctgttaaggacagcctttattatgtaaataaatgtattttaaatgcatataataaaataagggtgaaattgccatatttttataaatgtattttcagggaaaatctttacaaatcgaagttctgtgatatactttataagatgtgactattatgtttagaggtgctatatggaacaatatgttgtcaagggtggagtgccactcagaggaaaagtttccattggtggtgcgaagaatgcagctttaggtattcttgcagcagcaattatgacagatgatactgtaacaattgaaaatgtacctaatgttagagacacaagagttttacttcaggctatagaaggaattggtgctaaggttaagtatgtttataacaattccgttcagataaatggtggttcaatctgtgataccaatgtagaatatgattatataagaaaaataagagcatcttactatctgttaggtgctttacttggtaagtacaatgaggctcatgttgcactcccaggaggatgcaatatcggaagccgtccaattgaccagcatatcaagggctttaaggcacttggtgcggatgttgatatagattgtggagttgtacatgcaaaggcagagaagcttacaggagctcatgtttattttgatgttgtaacagttggtgcaacaattaaccttatgatggcttcatgtatggcagagggagacactattctggaaaatgcggctaaggaaccgcatatagttgatgtagcgaatttccttaattctatgggtgctaacattaaaggtgcaggaactgatgtaatccgtatcaaaggcgttaagagacttcacggatgtacttattctattattccggatcagatcgaggctggaacatttatgatggcagcagcagctacacatggtgatgttgttattcaggatattattcctaagcatatggaatcaatatctgcaaagttaattgagatgggatgcaggattgaggaaggtgatgacagcttaagagttatagcagagggctgtacacttaggagtactaatgttaagactttgccatatcctggatttccaacggatatgcagccacagatttcagttgtacttgcacttgctgaaggttcaagtatggtaactgagagcatatttgagaacagattcaaatatgtagatgagcttggaagaatgggtgccaagattaaggttgagggtaacacagcctatattgaaggtgttaaaagtttttgtggtgtgcagcttaatgctccggatttaagagctggtgcggcacttgttattgctgcgctcgcagcagatggaatatcagagattgatgatattgagtatatccagagaggttatgaggattttgaaggaaagattactaaccttggtggaattattaaaagagttgattcagagagagaacttcagaagttcaggctcaagataggttaattgcaggctgtagcggatattccgttacagctgttttaatttatatttaataaaattaatacatttgtaatgttgcaaatatccctgtatatggtagtattgagaggaaaaggggttaattatgaagctaaagaataagttgtatatttctttctgtattatggttatacttcctgtgctactgagtggtcttgctctgggaggtctgtattgtgtacagaaggaaagcattgagagaacatataatgtagatgatggggcaattctcgttggcgtatattcacctataatactttttggaaagattactgacagcatatataaggatatgaagacggaggttgatacttcgccggagcagtttactaataaggaatatcttgatgaattatcaggagagctgtcatataagatgtcctgtcttgttgtaagaaggaatgaaattattatatataattcaacagaagcaccagacagcgaaattgtaaagattcttcctgattattctgctgatgaagagaatgtttctgatgttggaacttacaagggtggagagtaccagagtcttataaaacagcttaattttaaggattcagaagataatttttacagcgtgtcaattgttacttcattgaaacagattcttccacaggttaagacatttataatgcaggttatatttgttataattatggtgttaattattacaagtcttggacttactctgtggatatatagttctattgttaagccacttaataagctgaagcttgcaactgataatattaaagaaggcaatatggatttcgagatgccaaaggtatctaataatgaaatcggagatgtatgccgggattttgaggagatgagagtcgtacttaagcagagtgcggaggataagattaagtctgatgccgaggaaaaggagcttattagaaatatttcacatgacttaaagacaccgcttacggctattaaaggatatgtggaaggattgcgtgacggaattgccaacacgcctgaaaagcaggctaagtatatccagactattgctaacaaggttaatgatatggacaagctgattgatgagcttactatatattcaaggcttgatactaacagggttccatatacatttgtcagatgtaatgtaagtgactattttggagactgttgtgaagagataggcactgagcttgaggcaagccagattgaactggaatataatgaccatcttactgagccggcatatatgaatgttgatccggagcagctaaagagggttgttaataatattataagtaactcggttaagtatatggctgagggacgacagggaaagattaagattgacctgtacgatgaaggcgactacattcatgcaatattctcagataacggtattggcattgcagctaaagatgttgagagaatatttgagcgtttctatagaactgatgaatcaagaaacagcaagcatggtggaagtggtataggccttgcaattgttaagaagattgttgaggaccacaaaggaaagatatgggcagagagtgtagagggcgaaggcacgaccatgcatcttaatctgcttaaagcaaaggatgaagagaatcctgagaatgcataatgaaactacacgaaaggggactggctatgagcaagatattaattgtagaagatgaagagagtattgcagatattgagaaggattaccttgaacttaacggatatgaggttgaggtatgtaatgatggaacaagtggccttgcggctgcactgcatgaggatattgatatgtgtatccttgatattatgcttcccggaactgatggtttcgagatatgcaagcaggtaagagaagttaaggatattcctattatcatggtatctgccaagaaggaagatattgataagataagaggacttggagttggtgcggatgattacatgactaagccgttcagccctagtgaacttgttgcaagagtaaaggcacatcttgcaagatatgacagacttgtaagtaattctaagaacaataacaatattattgaaatcagaggaatcaagattgataagacagcaagaagagtatttgttaatggtgaggagaagccttttacaacgaaggaattcgaccttcttacgttccttgcagagaatcctaaccatgtcttcactaaggaagaacttttcaaggaaatctgggatatggattcaatcggtgacatcgcaactgtaactgtccacatcaagaaaatcagagagaagattgagcttgatacaagcaagcctcagtatattgagactatatggggtgtgggataccgctttaaaatgtaaaagattaaacttatagactatgtcatattacatgctgattttgaaaacatactaattgaccaatgatatgtagattagtgggtgtttattgcatgtaaacaaattgaagttatgacaaagacctacgaaaagatgttgatagattctttttgtaggtcttttttcttgtttcaagtagctatttcagtggtttatgcgctaattaacctacgaaattataataagaaaagtgtttcatgggtttttagcaaggcgtgagtgttagaatgacacgcaggaaacctactaggtatgcacagaaagcttgttgtgtaggttattggacgcaggctgtaaatggttggactttatcagcaaaatattggacggtacgtccacgaattacgaataaaagtccaaaagtaaaaaatacaacgtgtcacccaatcgaaaactcaggcgcaacactgtaagttttattatcgacagtaagtgaaacagcacacagtgcaatctggtttcttttaagtgccactgctttaacggcgttatccatgccgcaatcagcagtggcatatttataatctccaacaagcgggttcctgcggcttgcaaactgtactcttatctggtgatgtctgccggtaatcagatgtattcttacatgtgtaatgtctttaacttcatcataagatatcacttcatattcaagctttgaaagctttgcttctttatcattagcagcggcgtctgccggaactatggctgatgtgttcgttcttccatctttctttaaataatcaacaaaagttccttttggttcggatggttttccacatattaaagcttcatattgtttattaaatccgccctccttctgcattagtgtggaatactttgctgctgcagacttattctttgcaataagcacaagtcctgaaaccggtctgtcaaggcggttgattattgctgcatatgcagactttccctgtgaagcgttgtaagtcataacttcgcttacaaggtctaaatcaaatcctttcgcaccctgggatagctgtccggctggtttattcactataataatgtctttagtttcgtgtattatattaagcatggttgtgtccttttaatgtttttattaagaatacatgcgttttaataattaatcaacaacattcggcgaataaatgtcctagccatgcacacactaattaaacgataagtattagcaggtgcgaggtggcatatgggtgaaaatgtgtgggatttcaggaagcggctgacgcttcttttggcgagtgccgttattattgcggtggttttttttatatttaaagtacttttctattatgtgtggcctttcttgattgcattttgttttgcggtgctgcttcagaagccgatagtggggctggcgaaacttttaagggagaaaaagacgcttgctgcgagtatagttgtaacaatggtaacgcttattattctttcagtgctgttgtatgtcggttatatggcgtttcgcgaacttaaagatttcatagccaattttgatgagaatattaacagccttgatgggcagtttaagcttgtatgctgccgtattgatggctggattaagttgaaagaaggctgcagttacgcattttttgaaaaatgtaaagggataattatagatggagacggacagcagatgttctttacaattatgagaaaacattctgttccggttataacatggtgcgttatggcggttgccggacttgtggtgtgctttattggaacgatatatgcggcggctggaattgagaagtacagaagctggcgggagaacactatatttaaggacgaagtcggggcggtgcatgtggggcttcgcaatttgataaatgtatatttcagggtgcagcttattataatgtcgataaatattgtggtgtgttcaacagcatttttaatgataggcaatccatatgcgattcttcttggtgtgctgactgggattattgacgcacttccgatatttggtacgggaacggtactgataccatgggctgtgggaagcctgcttttcggacatgtgaaaaatgcggtgattcttgtggtgttgtatattgtcacatattttgtgagggagattatggagtcaaaatgtatgggtgacagaatgggaattgcgccatttacaatgcttgcggttatatatatcgggatacttgtgtatggggttgtcggatttattcttggaccaatatcatattgtataataaaagcacttgttctttacttgaaaagcattttagaacatgataaactctagtggtgccgtcaatggcaggcggacaatgcgaagcagcattcgcatcaggctccgtatgaaacgggtctgtaatgtcatagaaagaggtttattatggcagaagataagaaattagtagaagcgattacatccatgaaagaggatttcgctcagtggtacacagatgtgtgtaagaaggcagagcttatgtcttactcaagcgtcaagggatgcatgatttttaagccggctggatatgcaatctgggagaatattaagaatgagatggacagaagattcaaggaaacaggtgttgagaatgtttatcttccaatgttcattccagagagccttcttgaggttgagaaggatcatgtagaaggatttgcaccagaagttgcatgggtaacttatggcggacttaatccacttcaggaaagaatgtgcgtaagacctacatcagagacacttttctgtgatttctataaagatgagatacagtcatacagagatttaccaaaggtatataaccagtggtgttcagttgtaagatgggagaaggagacaagacctttccttcgttcaagagagttcttatggcaggaaggtcatacagcacatgctacagcagaagaggctgaggcacgtacacagcagatgcttaacctttacgctgacttctgtgaggaagttcttgcaattcctgtaattaagggacgtaagactgataaggagaagttcgcaggagcagaggctacttatactatagaggcccttatgcatgatggtaaggctctccagtcaggtacaagccacaactttggtgatggatttgccaaagcatttggtatccagtacacagacaaggataataagttaaaatatgttcaccagacttcatggggaacaacaacaagacttattggtgctgttattatgactcacggtgatgattcaggacttgtgcttccacctaaggtagcacctgttcaggttgatgttattcctattatgcagaagaaggcaggcgttcttgacaaggcttatgaagttggacaggctcttaaggcagcagggcttcgtgttaaggttgatgattcagataagaatcctggctggaagttctctgagcaggagatgcgtggtatccctgtaagagttgagatgggaccaagagatatcgaggctaatcaggctgttattgttcgtcgtgatacaagagagaagattactgtatctatcgatgagcttgcagacagaattccagaaattcttgatactatccagaaggatatgcttgagagagcaagagctcacagagaagctcatacatatacagctcttaattatgatgaattcaaggatacagcagctaataaggctggattcatcaaggctatgtggtgtggagaccaggcttgtgaggacaagattaaggaagatactacatgtacatcaagatgtatgccatttgcacaggagaagttaagtgatgtgtgcgtatgctgtggtaagccggctaaggctatggtttactggggtaaggcatattaattctaagaagtgttaattaaaataaccctcatcggatttgccagaaggcagccggtgagggttattttatgattatattatttgatatgttcaatcattgcaataagagtagctttatcattgagcttagggttctctataacgatatcaagcagggatttcagtgtttcaccgatttcgtgtccctgaaggccatattcaataaggtcatttcctgatatgtcgagggcttttattgtaaaacagtcaccgcgtgcaagaatatctgttccaagacgctttaatgtgagaagatgctttaccttcgccggattacttattcctgtgatgtcttcagatgcctggattacagccatcataagctcatgccacagaggcaggaaatctctgccatacttattaagggcagtacgaacagccggttcagtttcttctatatccatctttgataattcaacaagctttgatactgtgttaactgtcttgttatccagcttaagtgcacggagagtcttagcggcttcatcaggtgtagaagttatgaaaagtgcagcgtagcgtaagtatatattatcaggtgtgtgttgtaatgttgcaagtattttgcgcttgtagcggctctttagagcattgtcaattaccgggagtattggggcaaaaagtcctgcttctgaatattgcgcaacataatcgggatgtgcagacataagcgttttgccaagctctacatgcacacgctccatacttattttgctgattgaaggggaaagctttttgattgcattccatgttgcttcatcaatggtaaagccaagctgtgcagaaaatcttatggcacgcatcattcgcagagcgtcctctgtaaatcttaattctggttcaccaacgcagcgtattatttttgcatccaaatcatcaagaccgttaaattcatcaacaaatccatcagtgtcgttgtatgccatggcatttatcgtaaaatcacggcggcataggtcatcaacaagcctgtctgaaaattctacagacttcggatgcctgccatcctcgtattcgccatcaattctgtaggttgtaacttcgtatccggttttatctatcattatagtgacggttccgtgggcgattccagtatcaacagttcttttaaagaaagtttttatctgtgatggaacagcagaagtggttatatcccagtcatctgggtttcgtccaaggatactgtctcttatgcatccgccaacggcatatgctttgaagccgtgttcttcaattgtatgtataatgttcctgacagcttccggcatgtcaatatgaaagttttcaggcatgatttccccctataataatatttattataaatgtgaaaaaagctcacatctatctattataagaaaaaattacattttcatcaagattatgattttcttaattcgtcgtatcattaaatccaaggaatatagcagccataaatgtcataagataaggcagacgcagacgtatgagcaaagggcgtctgtattaagtgcggaaatgggggattatatgaacgataaatcattggaatgtattagattttatgatattcaggttaataaaatggtaaaaggtcgtggaggagtaattctttttacagacagaggatgcagactttttctcgagtgttcaagaaatgatgggttttatctgagagatgaggcagtgacaaaagcagttagtgatgcaggctttgaaaatgtggatacatatgtgagaaatcaggatggagaactttttactgttggagatgatgggcacagatatgtaatgaagaactggtttggaggcagggaatgtgatgtcaagtctgtgaatgacgtgatggaggcggtaaggactctggcaagacttcatatttgtctaaatgttgtttcgtctaatggtgtaagatatttaaggaataatgtaaatacaaatattacaaagcaatgggaatgtatggcgcttgcagagaccgcagatgagcagcccgagtcagaattaaaggccagtgaaagcatcgtacataatgctgtacattttgacaggggagcagggttacgcaccaatatggaaagacatacaaaagaaattaaaaaggcagctaattatatgcgtggcaagaaaaagaaaaatgaatttgaacagattgcgcttggtgcggttgatacatttttcagggaagcggatgaagcgagcaggaatattaattcaaaacgttttgatgagcgctttgacaggatggaacagactaatgagcttgtgcatggaagctataattatcataatgtgtttcttgatgttggtaatggcggcaatgcagtgactaattttgaaaaatgtcataatgactgtcaggttgcagatctttaccagtttttaagaaaggttatggaaaagcatgactggaatattaatgtggcatacagactggttgatgaatacgacagattaaagccgcttgaagatgatgatattgacatgcttgtgacattattgagctttccagaaaaattctggaagatcataaatcagtactataacgcaggaaaggcgtgggttcctgctaagaatatagataaattaaagattgttattgaacagaatatgcgcagaagagaattaattgataaaatgtgtggtatgtgataaaatctgatgatacaagggtaaaagtatttgcgaggaatgcttatgaaaagaataattgcagtgtgtatgcttatggtgttaattgtaagtcagacagcatgcacattttccagaaataatgacagggcggtgataccaggaagcagtattacccccgcaccaggtgccgcaaaggagattaagggtgatggagagaatcctacacttacaggagttcttacattgagagatgctgacacgggtagaatgcggtttgtagatataaagacaggaacagaatatgaagtcccttatacaggcagtacagatattcaggatgcttacggaaagataaaagcagcttctaccatggatatgggtggaatatatgatgtatatgtggataagaagggcaaggcggtgaagatacacggaaacagtgatgcctgggtaagatatgatgtttcaggaataaccgtagatgagaattcaaggaagttaagcattggggcttccaatatgatatatgaaagttacacagttgtgctttcaggagaagaacgtataagtattgcacagctcgttgaccaggataagctggttatcaggggcgttggagagaaagtatattcggtgaatgtaactgcaggacacggatatcttaaacttacaggtgtagatgcacttgttggtggttatgtaagcataggtaataaacaattactgggtgttacaaaggatatgctggtgactgcacctgttggaacacatacggttaatgtacgtaatggcaacctgtcagcaagtaagacagtgactatagctaaagatgagactacatcagttgatttttctgaagtacaaagtgatccggttaagatgggggctgttaatttttcagttactccgaagggcgcggttatgagcattgatggtgttgaggttgattattctactccagtgtcactttcttatggaactcacagagttaagctggtagccaaccactatcaggagtattctgagattataaatgttaattcagcctatgttacgaagattatcgatatgacttcatcaggtacatcgacaagtacagcggcagataatacaagtggatataaggtatcagtaacggcacctaagggagcggttctttatgttaatagtgaatacataggaactgttccatgttcatttgacaaatcatctggaaagaagacgattacactttcgcagaatggatataatacagttagttatacaatatcaattgctaatacagcaggagacctgacatatgcatttccagaaatgataagtggaggtactcaggagactacaacacaggtacaggttccaacagtcactcctgcaacaacaaagtcatctacaaagtagagtacgaaaaggagataagagttatgaatattttattttcaccaccagatataaccgaggaagagattcaggcagtttctgaggctttaaggtcaggatggattacaacaggtccaagaactaaagagtttgaaagaaatattgctcagtttgtaggctgtaacagggcggcatgtctcaattcagctacagcatgtttagagacagcactccgtctgttaggaatcggtgagggcgatgaggttattgttcctgcatacacttatacagcatctgcaagtgtcgttgcgcatgttaatgcaaagcttgttcttattgatgttgaaaaggacacatatcaccttgattatgaagcgcttgaagctgcaattaatgagagtaccaaggctgtaatacctgtagatataggtggtgttatggttgactatgacaggataagaaagattgtcgagagtaaaaagaatatatttaaggcttcaacaccgcttcaggaggcacttggcagagttgcaattgttgctgattctgcacatggtttcggagcaagtgagggtggtgttatgagtggaatgaaggctgactttacaagcttttcatttcatgcagtcaagaaccttacaacagcagaaggcggagctcttacatggagaagtattccgggagttgatgatgaggatatctataagcagataatgctttactcacttcacggacagtctaaggatgcacttgcaaagactaagcttggtgcatgggaatatgatatcaagggaacttattacaaatgcaatatgactgatattatggcttctattgggcttgtacagcttaagagatatccgggacttcttaagagaagaagagatataattgagagatatacacaagggattgcagccgatgatgtggatattatgaagcattttacagatgaatatacttcaagtggtcatctgtatcttgtaaggcttcttggaaaggatgttaaggagcgtaatgaactgattacaagacttgctgaggcaggtgttgcaactaatgtacattttaagccgcttccaatgcatacggcatataagaacatgggatttgatattaaggattttccacattcatataatatgtatcgtaatgagattacactgccgcttcatacatgtcttactgatgaacaggtagaatatgtaatagagcagtttaacagaatgaaataatcggacattagttatacaacaacaaaaaggggattgattacgatggagttaagaccatggcagcttcttcctgatgaaatgagaactaaggaagtaagaaaatactataatatacttatgaaacacagaatgtggttagagatgaaaagagtgcttgatgttattgttgctggtattatgctggcagttttaattattccaatgggaataattgcacttgcaatcagacttgattcaccgggacctgtttttttcaggcaggcgagagtaacacagtatggaagaatttttcgtatatacaagttcaggactatggttgacaatgcaagtaagctaggggcagcagtgactgtagataatgattcaagaattactaaggttggtgcatttttacgaaagtacagaatggacgagtttcctcagctttttaatatacttgcaggggatatgactcttgtcggaacaagaccggaagttcctaagtatgttaagaagtatactaaggagatgtatgcgacacttcttttgccggcaggacttacatcaaggacaagtattgcttataaggatgaggacaagcttcttggtgaggctgttgatgaaaaaagtacagataatatatatctgaatgaagtattaccggcaaaaatgcgttataaccttgaaagtatgaaacattttggcgtgaaggctgatgcggctgtattgtgggatacatttacatcagtagttggaagtgaaagaatgactgttaagaagtaggtagagtatgtttattacaattgccgttattgcatataatgaggagaatacgataaagaatattcttgatgacataagcaggcaggattatgatcataatcttatggaagttgtgcttgttgattctgcatcaactgatggaacgaaggcggttatgcagaagtttgctgatgagaataagatgggagcaagacagatagttgtgcttgataatcctaagaagacacttccgtgtggatggaatgtgctgctcgataattatacaggggaagctgttataagagttgatgcgcatgcacatatcccggtggattttgtcagcaagaatgttaaagttttagaagaaggcgagatggttgtcggtggtgtccgacctaatatagttgatgaagagacaccatggaaggatacacttcttcttgccgagagttctatgtttggttcaagcatagcaccttaccgtaatggcgggaatggaacggaagaaaagatatatatgaaatcgctgttccatgctgcatatagaagggaagtttttgaagaaatcggacattataatgagtctcttgcaagaactgaggataatgaaattcattaccgtatgagaaaagcagggtttaaattaagattctgtccggatataatatcataccagcatacaagaagttcacttcctaagatgcttaagcagaaatatggcaatggatactggattggaaagacaagcaaggtatgtccaggatgcctttctatatatcattttgttccgtgggcttttgtcatggctattattgttacaacagttgcaagtgtgtcatgtaagctgcttgctgtgaagtcgtttttttctcgtattgtatacggacttacaggacttatgtggggatcatactggctgttggcggtggttatgtcggtagttgcagtaataggagctaagaaggaacgcaataaaacatgttttgcactgccatttttatttttcctgttgcatatttcttatggaattggtacagtatgtgggttagctgctaaaaagcctgctaaagaaacgaggaacagatgatgggtgagactaaaaaggatagaatacagcttctggtaagaagatttttcttgtttttaacagatacatttttactgaatgcatgcgtatatctgtcgcttattatgagatttgatgtaggtattgtatctatagaacctcagtatattagtaattatgtagagaacatgcttccgtacacgataatgtctctgcttatattctggctgttcagactttatcacagtctgtggcagtatgcgagtatagctgaggtgtacagaattgctgaagcgtgtattattgtagaagtagtgcatttcttaagtaataagattgcgggtaatatgcttcctagaagctgttattttaatgcggcaatataccttattattgcaatatgtgcaagtcgttttatgtacagaatgataagaactgttcttaacaaatacagaaatattaagacttccaacaatgtaatgattattggtgccggagaggcaactaatgtcattatgagagaaatacagaattcgagctatcttgcaaactctaatattgcatgtattattgatgatgaccgccgcaaggttggtaaatacatacgaggcgtcaaggttataggaacaagggacaagattaaggaagcagcaaagctttatgatattgatgagattatatttgcaattccatcagcatctaatgaagttaaaagggatatattaaacatttgtaaagagactgattgtactcttaagattctgccaggtgtatatcagatggtagatggagagattaatgttaactctatccgtaatgttgatgtgcttgaccttcttggaagagacccgattgaagtagatattgaatctatcatgggttatgttaaggataaggtcattatggtaacaggtggtggcggttctattggttcagagctgtgccgccagcttgtaagtcacaagcctaagcagctcattatatttgatatatatgagaataatgcctatgatattcagcaggaattaaagattaattatcctgatgccaatgttgttactcttattggttcgataagaaatgtttcaagacttgaaagcgtatttgcacagtataagccagatattgtatatcatgcagcagcacataagcatgtaccgcttatggaagtcagtcctgatgaggctgttaagaataatgttgtcggtacatggaatgttgcaaggatggctgataagtatggggttaagaagtttgttatgataagtacagataaggctgttaatccaactaatgtaatgggagcaacaaagcgtatctgtgagatgattgttcagacgtataacgagatatccaagacagatttcgttgctgtaagattcggtaatgtacttggaagtaacggctcagtcattcctctttttaagagacagattgaggctggtggaccagttacggttacagatcctaatattataagatatttcatgactatacccgaggcggtttcacttgttcttcaggcaggtgcatatgccaaaggtggagagatattcattcttgatatgggtgagcctgttaagattgatgacctcgcaaagaaccttatcagactgtcaggttacacacttggcgtcaacatggaaattaaatacacaggactccgtcctggcgaaaagctctacgaagagcttcttatgaaagaagaaggtcttcaggagacagataacaagcttatccacattggaaaaccaattgagtttgataaagagaatttctttgataaccttgagaagcttaaggaagaagcttattcagaaactggtaatataagagaatcactgaagaaggtggttgatacttatcatccgaatgaacattaatagagaagacctactaacatgctttttataaggatgttggtaggtcttttttatagaaaattgttggaatttattagctgggagatgagatggtgggaaaaagacctactatatagtatatattactaagattagtgtgcttttcaagttgctagttgatttttggggagcgaaaaacatctactcaattaacaactttggttaattgagtaggtgttgtgtgaaagaattgaaccattaaagcttcattgactataaaagatattcattaatattaatatcaatggtattggaattgagaggaatagaagaagattcgaaggtggcaataaagttcctgcctaatacataaccggatttagcgtaatcgttaatcttctttaatgttttgttcatataatcagaatctcccataatgccgaagtgttcccatatgaattcctgacgggtattaatattgaggcaggtaaaatcaggatggacggttaccctggtagaaagcacaagcggatattcatacttatatggaatattgtgctgttttagtttgttggcgattattaattcggatttagaacgcacctgttctccgttatcagagtagaagtcaggagtatcatcaggaatgtcaagagaattatattgaacattattccagagattcaatgtatcttcggcaggtgtatagactggtgtaataagttcctgtcttatctcattaagagaattgtataaatgttcaatctgttcaggagaatagttcttaagaaaagtttcaatagcatgaagttcatgttggatttcatgcttgactttcagatcatattccttctgagccagactcttcgcaagattaagattagatttcttttttatgtatgttcctgttctgtcagtagaatctgttctgtgataatattgatgggcgttgccacgcttagcaatgcggagtgttccgtcaggggcattacttagtcttgaattgatagtgttgagaagcaaaataagttcggattgacgattggaaacagcactgatagttaaatcaggtgataaaagcattgcatttaatattctgttatttgctatatggttcatatatcaacctccttatgtaattatattaatactatacaatataactatgataaacacaatatcaaaaatatatataaatggtgaaatgataagaaaaaattttgctaggataggggatgcctacgaaacaaggtaaagtctgacgaatagtgggtgaaataaaacaggaagaaagttgttggaagagagaaagcctacgaaattatgccaagctgtgttatcagtaggtttttcgacagcagattcttaaccaggacaggaaaataaagaagaaaagacctacaaaaaagtaaaaaatatgtagattagtaggtgaatgctatatgaagagtcagaaaaagagatgaaaaagcatactaattaaataaaaaagaggagattagtaggtctttcggcatagtagtgcgaaaaaccagctaatctcctctggaaaccggccaatttcctttagaaaacagctaatctcccctgaaaaccggataaaagtattcataaacgggtaaaaatatccagaatcagataaataccttgaaagtaagacaaatacactaaaagcaagataaaatctagaaatataatatctcgaaattagtcaaacttaaatgtgttctcaagtgtatcccaaagctggtccttatcacttaagttaagctttgttccatcgcttaaagcgtagccttcacctgaagctgagccgttgtaagtacctgtaagctctggccattcaataccgattgccgggtcattccatgcgagaccaccctcgtcgttaggatgatagaagtcatcgcacttgtagcagaattctgctgtatcagtaagaacgaggaatccatgtgcaaatcctttagggataaggaactgcttcttattctcttctgtgagaaggattccgtaccactttccataagtttcagagtctgtacgaaggtcaacagctacatcaaaaacggctccctttatagctctaacaagctttgtctgtgggaaatgcttctggaagtgaagaccacgaagaacacccttagtactcatagactggttgtcctgaacaaagttaatattgataccagcttcttccatatcacgctggctgtatgtttccataaaatatccacggttatcgccgtgaacagcaggagtgatgacacaaagtccttcgatacctgcgacattcttttcaattgtaatctgtcccatgataaaatctcctttgaaatattaaatctcaccgatttcctttaagaatctgtgaagagcatcctgccatgttggaagcggagcgaatccgttagcagtaagtttgctcttatctaaacggctgttaaaaggtcttgcagctttagaaatgccgtattcagcagtagttacaggtgtaaccttagtagaaagacctgcctgtgcatagatttccttagtaaagtcataccatgaaatgtatccaccttcattagttgcatggtaataaccgtatttgtcagtttcaaccatatcaacaagaagtcttgcaagatctaatgtgtaagttggtgtaccaatctggtcgttgacaacacgaacctcgtcatgagtctttccaacattaagcatagtcttaataaagttctttccattaacaccaaatacccatgcaatacgcacgataaagtatttgtcaagagtgttagaaacagcaagttctccggcaagcttagtctctccatatacattaagaggcttgtagtccttgcagtctggttcccaaggtgtttcaccctgaccatcaaatacataatcagtactgatgtataccatcttgcagtcaagctgtttgcagacattggcaatattctgagtaccatctgcattgatagccttaaccttggctttcttatcatcatcttcagcagcgtcaacggctgtccatgctgcgcagtgaattacaacatcaggtgaaaccttagtgataacttcagaaacctgggcagcatcagttatatccataggtacatattcggctgttgtgacagcgcttccatcagcaactcctgaatattcaggtgcgatgtcgctgccaacgcctgtatgacctctgcctatcagttcattcataacgtcgtggccaagctgaccaccaacgccggtaactaatatcttcatgtcaaatctccttacagaataaatgtgttaattagcggttgctatacattttctcatagtagttctgatattcgccagaaatgattgtctcccaccattccttattatcaagataccactgaattgtcttcttgataccatcttcaaacttagtttctggaagccatcctaattcattgtgaatcttagttgggtcgatagcgtaacgcatatcatgtccctttctgtcacctacatgaacgataagtgattcaggcttgccaagctccttgcagataagcttaacgatatcaatatttctcttctcgttgtgtccaccaacgttgtatacttcaccaacacgtcccttgtggatgataaggtcgatagccttgcagtgatcctcaacatagagccagtcacgaacgttaagaccttcgccataaactggaagtggcttatcgttaagagcattagcaatcataagagggataagcttctctgggaaatggtatggtccatagttattagagcatcttgaaatagtaacaggaagtccataagttctgtggtaagcaagaacaagtaagtctgcgccagcctttgatgagctgtatgggcttgatgtatggattggtgtctcttctgtgaagaaaaggtcaggtctgtcaagtggaagatcgccgtatacttcatcagtagatacctgatggtatctctgaataccgtactttctgcaggcatccataagaacctgtgtaccaagaatattagttgtaaggaaaacttccgggttctcgatagaacggtcaacgtgtgattcagcagcgaagtttacaaccatatctggatgctcttcttcgaaaagcttgtaaacagcttcgcggtctgtgatgctttccttaacgaatctgaagttagggttagacataacaggctcaagagttgaaagattacctgcatatgtgaggcagtcaagacagatgattctgtagtctgggtatttgtttaacatgtgaaatataaagttacttccgataaatccggctccaccggtaacaataattgtcataattaatctccttaatatttaaagtgtgttcttatatgaaaaatgttttaactaaatgtacttaattattcatgaagcttgtcgacatatttgccgtctaagacatcctttaagtactgaccatactggttcttctttaatacttcatataccttgaggacgtcatctttgttaatccagccgtttaagtaagcaatttcttcaagacatgcaatctttctgtgctgatgagtctcaacagtcttaacaaagttagtagcttctacaaggctttcatgtgttcctgtatcaagccatgtaaatccctgaccgagaagctctacatttaaagtacccttctctaagtagatacggttaagatcagtaatctcaagctcgcctcttgcagatggctttaagttcttagcgtattcaacaaccttgttgtcgtagaagtaaagacctgttacacagtagttgctcttaggctgcgctggcttttcttcgatagagacagcctttccttcattattaaattcaacaataccaaatctttcaggatcatcaacatagtagccaaatactgttgccccctttcctgattcagcattctcaacagctgccttaagtctcttcttaagaccgtgacctgcaaatatattatcaccaagaaccatggcaacagtgtcattgccaatgaattcctcaccgataataaatgcctgtgcaagtccgtccgggcttggctgtacagcgtaagtaaggttaacaccaaactggcttccatcctttaaaagctctttgaatcttggagtatcctgtggcgtagagatgataagaatatctctgattccagcactcataagaactgagagtggataataaatcattggcttatcatagattggaagaagctgtttactagttaccattgtgagtgggtaaaggcgtgtgccagaaccaccagctaaaataatacccttcataattgaagttcctccttgtttgttaaaatgttatgttaattttcaagtagacattttttaagtcaggtatataataaaagatgacgtaacgtcaccttcaagtgttttttgaaaaatttttacaaggagtaatatatgcataaagacgggtattattcttcaggcgaatttgcgaagaaatcaaatgtttcagtaaggactataagatattatgaccagcagaacatattaaagccttcacttcttactgatgagggagtgagattttatacggattcagattttacaaggttacagcagatattattgcttaaatatcttggatttacactggacgatataagaaatatgacaattggtgattcagattatcatgtacttaagaattcacttgaacttcaaaagcgaatgattcaggacaagattgcacagatgcagcttgtatgtaaagctattgaggaaacagaagactctattaaagagggaaaaggagttgactggagtaatatgctggagattatccatcttactaatatggaagacagcatgaagaatcagtacattaatgctggaaatatatctgcaagaattaatcttcataacaggttttcagttaataaacagggatggtttccttgggtatatgagcagtgtggtattgttaaggggatgagaattcttgagattgggtgtggtgatggaacattgtgggttgacaatataggtcagcttgccatgacaggaaagagaaatgaattttcagggaagaaaaaaaacatatatatagagcttacagatatatcagaaggcatgataagtgatgcgagaagaaatataaaaaaagcaacagagagctggaaggaaagagatattgatgtgtcattcaggttcagagtggcttcatgcgaaaagacaggggcgaaagatgaatcgtatgatctggtgattgctaatcatgtgctgttttattgtaaaaatgtcaataaggcacttgatgaaattgtgagggtgttaaagcctggaggggtgcttgtgtgcagtacatatggcagcaggcatatgcaggagataagccgccttgtgtcgggatacgataagagaattgcacttgaagcagataagctttttgaaaaattcggacttgatgatggatataagattctaaagaaacatttttcagatgttgaaagaagagattataaagatgcgcttgttgttgatgaagcagaaccgctggtagattatatactatcatgtcatggcaatcagaaagagtaccttgtggataagtatacagattttaaaaaatatgtagagaaaaagcttgtgaaacctatgacaataaccaaagaggctggtgtatttgtgtgtagaaaataatgtatagcaattatatctataatatggtaaaatcaaaagaaacatgttttgttacaggggtagtttgaacatgcatattatggaaatactctgatagaataaaagattatttattgggggcagagaatacagttatgaagaaattaaagattgctgttgatgcaagaactttaggcagcagaccaagcggtgtgggcatgtatcttaatgacttcttagaacagctcataacatatgatgaatttgaatggattctttttacagatgttaaagagagtgaatatattaagagatttgaggctagaggaatcaaggttattgaatggggaaagcctgtatatagaagtgcgggtgtgtatgcatattttgcatttattaagaaagaattaaagcaggtgaggccggatatattctgggaggttaattcgattattcctattaatctcggtggaagctttaagacacttatcacaatacacgatatgtttcctattcagtatgtaagatactttggaaaaatatacagctattattttaagtttaatcttggcgtgactttaagacatacagatatgattctgtataattcggagcagactaaggacgacacagagatgtattttccaaaggctaagaagattccaagctgcaatgcctacattatatctaatccgcttacaagatatgtaccgcctaaggatgagaattatttcttgtatgtaggtaatatggagaagcgtaagggcgttgatatccttattaaagcgtacagaagatacagggaagaaggcggaacaagacctcttattcttgccggtaagatgcaggaggatgatattgagcagcttcttgagactgcacttacagaggttgaaggtcttacttatcttggttatgtatcacacactacaagatatgacctgtataacaattgttcatgctttgtgtttccttctatggcagaaggcttcggaatgcctatattagaggtaatgaagcataataagccaatacttgcaagtaatcttaaaatatttgacgaggtagtaggtgactgtgtggaaagattcagtcttgccggtgatgatgatgataaggttataagtcttgtgaatggaatgaagaatatagataagaagattaattctggacttgttgatgagaatgcatacagacatgcgttggacaagtatacaccggaaagacttggtggtatggtgagagactttattaacagccagatgaataacagatagaatgttgaggtttatatgggtttatcaaaattttttcttaatacgggagaagcattgagaccggtgctgacaaagattattcctatgaagcttttaagtaagatgaaagcagggataattaataatgccacagacaagctgtcggctgattctattgaaaaatatgaggcaggaagatacaaatgtggtgccaatataataggtaatattaagggagataatggacttggacaaagcgcaagaattatgtgcaggctgcttgatgagaataaagaacctcatgttataagggatttctttgttccaccaggaggttcaagaagcaatgatacgtatgatgacagactcacagaggagcttccttttgatgtgaatattattcatgttaatgcaagtgaattcatggtagcatatttaagccttggaaaagaagtatgggattacagatataacataggatactgggcatgggagctggagacatttccagaagagtggcttccggcattcaagcttgttgatgaagtctggacaccgtctgattttgttacgaatactttgaagaaatatacagacaagcctgtgataacagtcccacactgtgttgcacctgatacggatactgtgaagtttgatagaaagcattttaatctgccggaagataagttcttattccttgtaatgtataacagtggaagcgttatggaaagaaagaatccgcttgccgctattaaagcatttaaagaagcattctgcaaagatgaacagatgaaagaaaaatacaaggatgtcggacttgttattaagataagtgaggcagaattatctgcagaagatgaaaagattattggttctgtaatagaggactgcaataacatttattatatgtgcggtcatatgggaagatgtgaggttaatacacttcttgctgatgttgatgtgtatgtttcgctccaccgttcagaaggcttcggacttgttatggctgagtcaatgtatgttggtacacctgttattgcaactgactggtcaggcaatacagagtttatgaacagtgatacagcatgcatggtcggatacgacatgatagagcttgataaggactatgagccgttcaagaagggaaatgtatgggctgatgcacatgttgatgaggcagcatactatatgagaaggctttatgaggataaggatttctacgaaagaattgctgggaatggtcagaaatatgcaagggaacatctggcgtataagcgttctgcggatattgtcagtgagaggttaagaaagatacatggaaaaagttgattgacaaggtgattaattagtaatattatcatcagttgatattctttataagaaacaatatagaaggtagttatgaaaaagtttaaaccaatattaagatgtgtgatattcctggcaggacttattgctataatgggagtcattgattttgcctgtgtacagacaggttatgttaattatattttaagaaatgtatgtgtgaaaaataataaaactgattatgatactgtcataattggagcttcacatgcaagggcatcatcagatccggatattattgataaatattccggaacatattcaataaatatggcgattccaggagaaacggtaaaagattcatattatgtgcttgaagatacgtgcagaactaatgatattaagacagtaattctagatattgattatcagtattatttcaatccgcctaaagaagggttttatactgaacagtttattcaatgtcagatggattggcgttcatatgtaaagtggcaatatatatacgataacatggaacgtatggagataaggaatgttttcacaagaagacaggcatgtacgtttactccgtctaatatgaaagataatattgaacagaaattgtcaaaaggttacaaagaagcggatatttattcacttgatgtagatggtggaacatatgccggaagaggatatttctacattagtcctgttaatggagaactcgctggtgaagaacttttaaaaagctggagtgtaagaagtaaagagcaaattacaggttatcctttgaagtatattaagaaaataataaagtattgcagagataatgatattgatcttattgcggtaacatctccaataactccaagtagtgtgggtattcttcatatggagaatgtccatgatacaattaacaaactgcttgctgacaatggagtgttctattatgatttcaatatggcgagacaggacatattgccaagagaggattcggactttgttgataaagaaggtcatatgaatggagattttgcaaaaaattattcagaacttcttggaaaagtaatcaaagaacacaagcagggagcaagagatatcaataaatatttctacagttcatatcaggaaatgtataatactgatgcaggattgtacggggtagtggagaaataaaatgtcatttacaacagcgttattttggatttttatattaattggagtagttatatattatatacttccatctaaagtaagatgggtatggttactggtgttaagttatctgtattatttttcattcaatgtgaagaatagtctgttcatggttgcagcatcgcttgttatatatctggcggcattagcaatggaacgcatacaggataggtcagatgtgtatctgaaggaacacaaagcagagattgacagggaacagaagaagaaacttaagaattctgttaagcataagaagagaataattcttgtaatagcaatgcttattaatttcggagttcttgcagtattaaaatacggtggttttatcacaggtaatattacagcagttcttaataagataggaattgacaaaactgtgtatgcattaagcaattatgtaatgccgcttggtttatcattcttcacattccagtcaatatcttatgttattgacatatatcaggggaaatacagagcagaaaagaatccgttcaagatatgtcttttcgtatcgttcttcccgcagattatgcagggacctattggaagatttgataagcttggaaaaactctttttgcaggcaattcatttaatcttcagaatatacagtttggtattcagagaatattctggggtctgttcaagaagatgattctagcagacagggctggagtatttgtggcaatgatattcaacaagcctgatgaatacggtggagcaatggcaataatagcggtgcttatgtattcaatccagttatatgcggatttttcaggtggtattgatatagtaatcggtgttgcacagctttttggtgtaactatggatgagaacttcagacagccatatttcagtaaatcaattggtgagttctggagaagatggcatataacacttggtacatggatgaaggattatgtattctatccattctgcttatcaaaggctatgaataagtttggtaagtggggaaagaagcatcttggtgaccatgttggcaagacgcttcctatatgtctttctaatcttctgatattctttatagtaggtatatggcacggagcagaatggcgttacatcatgtatggtatgtataatggcgtaataatagcattcagtaaccttgtagagccactttataaaaaatgcttacatgcatgtcatattaacccacacaagaagtggtggcagtgtgtacagatattaagaacatttatacttgtcaatatcggatgggtattcgattgcagtgcagcaggtatgggatctgcaatcagaatgataaaacgaatgattacagacttaagatttgaccagcttaatgcaggaatgtttaagagcattggtttaacatcagtagattacataattctggcagcgggatgtattgttatattgataataagcatcctcaaagaaagaggcgtacagattagagctgcagtggcagcaaaaccaatagccgtaagatggcttatatattacggtcttatagtagcaatatttgttctgggatacgcaagtgacgctggaagcggattcttatatgcgaatttctaacagccataattaaatggaggatttatgaaacatttaaaggaaatgtatgaatacagagagatgatattttctctggtaaagaaagatttacgtggaagatacaagggctctgtgctcggatttatgtggacatttattaacccattgttacagcttttagtgtttacattggttttctcaataattatgagagccaattatgaacagtattatctgttcctttttgtagcacttgtaccatggatgtttttcggctcaagtgttcaggatggctcaacatgtataatgcgtgaatctaacatggttaagaaaatatattttccaagagaggttattccaatatctacagtaacaagtgcattcattaatatgattcttacatttgttgttgtgtttatcgttcttcttatctcaggaagaggaattaatctggttgcattattatatcttcctgttgtaatgattgttgaatatatattatgtcttggaattggacttatagtttctgcacttactgtttatttaagagatttacagtacattcttggaattgtagttatggcattacagtatatgacaccagttatgtacggcgctgatatggtagagaatgctaatgttccacagatattaaagacaatatttaacttaaatccaatgacaccaatcatcaatatatacagacagattctttattataagcagattccagatctgtctacattattggttgctattataacaggcgttgtttttgttattctgggagcaattatattcagaagacttcagcgcggattcgcagaagagttttaatgtttaagaaagagagataagtatgcttaacaacgagaattcaatcgaagtaaggaatgtatccaaaagctttaaagtgtattttgataaaggtaatgaacttaaagagaaaatgctgttctggaagagaaacagatatgaaaacagagttgttcttaataatataagttttacagtaaagaagggtgaggcagtaggtcttattggaagaaacggctgtggtaagagtacaactcttaagctgttaactaagattatatatcctgacagtggttctattgaaatgtgcggaagagtttcaagtcttcttgagcttggtgcaggcttccaccctgatatgagcggaagagagaacatatatactaatgctgccatattcggtcttactaagaaagagatagatgagagacttgaagatattatcgagttttcagaattacagcagtttattgataatcctgtaagaacatattcatcaggtatgtacatgagacttgcgttctcagtagcaattaatgttaatgcagatattcttcttattgatgagattcttgctgtaggtgatgcgaatttccaggcaaaatgttttaacaagttaagagagattaaggctaacggaacaactattattatcgtatcacatgcccttggacagattgaagagatatgtgacaagtctatctggattaaagatggacagattgagcaggaaggtgatccaagagaagttgacattgcttatcttgattatatgaatcaggaaagattaagcaaggatgagcaggaaagagccagaatcttaagaattgaagcagagcagagaagacttaagaaggctgaggaagagaataaagaaggtggtaacgataaacgttacggaagtttcgaggcaagaattaatgacgttatcttgtcttgtgatgacggcaagaggacagaaactcttgaaacaggaagaaaagccgtgatagagatagattattctgttgagactccggtaaaagatgttcatgcaagatatatgatttacagaattgatggtcagttatgcagcggaagcagcactaagatagacagacttgatgcatttgaccttgagaaggatggaaagattgttatcgagtttgccagcatgacgcttgcgagaagtcagtattgggttgatatagtacttgagaaggcagatggaacaccaatcgattattataaagaagcagcaagatttaatgttgtatcaggaattgaagatatgggtgttgcaagaattgaacatacatggaagaactgttaattgaaaggtagtggctatgaaaaaaagtgataatgtgattaatgtacagctttcagataatcagggaaaacttcatatcagaattgcaggctggtatattcctaaggattttgatgattattcatttgaattacttattaatggcaagaagacagagtgcagcgttgagcatataacaagagaagacaaacttgatgaattgttagagagaggccttaacagagattgtgaaataggatttatagttaaggctgatacagataaaactgatattaatgaaataaaatttgctgttgttgattctggggaagcaaaagaacttgcatcacttgataataaagatattggatatactattgaagaacagcttttacagtataatatagaccgcatatgggctgaaaatacaccagatggagatgctgtgtacagaatagccggatgggtattgtcaaaaggtgatataagcattgaagttgtaaatcacgataataaaaaggttaattatacctatgtcaaatgtgacagacaggatcttattgataacggatatacagaagataaagaaaaagcatatggatttacaatatctgtagaagaaaaagatggttatatattaaaattcatgtcagattctgctcagaaggatatcgatatagacaaagaacttaaatggcaaagaagaagacataacatagataagacaaagagacttataagagcaataacacctcataatgtagcaagtctctgtaaatatattggcaaatatggattttctgatttaagggaatatgtatatagtggattatatggaggcaataatcaggagcttatatataagagatggtttgcagatcataaagcaactcaggaagagctggaaaaagagaagaatgaaaactttgaatatcagccacttattagcattatagttccaacttataatacaccaattatattcttaaaggaaatgattgattctgttatagcgcagagttatggaaactggcagttatgtattgcagatggaagtcagggaaataaggaacttgaggctgcattagatgcgtacagtaaagcagattcaaggataatttacaaagtccttgatagaaatcttggtatagcaggaaatactaatgctgcacttgatatggctgaaggtgaaatagtcggattattagatcatgatgatacacttgaaccaaatgcattatatgaagtggtgaaggcattacaggataaagatgttgatgttgtgtatactgatgaagataaaatattaggaccagactggaaaaatgttaatcctaattttaagcctgatttcaatatagacttacttcgttcatacaattacattactcatttttattgtgttaaaactgaacttattaaggaagttggtggttttagcgataagtatgacggggcacaggattatgatattattcttagaacaacggaaaaagctcataaaatagcacatgtttcaaagatattatatcattggagaatgcatagtaattcaacagcagctaatccagaaagcaagaagtattgcaatgaagctggaagaagagcggtcgaagatcatcttaaaaggatgggaataaaagcacaggttcagcttagcaaactttttggtggatacagaataagatatgctacaccaggaaatccaatgatatcaattgttattccaaacaaagatcattataaagatcttgatttatgtgttacttcagtattaaagaagagtacatacagaaatttcgagataattatagtagagaataacagcacagaaaaagaaacatttgattattataataaaatacagaaagaatatgataatgtaagagttcttacatgggaaagagaatttaattattctgcaattaataatttcggggtaaaagaggccaagggtgattatatactgcttcttaacaacgatactaagatattagataaagattcccttggagatatgcttggatattgtatgagacctgaagttggaattgttggttctaaattaatatatggagatggaactatacagcatgctggtgttattctaggtctgggtggaattgcaggtcatgcatttataggcttagatgctaaagaatatggttatatgtcaagagcatatttgtcatgtgattatacagcagttacagcagcgtgccttatggtgcctaaagcagtgtttgatgaagttggcggattgtgtgaagaatatgctgttgcatttaatgatgttgacttctgcatgaaagtcagaagcaagggataccttgtagtatatgatgctttttcgcagtggtatcattatgaatctaagtcaagaggatatgaagatactccagaaaagcagttaagattcaagggagagatagaaactttccaaagcaaatggcaaaaagaattggatgagggagatccatactataacaggaatttcccaatgacaacagaggcgtatgtattggcttcagagtaattatcagaggtaaagatgtttttaacgagagcagcgcagattattggaaaagaaggctttaagacatttgggtatgcattacaccagaagatgcatcagaatatgacagatgcgaaagcctatgacaattatcagaaaagaattgcacctaagcagcgtattactgataataaggcagattgcatagcaatatgcggatatagtgaaagctatgaaagcatgctggcagaagtgtctggaatggatgctgaatatgtagccgtgtgtgatgaaggttgtgaattagataaagattatacagcgattgtctcacattatataagaatacagaaaagggcaggacgcagtccccgatatatatacactgattcggaaaattataatcaggaagccggatgcggacttcctgactgcaagcctgattattcatgggatacactgttatcttacaattatattggagatgcatttgttgcaaagaagaatgctcttatagatgctattaatgaatgtaagaatcatggtgtgggtgataaggttaattattatgaattgtctttaatgattctttcagaatgtaagacagcagatgtgggacatgtccatcaggtactcgttaaggatgtaagaactgataataagtcagacaggattgctgatggaggaattgcagcttttaagaaaatgcttcttaacaggtcagggactaatgtgaatatcgtagcagataagcatgatacagaagttggtcatgtgcattatattccagataaacatgatctggtaagcataattattccatcgaaggacaatccggacatattagaatgctgtttacagagtatcagtaagtttacgaaatatattaattacgaaattgttgttgttgataacggaagtaatgacagcaacagaacagaatatgagaagcttgtagatacatttgaaggacaggcatcatatgtgtatgaaaaagcagattttaatttctcgcatatgtgtaataccggagcagctaaagcaaaaggtaatctgttgctgttccttaatgatgacattgaaataatcggacaggattatgaagacacagactggctttcagtacttgccggacaggcaaagcaggaaagtacaggtgcagttggtgcaaagcttctgtatcccgattcgtcatacatccagcatgtgggtgtaattaattatgaatcaagctgttttgcacatctgtatgccaaggcagttgatgataggaatatcaaggctcacagaaattacgcagattatgactgtctgtgtgttactggagcatgctttatgcttgagaagactaagtttgataaagctggtggatttgatgaagcattcgaagtgacacataatgatgttgatatatgtctgactctgtatgaacagggatattacaatgtcttaagaaatgacgtggtcctttttcaccatgaatcattctcaagaggtgatgacgaagttgatgaagagaaaaacagacgtaatatgcatgcaagggatttgacatatgaaaaacatcctaagcttgagaaatatgaccctttctatagtcctcttcttacgcagacagagaataactacagatttggggatgagatatattctgtaatatacagaaaacctcagaaagctgacagattaaagccggctgcaggatatatggaagtatcacctacagttaaggtgacagaaacaggatatcatgatgatatgcagcttaggggatttgcatataacggaaataaagtgtattataatcccgtaatttttctgtggaatgaacagaattgttataggattaaggcacagtcagtatgtgacagagtatttcatttaagaaaaggtgtggataagaacattaattatgcaccgtttttttgtggaatagatacaacagatatggaaagcggaacatatagatgtgctatcagagctaatggcagatattatgatgcacagacatgtatcgtgattaatgatgatgatggtattgcacaataaggaggacgatatgaaaactacagcacttattatggcaggtggtaagggagagcgattctggccaaagagccgtgttaatatgccaaagcagttcctttctcttacagatgacggaaagactatgatacagctcacggtagagcgaatcagcccattggttgatattaaagatgtttatgttgctactaacaagaactacagagaacttgtaaagcagcagcttccaggtattccggaggagaatatcttatgtgagcctgttggaagaaatacagcaccatgtgtaggtcttggagcagttcatgttgcaagcaaatatgatgatgcagttatgattgtacttccatcagaccaccttattaagaataatgaagtgtttgcagatacatttaaagaagcagttcagattgcagaagagggggctaaccttgtaacggtaggtattactccgaattacccagagacaggctatggttatattaagtataatcagactgacaagaagaataatgcttattcagttgaaaagttcgttgagaagccagaccttgagacagctaaatcataccttgctgacggaacatatctgtggaacagtggaatgttcgtatggaaggtatctacaatattagactgctttaagaagttcatgccggatacatatgaaggcttattaaagattaaggcagcagttggaacagcagatgaaaatgcagtgcttgaggcagaattccctaatcttgagtcacagtcagttgactacggtattatggagaaggcagattctatctacacacttccaggcaacttcggttgggatgatgtaggttcatggcttgcagtaggaagaatcaagaagaatgatgataacagcaatgtaattaacggcaatgtagttgcagttaatactaggggctgtgtaatagaaggtggcgaaaaacttattgccacagttggtttaagagatatcgtagttgttgatactaaagatgcaactcttattacaactaaagagaatgcaggcgaaatcaagcaggtacttgcaaagcttcgtgaagaaggaaagaatgagtatctgtagaagatagtatgaagatacatatgcttaaaacaaggcgtttggaggaactataatgacaaaggaacatgtcaatactaatcatacatttgcgatatgcgcttataaggagagtccatatctcgaagagtgtattacatcacttatggaacagactgtaaagtcagagatatttattgctacatctacacctaataagtatattgacgacatagcagcaaaatataatttaaaggtgtatgtcaatgagggagaaagcggaattacacaggattggaattttgcttattctaaagtacagacagattatgtcactatagctcatcaggatgataaatatgcgcctgaatatgtagagaatctgttagcgtatacagctaaagctaaaaagccgctgcttttctttaccgattatgcagagataagaaatggcgagattgtaacaaccaataagattcttaaagtaaaaagaataatgcttttcataatgcgtccaaaggcaatgtggggaagcagatttataagaagaagagtgttatcgcttggctcaccaatatgttgtccatcagcaacatattacagacctaatcttatgaagcaggtattccttaatggattcagagctgatgaagactgggaagcatgggagagattatcaaagcttaagggagactttatattctgtaataagatactcacatatcacagaatacatgaggactcagagacaactaagattcttaatgataataagagatctgaagaagattacattatgtatcagaagttctggcccaaatgtattgctaaaatgcttactaaggcatacagcaagagtgaagaatctaataatatgaagcagggataggagttaacgatgaaagaatacgatgaggcaacccttaaaaaggtacagcagacagagatggaaattcttagagatttcatcaaagtgtgtgacgagaataatcttacatggtttggtgatgccggatcaggaatcggggcaataagacataagggattcattccatgggatgatgatattgatgtaatgcttcctagaaaagatttcgacaagatgattgaagttattaaaagagattacagcgataagtattcaattgccaatgttgaaacaatgaagaattatccattgatgacaacaagaattatgatgaaaggaacaacatttatagaggaacctcttaagaatatcaaatgtgatcttggaatattccttgatgtgtatccgcttgataatatatcagatgatgaggaagaacttaaaaagcaggctaaagctgcctggttctggagcaagcttcttattctcagacatgttgcgttcccggtacttccttataagggagttaaggctaagataacacatattgcaacagcaattattcatgccggacttgttgtgtttagaatttcacataactggattgctggcaaatgcttaaagattgcatcaagatataatgatgtggatactaagagaatggcattcttatttgatacagatccatattatcatataatgttaaaggatgagatatatccattacagatgtatgattttgaagatattaagatgcctcttccagccaacgaagatgagaagttaagaaatatgtatggagattatatgcagcttcctccagttgaaaagagaaagaatcattacccatataaattggaatttaaagactaagaggtatatatgaatattatttcaagaataatgggtgtggataagacaccagaagataagtacaaatatatctggtttacaatgggaacagcatgtttcgcacttgccacgcttgttatgacaattgttataagccgtttcttaggtgaggctaaagcgggaatgttctcgattggtctttcaattgcacagtggcttgttacaatagcctatttcgaaataagaacatatcaggttactgatgttaagaatgagtatccttttggatattatttcactttaagacttatgatgtgtcttataacatttctggcaagcatagtatacgttgtatttaacggctacagtccggagaaagttactgttatattgcttgtatgtatctataagatacttgattcggtagctgatacatttgaaggtgaattccagaaagaggaaagaatagatatgtccggtaaatcagagttttacaggatattcttcagtatactggttcttgttgtaacagtaattataacaagaaatctgatattctctctgatatgtatgaatgtagttgcattgcttataattctgtgtcttgatgcatctgttgcagcaggcagggttaagatatgtattgtcagggattacagaagagttttcgtactttttaaagtgtgtctgcctcttgctataagcacatttttaagtaactatattatcaattcatcgaaattatctgttgacagaatgttaggtgatgcagcacagctgtattatacggcggtattcatgcctaatatggtaattaatctgtttagtggtataatatttaagccgatgcagacatcaatggctgttaattattatgagaagaagtataagaatttctggcacataatattcaggatgtttgctataatagcaggatttacacttatatgtgaggtcggggcatatatactgggaataccggttctgtcatggctttatggtgttaatcttaaggattacaagatgacactgcttctgcttctgttatgtggaggcgttaatgcggtcaatataatattctattatgtacttgccataatgcgtaagcagaaatacatgactattctgtatcttattgtatgcggagttgcgctgattattatggatccgattacaggcagacttggtcttaacggagctgcactcggctatctgatacttgttgtgttattaggcgtattattgatgggatatatcttataccagattagaaaggatagaaaaagacaatgagccagaatgaacagtatgatccaaaggtcctgagaaagttacagcttgcagaattagaggtgtttaaagattttattaaaatatgtgatgagaacggactttcatatttcctgtttgcaggatgtgcaatcggagttgagagacataaaggatttattccatgggatgatgatatagatatcggaatgctcagagatgattatgagaaggttctgaagatatatagagagaaatacacagataagtatgtagtacttgatatagattcacaggaaacatttcctttctataatgcagagatagcaagaattggaactaagaatataccatatgtattcaaggatgctaaggttcctatgggaattgatattgcgctttatccttatgataatgttcctgatgatgccaagaagagaagaagacagagatcatcagtattcttctggagcaagttaagaatattaagagaattcaagaaacctgtgcttttcatgcatggatggaagagaaaagttgtaagtgcaatgtgtatagtaatgaacagattacttacatggacacatttctcaagaaaattcatcaacagacgttatatgaagagcgcacttaagtataacaatgagaagacaagatgggttgcatgtttctttggtgagatggatcctttaaagcaggctataaagttagatgacctgttcccattggttgaaaagccatttgaagatataatggttaaagttcctaagaataatgatgtatttcttaagagaatgtttggcgattatatgaagatgccaccagtagagagcagaaagaatcatgtacctgaggttctggagttcggaccatttgatgaggagctgaaagatattgatatttaaagcatggacaattatggagaaaatatgaaaaaacttataataattccagcatataacgagagcgaaagtatagagaagacagtcagagatattatagagaatgcaccatcatttgattatgtagttatcaacgactgctcaactgataatacacgacagatatgtgaagataatggatttaatattgttaatctgccagttaatctgggaataggcggagctgttcagacaggatatctgtatgcagaaagatatggatatgatattgctgtacaggtagatggtgatggacagcatgatgcgaaattccttggagagatggctgattatcttgaaaagaatgaccttgatatggttataggttcaagattcatagaaaaacagggattccagtcatctaaggcaagacgaattggaattaactatttcactggcttgataaagttatgtacaggtcagaagataacagaccctacatcaggattaagacttataggaagacgtacaatagtacagtttgccaagaagtatcctaaggattatccagagccggaaacagttgtggcaatattaaagaaaggtttcaaggtggctgagattccagttgtcatgagagaaagacagggcggaagctcatcaataacacttaagaaatcagtatattatatggttaaggttacactggcaatattgtttgagaatttcagaggagataagcatagatgagtataagaattaaatgcgttataattgttgttcttatattaggactgttaaagatattaggtcttatcaagaagaacaaactggaattaaaatatgcactttcatggctttttctggagcttgggatatttataattacgttaatacctaatcttcttaatgttatatctaaggcactgggaatatataatgagattaatatgttgttctttttagggtttgtctttattatacttgttatattctcacttacaatgtcactttcaagaaattcagaaagagtcagaaagatggcacaggagattgctttgaatagttattataataataagaaaaatggttcagacattgattgatgtctgaaccatttttcttacttcttttttaatgtttttttagttaatttctcgactctgcgttctataaagatatgcatgggaagggcaattgctatatctataattatcgcaataataatgttgataaatggattgattggaccgcctcccatcacatatacaatactctgttgtatagggaatcctatgaggtacatgcagtaagaacagtcacctaatatttccgctttttggaaatgctgatgcttactgatgaacattacatagaacataaagtaaggaacacatatccatacggcaagtgcagaaagactcttaaccggaaatacaagaacaaataaaataatcgaagctatgaataaaacctgaggtttcttaatattaagaaggtgttctctgttaatccagtactggataccaagccagaatgaaatagccggacataaagcatcataaagagatgatatgtggctctgtaacaggaaagcacctaatataacaataactgataaaacaagcattatacggtttacaatattatctttgttcttaaagattttataaaaaatgtagcagaacagataacataagaattcaacaggaagtgtccataaagcgccattcacagtaggcatatatacgttattggtaaatacaccaggcaggttatgctgtaaaatcagtattccgttcaaaagatatttccatgtaagtatattggaaaaataatctttaagaggcagtgttgtgaatacaggtcctataatgaatatagatataagtacaacaagtataagcatcggaagcagtttaaacagtctctttaataagaaaaccagaaagctttcattgcgctcacatgatttcgcaatatagaaacctgaaccaaagaagaaaactgcaacagcaaggaatccccatgtgttgatattaataagattaaggtgatggctatctatataatgctgtgatgaagcaccgagtgataatgcaaatgagtgggatataataaccattaaagctgcaataaatctaataaaattgtaattataattcttagtattgaaattcaagacaatcctccattaatatatgtatttactgaattatacatgaattgaaaagttaagacaaggtaaaggacttgtatgtatttataattgcgtgatataataaaacgattaaaattgttaggagattaaaacacatgaagaataaatcaaaatacattaagatattgcttcttgttgttgtggcagtattgttcgtattaagaggagtacacatatataatgttactaatgataaagtggcagatatgtatgattcaggatttgcagcaagacaggagactgccggtttagagaaaggaatggagataacccaggatatatatattgatggggaattcaatggaatagcgctttatttcagcactaatgccataaggaatttctctaagataactgtagaacttgtagataagacaacaggtgaagttgtattccaccagaaggtgagcggagtcaatatcaatgataaccagttctctaattttgctgaggaaaatgttatatcaggtgggaagacttatacgctaaaggtttctacggatacatcagcgaatggaaagaagtttacattgtggacagataatcagaatataacagatacatcagtgcagtacagcattaacggagagaaacagaatggtgtactttgttatgcagttttaaggaattaccaccatactgataattatggtgtgtttgcagtaagaatggtgtttatgacacttcttatgattcttgtatgtgcatttattattgctggacctaggaaattatgtgagttcatatttgataagagattctatattgctgttgcaatgtttttgcttcttgttattatgagggttaatttctcgtctataggaatgtttgataattatgtgcagccgggacagggaagtgagtttgtaacgcctgtttatggagagacacattctataagaagtgatgagtgggctgtttcaacaccaagatatcttacagccaagtatactgattatggtaaatataattatataattatggggaagcagacagaaaatatagcacagactggattgtataagtcatattcagcactggctaaaccgcaaacatggggctattacttttttggagacagcataggtatgtcggtagaatggtgtttcccatttatattacttattgttatgtcaatacagttcttttacattatagcaggaaagaataaagtactggcagtaaccggaggcgttatggtagccttctctggatacgaaatgtggtggatgaatgttgagtatctgtcctgcggactgacagcacttgtatgtatatattactttataaatgcagagaagacatggcagaggatggtgctcagcccgtgtattgccatacttggcgctgaatatataacaatactatatccagcattccaggtgccttcaggatatatttattttggaattgtagtatggatggttgtaagttcatgggataatttcaagaaaatcaagcttaaggaatggcttgtattcgcagcatcaatgttgtttatggcatcaattgttattgtgtacatcaaggacagaagcacatatgtaacagagataatgaatacaatctatccgggttcaagagtttcaactggtggatattctttatataagatgtttgaatatgttgctacaatattctatccattcaaggcaactcttaataatagtgagttctcaatgatggtaacattgttcccattgccaatggtaatggcagtgtactgcattattaagcagaagggtaaggatattcttctagatatcatgcttggattgtcatgtgtatatacaatatattgtacagttggcttcccattgattgttgccaggctcacattattcagttatgtaccggaagaaagagcagcagacctgttaggacttttacaggttatattacttataagatgtatatatgtatgcagggaaaacagatataaagtcaatcctgttattgttgtggttccaatgcttataagctgttattacagctggaaagaagcaagaactgtatatgatataactgagtctggtggaatgttacagtatgcaataatagcgctggcaattgtgtttacagtaataactattgttgtattctgtgtaaaagagcatgacaggcttaagaatatggcactgttatcgcttgcgggtattgtgttcttatcaggaatatggtcacttacagttaatgtaggaacagacgctatatattctaaaccacttgccaagaaagtatgcgagattacaagtgaagataaagatggtaaatgggtaatgcttgattcatgggtagaatcaatgtatcttgctgcctgtggtgctccgacaattaatacatgtaataatgttcctaactgggatttatggaatattcttgatccacagaaagagaatgaatactgttataacagatttgcacatatgttacttacacttacagaagaggatactaatgaggaacttgttcagcaggatcttttacagttgaatctgaactataaagatgccgagaagattggtgttaaatatattgcatcaagaacttataatgatgattttgataaggtccttgagaaatattacaattattcaatattatatgatgaattcggatggagaatatatcagcttaattcattgaaagcagcagctaactaacagggagattactatgaagaagataaaagataaattaataacgatttatcctcaattgatatttcttattgtaacattctgtatatttatgccatcatctttatttcttggcaatattgatcaatttgcagtgggattcgcggcacttataccgcttcttatggcagcgtcgttaattacggcagcagttgttatactgataggtctgattgtgccaaagaagatatgtaacatatacgcagcggtcatatttggcggtgcacttgctgcttatgtgcagggaaatttccttaaccctgatttcggagtccttaatggaaggcagattcagtggagccagtttaaggttaatggaattataagtacagttgtatggatagtacttattgttgttccgccagttattgtatgctttaagaaagatataatgacaaatataataaagtggggcagcctgtttctttcaagcatacaggttgtgacacttgtggttcttattgtatcttcaaaaagaagtgttgattattcatatgtagttactaagaatgatgagtttgcgttatcttcgcagggcaatgtagtggtattcattgtggatacactggataatgaggacgcacagaattatgttatcgacagatactgtgaagaattaaaagattttacttattttgataatatgataggcggaggtgcaccaacagctctaggagttccacttatgcttacaggttatcagtatgatacaacacattctctggctgattacagaaagaaagcatatgaagaaggtactcttattcaggatatgtcagataacggatatgatgttaagttgtatacttcaagtgagtatcttaatggagttaatcaggaggcagtagccaatactgcaggtggacagaaatacagaatatcagacaaagttcaattctttaagaatatatataaaatgtcggcattttatgcatttccacagattataaaacagtatttctggttttatggtgatgattttgcagcatgtcaggctccagagaataacaatattattcaatatgaactggatgattcacagttgtatgctgattttaagaataatggcggtataacagttgatgctggaaataaaacatttacactgtatcatatggtaggggcacatgcaccttatgagatgaatgaacagtgtgtagatgtgggggaaacagagacttctcttgataagcagatacagggtgtgttcagatatattaatggatatatgcagcagatgaaggataaaggtgtgtatgataacagcacggttataattacagccgatcacggcggatatggattgtatgaacgccctgctgtatttgtgaaaatggctgatactcataatgatgtaatgcaggttaattcagattctgtaacatttaagaatctgtatgctacttatggcgaggcagcacttggacagaacagtaattatggaaatacgctttttgatatggctggtgtttctcagtcaagatatcatgtagcaccatgggatgtgtcaaaaggtatgtacccggcagatgaatatcttaaaaacagagattattcggtgttcagaatagaaggggacgctgtaaatccacagatatctgtaattaaagatgagcagcagatgaagaatattaataattaatgatgaagcagcagctatagccatggaaggtttatagctgcttacttttatactggtaatttagtttattatctgctataatccattctgttcacgcaatggacaaaaatatgaccgaacgaataaactgtgagaggggatatttatgaatgagaagaatcagctggttcgtgctttagggcttaaagaatcaattagtatgacaattggaaccgttgtaggtgtaggactttttacctgtggttcagcacagataggaagtgtaggctcatggataataggatttacctttgttgcacttcttatatctatatggccatgtcttatatatggagagatgtctgcagcacttccttgtgcgggtggaacatataattatgccaagagaggacttaacagagtatgggctaatatggcaggatggcattatatagtatctgttgtagctattggtgcaggtgagacgcttgcatttgccaattattttaagattcttatggaacagcttggaataagcatcgttaagcttgattcaagaattatagctattatccttgttgcagttttccttattcttaatttcagaggtattgagcagtcaggtaaggcgcagacagcatttatgtttttcttctggggctgttcagtgtgctggttcctttatatgatacctaaggttcatgttgaatattttggtggaatagcaatgaactcattgcctccatttaatgagatgatgtatatatttggtcttgtatggtggtgctatacaggatttgagacatgtgtatctatgggtgcagagactaagtatccacagtatacacttccaagagcattaaagatttcggtatttatggtatttgcacttaacgcattattccagtggtttcttgtaggtcttgtacctaaggagttttatggaattctcgcagcggcagatgctccatatgcagaaggacttaaggcagtcggacttgttggatttcctattatacttttatgtattggtattgcatttggaggagatttatctactattaatccgggaattgccgcacctgcaagatacatttatacaatggcagaagatggcgcattaccaaaattccttggaaagattcatccgaagttcaagacaccatatgttgctgtaattgtggttggtgttatcaattttatacttattgcaacaggttcaattaattatatagcatcagtatcgcttatatcacttgctatatgttatatgataggctgtctttcatatatggggcttaagaagaagtatcctgatatgaagagaccttataaggctcctcttggagttgttggatgtatatttacaattgttgtgtattgcttcatgttaatatttgcggataaggcagcacttattacatcaggaattataacagtattatgtgtaatattctattttgcatattctcacagaaaagagtgtgttatgccgacaattgaggaagagattggcgttatagaagagccggatgagcagactaaggctaagatggacagacagtacaccatatggaaggtatgcacaattattgttacatgcattgcacttggaatctatataattccaatggtgctgtaaggaggaaatatgaatcgttatcagtttgaagtacttacatatattgaaaagaacggtaagaaagagtatccgatgagaactctttcagatacattaaagatttcaggaacagctatatctaaagctctggatgagttagaaaatgaagctcttattaaaagatgtgaagatcagatggagattactgaaagaggtctggaggcacttgagccttaccgagtaaagagagcggttattatggcagcaggatttggttcaagaatggttcctgttacattagacagaccaaagccaatggttgctgttaatggagtaagaattatagatacattacttgatgcacttgtttctgtaggaattaaggatataactcttgtaaggggttataagaaagaaaaatttgatgagattctggagaagtatccatttatcaatcttattgataacgatatatatgataaaaccaataatatatcatcagcaatggcagcattagaacatattgaccagtgctatttatgtgaagcggacctgtatatatctaatccggctattatcacaaagtatcagtactgcagcaatatccttggctcttattcattggagactgatgactggagttttaagcttgataatggatatataacagattatcagaagggtaatacatattgctttaattattatggaatatcttactggacaaaggaagacagtgcaagattaagagaagactttgcacaggtatataatgaagagccggagggcaatgattatttctgggagtttattccacttgtgcttcgcaaggaaagatatgcggtagaggtaagaccttgtgagaaatcagatattatggagatagataatttttatgagctggtacagttagattcttcttataaggattatccgggacaggaacagtaaatgcagatataaagggaaggtgaatgtctatgatatgttataagggaaaggttcttacagttgacagtaatgatacagtagccggttatctcgttgaagataaaggaagaattgtgtatgttggtaatgaactgccagaacagtataagaatgtgcagacagttgaacttggaaagaaggtgctggttccggcattcgtagatacacatcagcatatggcatcattttctacatttcacgcaggacttaatgttatggatgcagagtccaatgaagagattgcacagatggttaaagaattcgtgcagtcaagcggtaataaaaaaacacttatagcatttggtgcgtcaccatattcagttaaagaaggaagacttataagcagggaagaattagataaggtatgtcctgataaggaaatcatggttgtcaaatatgatggacatgcgtgcataattaacagcaagcttcttgataagctgaaggggaaagtaagtgagttgagaggttatcacgaagatacaggtgagatgaatcaggaggcattctttgaatgttctaattacattaccaattcactttctattattgaactgtttaagaatatgcagagtgccattgattttcaggcgtctcatggaattggctgtattcatactgtaagtggtgtgggttttacaggcaatcttgatattacatttgaaaaaatatttgcaaaatccttaactaatggatttcaggtaagggtattcccacagtcaatgaatgttgatgtcgcattaaagagaaaactgccaagaataggcgggtgttttgaatgtgcgcttgacggatgcttcggttcacacgatgcagctatgaatgaaccatatattgattctttaggcggtgacggagtactttattatgatgatgaaaaggttattgatttctgcaagaaggctaacagagccggactgcagatagagatgcatgcgattggggataaagcatttgaccaggcatgcagggcacttaaggcggcacttgacgattatccaagaaaagatcacagacatggaattatacatgactgtcttccaactgaagagggaattaagatatgcagggactataatatacagatgcctgtacagagtgctttcattaactggaaacaggaacctgatgagtatcttaaaagtattatgggtaaagaaagagcagaaagacttaatccgctcagaacatttaatgagaatggaatagttgtttcgtgcggttctgatgctccatgtacatcaccggatcctatcgtatggattgacaaagctgttaataatatgaatcagtctcaggcagtatcggttcaggaagcactaaggatgtgtacgtataatggatattatgtaacatttgacgagaaagaaagaggaagccttgaggcaggaaagattgccgatatggtggttctttcagatgatttgtattcagttgacaagaaggatataaagaacattaaggtagagggacttatactttcaggaaaaaagtatgaatcatgtagagaaaatgtaatcaaagcagtgattcgaggaatgttctcaggaaacatggcataaggagatatgtataatgagaaaagaagagttttatgtattgaacagtttgtataatggaagcattggaagagccggctgtacttatgatgttgaggcgacaaaagctcttaatgacacagatatttataataaacttgtaaaaacagggtatattgaaaaagagtctggtagtcttacaaagactggattagaggcgcttgaaccatacagggttaataatgccgttattcttgcagctggcgcatctacacgatttattcctttatcactcgaacagccaaagggtctttttgaagtaaagggtgaacgtcttatcgagagacagataaagcagcttcaggatgctggtattaagaatattacagttgtacttggctataagaaggagatgttttactatcttgaagacaagtatggtgtaaagttcattattaatgattcatttaatataaagaataatattgaaagtctttatcttgcaagaaaagaacttaagaatacgtacatatgcgtaagtgacagttattatatagagaatccgtttaatcagtttgaatatcatacattttattcaggttattatggaaaggaaacaacggatgaagtatatgcaagagctgatggatttggaaagataacaagaattgctaaggataataagattgatggctatgttcttatgggacattcattctggagaaaagaattctcagaagcatttattaatcaggttgaggctgtccgggaatctggaatatataataactgctattgggagattcttgtaaaggataagctggatgaaatgcctgatatttattttaaggaatatcttcctggtaatatatttgaatttgattattttgatgagcttaggaagtttgattcacagtatcttggacatacgcacagtgagataataagaaatatcaagcttgtattcagatgtgatgaggaagatataattgatttcagaaatgtaagtgagggaatgaccaacacctcctttatattcaagattgacggaattgattatatatacaggcatccgggcgatggaacagaaagcataatcaatagaagaaatgaaaaaaaatcacttatcacagccaaagaggttggtgtagatcctacatacatatatgcagatgttaatgagggctggaagatatccatattcattccagaattcagagaacctgattataattcttttgaggactcaaagaagatattggctgttttaagaaagctgcataaggcagatataacagctgattatggaatgaaaccttgggaagatgcacttgatatggagaagcttcttgagaagaaagatcctgtgtgcttcgttcaatatgaaggacttaagaacaacataggacagttgtataagatgactctagcagatggagttgaaaaatgtttctgtcatggtgatacatataagccaaactggatgataagaccagatggaagtgttatacttattgactgggagtattctggatattctgacccgggaattgatgttggatattatgtggttgatgccatgtatgattttgataaggctgaggaattcataaaggaataccttcaggaagattataatgagacaacaagatttcattatatggcatatgttgctattattgcgtactactggtttgtatgggctatgtacagggaatcatgtggtgcagacatgggagaggcattggagaactggcgagacatggcagttaaatatgctgagtaccttttgaaataaataatattaaaaggacactgtattatgtaagaacagtgtcctttttttgtgtgcaaaacatgtaaaatttatattgggtatgtaaaaaaagtatatcggatatgtaaaaacacctttcaataattgataataagtgatatgattaattattatattggatgactctgacacaatcaataaaatcttcaaaagaggagttatttatggaaatattatcgacagccttaggttatgtaatgaatttttgttacaaattactgcatgattatggattggcaattatattattcactttgataagtaagattgttctcttacctgtatcaatctgggtacagaagaattcaattaaaatggttaagatgcagcctgatattaacaggattcttattaagcattatggggataaggatgagatagcagaggaacagtctaagctttataaaaaagaaaaatataatccactggcatcacttatacctcttattatacagataatacttctgctgggagttgttgcagttatcaaagacggaattaatgaaggtgttgcgaacatgaagttctgtggctatgaccttacatggattactacaaaacagtggggattatcaataataacaccaattatagcaggtgtctcagcatggcttttatgtgttgcacagaatgcaagtaacgtattacaggcagaacagagtaagcttaataagtatggtatgatgatattttcagtaggtctgtcgttatatttaggatgctttgtatatgcaggagtagctctttactggactgccagcaacatatttgcaattcttcagttatatcttcttaactgggcgattaatcctaagaattatgttgattatgaggctcttgaggaaactaagaaagaacttgcagagattgaagctcttggtacgaaaaaaggtaaaagaaacaaagaagatattaagagagaaaaagctgattataaaaagtttttctctgttgttaataaacatcttgtcttctattcagagggttcaggtttttataagtattttaaagggataattgaatacatacttaataatacgaatattacaatccattatgtaacaagtgatccagatgatcagatattcagaattgcagaaaaagaaagtaagattaaaccttattatataggggaaaagaaacttataacacttatgatgaagatggatgcagacgttgttgttatgactatgcctgatattgagaattatcacattaaaagaagttatatcagaaaagatattaattatgtttatgttcctcatggcatggacagccttaatatgacaatgcgaactggttcgatggatcattatgattctgtattatgtacaggaaaaattcagaaagaagaaatagaaaaaacagaagaagtgtataatcttcctaagaaggagcttgttgagtggggatattcattgcttgatgagatgcgtgaggattatgcaaagatgccaaagaaggaaaatgatattaagtcaatacttattgctccatcatggcagaaagataatattgtagacagttgtcttgaggacatacttgataatcttaagggacatggttataagattacagtccgaccacacccacagcatgtaagacatatgcctgagaagatggaaggacttaaagaaagatataagaatgatacagatatagagattcagaccgatttttcatcaaacagtactgtttttgaggcagatcttatgattacagactggtcaggtatagcatatgaatatgcttatactacatgtaaaccggttcttttcattgatacaccaatgaagataatgaatcctgaatacaaaaagattggaattgagccacttaatatatggatgagatatgaaatcgggcgtgtacttaagcttgatgaaattgataagacagctgatacagcagcaaagatgctggcagcttctgatacatataaggacagcatagaccgatttgttaaagaatatgtgtataatcttggcagtagtgcatcagttggagctaaatatattattcaggaaattcaaaaagcaattaaaagacataaggaacaagagtagagtcggattataggaggggattatgcaggcaattattttagcagcaggaatgggaaagcgtttaaaagaacttacccagaataataccaaatgtatggtaaaggttaatggagtatcgcttatagacaggcttttgcatcagcttgagaaacaacatctctcaagaatagtgattgttgtgggctatgaaggacagaaactgattgattatatagcgacattgggaattaagacaccaatttcatatgttgacaatgcggtatatgataagacaaacaatatttattcacttgcactggcaaagaattatcttatggaagaagatactctgctttttgaatcagatgtaattattgaggattctgcaattgatgaacttgtaaaagatccgagagatacacttgccatggtagataaatatgagagctggatggatggtacatgtgtaaagcttgacgaatatgataatattgttgcatttgttccaggaaagagctttgattttaaggaaaaagaggaatactataaaactgtaaatatctacaaattcagcaaacatttttcacaggatatatatgttcctttccttgaggcatattgtagtgcattgggagaaaatgaatattatgaacaggttcttagagttataacgatgctggacacacctggaattaaaggtatgagattatcaggtcagaaatggtatgaaatagatgatgaacaggatcttgatatagcaacgacactttttgctccagatgatgagacaagaattaaccttatgcataaaagatatggaggattctggagatatccgggattgttggatttctgttatcttgttaatccttattatccgcctaaaaagcttaaggatgaactgcgtgcaagctttgatacacttttgacagaatatccttcaggtatgggagttaattctttacttgcagctaagaattttggtgttcataaagacaacataatagttggaaatggagcagcagaacttattaagtcacttatggaaagcttttctggaaagacaggcgttatcagacctacatttgaagaatatcctaacagatattctgttgaagacgaagtggtatttacaccgtcaaatgataattatacatattcagttgaagaactgatagagttctatacatgcaacaaagtagataatattattattattaatcctgataatccatctggtaattatctgaaaaaagaagagattataagattaataaaatggacagacggtcagggaataaagctggtggttgatgagtcgtttgctgatttctcagatgaaccggataattctcttatagaacagaaatttatcgaaacatatagaagattatatgttatgaaaagtatatctaaatcatacggtgtaccgggactgaggcttggaatccttgtttcctcagatacagaagcgattgcagcaatgaaaaaagatgttgcaatatggaatattaattcatttggtgagtattatcttcagattgcagaaaagtataagaaagattatgcagctgcaatggataaattccgcgtagaaagaaaaaggttctataatgaactggagcagatatctggtataagggtcatcccatcacaggctaattattttatgattgagataactaatggaatgacagcaaaagaacttatgataaaactgtttaagaatcattatctgcttataaaggatcttacatcaaaattacatgatggaaaacagtatataagaattgcaatcagaaatgatgtagataacaacaagatgattgaagcattaaaaaaagaacttaattaaaaaggagataagaagtaatgttgacattattaaatttaaatgtagcaggttacattgacccatctgttatgacttatgccattcaggctattgccggagtgataattgctgttggtgcatttcttggtatttatttaagaaaggcaaagaaaaagcttaataacaagcttggaattgatgaaaacagaaacaaggaagttgagacagatgatatcgttatcaacgaatcaaaataataaatgcatttccaggacgccgtttttatacggcgtctttttcttgatttgttattgataaaagtataaaatagtatggcgttatatcaataaaaacagtgaggtaattatgagtaacaatacagataataatatgcaggaaattaagccggatatatttgataagattatgcatctgccgggtctgagggtgtttgaaccattgtataagaagtataaggaagtacttctgtatcttttctttggagtacttacaacagtagtgagtataggttcatatgcattctttaatgttacacttggaattaatgagcttattgcaaatgttatttcatgggtacttgcagtactttttgcattctttactaacaggatatgggtgtttgcagcaccaactaagactgtggaagaatttatgaaacagttagtttcatttgcaggtggaagagtattaactcttgtaattgaagagataattcttcttgtattcattacaatgctgcatttcaacagtatgttaataaagtttattgcgcaggtagttgtaattatacttaattatgttataagcaagctgcttgtattcagaaaagataagaataagaagtaaaaggagaaggtaatggaaaagaatgtattagagtttcttgaaaactcacagagaatgtatggggaaaagacagcgtgtgcggacatgaataatgaacttacttatacacagcttatgaatcaggcaaagttcataggaagctgcctttcgcttaagattaagcctacacagggagttcctgtgtatatggataagacatgtaatacattatctttatttatgggaattgtgtatgcaggcggatattactgtatgcttgatacaactcatccggttgagagaattaatcttatattagatacgattcaggcagatattctggttgtggataataagtcagccaagaaagcagaaaagctcggatttcagggcgagattattaatcttgacgaattgcttgaagagtatgacggacaggctgtggattcagaggctcaggagagactggaaaagataagagaacaggcacttgatacagatccattgtattcaatatttacatcagggtcgacaggtgttcctaaaggagttatagttaatcaccgttcaacaatagattttattgactgttttacagaaacatttggaattactaatgaggatgttataggtaatcaggcaccttttgactttgatgtatcagttaaggatatatattcaagtttaaagacaggcgcaaccttacagcttattcctaagatgtgcttctcatttccaaccaagctgcttgatttccttgatgacagaaaggttacaactattatatgggctgtatcagcgttatgtattgtaacaactcttaatggattcgagtataagagaccatcttcacttaacaagattatgttcagcggagaggttatgcctataaagcatcttaatgcatggagagtgcagtatccggatgcaatgtttgttaatctttacggaccaacagagataacatgtaattgtacatattatgttattgacagagagtttggtcttgacgagaagcttccgatgggaaagccatttgccaatgaaagagtattcctgttagatgatgaggataagcttgttgatgcaggcagaccaggcgagttaggagaaatatgtgtatctggaacagctgtaactatggggtatctgcgtaatcctgaaaagacagcagcagcatttgtacagaatcctcttaatgacagatatctggaaactatataccgcacaggtgatcttggttactatagtgaagatggtgaacttttcttctcatcaagaaaggacttccagattaagcatatgggacacagaattgagctaggcgaaattgaaacatacatgaatgctatagagggattgcttagaagctgctgtatatttgatacagatgagaataagattctcggattctttgagatagaaggagcaagtgagcttgacagaaaaggtgtaacacatgctcttaaagacaaagtgccacagtggatgattccaaatgtgcttgttaaggttgaaacaatgccgattactaagaatggtaaaattgacagaaaagaacttatgaagatatataaagaacaggaggcataggatggtaggagttaatgaattaaaagagattgccataaaatgtggaacaccatcgtatatatttgatacagatgagctatgtgcaaggattgatgccatgcagcagattctaggatgtggagttacagtgtgttatgcaatgaaggccaatccgtttcttataagcgtgcttgacaagaagcttgataaattcgaggtatgttctccaggtgaatttgcgatatgcgaaaaagagggcataaacagggagaagatagtcctttcgggtgttaataaggaaaagaaagatatcctctacacgatgaagacaggtgctgttggaatctacacagtggaatcacttaatcagcttgaacttatcaattcatgtgcagttgagtgtggcattaaggttaaggttcttataagagttaccagcggcaaccagttcggtattaatgagcgtcaggtgtatgagattgctgacagaaagaatgaacttaagggaattatcatagagggaatccagtgctattcaggaacacagaagaaaaaattaagccagatagaagctgaggtagtatggttacaggcaatagcacatacatgtgaggcagagcatggcgttaagcttaatgagattgaatatggaccaggtctttcagtcgattacttcgttacagacaaatgtgatgccatgaatactaactttgatgagttagaagaatttgcaggcatgattaaagaaatgtccgaaaaattcaatgttactcttgagatggggcgatatattgcagctacctgtggagttcttataagcagaattgctgatatgaagatgaatgacacaacaagatatgcaattattgacagcggaattaatcatattaattattatggacaggctatggctatgaagaaaccaagatgtgaattcattccaatggagtacacagaagggtttgctgatggcgcagatcatgaggtggaagtgtactcacagggagtgcagccatataacatatgtggttcattatgtacagtaggggatgtaattgttaagaatcttgaattaaaagatgctaagattggcgatatgatagcattttataatattggagcttattcggttacggagggaatatatctgtttctgagccgtcgaatgccagcaattgtgatgtattcaaagaagaatggctacaggattattagaaatccagtggacacttttttaataaacagtgttagtacacaataattttacaattttgttacaaaatatgattgactatatgtgaatgagaagatagaatgttttctgttcacagatgtgtgattaataatttttttgcgaggtttattatggatcagttattagacattttgaatgaaattaacagcgatgtggattatgaagtatgtgatactcttattgatgatggtatattcagctcatttgatattgtatcacttgttggtgagttaaacgatgcatttgacattgatattacaccagttgatatagtacctgagaactttaattcagcagaagctatgtgggagatgattcagcgtctgcaggattaatccggaaagcggggtaaaataatatgtcactagtttctaccggatttctggtatttttattagtgggagtaattgtatattatcttatacctaagaaggcacagtgggcatggcttttgatattaagctatgcctactatttatgttcgggatataagactgttgtattcatattacttacaacaatcgttactttcacatcaggaatccttttagagagaacagaggataatcttgacaagagccttaaagcagatgggctggcaagagaagataaaaaggctttaaaagaaaaggcaaagacatataagaaaagagttgtagtacttgctcttcttctggtatttggtgtgcttgcagttgttaagtaccataattttgcgattgagaacgtcaatggcataattaaggcttttggtggcaatggcaggatatcaacatttacactgcttcttccacttggaatatctttctattcattccagtcgatatcatatgttattgatgtatacagaggcaaagtaaaggcatgtaataacatttttaaatacgccttgtttgtttcgtattttccgcagataacacagggacctatcgggagatatgacagacttgcaccacagtttttggcagagcacaagtatgatcttgcagttatccagcatggattgcagcgtatggcctggggacttttcaaaaagtttattatagctgaccgtgcaggagtcgtgtctgatctggtgtttaataatctcggtcagtatcatggaatatatgtaataataggtgttcttgcgtattgtgcacagctatacggagattttgccggtggaatagatatggttatgggtgcttccgagatgtttggaatccatctggatgataatttcaggcagccatttttctctcattctattggagagttctggcgcagatggcacataacacttggtacatggatgaaggattatgtgttctatccattcagcttaagtaaagccatgaataagctgggtaagttcttcaagaaacacagcaaaacaagatttggtaaatatatggcgaaggcattgcctatctgtctggcagatttactcatattctttatagtaggtgtatggcatggagcagcatggaagtatatcgtatatggtatgtacaatggtataatcatgagctttagcagtattatggcacctgtttatgaaaaaatgtttaaaataacacatattaacaagactgcacgctggtacagaggatggcagataataagaacatttatacttgttaatataagctggtattttgataacgcagctactcttacagatgcattcagacttatgggaaatacatttaaacatgcatcattcagcatggacgccgttgtaaaaatgtttggaagccagctggatttgattatattacttgcaggctgtcttgtgtggctgattataagtatacttaaagagaaaggcattgtaatcagagaagctcttgacagaaagccgctgattatcagatgggctgtatacatagctcttgttatgtcagttgcaatgcttggctatatttctaatacatcgggtggatttatgtacgcccagttctaatcagaggtgcaggataccatgaagaagaaagcatttaaagagatattaaaatatgtgagggtgatagtattctttgcggttataaccatacttgttgaagcagttaattatgtaatggttcagccggggtatgcaagatatataatccatacagttgacaatccggatgatggctctgattatgattgtattgtagtgggagcttcacatggaagggcttcaattgacccgcattattttctggaaatggaatatgcagttaatccaattaatatgtgtattcagggcgccacggttattgataattattatatgatcagagaagcgtgcaataataatgacgtaaagaagataattcttgaacttgattatcagtactggaataagaatctgaaacgtgattcggattttggagatcttcttgtatatggacagcttccgtttacaagtcttaaaatggagtatatagtaagccagcttatggataaagacttcaggacaatatatttcagaagatatgcatttgccaggaattggaaaacggctaagaaatatatggctataaagaagactgatgaatataagaatttccagatagagggtgttgctggaattgatacagaaggaccatatcagggactgggatttttctaccgtacaaaggtaactgataagaagggaaagcttaatccatcaccgtggacatatgaagatcttaatcctaaggtgcagaaatatttccagaagatagttaagtattgtaaggacaatggaattgagcttatatgtgttactgcaccaattacaccatcgtcggttgtttcgggtgctgctaatgaggctgatacatattttaagcagatatgtgatgagaataatgtaaggtatatagatggcaatcttattaagaatgagattcttaatgtaagtgatgatgatttttctgactgggaaggtcatatgaacggagagcttgctgagcagttctcagaggtactcacggagatacttaaaaagaatgattgttcagaatatttttacagcagttatgatgagtgcatagaggcaattaaagcgaggggcaatgagtaataaaatattaaaatatgtcagagctgtggtgtttattgccatagtggtcgggcttgtcaaatgtatggattatgcgatgatgccatcaggctatataagatacattatacatgaggccgacaatgcagatactgatgaaggatatgacaatataataattggagcttcacatgcaagatctgctataaatccagtaaagctcgatgaagccggggcatctgacaatgcatttaatcttgcaataccaggcgagacggtaacagattcatattatcttttaatggagagtgaccggcataataatgtaaaaagagttatatatgaccttgattatcagtactggtgcaattatgcagagagggagtttgaagactgtttcatatatacatggcttcctttcagtaatgtaaagcttaagtatatagctgataatctgctcacaaaggattttcgtactgtatattcaaagagatgggcttatgagatatcaccgtctgctattatgaataatcttaaggttaagagcagtgcggcataccgcaactacagtatggatgcagttgagatacatgatgccggaggaccttatactgccaaaggatttttctatagagatatgaagatggacagcctcgtgccatctgatattgttgcatgggatgagagtggaatcagtgataaggttctggattcatttgaaaagactgtccaatattgtaagaagaataatattgaactggtatgcgttacatcacctattacgccgacaacatcagttaatggttattcggaacaggcaggagcgtattttacgaggctttgtgaaggatatggtgttgaatattatgatttcaatctgttaacgatggatacacttccaagaacagatgatgacttctttgatgaagaaggtcatatgcttggagaacttgccgacagatattcagatatactggcatcagttcttcttgacaaatgcgacaaaagtaccgctttttatggtacttatgcacagttagagcaggaagtttatgaaaattatgtgacaaaacagtgaaactgacaaaatatgcttgctataaagataacaatgtgctaaacttcattcactgcatatgttgaatctgcaggtagtaaagagtcgtgatgtactacatatctgttattgcatttgggacacttaggctgcgccagaggaagtcatatgtattaataatacgcctgctatgcaggcactttacgccggtgtggcggaactggcagacgcacaggacttaaaatcctgcgggacttatactcccatacgggttcgattcccgttgccggcatattaataaagagctatacataactatggttatgtatggctcttttttcttgccatatagaagtgcaagtcgtacaattaaggaagattattatgatgggagataatcaatgattaataatagaaaacgtattattataatatctgctcttggcgcggcagcagttgctgcggctgccatgtgcattatgatgacaagcagaataagaggcggtaatcctacgggcgaggctttatcacagaatattaatccgattgaggctgcttcacagacagaagaacctactgtatatgtagataatacggtcgacataattgacgttaattcgaagacaagaccatttgcagtatctgttaacaatacaccagtagctgtacaggtgcagactggacttaataaggcatatattgtatatgagcttccaacagagagttatacatgcagacttcttgccttgttcaaggtagaggattcagatgttacagatgaagcaccacaggagattattgggtcaggcaatgtaagtcagacagatacggttattggaacaataagaagtgcaagacataatttccttgatttctgttttgaatcagatgcgatatttgtacattttggcggaagcacttacgctgagagtgatgaggcaaagactggtattaactggattaacggcttctataacagtgcatattattggagacataatccggaagggcttgcaacagagcatacagcatatacatcgctttacaggttaaagagtgcagtacaggaaaaaggtttcaatgctgaggctgagaatgcatcggacacagtactgcttaattatgatgtatcagatgttgacctttctaaaagagaagattcagtcagtgcatcatctgtgtatgtgccttacagcagttatcagtacacaacatttacatatgatgctacgtcaggtaattatttaaggtttgcgagtggcgagccaagtcttgaccacgaaacaggtgaacagtttaatactaagaatattatcgtgcagaagattacacacagcatgatggatgataattactgctggaatcttcatacagtcggcaggggggaaggttattacataactaacggttatgctgttccaatccagtggagtaagtcagaccgttattccaagacagtgtatacatatgcagatggaacagagattaatgtaagtgatggaagaacttatattgaggtgtctgatgtaactatgactgttgaagtggaatagtacaacagatggaagcatatacttctattattcaacaataatggaggtgtgcattgtgaacaagacaatcaaaaaacttaatataacaatgataatagggattctggcagtatgggtgtcagggtccttatttcattttgtgtatgactggacaggaaagaatacatttgccgggctgttttttccaactaatgaatcaacatgggaacatatgaagctggcgtttctgcctatgaatctgtatggaatctatacatggtatgcattaaaggacagatacgaagcaagcggctttgcggttttactcggtgcaaatgtggcaacatgggcaattccgtttctgtactacacatatatgggagttcttggattttcaaaaatgtggcttgatattgcaacattttttgtggcagtgctaactggtttcgctgtggagtatcatgtgttaagacgtgccgggcatgagagctttgtacttggaacatggattatggcaattgttgattttatgatggcagcagcatttgtttcatgctcgtatggtgcgcctgaacttggcatatttgcaaaaccttaaaaataacagttgacaataactaaatataatagtatgctgtaactgtactaattaatatagtacagttattacgcaagcttgtaaccagttaaaataaacacagaaaggaatggaacatgttcactatagatgtcatgtcgcgagtgccagtctatgaacagctcattaagcaggtggaagaccaggtgcttaaagggattatgaaggaaggcgataagatgccatcggtacggtcgttatcgatggagctgtctactaatccgaatacaatccagaaagcatacatggagctggacagaagaggaattctggtgagtgtaccgggaaagggctcttttatatcggcagaagcgttaaagattgtcggtaatcagtctaaggaaaagttttcagatcttaaggagattgtaagaaagcttgcatacgcaggggtgagtaagagtgagataacagatatgattgaggaggtttataagaaaatatgatagaggtaaaaggtgttactaaatcatttgatgactttacagcacttgacaatgttacctgtaatatagcggagggctgtatatatggtatggttggttctaacggtgcaggaaagtctacattgttaagagttctgtcaggaatatataaggcagataagggagaagcaataatcgatggaattaatgtatatgagaatacatacatgaagaataagctggtgttcgttgcagatgaattattctttcttgcaggcgcgaatatgaagagcatggctaagttctatagttcaatatatgataattttgatatggacagattcacagagcttacgaaaacatttggacttgatccgtctaagagtatatcaaacttttcaaaaggaatgaagagacaggcagctataatacttgcgctttcaaccagagccaagtatttgttctttgatgaaacatttgacggacttgatcctgttatgcgtaatcttgtcaagaagttaatatgtggtgatgttgcagataataacgctactgttatagttacatcacattcattaagagagttagaagacttatgtgatcatctgtcacttcttcacaaaggcgggctggtgcttgacagcgatgtatttgaactaaagacgagtcagttcaaggtacaggtagcttttaaggatgattttgatgagagtaagtttgagggcattaggattacaagataccgtcaggagggttcagttgccaacatgatagtaagtggtgacagggaacagaccattgacattataaatgccatgaatccggtagtatttgatgtcctcccgcttacacttgaagaggtatttacttatgagatggaagcactcggttatacatttgatgtgaagggggataagacgcatgaataataagaaagtattcagctttcatatgtttttacagacattgaagcagacaaggcttgcaggctttataatgatggcggtaattacacttatatcagttgtaccgattatttcatcattaagctatattaaagaatataaacaggttaataatgtaggtggaatttcggggaattattttctggtattagtattcataattgttgtacctgttatatcattgatagtatggagttttcttaataagagaagcggcagtgatttttatcattcaattccatatacaagattgtgcatatatcttagcaagacggcagcaatacttacatggattgccggaatacttgttgtgtcatatgtatcacaggcagttttattcatggctaacaggcagtattttaatgtggattatgcaacaatgttccggatgtatctttcgatatttatatgcagccttttatgcatggcaattataaatgtatcaatatccattacaggaaacatattaagcaatatatgtgttacaggacttataatgtttcttccgagatttattatgttaatggttacagaactgactgtgtttcatggagaagcttacatgataagcaacagtggtgtggggttactggattcttccagcaatatgattgttggctgggtattttctgtatttgatatgtacaatggttcatcaggaattgcagatatggttctcagccttacaagtaacttatatacacttgtgcttgcacttatatatatagcacttggcgcacttctctttgtaaagagaaaaagtgaaacagcgggaaaagcagctaatggaaaggttctgccaatgattatcagaacacttatcggcttttcaattgcgtttataggtgtaatgatagcatatacaagtatagatagtgatgagacaatagcagttgttgtgatgtttattgtaagtgcattggttgtgtttgtttatgaatgtatagtaagtaagaagatgaatgttataaagcagtgtattccatcaattcttcttggatatgttcttgcagtggtaattggaacaggagctaattcatttggcaaatatgaggcatcgtacgaaccggatgcttcaaaacttgcatatgtatcaattcagtcaatggatatgtactatgcttcagataacggatatttcagttctatatcatcgaaggttcagtttacagatgaagagattcttaaatatgtatcggagaaatttggggcatataaagataaatgtatatcaaatggtgttcataattatatttataacggcagaggttcagtgactaattataaggttggtttcagacagaatggtgttacacattacagaaggattcagcttacagacagtgatgccaataaacttgcaagtctgttaaagaaggatgagaattttgttaaggcttatatggaacttccggatagtgacaagatttctgttaattatataacaggtaatatggaggattctgactgtaaggatatatatgaaacaattaaaagtgaaattaaacagattggttttgagaaatggtatcagatagttacttcagatgctgatactttcttgatgtcagtacggttttcaaaaaatggcgttacttatgatatggttcttccaatcagtaagaatatgccacaatcttataataagtatattagtatacggaatgaatatgccattaagaataatgaaaaagagcttggaacaatgagcgacattttaaagcagtatttaaatgacagttccagaacatgggataaatatactagtggatatgaaactctttcagcagttcttatatataatgataccagaacatatattaatctggattcgtatgtaagaaaagatgaagaaagagcacaaaaagtattaaatggacttatagagtcccttgacaagaagaattttaataaaaatataaatgcagataatccttgcattgtattgaattatgaaaagtataatcctgacaacggtaaatctgttctggcagacgctattatacagttagatggttatacaagggtagaagattatatatctgatattgattattattaattacttcttatgttgaattaatgtaatataataagtataattaatggggtggtgcggtcggcatcatcccattatttaagatagaaaaggaacaggattatgtatgattatttaatagttggagcaggactttttggttcagtgtttgcacatgaggcagcaagagcaggaaagaaggttcttgtaatagataagagaaataatattgccggtaatgtatatacagagaagatggaaggtattaatgtgcatgtatatggtgcacacatttttcataccaataataagaaggtgtgggagtatctttcacagtttactacatttaacagattcactaattcacctgttgcgaattataagggcgagttgtattcactgccattcaatatgtataccttcaataagatgtggggtgttgtgacaccacaggaggctgcagaaagaatcgagcagcagagaaaggaagcaggaatcacagagcctaagaaccttgaggagcaggctataagtcttgtcggaactgatatatacgagaagcttattaagggatatacacagaagcagtggggcagaccatgtaatgagcttccatcattcattatcaagagacttcctgtaagacttacatttgataataattattttaacgcgctttatcagggaatccctgagggcggatatactaagatggttgccaatatgcttaatgacagcgagctttccggaagcattgaggtaagacttggtgttgattatcttgcatctgctgatgctaaggaagaattagacagtcaggctgaaaaggttgtatatacaggtgcgatagacgcatactttgattataagcttggtaatcttgaataccgttcagtaaggtttgaaacagagactctggatactcctaattttcagggtaatgcagcagttaattatactgatgccgaaactccatggacaagaattattgaacacaaatggtttgagttcggtaaggatgagaatggcgacgaccttcctaagactgttatcagccgtgaatacagctctgagtggaagccgggtgatgagccatattatcctgtaaatgatgagaagaacggcgctttatatgcacagtataaggagcttgctgatgctgaaagaaaagttatattcggcggacgtcttggtgagtacaaatattatgacatggatgctgttgtggcagcagcacttgactgtgccgcaaataatatataattacaggtggtggggtgacccataataaagtcacccctgaaaattgtcacttgccttgcggtcacataactgactgtatatatcaggaccaagtcctgtctgtaattctgtatatgcttttcttaactgttcgtcagtcatatgctcacgccttctttcgattgcattaatactgtcgacaattactttgtcctgattatcgtgagtttcccaattatacatagtttgcccttttacgatagatttattgttgttgtctgttggaagattttctgagttattcataaattcacctcattataatatataagatagtttttatataagatattatctgcattaatttcctgtctatacttgaaaaacatggcatagcattgtaatattaaaaggtgtgtaaacatcagagggagagtataaatgttaaatctaaatggtatgctgtctattgttatgccggcttacaatgaggaaaaacttatatatcacagtatcatggaaacattgagaattgttgaaaagtttgttcctgaattggagattattgcggttaatgatggcagtaaggataataccaaagctgagatagaaagagctatcaagcaggatagccgtgtgcgtatggtaagttctgaaaagaacagaggcaagggtaatgcaataattgccggagtgtcgcaggttgaaggaaagtatgtcgcatttgttgatgcagaccttgaacttaatccatcacagttagaaggttatcttaagaaaatgcttgatgataataaagatgttgttataggctgtaagttccttaaggattccaagcttgattatccgtttaagaggaaagtgataagcatgggctattatataatgcttctagtcttgttccatcttaatgttaaggatacgcagaccgggctcaaggtattcagggttgaggcaatcaaaccggttgcacatcttataagaacatcagggtttgcttatgatatagaacttttagtggcgattcacagaaggggtttttcgatagcacagatgcctgtggaggttgtatatgtcagggattccggtgtaaagcgtataggaatgaaagatatatggcaggcattctgcgatacatgggcaatattcgggagagtttacttcaaacattattatgactaatcaggagatgcatgtaggatgaaagaattattaaataccatagcaggaaaattatcaggaatatgtaagtctgtatttgtggcacatgcaaaggcatgtattattgcaggctcagtcgtggttgcaggaagtgcagcaactgtaacaacagtagagtatgttaatcatcatagcagcaaaatgcaggtacaggcacaggagacagaagtagagactgagacagacagtaatcttgataagctgagtgagattcttaccgaaacacaaacagaatcagagacagagatagagactgcaacacaggaagagatagcagaacttgttaaagaggctgttgcagatgagaatacaagcagtaaagaattatatgagataattgataaggcagcagagaacagcagtgcaccgattccggttaaagatgttgaggaccttgagatagtagaagataattcgtcagaaccatcaagagaggagactgaggttgaggagcctgaaccagatcagccaagctcgaatgatgtatatgaaatcagccagttgacatatggtgtagatgtttcaagatggcagggagatatagactggtcagcagttgctgctgatggcatcacatttgcaatgataaaatgcggtggcggagatgatggtttatatgaagacaggaaatttgagcagaatatacaaggagcacttgctaacggtatacaggttggtgtgtatttctattcaggtgcttctaatgcaagagaagcatacgatgaagcaagttactgtataagtcttataagggattaccagataacatatccggttgcatttgactgggaactggatggtgattatgattcagtaacagaagcctgtgagacgttttgtaatgttatatccagctatggatatcagcctatggtttattctaacagaaacagatggtataacaattttgatggggaaaagattgcaagtaagtataaagtttggatggcggcatattttggtaagttttattatgattcagtaagatggacttatggagatgatcttccaaatttcagatatcattatgatatgtggcagtatagttcaagatgttatgttgatggtatcagtggacaggtagatgtagatatagcatttttcggctatgctaactaccatgttgatactaaggacgctgtgcttacggttactaacaaggagattaagcgcacatacggcgaaggaatcggaagactgacagaggaacttaatctgcttgacggagttaagggaattaatactatcggatatgatatggatatcgagtattcaatatatgatgaatcaggcaatgaatacagcgaggaggaagcaatatcaacggccgggaaatacacagtagagtaccgttttaaagaccctaagtctggctggataaagaacacagcaaagcttgagattgaggctataacagaggaatttacaggaaatgatattgttgtaaagaataacactatgtcaaaagattataatttcaggacaggagtcagttgtaagaataatcttggacaggaagctgaattaaccggagttgtaataaagaaggttaatatagaaacagaggaagaagatgtactgacagagcagcaggcaatagaagaaaagtacgactttgataagtacacctatgtagcagagtatgcttttaatgtgccaggagaaggagaagttattaagaaagcagctattgtcagaggtgcagaggaataacaggaagcagatatgtgtgattcagataaagaagtagaagacataaaaacagaagaaaatgtggagaatgacgaagcatctacagagacagaagactgtgagaagaaggacttgccagaagaaccgcagtatgagattcttgatgttgaggaacttcagagaaatttcagggaaaaggttatcgatttcttcaaggttaagagtcatattgttgtgacatcagtatctgcagcagttattatagcaggagtgataacagggattgtagtaggtataagcgtaaataaagcctctaaacatcagccggcgattgtagaagcagcagagacccagactgaaatgcagactcatacacagcctgaaagtactgagccggaagaagaggaatctacagaagaaacatttgaagtgattgataatatcatggaaaaggttgttactgacagtgctgtgactcagaaggaagatcctttgaaaaacagaaataatgcaacagctggtgaagttataaagcctgtgttatatgttgataatgcagtttcaggaagtgtaagtgtttcatcagtaaagaagtcaggaacagatgttatatacagcttaaaaggcagaaaaatacaggatttcacggcatcccagcttgataaatgcagcaagggcagtattcttgttgaagaaaacggaacacagaagcaatatacaggatatgtatatgaaactggaactgtcagtgttacaggtggctctgaaaatgttgtaaccaaatttcttataaaagatgacaatacagaaacttctacaaagcaggaagaaagtacttctgcaaaggcacctgataattcacaaaaagaaagtgtctctaatatagaagaaagttcaaaatctgagacagaaacttcaactgaaataaaaacagtttcgtatatagttatggaggttgaggcacagattgaatatatatatgctgatggatggcagaatataaaaggaaaaaattattattttgaaaattccaacgctgtaacaggctggaagaatatagatggagtgcaatattatttcaatgctgacggttcacaggggtcatcgcttgttattgatgtgtctacttataatggagatattgactggaacagtgttaaagcttctggtattaactatgctatgataagagttggatatagaggatacgaaacggcaagacttgtacttgataaaagatttcatagcaatatgagccaggcaacagctgcaggaattaaagttggagcttatattgtaacccaggcagtggatactaccgaagcggttgaagaagcaagctttattgtatcagcctgcagtgaatataatatttcacttcccttggcaattgatgttgagagtgcaggtaatggaagcggacgaggagataagatatcatcatcacaaagaacagccgttataaatgcatttgcacagacagtaagaagctgcggttactcagcaatactgtatgctaacaaggactggatgaataaccgtatatatgcagggaatgtaggttgtagtgtatggcttgcacagtataacagcaaatgtacatatacaggaccatttacaatgtggcagtttactgagaaagcacgtgtgaatggtatatcaggtaatgttgacatgagtgcatggaagcattaaatgatgtgactatataaaacaactgaaaaatcgtgacatttctttaacagagtggtataatcaatcggaatgtatattcacgaggagataaaatatgagtaagaatcaagaacagatgaaggaactgattaatgatgtaaggactggaaagactgataaagaggtcttatgcaaggagatacagaaagatgtaaactgtcttatatatccggtttttggagaggattacaagaaactttctccaagagcgattattgatatatgtactaatcttgatagtatcgatgttaataagaatattatgcgtcagattgcaacaagagtttcagtgtttatgtttaatcttatagataattctactattaagatagatgatgattacgagtatgagtatggcagaattaaggaagataaagaattatttgacataataaaagataattccagaatatttaaagattttaaggcatatgacaatgcacctgataatattaagtcattatcaagagtccagactattatgatggaactttacggatatgagatgcattcagttgacgagatagaaactttgctcgatatagacagtgcatttattcttaagcttattgcaatgatgaaggataatatactcggtatatcatcagttgtagagaatatgtcagattatgcttcgtttgatgaagaagagacagatgattctgatattaagatatatggtgcagagcagaaagcagcggaaacagaagctgccgacgagtacgaggcttatgagcctgaaaatgcagatttacctgataatgaatcagacgaagggatagaaaatgatgaatcggacgatgaggattctgatgaaggtgtgttatttgaatatgacatgaatggatatgagaacaatgattttgatgatgtccctgtaaggggtgtttcacttatggacaagcttacagcatttgttggaagagtgtttccgggtgtaccaagagcaagaagacgtaatgttgtatatgcgtcaatggtggtaattcttgtagtgattatccttatagtgtcaatagcagcaatggctggtggtaacagaagaaaagccaataataagaataacagcaatgaatggaaaccgatggaatatacaaccaaagcacctaaggagactgcgacaagtaaggatagttcaactgcagcacactcatctcgaacttcagtagcagaaagcactagcagcagggaagagacaacagcagctaatgagagaacaattgccgaggataagaataataaaccagcaggaagaaacgacagcgataatacctcatcaggtggagacgaaagcacagataagccagcaggtggagacgaaagcacagataagccagcaggtggagacgaaagcacagataagccatcaggtggagacgaaagcacagataagccatcaggtggagacgaaagcacagataagccatcaggtggagatgaaagcggagataagccagcaggtggagacgaaagcggagataataagccagcaggcggagatgacagtagcaatacaccagcgggtggagatacttcagcagataactaataaacatattatctataacagatattttaaggaaggattgctatgaaatgtgtaatattagccgggggtagtggtgatagtttatggccattgtccagaaggcagtttccaaagcagtttatgaaaataaaagaaggccgttccatattacaggaaactgtagtaaggaatatgccattctgtgaggaatttataatagttaccaatgagagctataagaatattgttaatggacagatgaaagcgttccagagtcttaagtacagagttatcctcgagggtacaccgaagggaacaggagcagctgtattgttaggaactatgtttgccaacccgtcagaattagttctggttgttaattcggacaacctgattgagggtgatggttataaagattcaataattgaggctaaagaatatgcaaaagaaggatatcttgcggtattaggaattaaaccagaatcacagtcatccacttatgggtacattctccgggataaagagaatgttaagaagtttattgcaagaatagatttcgatgaagatgagacagaaggtctgcttggatatgattatgatgaggggtatctgtggaacagtggaatacttgtattcagggcaggggatatggttaatgctgcaagacgccttgcatcagaactgtacactacctgtaagacagctaagagaaaggtgccggcaataagaaggtctgtgagattttcagagacggttatgcaggctatgccacatggcagtattgaaacacttctccttgaaaaatgtgattcaataaaagtagttgaagcacatttcgagtggatggatgtcggcaacgccagcgatttagctgaatttggaaacaatattaagtcagaatgtgttatcaagaatgactgcgataatgttaatattataaataatgcaccgaagagacttgttgtcgccaatgatttaagagatcttgtagttgttaatacagatgatgcaacatatatatcatcaaagaaatctgctgataatatcaagcagattatgaaagataatatggatacttatgaagcatttttcgattataacaggactacttataaggaatggggaatacaggagatacttaattattcacagggatataaagtcagaaagctaactgtttttccaggaatgtcaatgtctcttcaccggcatgaaaagagaactgagcattggtcaatagttgaaggtattgctacaattacacttggtaatgaaactgctgattataacaaatatgaaagtgtattcattccagtgggaacgaaacacaggattgctaataagacagacaagaatgtggtagtaatagaggttggtattggagataatatatcagatacagatcttgttaagatatataataaggataacccacaggcatctgctaattatgtaagactggataagagtcctattgcgaagcttgaacctgcatttaaggataatctgtggggtggaaccaagattcgtgatgtatatggcaagaaatgtgattatgatgtcatcggtgagagctgggaactttcagctcatcctgacggtcagagccgtatagctgagggaagatataaaggaatgctctttaatgagtaccttaatattataggaaaagaagcattaggctggaaatgtcaggcacaggacagattccctatccttataaaattcatagatgcaaagcaggcactttctatacagattcatcctgatgatgaatatgctcttgagaatgagaatgaatatggaaagaatgagatgtggtatgtagtggacagtgaaccgggatcatatctgtactgtgggctttcaagagatgcatctaaggaagaaattcttgagagaattaataataatacaatcacagacatacttaataagatagaggttaaagcaggcgatgttgttatggttaaggcaggaacaatccatgcaataggcgcaggtgtattcatatgtgagatacagcagaattctaactgtacctaccgtatgtatgattatgacagaagggacaagttcggtaatccaagagaacttcatgttaagaaagcacttgatgttgttgataaccataaatatatcaaggacaataagacagaggttgttattgcaagaaatgaacatttcacagaagaaagacttgtccagtgcaaatactttgaagtatataagtatgatgtcaatgacgaggcaaagattactgttgatgaggcatcctttgtttctgtacttttcattaatggctcaggaactattgaaactgatgattatgaaaagactatggagtttaaagcaggtgacagtttctttgtaagcgcaggtcttcgttcaataataattaagggacaggcaaccatggttgttaccagagtataaaaaaatgttttactttgttgtatattgatgtataatgacgagagaattctttttaaaggagagtatgataatgttatcagtagtaataccaacatttaatgaaagcaagaacatcagaaatcttgtagcacagattgatgttgctttgaagggtgttgattatgaaattgtctttgttgatgacagtaaggacaatacacctgatgtgattatggaagttgctaaggaatatccacaggtgagaatggaacatagaaagaatggtacaggattagcaactgctgttcttgatggttttaagcttgcaaagggcgaatatatggcatgtatggatgctgatttacagcacccaccaatcgttcttaaatatatgtatagggctatggaaagtggtgcagacttctgtatacctagccggcttattccaggtggagatgatggcggacttaactggtacagaaagttcgtatctggaacagcaagaaagataggacaggttatgttgccttgccttagaaagatatcagatcctacaagcggactctttatgttcagaagagaagttattgagaatgctgaccttcagccaattggatggaaaattatggttgaggttcttgcaatgggtacatatagcaaggttgtagagattccatacaaattccagcagagaactgaaggtgaatcaaagctttcaggaaaggttacgttagagtacttaaagcagctcaagaaccttagaaagagatataataagagcaacaggtacgaggttgaaatatggtcaactgagcgtatgatgaaaggcgacaaataatatcgtaacataagacatataataagccacagaacgagatgttatatgaagttttgtggctatattagtatagaacataaaggagataacaatggcaatattagttacaggcggtgcaggctttattggaagccacacagtagtagaacttcagaatgcaggttatgatgttgtagttgttgataatcttgttaattcaagcagaaagtctttagaaagagtcgagaagattacaggaaaggaagttacattttatgaggcagatatcaatgacgctgcagcattaaatgagatatttgagaaggaaagtatagacagtgttatacattttgctggacttaaggctgtaggtgagtcagtagcaaagccgcttgagtattatatgaataatatatccggttcacttacactttttgatgttatgagaaatcatggtgtcaagaatattatattctcatcttcagctacagtttatggagatcctgcatttgttcctattacagaggaatgccctaagggtgagattactaatccttatggaaaaactaagggaatgcttgaggagattcttacagatatccagaaggctgacccggaatggaatgtaattcttttaagatactttaacccaattggagcacatgagagcggaacaataggagagaatcctaacggagttcctaataatcttatgccatatataacacaggttgctgttggaaagttaaaggaacttggggtatttggtaatgattatgatactcatgatggaacaggagtaagagattatattcatgttgttgaccttgcacttggacatgttaaggccatagaaaagctcaatgataatcctggaattgtaatatataatcttggaacaggtaatggatattcagtacttgatatagtaaagaattttgaggctgctacaggaatacatataccatatgtaattaaggcaagaagaccaggtgatatcgcaacatgctactgtgacgcaggtaaggcagagagagagcttcactggaaagcagagcgtgatttaaagactatgtgtgctgattcatggagatggcagaagaataatcctaacggatatgatgattaaggagtagattatgggtaagtattttggaactgacggattcagaggagaagcaaatgtaactcttacagttgaccatgcatttaaggtgggaagattcttaggctggtattatggaaaaaaccatgagaatggtaaggcaaagattgttattggtaaggatacaagaagaagcagttatatgtttgagtattctttggtagccggtcttacagcatcaggagcagacgcgtatcttcttcatgttacaactacaccaagtgtttcttatgttgcaagaacagaagattttgattgcggaattatgatttctgcaagtcacaatcctttctatgacaatggaattaagcttattaatgccgcaggtgagaagatgaaagaggatgttatcgctgaaatcgagaagtaccttgatggtgagcttggagaaattccatacgcaacacgagaaaacattggatgtacagttgattacacagcaggtcgtaacagatatatgggatatcttatgagtcttgcaatttattcattcaaaggaataagagtaggtcttgatgcttctaatggtagtgcatggacacttgcaaaagctgtatttgacgcacttggagctaagacatatgttataaatgctgctccggacggaactaatattaatgcaaactgcggttctacacatattgaaggacttcaggatttagtaagaagagagcatcttgatgtaggatttgcgtttgacggtgatgctgacagatgtctgtgtgtagatgagaagggcgaggtcataacaggtgaccatattctctatatctatggatgttatatgaaggacagagataagcttgtcggaaacaaggttgtaacaacagtaatgtctaacttcggactttacaaagcatttgatgcagtaggaattgagtacgaaaagactaaggttggcgataagtatgtatatgagtgtatgtcagagaacggctaccgtataggtggagagcagtcaggacacattatattctctaaatatgcaacaacaggtgatggaattatcacagcccttaagatgatggaggttatgcttgcaaagaagaagacattgtcagagcttgcagcaccacttgttatatatccacaggttcttaagaacatcagggttacagataagacacaggcacaggatgatgcagatgttaaggctgcagttgaggcagttgccaatgcacttggcgcagatggaagaatcctcgtacgcgaaagcggaacagagcctgttgtccgtgtaatggttgaggcaggaagcacacaagagtgtgaaaaatatgtcgaccaggttatagatgtcataaagagtaagggatatgctgtgtaagtttcgtgtacatttgtaaggtgaacacgcacgctccaagtgtctgtctgtggcattcgctttcagtattcctgcgcttagcaggagtaaatgccgctatctacagagtttattacagtgtgtgaaagcaaacgcacttcgtttgaacgagctttcacacactgaacttatgtatatagcggcattaactcctacacagctcgtcataattcaagcgaatgccacagacagacacttggagctggttgtcatcttccaaagagacataaacaaacatcagtattcctgacgggaagttatgccaagagtggatagttgacactatatacacaaatcaaaactttatatgaatattttcaacacctccacataagattaaataggtcttattgtgggggtgttttttatgtgtgggaaattatggggaaaagttgtgactgttatgttggcattgttgataattatgcctgcgtgtgccatgacagggtgttctggcagcaaagagccagataataagaccagtgttgattatacagtggttgaaaatgcagagctgccggaagagcttaagaagcttattgaaagcaaaaaagataaagtgatgaggcttacatacacgactaaggattatacatatgttgtggccggttatggaacaagggaaacaagtggatattcaattaaggtaaatgatgtatacacaggagataatgcactgtacattgatcttaatctgataggtccggcagcgggggaagctgtaaatgaggttgacacatatccggtaatagtgcttaagatggagagacgtgaagaaagcgttgtttttaaaatgtagaatgtataggaggtcagtctgtgagactcagaacagaaaatattcatgaatatcgtttgaaatgtaatacagtggcacagattacgcttgatgatgattttaatgtgccggacacaaaagatgatattgaacttatagtgaaagaatggggaaatgtccagaccgacagtgtaaaggtaaataaggataaagctgcagttgatgggcaattaaaattttcacttctttatataggtgcatcatctgactcagaaagaatgcagccggtcaaaatgacagggaaaatgagtttttctgaaaatgtcaatctttcgggtgactgtacaggtgattatgttacatgtcaggcatcaatagaagatcttagtattaaagcaattaattcaagaaaaataagtgttaaggcgatagttacccttaaacttatatgcgagagtctgcaggatatacagatgataacgggtgtggatgagacggagaatacggacattcagcagttaaaggaagaattggaatttgtgcagcttgcagttaatcagcgtgataatttcagaataagagaaaatgtatcacttccggccggaaaaccagagatacaagaaataatctgggatgatgtagatgtaaggaatctgaatacaaggcttgcagatgatggacttaagcttgctggtgatttagatatatttgtaatgtatataggaaatggagaaacaggaaatgtgcaatggtacgagacaacagcatcatttgaaggaagtctggatataagtggttgcaatgcagatatgattccatatgttaattttcagataattggaaagacagttgaggagcggcctgacttagatggtgaaaaccgcgatattgcagttgaagtggttcttgatatggatgtaaaagcatatgaggagcgtaagaaggatgttatagcagatatatactcgccttcatatgatatggaaatagagaatgcagatacacagctgcgttgccttgttgtacgaaataatgtatcaagccgtgtttcaggtaatctccagcttgagaattatgctgaccttatgcagatatgtaactgtacagctacggtgcagcttgacgatgtgacatataaagaaggagagctggttgcggaaggtgttgtaagtgcaaatgtattttacataacttcaagtgacagtcagccgcttggcagtgtgcatacaatcattccgtttgcaggtacagttaagattgatggtgtcagttcagattcacttgaatacaacataaagccgtcagtacagcagctttcagccacaataaacagtgctggtgtaatagaggttaaatcatcagtttcactggatgtaattgtttttagaaactttgagtatagtggcataaaaagtgcttatatgtcagaggaaaaatgtgatctgtcaaagatgccgtcaatgaccgggtatattgctgatggcactaaaacattatgggatgtatctaaaatgtatcatacaacagcagattcaataaaggcaagtaatcctaaatgtgctgatggactgtcagagtctgtgattataccacgcggtaccaagcttcttcttgtgaaggcatagacataaaaagaggtacagtctgtaaagtctgtacctctttttatgtctggttatgaattctttccggcaaagtaatcgtcgaatttcttaagaacagcatctcttgtgttctgggaaatatcagggagttccttgccccatgttttagtggcttctttaaaacctttttcaaatgcttctttcatcttagtcatcttttcttcatcatcacctgcgagtgcctgtgcaaatgagaagattctttcagatgtctgtttaacaccccagtaaccgttttcagaaatatcttccttagcctgtgcaatagtgtcagcgtctgctgtgaagttaccgccagcaagtgccttccacatatcatcggcagttccaatagttattccctgtttagagaacatcttagtaacgaggctttgcatctgagccatgcgtgtttcctggtcagcctttaactgggcaacaatagaagcgttagaagctttcttgttaacagctgctactaaaccttcagactgtgaagcatgttcataagttgccgctacacctgaataagctgtagtcttagaaatctctttagttgaaaccttcttatcagaaccagaaacagtatttgtttcataagcctgataatttgaattaactccgtttaatgacattatatccctccttggacttttattgtagtgtttctatagtgtatatcggtaaatgtatttctttaattaaccttctgttttttcaatttttatagtagatttcttccatattcctgtccagtagaggccataaagtatggcagcggatgttccattactgattacgacagcataccatacagattcaacccccatattaagcacattggcacatacccagagggtcagcagacggaatatccagattcttgaagcgtcgacaatcatggttatcatggtgtgaccgcttccctgaaaaagtccctgagtgacattgtaaaatgcgttgctccagcaccagaatgccataagtgagagaaaatctgttgccagcggaataactctttcatcagtcgagaaaaatgttaccatagcctgagatataaatcttcttgatagaatcaaaccaaagaataacagaaacagtgcacccatacggagtgcgtaatggtaagccttgtctgctctgtctttctgtccggcaccaatattttgtcccactatagttgatatggcggagccgataccatttgcaggcattgtaatgatgctgtttatcttgtttccgataccataagcgcttgttgcaataaatccgtaagcattaacatttttagtcataagaaggaaaccaagctgcatagtgcttccgccgattgctgttggaagtccgatttttacaatcgaacccatcttgcttttatcaaacttaaatcccctgaaattaattcttataagctgttctggtcttgtaagtacaataagtgcaatcactgcacatggaattttggcaatgagagttgcaagggcagcaccagcgataccccatttgaaaaccataaggaataacgggtctaatataagattaataacaacgccaaacatattaagaagcattggttttactgtgtcgccctgagactgtttgactgatgtgaagaggttaatggtaaacagaaaaggcagatcaagtactacaattcttatgtatgtaagtccgtatttatatatacttccttcagcgccgagccatttcacaagtcccggagagacaagccagcatataagtgcgcataatactgaaaatgcaagtgaagtaaggcagatgtggttagccattgaattagcctgttcatcctctcttgcaccgaggtactgtgatataaggattgcacctgcagttgttatgccgttaccgaaattaatcaggatattctggaaaggtgaaacaagcgtgatagccgactggttctcagtacctattcttcccagccagaaagtatctgtaagattgtacattgactggataaaactattgatcataactggaattgcaagcatgagaattgcatgaaagagattaccattaagaatcatatttcttttatcttcacttattggttttgccatgataagcccccttgttttaataaatatgttaaaaatgtttctttaaatacagaaaaataatcaaaatactgattatttgttgacatttcaaaatcctttatacataatataagcataaaaaacagtgatttctacaattaaacgaaaaaatattctttataatacagaaaaattactataatagacgcaaatgtgtttgagataaggagtggttatatgtttcaggatatgtcgaaggattttgatatcaagaggataaaaagaagtaataccagttgtagtacaggggtaggggcacatgtgcatccgtttaatgagatattctatctttcgagcggagagtgtacaagctttattgaccacaacatttataagttcggaaagggtgatcttgttattgttccaagcggatgtcttcacaggacaacttataatggaaaaggaatgcatgaaagaattgttataagctttagaaatgatgcaactgaatggattcagaaccagactggtaaagaacttatggaaaattgcatgaagcctggagttgttaatattcctgaaaaaagaagagattatgttgttgctctgcttgacaaactgctatttgaaaatgattctcctgatgagctgtcgccggcatttataaaggttggcctgattgaacttctgctgtttattatccgctgtaagaattatgaggaaaatgttattaaggaaatagatgtggataacaggattattcaggaggttgccacatatatatatgaacattatgcagataatctgtctttagagtatgttgcagataaatttaatcttagcaggtcatatctttcaaagaaatttaagacagcaaccggatttggatttaaggagtacattattaatgtaagaattcagaacgcctgcaatctgctgcttgaaacaaacaaatcaattactgatattgcatttgaatgtggctttaatgacagtaattattttggagatgctttcaggaaagcaaaggggatatctccacataagtaccgtaaaaatgaaactttttaaaagtgcattttaaatattgtacttgattttatacaatatctttaatataatagttttgaaaatggattttgtatacaaggttaggtaatatatggaaagtatcagattaaaggcaagagccaagattaatcttggacttgatgttattggaagacgcgagaacgggtatcatgatgtaagaatggtaatgcagactgttggtttgtatgaccgtattataatgacaaggattccggaggaagagataagaattaagactaatataggatttctacctgtgaatgagaataatcttgtttataaggcaattatgcttatgaagaataagtataagctggatggaggaattgaggttgatcttaataaattcattccggttgcggcaggaatggctggaggttcaagtgatgcggcatgtgcattatttggaatgaacaggcttttcgaacttaatgttccaatgagagagcttatgaagcttggtgttgagattggggcagatgttccatactgtcttatgagaggaacagcattagctgaaggaattggagagaagcttacaaggcttccggatatgccattttgtcatattcttatagcaaagcctccggtaaatgtatcaactaagcttgtgtatgagaaactggataacacagatgttaagctgcatccagatatagatggaataattgaggctattaagttaaaggatgttgcacttgttgcttcaagaatgggaaatgttttagagtcagttacagtgccgttgtatcctgtcattgacagcattaagaaagatatgatagaacatggtgcaattaatgccatgatgagtggcagtggaccgacagtttttggaatatttccagatgaacaatcaatgatagcctgtcagcagttcttaagacagaagggcgaggcaaggcaggtgtatacaacggaaacatttacaccataatatatgtggaaataatacacattcagagtaatagagaaaggcaaggttttatatgaaaggtgaacttaagatggatgttaatgactatcttccattaagagatgtggtttttaatactttaagacaggcaattctccgtggtgagatggagccaggtgaaaggcttatggaaattcaactcgccgataagcttggagtgagcagaactcctataagagaggcaatcagaaagcttgagctggagggtcttgttataatgattccaagaaagggagcagaggttgcccatataaccgagaaggacatgagagatgtccttgaggtaagagcagcacttgaggagcttgcagcaacacttgcatgccgcaatgttactccggagcgtattgaagagcttaagatggcaaataagagattcgaggcagcaattatatctaaggatgtggttgcaattgtagatgctgatgtgaatttccatgatattatatatgcaatgacagataatcagagacttattcagattattaataacttaagagagcagatgtacagatacagactggaatatgttaaggatgcaagagcacattctattcttatcagcgaacataatgacatcattgataagctttctaagaaagatgaagaaaatactaagattgtcataagacagcatattactaatcaggaaaagggtattatcagacttcttaacaaataatctttagattacacggaggctggctgtatatgccagcctttgttagtttgtaaaattctgtttattatgcaaatatatggatataatcccagatatgaagatatatcagggggtaaatatcatatgaatattaaaaagaaacttggaattctgcttattgttataatagttgtcagtggactggttggttattacagagtgtcttatgcaggaaatttagaggcagttacagaaggcatatctgagagtattataagattccatgtgagggccaacagtgattctcaggaagaccaggaggttaagcttaaggttaaggaagcagtagttgattacataagaccggctctttcagagtcagattctctttcagagtcaagagctatattagaggcagaaagtgataatatcagaaatgttgctattaaaaccttacgggataatggatttatggaagatgtaagcgtgtattttgagaaaagttattttccggttaaatcatacggtgatgtaacatttcctgcaggatactatgaggctttcagagttgatataggtgatgcagagggaaagaactggtggtgtgtgctgtatccgccattatgttttgtggatgcggtgtatggcgtagttccagagaattctaaggaaaagcttgcaggagttcttacagacgaagaatataagacagtaactgacaggggctgtaaagtcagatttaaatatttaacatttataaatgaactgcttgggttataagcagtcagtggaggaaggacgattgaataataaggataaggtctttattaagattaaaggtttatatacgggaacaatggacgaggaagcctcgtgtgatggtgaagaggttgaagtaattgagtcacaggacgatgaggtcgaagttataaatgtcggcacatactcggttgtcaacggcaaggaatatatacggtatgaggaagtatatgatgactcacaggaacggtcaagcagcataattaagattgatggtgacagcgtagaagtgacaaagaaaggcgttgtatctacgaagatgagatttaccatgggcagtaaaaatatgacttattaccagacaccttatggaaatatgagccttggtattataacgaaaagtcttgaaattgaacgaactgaggatacaataagtatatatcttgtgtatggaatggaagtgaattgtgaacatctttcagattgtgatatgcagataacaataacaaccagagaacttagaattgatgaatagtacatttttctttgaaaaaggagtagttatgaagaaacagtttgatgagagaaatcttacaatggtaatggatttttatgaacttacaatggctaatggttattttaaggatgaggacaaggaaagaaaggttgcatttgatgtattctacagaaagaatcctgataatgccggatatgctatatttgcaggtcttgaacagattattgaatatatagagaatctgcattttgatgaagatgatattgaatacttaagaggtcaggggctttttggggaagaattccttgcataccttgctgattttaagttcaggggagatatttattcattcccggaaggaactattatgtatcctaatgaacctgtaatcactgttgttgcaccattacttgatgcacagcttgttgagactgcaattcttcttcaggttaatcaccagtcacttattgcgaccaagacaagaagaatcgttcgttcagctaagggacgtgctgtatcagatttcggtgcaagacgtgcacataacatggatgcagctgtatatggtgcaagagcagcttacatcggaggtgcggttggaacagctactgttcttgccggtcagatgtttaatattccaatcagtggaacaatggcacacagctgggtaatgttctatcgtgatgaatttgaagcatttaagcattatgcagagaattacccggatgcaactgtgcttcttgtagatacttatgatgttgttaaatcaggtattcctaatgccatcagatgtgcaaaggaagtgcttgagccaatgggcaagcgtcttaagggcatccgtcttgacagtggtgaccttgcatacctatctaagaaggtaagaaaaatgcttgatgatgcggggcttactgactgcaagatagttgtttccaacagtcttgatgaatggactattatgtcaatcttagagcagggcggctgcattgacagctttggtgtaggtgagagacttataacagcaaagtctgatcctgtatttggagctgtgtacaagattgcagcagtagaggagaatggagtattccagccaagaattaagatttctgaaaatgtcgagaagataacaaacccgggacttaagaaggtttacagaatatatgacgagaataaaaaggcaatagcagaccttatagcaggtgctgatgaggttgttgacctttcaaagccttaccgctatgtagaccctgtaaagccttggaagaacagatactttgaaaactgcacagcagtagagttacagcagcttgttgtaaagaacggcaagcgtgtaatggacagagtatctattgatgagattaagaagtatgttcaggatcagctcactgataatatatgggaagaagagcagagatttgagaatcctcataaccattatcttgatatgagcccggcatattatgatatgaagatgtcacttcttcataagttgactgactagaggaaagtggcagacggacggggacagggtgtgtatatgctgcatcgtaagacacgcttccgctcgtggaaatgcgtagcggtactaggcgcactgcctcacttcgtgaggtgcgtttgccaagtgccgacgcctttccaacggtcttacactacagcatatgcacaccctgcccccttacgctgtcacttcccctgtccgcctttggcggaggtggggctggcgagagagatttccgcagagagcgatggtgccaaaggcaccaagcaagagtttgtggggaggtggtcggagtgtgtgggtatatgtcattttcagaccgttggaagtgcgtcggcacttagtgaacgcacctcacgaagtgaggcagtgaacttagtgtccgctacgcactttcacgagcgggagcgtgtctggaaatgacatatacccacacaatccgccccacagaccaacacaaaacacttgcaattactgattgttttgatataattaactagtatatgaaaagttaacgaaggagtagtaaatatgccagtttggagtattgttttattgatagttattgctgtacttatagcagcacttgttgcacttactattgtgggtagaaagcttcagaagaagcaggaagctaataacgcacagttagaggctgcaaagcaggttatgtcgatgcttgtcattgataagaagatgatgaagatgaaagatgccggacttcctaagatggtcttagaccagacacctaaggcattcagaggtcgtaagatgccaatcgttaaggcaaagattggaccaagagttatgtcacttatgtgtgatcctaaggtatttgatcagattccaattaaggcagaagtcaaggcagaagtaagtggtatctatattgtaggcatcaagtctgtaagaggtggaaagattgtagttcctgaaaagaaaaagaagggattttttaagaagaataagtaaggatgagaggctgcatcagcggattgctggtgtggtctttttttatgccacgaaggtcaggtgtggatgtgtagttttgcaatgaaaattgggaaatacggacgaaatggctgtttttatatgaattagtaggtttattggacttcgatatattagagaattagggatgaaaacctactaatatatctgatgtgtgcggattagtaggtcgttttgtgaaattgctggctgatttagatgaaatatgagcctgcgtgcctggaaaatacctactaaattcaatttaacttgcaagttagtaggtcattgaagttgatataataaaaaataatgatttattgacatacgaaacagattgaataaggggagttagtaggtttttgccaataagtaagcaaaaagacaactcccaacaagcaaggtttcccaacgggaaaccaaagcaaactgtaaattgggtgaagtgtaaggtcatgatggaggtatgttgtagtttcagaccgttggaaaggcgtcggcacttggcaaacgcacctcacgaagtgaggcagtgcacctagtaccgctacgtcttttcacgagcgggagcgtgtctgaaaggacaacatacctccatcatgaccgcccacttcaaaccaatctacacaagtgccttattttcctcgtacatcttctcaataagatcctgcacatccttggcaagagtttttttctgctcgcggtccatgctggcgacatcgattggcttgccaaattcaaggacagtgtgagtctttttaaagaatggaaggtggtcttctaatgcagcagctgtgttgttctgtactataggaataatcctgcagcctgatttttcagcaagcttaaagcttcctgcatggaaaggaagaacaccatcaatgcttttatttcttgttccttcagggaatataacaattgaagttccagctttaaggtaatcaataccggtaaggatagtctttaaaccttctttcatattctttctgtcaaggaagaggcagtaaagatatttcatccatatattaagaagaggaactttttcaatctctttcttggcaacaaagccagttctgggtttcatgtatgtgtaagaaataattgtgtcgaagaaaccatggtgattgcctacaaaaagtacagcttctccgtctttagggaggttttcaagtccttttacagttgttgtaacaccagacagaaaaagaacaaccttaaaaacaccctgcacaaagcggagacttccgcgatccttagcatcctgattgaacttgccaataagccagaatataggaagcattataaggctggcaaagaatattattattgcaaatataacgattaatatgagtcttatcattgtatgttctccatttcatttttgatattaagttaagcctggtagcgcgagatatctcagctctttacataggcctttgctccactagaatagtgaatttcaccttcattagtcacaaatacagcttcaataccgtcaaggctttcaataagcttcatgccatcatcaagacccagacagaagcaggtagtgcttaagcagtctccggtaagcgaatcctttgatagaatagtaacatcggacaggtcattgtcataagaatagcctgtagccgggttaagtatatgatggtaaaatgtgccgtcatcagcatagaaataccgctcatagttgccagatgatacaacagaggaatcatcaacagaaagagcaaccagcacttcattattggctgcaaatggcttccttacgccgattccaaagttatccgtgttagttttcttacctatacataaaacattgccaccaagattgattatagcacgttttacaccattttcttcaagaaaatctttgattttgtcggcaatatagcctttagcaacagctccgaggtcaaggatgacatcatcaggcttgctaattaaataagtaccatcaccgttatcggacacactgactctggtgtaatcaacatgtgtcaaagcttcggcaatacgtccgctgtcaggaactttcggtgattccgcggtgaagtcccacagtctggaaacgcttcctattgttatgtcaaatgctccattactcaaagcagcatattcaagtccggcacttactaattcatacatttccttagatatgcttgttgtctggttagaattaacctttgataactcgctatcttccttagtccttgaaaaaatgttttcgtagtagtcacacagattaagagcttccgtaagagtattcttagaaacacttgtgtatgagtcaatctgcacaaatgtgtttaacttaaagccgttcacagactccggggtagtcagtgtaactgcaggtttttcgcaggcggtaagcacaaagcccagagccagaataacagtaaacacatatgaaaagcattttattttattaaatttcttcatagaataattaccggaataaaccggcatcctccaaaaattattaacacattgagattataacagtttaacgctgtataaaaaagtgaaattagtgtgaaattacttttatttttttgataaatgtgctataaatataaggcttgctgttaggcagaaatgtttatgtatgtagaaatgaggaagtatatgaaaaagaagttatttagtgtgttacttgtaggtgcacttgcagcatcattagtagcatgtggtaaaacagaagagaaagaagctaaagcttctacagctaacacagagataaatgcagaagagtatgcaggaacaattacatctaatgcaggagtatataagacatttgttaatctttcagactggaaaggaatgtctgttgatcttaaggagtcagattatgttgttcttgattcagatgttgaggattatatcaagagcatgcttgaatcaaaggctacaactaatgttataacagagggaacaactaaggcaggagatgttattaagcttgattacagtggtaagcttgatggaacagcattttcagggggaactgctacagatgttacttacacaataggttcagggaaatttattgaagatcttgataagggacttgtgggacttacagtaggtcaggagactgatattacatgtgtattcccagagagctattacaattcagatcttgcaggaaagacaacagtattcacagtaactgttaatgaaattgacgaatcagttgttccagaacttacagatgagtgggttgcagctaatgctgcttcattaggaattgaggatagttcagttacaacagttgagcagttaagaacatatgtaagatcttaccttgagacacaggcttcatcaagccgttcaagtgctatatttgatgctgcttataaacagatgtctgatggacttgacgtttcagattatccaagcgaagaacttactgatttattaaatactcttaacagtaacgtagatgcagaatatcagtcatatagctcatcatactcttctaaggaggagtatcttaagagtgcatataaatttgattcacttgatgcatttaacgagtatgcagataattatgcaaagcagtatcttttacagaagatgattgtaactatgatagctgctgataacaatatcactgttactgcagatgatattaattcaacaggtgaggagcttgcttcatattatggttatgatgactataatgatattcttgatacttatggcaagactatgaattcagagattggatatcaggttctttatcagaagatagttgattttgtgtgtgagaatgttacggttaacgatacaacaaatacagcagagtaattcgtgattaagttaatatttaatgtttgacaggactaaggttgcacagcttttaatgggtgtgcagccttatttattcttattattttcgcattaaaacgggatttacatatatgagcaggcggattctgcactattaataatatgagaaatgtggtaaaaccacttaaggggaaaacaatgaatcaattcgtaccaaagctttttgatgttatgaaaggctattctaagaagcagtttgttaatgatgttattgcaggtattatcgttgcaatcatagcgttaccattatctatcgcacttgcgcttgcatcaggagtaggtcctgagcagggtatctacacagctatatttgctggttttgttatttcattccttggcggaagcagggttcagattgccggaccaacagccgcatttgcaactattgttgcaggaattgtggcacagaacggaatggatggccttattgttgcaacaattatggctggtatcattcttattatcatgggatttcttaaatttggtaatcttatcagatttattccttatacaattacaactggatttacatttggtatagcagttactattcttgtaggacagattaaggatttcttaggtcttgatacttctgcatatactggaccaactattgagacacttgataagttaaatgcagtgtttaaatgtattaacacatttaactggcaggctcttgttgtaggtggtgtttcacttgcaattcttataatatggcctagattcaagaagttagagaagattccagcatctttaattgctgttatagtttctgtaattatggttaaacttggaatgcaggctaagactatcggagatttatatacaatttcaagcaagctgccgggtatcagcataccacatgttaatataacaatggttaagaatcttttgccggatgcatttacaattgcagtactggcaggtattgagtcacttttatcatgcgttgtttctgacggtatgattggaagcagacataagcctaatatggaactcgttgcgcagggtgcaggtaaccttgtatctgctttattcggtggaattccggcaacaggtgctattgcgagaacagcagctaatgttaagaatggtggacgtacaccaattgctggtatggtgcattctgtaacacttcttcttatccttgttgtgcttatgccatatgcagcatggattccaatgccggcaattgcagcgattcttttcatggtagcttataacatgagtggctggagagaaatgatttctctttgtaagacttcacctaagagcgatattctagttcttcttacaacagcagtacttactattgtatttgaccttgttgttgctattgaagttggtgttgtgcttacagcacttcttttccttaagagaatggctgatgttacagaggttaagagctggaaatatattggtgataatatagatgagaataatgatcctgacagtattaatcttaagcaggttcctaaggatacacttgtatatgagattaacggaccaatgttttttgcagctgcggacaagttccttgatatccagacagtatcaggttctaaggcagttattgtaagaatgagaggtgttcctgcaatggatgttactgctctcagatctttaagaaatattcatgcagtatgtaaaaggcatggcgcagttatgattctttcacatgttaatgaacagcctatgtcagtcatggagcatgctggttttgcagatgagattggaagagataatttctgtgccaacattgatgcagctcttgagcatgctaaaaatattgtagaagggtaatgctaaatgaaggaagatacactttcctatataagaaataataaagagattacatttgaacagaagataagacttgtaattatgctgagtctgcctacgattctggcacaggtgtcatcaattataatgcagtatattgatgcgtctatggttggaagactgggggcaggctgttcggcttcaataggtcttgtatcgacaacgacatggctgcttggaagccttgcttctgcaccatcacttggattttcaattcaggtggcacagcttgttggggcaaagaagtttaacagggcaagaagagtgttcttacagtcatttggaatagttcttcttatatcaattattattggtgctgccggagccatgataagctggggacttccagcatggcttggtggagaagagtcgatacacaaggacgcggcaatgtattttcttataacatcattgtctatgccggcattaggatttaaccgtcttggtacgagaatgttacagagctgcggcaatacgaagacaccgggaattcttaattccatgaactgtttacttgatattatattcaattttatattcatatttagttggcatggttttggctttggtcttggagttatgggtgcagcacttggaacaacggcggcacagattgtcaccacaattattatgttttatgtattgatgttcagaacaccgatgctttctaagggttacggaacagattctgatgagaaggcaggtcttgcgacaataaagaagtcatttgttttatctcttcctgtcacatttgaaaatgtagttatgttcggagctatgattacgataacaagaattgttgcaccattaggagttgtggctgtggctgccaatgcatttgcaataactgctgaaagcctgtgctatatgccagcttacggaattgaggaggctgcaacagcacttgttggacagagtatcggtgcaggcagaggaaagcttgcgttgtcttttggaagaatttcagttgctttcggaatgggaataatggcgttcaccggacttctgatgtttatatttgcaccgtttatgattggaattcttacacctgacccggcagtaagagagcttggagtaactatacttagaattgaggcatttgcagagccactgtatggcgcgtcaattgtagtaacaggtgtgcttcgtggagcaggagatactcttgtttcaagccttatgaatttcttcagtctctgggctgttcgggttgttctttcattccttcttgttggaagttacggacttgttggtgtgtggatagcgatggcggcagagctttgcttcaggggtacgatattccttgtacgcatggagcggaagaagtggctgaagaaggtgtgatgacgtgaagatgtgagctgatgctggatgcgatagtagcagagtggtgcgaaatggctgatttcaatatcataatttaacaaagacctactcagatggcgttagttagtatctgagtaggtctttgtcattttaaaagtaaataaatttgttgaggatacctactaaataatggcacgagccagattgtgtaggtctttttaaggaatttataatgattcaccggctggatgtaaagatgaagcatgaaaaagacatactaaagggtgaagtattattaatttagtgggttttgtaaaagatattatgtcaaaagatgaaaaaacaacatactaaattgagtgatttcaagcttttagtgggttttcgccagtgatgacggcagaaaggctgaccaaattccgatataaagatgacaaaagtagcggtcaaataaccagaagatttactggttatctgaccgccatttaaattcagcattatatataattgctaataattaaccaagatacttagcaagtacatcaaccttgtcaagcttctcccaagggagattaagatctgtgcgtccaaagtgaccataagcagctgtctgcttatagataggtcttcttaagtcaagcatcttaatgattccgttaggtcttaaatcaaagttctcacggatgatttcaacgattttttcttcatcaagctttcctgtgccaaatgtatcaaccatgatagatgttggtcttgcaacaccgattgcatatgaaagctgaatctcacatctgtcagcaagtccggcagcgacaatattcttagcaacatatcttgcagcgtatgcagcagaacggtcaaccttagtgcagtccttaccagagaaagcaccaccgccatgtcttgcagctccaccgtaagtatcaactataatcttacgacctgtaagacctgaatctccgttaggtccaccaattacaaaacggcctgttggattgatgtatatcttagtgtcagcgtcaatcatagaaggatcaacgattgcatcaataacatatttcttaatatcctcatgaatctgttcctgagatacttcaggagcatgctgtgatgaaacaacgatagcatcaagtcttattggctttttgttttcatcatattcaactgttacctgagtctttccgtctggtcttaagtaagaaagagttccatctttacgaacctttgtaagctgcttagaaagcttttgcgcaagtgcagaagagtaaggcatgaattcaggagtttcgttagttgcgtaaccaaacatcataccctgatcgccggcaccaccttctgaatcatcaatctcgccatcctttgcttcaagagccttatcaacacccatagcaatatcagctgactgcttgtctaatgcaaccataacagcacaggtgttaccatcaaatcccttatcagagctgtcataaccgatatctgtaactgtctttcttacgatagaaggaatatctatgttagccttagttgtaacctcgcccattaccataataaaacctgtgttagtaagagtttcgcaggctactcttgagtatggatcctgctcgtagagagcatcaagtacggcatctgaaatctggtcacagattttgtcaggatgtccttctgttactgattctgaagtaaataatcttttttccatgttatctccttttgattttatcgtgaatatgtctatcccataccttatcgtgtctattcttatcgttactcgtgcttgtagcaaaatgccagaactgcaatgttactgctgctcgcgctcgcagctcagatgccagaactacattctggcattgtcgcggtgctcctcgaatccaaacgcatatgtcccaattcatgcaagcatgattgtgtcatatacgttagaattctcatcgctgctcgcacaaaaaaaggtccccgacaagggacccgatagactgtatcgaaatcctcttattgttcgactaatatcgctcaggttggcaccttcctcaaaaggggttgccgggcttcatagatcctatgtatctccaccgctcttaataagggatataaaatattcaattaatattaccgcataagatactacacaatatttaaacattcgtcaagagtaaattgacaatttctatatagaattttataattaaaatacatttttacagacaaatgtatcgtgaatactgggggaatgagtaatgacagataagacgatattcatatttgacgcacaggaaggcgataaactcgcagatgatgtacatacgccagatggtaatatattagcaaagaaagataccatacttaattatgatataatagcaaatatttcagggcatcatatactggaagtaaaggtatacgacaccaataatgaactgcaggatctggaaaaggttctgggaaaaactgctaataaagagaacgttaagtattttgataagataagagcaagcataaggtttaagcattttaaaaagacttatgatgagaatattctggatatcaaaggaggacttaacgatgttgttatgaataacagtcccattgatatagataagctgatagaaggaactaatgagattcttactgcgaacagaaatagtttacagctttttgatatgttgcacagtatgaggcagtttgatgaccttacatatgttcatagtgtaaatgttgctttgatagcttcaattcttgggcaatggcttaagtttagtgagaaagatataagaatactgacaataagtggacttcttcatgacataggtaagattatgattcctaacgaaattcttacaaaacctggtaagctgacagttgctgaatacaatataatgaagcagcatgttaactttggatatgagaaagttaagaatcagaacattgatatacgaattaaagaggcatgcctgctccatcatgaaaaatgtgatggaacagggtatccatttggcttaaagtcggatcatattccagcagtagccaagattatagcaattgctgatgtgtatgatgcaatgacttcagcaagagtatatagaggagcattatgtccttttgaagtaatagatacaatgtataaagatgcatttacaaagtttgaacctgaatatattcttcctttcttaaagaatgtggcatcatcgtatattaataacgatgtgagactttcagatggaagaattggaaaggttgttcttattaatgagaatgcactcagtctgccaattgtccagtgtgaagatgagtttatagacctatccaagacacgagaactcacagtttctgcaattttataaaaaactatctggcacatgcgtggaggtatttttctttagtagccatacctccgcggatgtgtctttcttgtttattgacatcaagaacctttctggcttctttggctagttcaggattgatttccataagtcgtgcagttacatctttatgtgcagtgcttttgcttacattaaatactttggctgtctgtcttacagtggctttatgctcaattatgtaatatgccagctgggtggcacgttcttctatatagtctcgcatgtcgggactccggaagtttcatttatacaatctatgccacggattggggttttatgttagaatgtgttatgactatgacaaggaatcatttacattatatttttaatttctccgcaaacataagaagtacgctgattgaaagcagtgcacttgaaatccatattgtgtggattccgaacagcattgaaaggtttccaccaatacctgcgccgattgcaaagaataatattatgccaaaataatatccggctttcttaagagatgttttattgccagtacgcacaaatactgaaagtgcgtctgtaccgcttcttaagttaccgatgcacatggtgcttgcataggaatagccattgacttttctaaatgcctgtacctgcatagcacatgagaacgatacgattattgttgcaaacatgtccattgagtggggcatgaagccaactgcaattaagataataatttcaataagtaatattgcctgccgccagtgaagtctggtagcatttttgtatttgccctgaatccgctctgttacgaatacgccaagaccaaatgctaagaatggcagaagatattttaatccctgataccattcacccatcataaaatgtgtactcataagaaccacattaccagtctgtgcgttggagaatacttcatttcttgtaaaatatgtatatgcatcctgaagtccaccggacatggcaaggaatacgcagtttatgaaggcttcggacatctgtatatccggaagcttcttagcgagggcgttgtgaagctttgatgccataaataacctccttgtgttttataactttggttgttatagcacaaggaggttttgttgtaaagggtatataaatattagatatgttgcgaattactttccaagtgctgttttctgaggcacttctgtttctttttcgtagcatgcaaatgcgctgtcaacaagctctttatctggcttcggtgtaaacaggctgactacaggaacgataatcattccggcaaacattgcaaatgcaccgcagttgataggtgactggagccatgttgggaagcctgctctgaagaagatgttggcaagcataagtactgagctgaataaaaagcatgcccagcatgatgctttggaaaccttcttagagtaaagcgagaacataaatggtgcaaggaatgaacctgcaagtgcaccccaagatattcccataagctgtgcaataaatgttactgaactcttgtactggataagtgcaagtattgcagatatcgcaatgaatacaacaacaagaattcttatgtataatacctgtttcttttcactcatgttcttgataaagttatcttttaagaagtcaatagtaagtgttgagcttgaagctattacaagtgatgaaagtgtagacattgaagctgacaacacgagaattacaactaatgcaataagcgcaggacttaaattagaaagcattgttggaattattgagtcgaagccgttagccttgacatctatctggtcagagaataatcttccgaaacctccgagaaaatagcatccgcctgaaactataagcgcaaatattgttgatattacagtacccttctggatagaagcttcattatcaattgcatagaatttctgaaccatctgaggaagtccccatgttccaagtgatgtaaggattacaacgcataaaaggttgaatgggtcaggtccaaaaaatgaagcaaatataccgggagtatcgcttactgccgggtcagacacatttgcaagaccctgcagtgctgacatgaagccgcctttagagtggattacggcagcaataacagcaacgataccgaataacatgataattccctgaatgaaatcattgattgcagtagccatgtaaccgccggcaattacatagatggcagtaagtgttgccatgattatgatacagacgctgtaatcaatgttgaaagccataccgaaaagtcttgaaagtccattgtaaagtgaagctgtgtatggaatcagaaaaatgaatattataacagaagcaccgatttttaatggattgcttccgaatctctttccgaaatactgtggcatggttgctgaatcaaggtgttgactcataattcttgttcttctgccaagtacgacccatgcaagaagtgaacctataattgcgttgccgatgccagcccaagttgcggcaatgccgtatttccagccaaactggcctgcgtatccaacgaatacaacagccgagaaataagatgttccatatgcaaatgcggtgagccacggaccaacgcttcttccaccgagaacgaaaccattaacatcagttgcatgcttgcggcagtataagccaatgcctatcagcaccgcaaagtagataataagaataactagttttaacataaaaacccccatattaaatgtattatagattacttcacaggtttaaagtgtaacgctttaaaccgataaagtaaacataaatgaattgtagcatattggggagggattagcaaggagaaaatgagttaatatatatgagtatatatgaataatatggatatacctactattatgcctataatatgtcattgagtaggtttgcttgagagaattataacctgatgcggagggagcaaacctacgaaacagctgtgaatagctttttgagtaggtctttttcctggatttttctgaattagaggctcttaaagatgaaatcttcgataaagtccatataatggtgtaaattacaaatttatataaaaaagagccgagagctcatctttcagttataattaagttaccacacaaaaacataattgaaaggatcctttcaattatgtttttgtgtggtaacttaattataactgaaagatgagctctcggctcttttttatataaatttgtaatttacaccattatatggactttatcttgccaataaaccagcactcaataataacagtcatgcaaagcaattgacatgagtaagacatactaaaactacatagattgtggtttgagtaggttgttttgcaggagttatggcaagttgaggactgaaagacctacgaaaaaagcaatgttaaagtatttaataggtcttttgccagcatagggcactcataatcaagcaagaagcaagaaaaagacctatgaaaaagcgacaaagcaggtaaatagtaggtcagcaagcaactataacaacaaaatgacaagctaatgaacctacgaaatgatgaagttgacgacttttagtaggtttatatttttttaaacattgaaaaattgtcaaaagtgaagccagaagattaaaaattagcaggtccactcacatttctttgctttttcaataagtaaggatgtggtataatgtgcgttagcattgagccgtgccgtatgcagcaggcaagcagtgctgtgctggcacaaagcacggaatgcatgatgcatacgatagggcgaaagcctgacatgcacggcggacagccggggtgcaagcagcaggcaagcagtggtgtgcttgccctgacatgcacggcgaaacgaggaaatatagaaaacaggagaagattatgaaagagaatcttaagaagctggctaaatactacaagccgtatttaggcacatttatacttgatatgatactggcaatgatgtcagcagctgtggcacttgtgataccacttgttgtaaggttcattacatcaaaggttgcatatatgagtgccaatgaagcactttcaaggattatgattattgttggagtactttttgtgctggtgcttatacagtggggctgcaactactatatatctaattatggacatgtaatgggcgcaaagattgagtacgatatgagggcagagatattcaatcattatcagaagctctcatattcattctatgatgaccagaaggttggacagttattgtcaagaataacatcggatttgttcgatattacagagcttttgcatcatggacctgagaatataactatttcactgattaagataattggtgcattatgcatattaagttcgattgacttaagacttacgattgccgcatttgtgctgattccgttcatgcttgtattcgcgtatgtgcttaacaagcgcatgaagagagcatttaagagaaacagggtaagaatcggtgagataaatgcacagatagaggacaatctgtctggaataagggttgttaagtcatttgcaaatgaagatattgaatgtgagaaatttaagaaggggaatgacttgttccttgaatctaagagagacagctatcattatatgggaatgtacaatgcgggacttactgcatttacaacaatgataaatgtaatcgtaatcgcagcaggcggtattggaattgcaaagggctgggtaaatattacggatttcgttacgtttttactgtatataaatatttttacggagccagttaaggtgcttattgatttcacagagcagttccagaatggctattcgggttacgaaagattcttagagattctttcagtagagccggaaatagctgataagcctgacgcaaaggaacttactgatgtgaagggtgcaataacatttgaaaatgtgtccttcagatataaggacggcgtggacgaggtgctttccggggttaatctgtcagtaagaccgggagaatatgttgcacttgcaggtccttcgggagtaggaaagacaacactctgctcgcttattccaagattttatgaggtgacgggcggttcgattaagattgacggaacagatatcaaagatgttacacttaaaagcctgcgtgaccatatcggagttgtacagcaggatgtgtatctgtttatgggtacaattaaagagaatataagatatggaaagcctgatgctacggatgaagaagtaattcaggcggcaaagcttgcaaatgcgcatgattttatcatgagctttgagaacggatatgacacagatatcggacagcgcggagtcaaattgtcaggcggtcagaagcagagactgtcaattgcaagagtattcttaaagaatccgccaattctcatatttgatgaggcgacatcagcacttgataatgagagtgagcagattgtacaggaatcacttgagaagctggctaagaacagaaccacatttgtaatagcacacagacttacaactattgaaaatgcggaggaaatcctgatgcttactgacgagggcatcaaggagagaggaactcacgaggagcttatgaagcttgatggtgagtatgcaagaatggttaagatacatagcagaacataacataccagtttacaatgtttatatgcaatgctattatataggaaacgttggaaggaagatgataatcatggacagaacaagaagattgagaatgaatgcgacattaagagatatggtaagagagaatcatgtaagggtggacgagcttatatatcctgtatttgttacggaggagaacgatgtaatacaggaagtaccatcaatgccgggaatatgtcagtattcgcttgaccatgttcttgaagaaatcggacgtgctgtagaggttggaattaagggaattctgctttttggaatacctgtacataaagatgaggtcggaagtgaggcatatgacgagaaaggtgttgtgtgcagggcaatccgccttattaaggatgcttatccagagcttgttatcatggttgatgtgtgcctgtgtgagtacacatcacatggacactgcggacttgtaaaagatggcgttatattaaatgatgagacactgccgcttctagcaaaggcgtcagttgcttatgcaaaagcgggggcagatataattgcaccgagtgacatgatggataagagagttgaggcaatcagaaatgcacttgatgaggcaggactggttaatattcctatatgttcatacagtgccaaatttgcatcaggatattacggaccgttcagggatgccgcacattcagcaccgggatttggtgacagaaagacatatcagatggatccggctaatggaaaagaagcgttaagggaagttgaagaagacatattagaaggtgcagacatgattattgcaaagccggcactcggatatatggacgttatgaaagagatagcgcttaacttcaatattccaattgtcgcttacaatgtaagcggtgagtatgcgatggttaaggcagcagcaatgaatggctggattgatgagaagaagattgtaatggagaatatgacaggctttaagagagccggagctaagatgataattacatatcatgctatagatgtggcaaaatggttaaaggaagagtaacatttttagcagtatttaattaagcaggaggagctggttttatgaatgaagagatgtcaaaggatttatatgagagagcagtaaaacatatgccgggtggtgtaaacagtcctgtcagggcatacaaggcagttgacagagtgccaagattcatagcttctgccaagggagacagaattactgatgtagatgggaatgaaatgattgactacatatgttcatggggaccgggaatattaggtcatgcacatgacagagtaattgcaaaggttaaggaagctgcggaagcaggccttacatatggtgcaccaactaagagagaagttgagatggcagagcttatatatgagcttattcctacaatggaggtgagtcgtcttgtaagttcaggaacagaagctgttatgagtgcaatccgtgtggcaagaggctacaccggaagagacaagataattaagttcagaggctgttatcatggacattctgacggacttttagtaaaagccggttcagcagcgcttacaacatcagttccggacagtgcaggagttcctgctgattacactaagaatacacttgtagcagagtacaatgactgcgattctgtgaaggagctttttgataataataaagatgaaatagccgcggtaatagttgaacctgttgcagctaacatgggagttgtgcttccaagacatggatttcttgaattcttaagagacataactaaggagaatggaagccttcttatatttgatgaggtaataacaggcttcagactttcaattggcggagcgcaggagtactttaacataaagccagaccttacaactcttgggaaaattgtaggtgggggtatgccagtcggcgcatatggcggacgagctgacattatgcgtatggtaagtcctgacggccctgtatatcaggcaggaacattgtcaggcaatccaattgcaacagcagcaggcttagagactttaagaatcttaagagataataaggatatatacgacagacttgagactaagacaaagcgtattgctgacagtgtaagaaaatgtggagccggaagggtatcggttaatcagattggttcacttatgagcatattctttacaccagatgcagtagaagattatgacagtgcagtaaagtcagacactaagaagtatgcagaatactttggacatatgcttgataacggaatatacattgcaccatcacagtttgaggcaatgttcgtatcagatgcacacactaatgaagacatcaaccgtacaatagaggttatggaagaatttttcagaaaataattcgtataataagtgagaatacagatgcagttaggatatgtaggaattaattataagaatacagacctttcagtaagggataaaattacatttacagacagcgggatagcagactttatgcagcaggcagaggaagcaggtgtgaaccagtgcatgtgcctttcaacatgcaacagatgcgaagtgttttatctgtatgaggatgaaacatttgtacaagtaatgtccgatttattcaatgattattttggacttcctgatactaaattagccggtgtcaaatgtggtgaagaagcactggtatatctgttttgcatagccgccggacttgaaagcatggtgcttggagaggatcagatactaggtcagttaaaggatgcggcagacctttcaagaacgcttggacacagcgggaaagagcttaattatatagtaagagaagcggtaagctgtgcaaagcggattaagacagagtacaaggtaagtgaaaaaccagtatctgtatgctatgtcgggattcaggagttagacagagtatgtggcatatcaggaaagcacgcgcttgttataggaagcggcaaaacagcggctcttgctataagatatctggcagaatatggcgctgatgtaacagtgtgttcaagaacttatcagcatgcgaaggcgttgcttaaggagttttcacagattgaggttattgcatatgataagaaaacagaagcacttaaaagcagtgatatagttgtctcagcgacttcatcacctcatctggtgattagagcttctgaattatcagagggtaaaaagatgacacttcttgatcttgctgcaccaagagatatagaaaaatcggcaggtgacatttgtggagttactcttattgaccttgacaggataggtgggattgtgaagtctaatcagaacgagagggcacatttgctaaaggaaagccagtgcgtgattgatgagtatatagcggaaacaaagaaatggctcacatcaagcagaatggatacaactatccagtcacttggcaaaaaatgtgatgagatagtacaggacagctatgattatcttaaccgcaagattgacctttcagaccatgacagggtaatcttaaagaagattcttaagtcgtcactacacagattgttaaaagaaccgattgaagaattgaaaaatgtggaagaaaatgaacagcaacagtataaagatatggttgagagactgtttggcttgtagggaggattatgcattacagaataggaacgagaggttcgaagctggcacttgtccagtcggaatatgttaagagaagaatggaagaggcgtatcctgaggatacatttgaacttgttataattaagacaacaggcgacaaggttacagataagccgcttgctgcgattggaactaaggggctttttgtaaaggagattgaggaagcgcttctttcaggcagcattgatatggcggttcacagcatgaaggatatgccggctgaatgtgcgactggacttacatttgcaaaggcgtggaaacgagaggattgcagagatgtacttatattaaagactgcaggaagtttttcagaacttccttctggtgcggttataggaactggtagcctcaggcgtgcatgccagcttgcaatgctgcgtcctgatatccggtttactgctatcaggggaaatgttgatacaagaattaacaaacttagggacgattcatacggacttgacggaattgtgcttgcggcagcagggcttaacagacttggcaggtcacctgagataacagagtaccttgacccggaggttgttattcccgcaccggcacagggagttcttgcgattgaggctgcagaggtgaatacagaacttcttgataagataaatgctttgtcagatgataattctgatagagaagctgtggctgaaagaacatttttaagattaacaggtggcggttgtcatgccccggttggcgcacattgtgtaaccaaggaaaatggtgaccttcgaatggttgtgttatttggcaatgatgattgcagtaggattcttagaattgaagttacaggaactgacagtgaggcggttggccacgaagcagcccgtatgctaggattggagtagattgtgggtaaatacatatatacatatattgaaaatggacagatgtacgatgaaagcccttcccttgcagaattacttgcaaaggaggggtttttctgcgaaaaaatagtaactggcaggattgaatacataaagattaaagattttgagacacagataaaagatgcacagtggcttgtgtttacaagtaaaaatgctgtggctgggtttgcttataatgcaggaaacgtggtacctgcaggagttaaggttgctgttgttgggaagaatacgcagaatgctataaggacagcgtgtgggattgaggcagattatgtttcgtcaaaagctacaggattggcgctgggagaagaacttatgaatattgcgtcaggcagaattgtgtatctgtgtgccgaagtcacaagcggttcacttgaggaagctatgaaggagtatgaaaacttaattaagattccggtatataggaacgaacctgtggattatgattgtatggaatacgacagcaggaattgcggagatattgatgggataattgttacaagtggcagcagcggggagcgtataaaatggctgattgacagacttgatgatgttttggtgtacagcattggcccggcttgcagtaagaagcttatggaagctggaattgtgaaaaaacgtatagttgaggcagaaaagcacacatatgacggactggtggaagttgtcagatgcagagccgacgaaaaacctttgaataatatatgataataatacaataagtatatttacaatgcaatatatctatgatactatatgtatataaatatgcatgtttattaattcagaggaggaagaaacactggtgttgtatatattatggagattaaagagaaggaagattattatgacgcagccatgcgtcagattaaaggagattcatggagcctgagtgcatatgggtatcttaagagtaatgaagaatggattggaaggtatgaggattttctaaagggaaggaagtcgctgccgttattgtatgacccgttctttaagaagatatttaatccggttgagagaagagacaggctttcagagctggtgagttgtctgttggggcagaaggttactgttcttgaggtgttcccgaatgaggattcacagtttcttggagtgatgattattatggatatggttgtgatgatgtctgatggaagtattgcaaacattgagattcagaagatttcttatgactttcaagcagagagaatatcgtgttactcggcagatcttgtgctgcgtcagtataagatgattactggaaatcgggagataggaggtgctggaagtgatgggggttcaatgaaaggttcatcaaaaccttcgtataaggatatgcgaccagttcatactattattctgtttgagaacagtagcagcagccttatcagcgaggttgataaggcattatattttcatgttggcaagacgaaattcaatactggaattaagataaaacttttgcaggattatgtgctggtaagccttgacacatttaagaaatacagatattctgatataagaaaagggcgtattgaagtgacgaaatacgattatgacagaacgcagtacagcgaaaagcaggtgacagataagatgaagcttgatcgtttaaagtacctgtcgttattcgtagctgagacaccagtggagatagagcgattaatagagatatttcctgacttgaaatcagtacgccaggatattaatgagtatttggagagaccgagggaggtgctcaatatgttttctgaggcgttaaggatattagacaggaatacggcggagctgatggttgacaggatgaaagatgagatggatgagcttaaggtacagaaaggtaaattggaagcgcagaatggagaacttgaagcgcagaatgaggctcttaaagcatcctttaaggaaaaagatgctgcaattgaagcaaaagatgctgaaatagaaagattaaagaagttgctagaagaacagaataagtaattattacagatgcagttatcatgatggagtggtaactgcatttttcaaaagcagagaaaaataaaaaagtactgtacaaaacaaaaacattgttttataataacatacaaacatagtatgtttatgtagcacataaacataacaacagattcatgaaatgttttcatgaattgatattagaaaatgtggaataataccacaagaaaagaggattgtatgggaaagatatataaatcagcagcagacttaataggtaacacaccacttgtagaagttggacatattgaagagaagttcggacttaaggcaagagtacttgttaagcttgagtattttaatgcaacaggaagcgttaaggacagagttgccaaggcaatgattgaagatgcagaggggaaaggtattcttaagcccggtgcaacaattattgagcctacatcaggcaatacaggaatcggacttgctgccattgcaacagcaaaaggctacagaacaataatagttcttccagagactatgagtgtcgaaagaagaaatattatcaaggcatatggtgcagagattgtacttactccgggttataagggaatgactggtgcaattgccaaggcagaagaattaaaaaatgagattaaaggcagcatgatagcaggacagtttgttaatccagcgaatccggaagcacacagaagaacaaccggaccagagatatggaatgatacagatggagaggtagacgcatttgttgctggagtcggaactggtggaacaatcacaggagttggcgagtatcttaagtctaagaatgataagattgagataattgcagttgagcctgcaacttcaccggtactttcacagggcaagccgggaccacataagattcagggaatcggtgcaggatttgttcctgaaattcttaacactaagatatatgacagtgtagttccagttgagaacgatgatgcatttgaatatgccaagttaatctctcacacagagggaattctggttggaatatcggcaggtgcagtactttacgcagcaatcgagtgggctaagaagccagagaacgaaggtaagacaatcgttgcactgcttccggacagtggtgacagatattactcaacatcactttttgagaactaataacagaataaatgtgtcaaatgtggacattctataagggcagggcgcaagtcctgcccttttcgtgctttgacagggttagtgaaattgagagctgcttttggctgattcagagtgcgggtgaaaatgtgccagtgaaaggagcaagcatgactgattttacaactaacatagacatgaatgtccgcatgatgaatgagaagttaagagtggacagaaattttgacattctgcaaagagatgtattaataggtggtaagagaacacatttttactttatagatggattcgtacaggaggaaacaattgaaaaacttgtgcagttcttttattcattgaaagaatcggacataaaggatatagatacattcttagaggtcggaatgccgtatacagagattgaaaaaaacggacattacgatgaggtggagaaggcatttctttcagggcagaccgtcatgataatagatggctttgacgaatgtatactgattgactgtcgtacttatccgatgcgttcagttacagagccttacaaagacaaggttctgcgtggctcaagagacggatttgttgagacacttgtgtgcaatgcggcacttttaagaagaagaataagggatagccgcttttcaatggaaatgtatactgtaggggaacgctccaggacagatgttgctgtgtgctatattgatgataaggttgataagaagctgcttgaaagaattgagaatctgataagcagcatagaggttgaggcgctcactatgaatatagagagccttgcggaatgtatgtttaagggaaaatggattaatccgtttcctaagtataaatattccgaaagacccgataccgctgcagcagcactttttgatggaaatatagttattatggtagatacatcacctgcagtaatgataattccaacaaatgtatttgatataatagaagaagcagatgattttaatttttcaccgatgataggaacttatataagactttcgagatttttctttacactgcttacggtttttcttacacctgtgtggcttttgcttgagagcaatccacagtgggtgcctgaatggttgaaattcataacgataagtgaggatataacggttccggttatattgcagctttttattcttgaacttgcagttgacgggcttaagctggcggcggtcaatacaccaggaatgctgtcgacacctttgagtattcttgccggtattgttgtgggagaatacgctgtggagtccgggtggtttaattcagaatcgcttctttatatggcagttgtaacggttggaacttactcacaggcaagttttgagatgggatatgcattaaaattcataagaatagtcaatctgattctggtgcagttctttggaagaatcggacttctggcaggagtcatatttgcaatagtgcttgtatgctttaacaggacaatatcaggaaaaagctacatttatcctgtgataccttttaacagccagatgtttaaaagaaaaattcttcgggtacgactgccacacaaaataaaaaataactagcaatatatggcgtattaagtattaaaatatgacttaacacgccatatattgctaattaattgcaaatgtgatacaatacaaaaaacatttgaataagatatataagatttatggatttggagatgtttaattatgattagtgattatgaggaagttgttatcaggtttaaggcatataggataagttatccattaacacagaaagaactttcggataaatcaggcgtttcattaagaagtattactcggtttgaaagtggagaagatataagtcttgttaattttatgaaattaatgaatgcgatggagcttatgaataatttcgtgaatgtgataccagatatgaacaaccggccatcatcttatttgaaaaatgttaaaacaaggcagagagcatctgcaaaaagaaaagcagatactggatttaaatggggggaagatgaatgataaatacagcggaggtaatgctttggggcacaagaattggaataattcatatgaatgaagcaaatggggttgttgcatttgaatatgataaagattttttaaagagtaatattgaggtatcacctatacatatgccattatcagaaagagtgtatgaatttccggaacttgcaaggacagcatttcatggagcacctggattggtagcggattcacttccagataaatttggtaataaaattatagacagatggctggctgagcagggaaaatcaattagtgaatttaatgttatagacagactgtgctatacaggaaaaagaggtatgggtgcattagaatatataccagcaacaagtccgtttgacagtacaatagaggatgttaatatatcgaaaatggtagagtttgcatctgatgtattatctgatagaaaagataagctgattaatctgaaagataatgctggatatagccagcttgtgctattgggaacatctgcaggtggtgcaagagcaaaggcgctgattgcatggaatgaagatacgggagaaataaaaagtggacagattaatgctggtgatggatttgaatactggcttatgaagtttgatggagtatctaaaaatggggatcataatctggaagattcagtagaatatacaagaatagaatacggatattatcttatggcaaaagcagcgggtgtaattatgaatgaatgccgtctgcttgaagatgccggatatgcacattttataactaaacgtttcgataggaacaataataaaaaaattcatatgcagacattaggagcaatttcacatatagattacaatattccgggattatgcagttatgaacaggcagcatattatatgaatagactaggtataccatattcagatgtggaacaattttatagaagaatggtttttaatgttattctgattaatcaggatgatcatgtaaaaaatgtttcttttctgatggataagaatggtgtctggagattgtcaccagcatatgatgtcacatttgcatatgacagcagcaatatgtggttgaaagcacatcagatgcttataaatggaaaaagttcagatataagttatggtgatttgataaaatgtggaataaacatgggagtaagcaagagaaaatgtgatgcaataatatcgtatatagaagatgttgcaaaaagattttcagattatatggaaatggcaggtgtcagggagaaaacctgtcagattatgaatgacattataattagcaataatattagaaaaacaggagattaatcatggaaaaaacaaacgagaaaaaagattttttacagaaaacatgggtggtgtgcgcccttgcacttgtgtgtacattcctttggggaagcgcatcgccttgtatcaaattaggatatgcgctgtttaagataccgtcaagtgaaacatggacacaggtattatttgcaggaacaagatttgtttttgcaggagtgcttacaatcttaattggaagtattcttaacagaaaaatgctgcttccaacgaaatcaagtgtaccaaacattgtaaaactggcaatgttccagacaattctgcagtacatattcttctatatcggacttgcacataatagcggagtgaaagcgtcaataataaatggttctaacacatttttcgtaatacttgtatcgacaattatattcagacaggaaaaactgaatctgaaaaaaataattggctgtgtgattggttttgcaggtgttatagtagtcagcatgaatggacagaaaatcgacatgaacttaagcattatgggtgacggaagtctgttcttatgtgcgttgtcatatgcattttcatcatgccttatgaagaactattcaaagaaagacaatccggtaatgttgagcggttatcagttcatattcggtggaatagtaatgattatattaggacttgtgatgggaggtagaattacacacgtgtcagtatcagcaatactcatgttattctatctcgcatgcatatcagccgtagcctactcaatatggggaatactgttaaagcacaacccggtatctaaggtggcaatcttcggtttcaccaaccctgtattcggcgtgcttctttcagcatggtggcttggagaaggaagcagagagcttggaataaatgcattaatagcgttagtattagtgtgtataggaatctgcatagttaatgtaaaaggaaagaaagcagagtaaattcctatctggattaatgtaaatgttgtaataatcatcagctaaatggtacaatattatcagttgcagagtaaatatagcggattttatagagaaggaaaaatgttatgaatgaagatatttttatgaaaagattaaaagagcgtttacttatagaatttaaaaagcaggatagaagcggtgtgtatggatatacgcagagaagtatggcatataattcgaacagaattgagggaagtactcttacagaaaagcagacagcatctatgttcgaaacaggtacattatatactgatgatacagaagtaatattccggactaaagatatagaggaaatgaacggacattttaaaatgttcaattatataatgaaaaatatagaagcaccattggatgaagatctgattaaaggtatgcatagaaatctcaaagaaggcgtgtttgaagattttgcaaatggttatgctataggagactggaagaagagagaaaacagagtaagtgatattaaggtggctttgccgcaggaagtgccagagaagattcataacctcatagaagaatacaataattccaatgaagtcagtatagataaaatagcaaaattccatgcccaatttgaacttatacatccatttcaggatggcaatggaagggttggaagaatgataatactgaaacaatgtttagacaataacataattccaataatcataagggatgataataaagcagagtattacagaagtcttaacaaagcacagcatgaaaatgattacagcagtcttgtaaaatattttcagaaagaacagaaatattatgtagataacacagaaaaaatgttatttgcatacgaagaactagagaaataacaagaaaataaaaagaccagttcgggaaatatctgaactggtctttttcgccactaccttaaagcttctttcacagcttccgcagcctcatgcagggaagcggccttctcctcattaagcttatcaataggtgctttagatataagcttgccaagatgcccaatctgagccttaacattctttttcttatccttctcccagacctttttattggcggcaagtgcgttgttagcctcattaagagtctttacagcatcctctcttatgtcaatgaaactctggtatgcttcgtcctgcttgctgtagatttcggcttcccagcgggcttttgcaatctcttcttcggtcatgttagagcttgaagtaatagtaatgctctgttctcttccggtgcctaaatccttggcagatacattgacaataccattaacatcaatatcaaatgttacttcaatctgtgggactcctgccattgcacgcttaataccgttaagacggaagttgccaagcagcttgttgtctcttgtaaactttcgttcaccctgaaaaaccttgatatcaacggatgtctggaaattgccggcagtagtaaatatctggctgtgtcttgtaggaatagtagtgtttctttcaataagcctgcttgcaattccgcccatagtctcaatagaaagagacattggagttacatccataagtatgatttcagaagcagcagaaccggtctgaagctggtttccaagcttgccaccctgaacggcagcaccaagggctacacattcatcaggattaagatttcttgatggctcttttcccataagctgtcttactttatcagcaacagcagggattcttgtagaaccaccaaccaataaaaccatattaatgtctgtcttggaaagacctgcatcatgcagtgcattctcaacaggtgtgattgttctgtctacaaggtcagcagtaagctcatcaaatgtctgtcttgataaagtgatatcaatgtggtgcggtccgtccttagacatagcgataaaaggaagattaatattagttgtcacagaagaagacagctccttctttgctttctcagcttcttctcttaaacgctgcattgcagagacgtcctttgaaagattgataccgtcacttagcttaaactgctcgacaagataattaactattctttcatcgaaatcatcaccacctaagtgattgtcacctgaagttgcaagaacttcaatgacattatcaccgatatcgataacagatacatcaaaagttccaccacctaaatcatacacaagaaccttctgtgccataccattgtcaagtccgtacgcgagagcggcagaagtaggctcgttgataattcttaatatgttaagcccggcaatcttaccggcatctttagtagcctgtctctgagcgtcagtaaaataggcaggcacagttacaacagcgtctgtcacaggctgtcctaagaaatcctcggcatcctcctttaacttcataagtataaatgcagagatttcctgtggggtataatactttccgtcaatcttcttgcgatagtccgtacccatgtgtctcttgatagagaatatagttctgtcagagttgacggcagcctgtctcttggcggcgtcaccaacaatacgttcctttgatttcgtaaaggctacaacagaaggagttgtgcggtagccttctttgctggtgatgacagtaggcgtatcaccttcaataacagccacacagctgttagttgttcctaaatcaattcctataacagttcccataataaactccattcaatatattgatatatttattttaccatataaaatacatttgactattaagaaaaaaataaaaataagaaaaaattaataaattggggttttgcttgatgatatatattttaatatgttaaaataaatcctattgaaaagatgaggagaatatattatggcaggttcagtgtttggaaatatatttaagatatcaacatggggagagtcgcatggagagggacttggagttgtaattgacgggtgtcctgcaggtctgcctatttgtgaggaagatattcaggagcagttagacagaagaaaaccaggtcagtcaaagtttactacaccaagaaaggaagatgatgaggtacatattctttcaggtgtatttgaaggcaagactaccgggactccaatatcacttgcagtatataataagacacagaggtctgctgactattcagagatagctaattattacagaccgggacatgctgattatacatttgacgagaaattcggattcagggattacagaggcggaggaagaagttctggaagagaaactatcggaagagttgcagccggtgcaatcgctatgaagattcttaaagagcttggaattaatattacagcatatgctaaagaaatcggtggaattggcattgattatgataagtttgatatagctgaaagagataataacgcatttaacatgcctgataaggaagctgcagagaaggttaaggcttttgcagagagcaagatgtcagttggagattcaatcggtggtgtcattgaatgcagggttacaggaatgatgactggaattggcaatcctacatttgaaaagctagatgctaatcttgccaaggcaataatgtcaatcggggctgtcaaaggctttgagattggagacgggtttgaagcggctaaagttacaggaaagtataataatgatgaattcgtaatgaaggatggcagggttggcaagctgactaatcacagcggcggagtgcttggcggaataagcgacggtgatgagattgtgttcagggcagcggtaaaaccgacaccttcaattagtgcattgcaggaaactgttaataagcagggcgaggatatcgaggtttcaatcaaaggaagacatgatccgatgatagttccaagagcagttgttgtggttgaagctatgacagcacttacacttgttgacctgatatttgacaatatgacggctagaatggacagagttaaagagttttacagaaaataaaaggagcagatatgtataaaattttaaagacagatggcagggcaaaaagagcagagttcacaacagtacatggaactgtgcagacacctgtatttatgaatgtcggaacagttgcggccattaaaggcgcagttgcgacaactgatttacagcagataggaacgcagatagaattatctaacacttaccatcttcatgtaagaccgggagataagattataaagcagcttggaggacttcataagttcatgaactggaataaaccgattcttacagattcgggcggatttcaggtgttttcacttgcaggactccgtaagattaaagaagaaggcgttactttccagtcacatattgacggacataagatattcatgggaccagaggaaagcatgcagatacagtctaatcttggttcaacaatcgcaatggcatttgacgaatgtgcgccggcaaaggctgacagaaagtatatccagaattctgttgacagaacataccgctggttagagcgttgcaagaaagagatggcaagactgaactcacttcctgatacggttaatcctgaacagatgctttttggtatagatcagggtggcgtatttaatgatataagaattgaccacgccaagagaatatcagagttagatcttgatggttatgcagtaggcgggcttgctgttggtgaaacacatgaggaaatgtatgatgtactcgataatgtagtgccatatcttccacaggataagccgacataccttatgggtgttggaacaccagccaatattcttgagtcagtagacagaggaattgatttcttcgactgcgtatatccttcaagaaatggccgtcacggacatgtatatactaagtttggaaagattaatctttttaatgcaaagtatgaaacagatacagcaccaattgaagaaggctgtggatgtccatgctgtcagaattattcaagagcatatgtaaggcatcttcttaaggctaaggaaatgcttggaatgcgtctttgcgttcttcataatctttactattacaaccatctcatgacagacataagagctgcgattgaagaaggaagatatgcaggcttcaaggaagaggcattatatcagatgaagacatatgataagcagtaatgctgtatgtttataaatattttgttaaaaatacattttgaggtagacaagcagctctcaattatgtattatatgttaagtttgaaagagacatttttaaggaggagtatcaatgaatattgctatcatagttttttatgtcgtaattattggtgcaatgatgtatttcatggcaatcaagccacagaagaaggaacagaagcgtcagcaggaacttatggattctatggaaatcggtgattatgttcttacaacaagcggtttctatggtgttcttatcgatatatcagaagatgatgtaatcgtagaattcggtaacaacaagaattgccgtatatcaatgcagaagaaggcaattgctcaggttgagaagccatcagacagcacatcagcagaataattaaaggcaattaattaaagcagggttccgggtcagacacatttgtctggccaggaatcctttttttattgaaaatgttgcgcaaatgttatatcatattaaattgaattatcatatgaaaaaggggtaaaggtttatggaaagcagaataactttaattccaggtgatggaataggaccagaaatcgtcagagaggctgtgaaagtgcttgacagtgtggctgacaaatacggtcacaagttcgattataccaagattcttatgggtggatgctcaattgatgagtatggcgttccacttacagatgaagcagtagcaacagctaaagcatctgatgctgtacttcttggagcagttggaggcaatgtgggtaattccaagtggtatgatgttgcacctaatttaagaccagaagcgggacttttaaagattcgtaaggaattaggactttttgctaatttacgtccggcatatctttatgatgaacttaaggcagcgtgtccattaaaggaagaaataattggtgatggatttgatatggtcattatgagagagcttacaggcggcctttactttggtgatagatatactaaggaaattgacggattggaaacagccgttgatacacttacatacaacgaagaagaaatcagaagaattgcaattaagggatttgagattgcaatgaagagaagaaagaaagtaacaagcgttgataaggcaaatgttcttgattcttcaagactctggagaaagattgtacatgaggttgcaaaggattatccggaagttgaagtttcagacatgcttgtagataactgtgctatgcagcttgttatgaatcctggacagttcgatgttattcttactgagaacatgtttggagacatattatcagatgaggcaagtatgataacaggttcaatcggaatgttatcaagtgcaagccttaataagactaagttaggtctttatgagccaagccatggttcagcacctgatattgcaggaaagaatgttgctaatccaattgctacaattctcagtgcagccatgatgttaagatattcacttgatcttgacaaggaagcagatgctattgaagcagcagttgcagctgttttaaaggaaggctacagaacaactgatattatgtcagaaggatgcacacttgtaggaactgacaagatgggcgacttaatcgcagagagagtttaatacatttaaataatacatattaaggagataagctatgataagtgataacgccagaagtggtatgcagcaggcacctgcacgaagcctttttaatgcacttggcttcacagcagaagagatgaagaaacctatgattggtattgtaagctcttataatgagattgtaccaggtcatatgaatattgataagattgtcaatgcagttaaattaggagttgctgaggcaggcggtgtgcctgtagtattccctgctattgcagtatgcgatggtattgcaatgggacatgtcggaatgaaatattctttagtaacaagagatttaattgcagattcaacagagtgtatggcaattgcacatcagtttgacggacttgtaatggttcctaactgtgataagaatgttcccggacttttaatggcagcagcgagacttaatcttccaactgtattcgtatcaggcggaccaatgcttgcaggtcatgttaaggggaagaagagaagcctttcttcaatgtttgaggctgttggttcatatgcagcaggaacaatgacagaggaagatgtacttgagtttgaggaaaaggtatgcccaacatgtggttcatgttcaggcatgtacacagccaattcaatgaactgccttacagaggcacttggtatgggacttcgcggcaatggtacaattccagccgtatattcagagagaatcaagcttgcaaagcacgcaggcatggctgttatggatatggttaataagggaatcacagcaagagatatcatcactaaggattctattatgaatgcccttacagtagatatggcacttggatgttctactaattcaatgcttcaccttccagctattgcacatgagataggatttgattttgatatcaaattcgctaacccaataagcgaaaagactcctaatctctgccatcttgcaccagcaggtccaacatacatggaagaccttaatgaagcaggcggtgtatatgcagttatgaaagagcttgctgatatcggacttcttaatacagactgcatgacagtttcaggaaagacagtcggagagtgtatagcaacagcatacaaccgtaatcctgaagtcataagaacagttgataatgcatacagtaagacaggtggtcttgcagttctttcaggaaatcttgcaccagacggatcagtagtcaagcgttcagcagttgttccagagatgcttgtacatgaaggaccggcaagagtatttgattcagaagaagatgcaattgctgctattaagggtggtaagattgttgaaggtgatgtagttgttatccgttacgaaggacctaagggcggccctggtatgagagaaatgcttaatcctacatcagccattgcaggtatgggacttggctcatcggttgctcttattacagatggacgattctcaggtgcaagccgtggagcttctattggtcatgtatcaccagaggctgctgttggcggacctattgctttagttgaagaaggagatatcatcagcattgatattccgggacttaaacttgagcttaaggtttcagatgaagagcttgctgcaagaaaggctaagtggcagccaagagaacctaaggtaacaacaggatacttaaagagatatgcttcactcgttacatcaggaaacagaggagctattcttaaaagttcagcagatgagtaatatttaatataattataaaaagacattaaagagaaatcaggagaagataaatgaagttaaatggttcagagataattgttgaatgcttgaaagaacagggcgttgatacaatatttggataccctggtggagctattcttaatgtatatgatgctctttataagcattcagatgagataactcatattcttacatcacatgagcagggtgcatcgcacgctgctgatggatatgcaagagcaacaggtaaggttggtgtatgttttgcaacatcaggtccaggagcgactaaccttgtaacaggtattgcaactgcatatatggattcagttcctatggttgcaattacatgtaatgtaacagttcctcttcttggaagagacagctttcaggagatagatatagcgggtgttacaatgccaattacaaagcacagctatattgttaagaatgtaaaggaccttgccaagacattaagaaatgctttcagaattgccaaggaaggaagaccgggtccggtattagttgatgttactaaggatgtaacagcagcagagtgtgagtacacaccaagagttccaaagcctgtagagagaattacagcaagcattaaggaagaagatattgacaaggcagtaacacttattaagaaagctaagaagccatatgtattcgttggtggcggagctgttatatcagaggcatctgatgaacttaagaagtttgttgagaaggttgatgcaccggtatgtgactcacttatgggtaagggtgcatttgacggatctaatgaaagatatacaggaatgcttggtatgcatggtactaagacatctaactacggagtttcagagtgtgatcttcttatcgtggttggtgcaagattctcagaccgtgttactggaaatgctaagaaattcgctaagaatgcaaagattctgcagtttgatgttgatgcagctgagattaacaagaatgtcaggacagatgcacatgtactcggagatgctaaagagattcttaagagaatcaatgataagttagacaatcaggatcactcagactggatggaacacatcaagtcttataagcttgattatcctatgagatataacagggatattcttaacggacctcttataatggaaaagatatacgaaattacaaatggtgatgcaattattacaacagatgttggacagcatcagatgtgggctgcacagcattataagttcaaagagccaagaacacttcttacatcaggcggacttggaactatgggatatggtcttggtgcatgtataggtgccaaggttggacgtaaggataagacagttgttaatattgcaggtgatggctgcttccgtatgaatatgaatgaagttgcaacagcaaccagatataacattcctattattgaagttatatttaataaccatgtacttggtatggttagacagtggcaggatcttttctatggcaagagatattcagctacagttcttgatgatcaggtagattttgttaaggtttcagaaggaatgggagccaaggcttacagtgttgatacaatagaggagtttgagaaagcatttaaagaagcaatcgaactcaatattccatgtgttattgactgtcatattgacagagaagacaaggtattccctatggtttcaccgggggctgcaatctcagaggcattcgacagagaagacctgaataacaagaaataattcatatattgactttaatgtgataaaggactaaaatagttcttaatattttatattttaggaggaagaaaaggtgagtagagtttataactttagcgctggtccagctgttttaccagaggaagtactcaaagaagcagcagatgaaatgttagattaccagggaagcggtcagtcggtaatggaaatgagccacagatccaaggtttatgacaacatcatcaaagaggcagagaaggatttaagagaccttcttaacatcccagataactataaggtgttatttttacagggtggtgcatcgcagttcttcgctgaagtgcctatgaaccttatgaagaataagaaagcaggttatatccttacaggacagtgggctaagaaagcatttgcagaagctaagatatatggagaggctgttgagcttgcttcatcagcagacaagacattttcatatattccagactgctcagatcttgatattccagaggatcttgactatgtatatatctgtgagaacaacacaatttacggaacaaagtataagacattacctaacactaagggtcatattcttgtatcagatgtttcatcatgcttcttatcagaacctatggatgtaactaagtacggcgttgtatacggcggtgtccagaagaacatcggaccagcaggcgttgtaattgctattatcagagaagaccttataacagatgacgttcttccaggaactcctacaatgcttaagtggaagacacaggcagatgcagattctctttataatacaccaccatgctacaatatctatatctgtggcaaggtgttcaagtggattaagaagatgggtggactttcagcaatgaaggaacacaatgagaagaaggctaagattctttatgatttccttgatgagagcaagttattcatgggaacagttgttaaggaagaccgttcacttatgaatgtaccttttgtatgcaacattgaagataaagaagctaaggatgctatggaagctaagttcattaaggaagctgcagctgcaggatttgttaaccttaagggacacagaacagttggcggtatgagagcatctatctacaatgctatgccaatcgaaggtgtagagaagcttgttgaattcatgaagaagttcgagaaggagaatgcataatgattaatgttaattgtcttaataatatagcggcatgtggtttgaagcttttttctgatgagtataatacagaaagctcatttgaagatgcacaggctgtacttgtaagaagtgccaagatgcatgatatggagcttagtgataatcttcttgcaattgcaagagcaggagctggcgttaataatattcctcttgacaaatgtgcagaggaaggtattgttgtattcaacacaccaggagctaatgctaatgcagttaaggaacaggttattgcagctatgcttttagcatcaagagatttaatcggtggtaacaagtgggttgcagataatgcagaagaccctgatattgccaaggcaactgagaaggctaagaaagcatttgcaggacaggaaatcaagggcaagaagcttggtgttatcggtcttggagcaattggacagttagttgccaatgcagctatagcacttggaatggaagtatacggatatgacccatatgtttcagttaaggctgcatggaatctttcaagtgaagttaagtacatatctgatgttaaggatatctataaggaatgtaactatattacagttcatgttcctgcacttgacagcactaagggaatgattaataaggaagcatttgaccttatgcaggatggaacagtaattatcaactgtgcaagagatgtacttgttgatgaagctgctatcggtgaggcacttaagtctggaagagttaagacttatgtttcagatttccctaacccaacaacagctaagatggaaggagcaattgttcttcctcatcttggagcttcaacagcagaagctgaagataactgtgctattatggcagttaatgagcttagaaactttatcgagaacggtaatattgtcaattcagttaattatcctaactgtgattgcggagtatgtgcaactaaaggaagaattactgtatgccacaagaatgttccaacggttatcagtaagataacaacagttcttggtgctgcaggcatcaatatatcatctatggctaaccagtcaagaggtgattatgcatattctctcttagatattgaagcatctgcaccagaggcagtagttgaagagctttcagcaattgaaggtgttatcaaggtaagagttattaagtaatcatatgtaatgagaataatatcaaagaccagtcatttgttgtaacatttggctggtctttcttgtattaaggtcgtctgaatgttaaaatatatctaatatatgaaagtatagtacttaagttaaatagtgcggatggaggttagtatggcagtaataagaccatttgaatgtgtcagaccggctgagaaagtggcagacagagtagcagctcttccttatgatgtgtatgattcaaaggaagcaagagcagaggtggaaagagaaccattatcatttcttaagattgacagggcagagacccagtttgatgaatcagttgatatgtatagtgagcaggtatataagaaagcccatgatatgcttatggaagctatagatgatggaacatttataacagataaggacaaggcatattatgtgtatgagcttacaatggatggaaggacacagacaggaattgtagcatgtgcttctattgatgattatcttaataatgttattaagaagcatgagaacacaagagctgataaggaattagacagaattaaccatgttgatacatgcagtgcccagactggtcctatattcctggcatacagagctaatgaagtaataagtgcagaggttgccaaagctaagcaggaaaagcctgtatacagttttacagcggttgatggaataagacatcaggtctggaaaataagcagtaaagaatctgtagaggctatagagaacgcatttgcaggaatcaaccagatatatattgcggatggacaccacagggcagcttctgctgtaaaggtaggtttacgcagaagagaagctaatccgggatatacaggcaatgaagagttcaattatttcctgtcagtattattcccagacgaagaacttatgataatgccatataacagagttgtaaaggacctgaatggtttaagtgaagaagagttcatggcaaagattaaagataaattcactgtaagcgagagtagcacacaggttgcaccttctaagaaaggtgaattcggaatgtatcttggcaaaaaatggtacacactcacagccaaagaagaaatcttaagcagcgacccggtagacggattagatgtagcagtactccagaacaacgtcttagagccactcttaggaatccacgaccctaaaacagataagagaatagacttcgtaggcggaatccgcggtttaggcgagcttgagagaagatgctcagaagattgtgtattggcattctcaatgtatgcaacatcaataggcgaattatttgcagtagcggacgcaggactattaatgccacctaaatcaacatggtttgagcctaaacttagaagcggacttttcatacatagattttaagtggattttatgtattttcggtgtagatgtgctgaagggtgatgtgtgtatattttcgtgcatggtctcatgattcctgcgcttagtgggagtaaatgccgttatctgcaaagttttttactgtgaacgaaagcaaacgcgcttcgcttgaacgagctttcattcacagcgcttatgcatctaacggcattaactcccacacagctcgtcataaatcgaccacacacgaaaatatacgcacatcaccaccactacactacagacataatatacagaataattcagttaggaggagaaaataatgttacacgaaacatttactatagaattaccatatgaggagctagggataaagcagcagggcagtgccacaataacaacttatatcaaggatgtgttccctaaggatcaggatccgtttaagagacctcttgttgttatctgtccgggtggcggatataatcatcattctccaagagaaggagaagctatagctattaagatgcttgatatggggtataatgctgttgtattgagatacagtcttgcacctgttacgtatcctgcacagctttttgaggcagcctatacaatgaagtatgtaagagataatgcagcagaatgggatgttgatgccgacaaaatcattatcgcagggttttcagcaggaggtcatgttgccggacttcttggaacgggatggaattcaaaaagacttgattatcttctggaaaatgtacttcactgcagtcatgagtatgttaagcctgatggcatgctgttaggttatcctgtaattacatcaggaattgatgcacacagggcatcatttgagagaagtcttggggaaaaatatgatgagtttatagatgaagtgtctatagaaaagagagtggataaggacacaccacctgcattcatatggcatacatgtgaagataagacagttccgcttgaaaattcattacttatggtagaggcgttaagaaaacaggagattccgtttgattatcatgtatatgctaaaggtactcatggtcttggacttggcacacgagagactgcgactaagaatatgggacattatgaaccacaggtgtcatcatggacggaatgctttaaacagtggatgggggtaatgtatgaataaaaacttatacggcctgatgaactggccggagatagaggggattgtatatgcagagtgtgacaagccaaaggagctgcttggggcacatgttaccggtaagggattgcttatacagataatgcgtcctgatgcagtggcagttaagctgcatatagatggcagaaaaactgctgttaatatggaaaaggttgatgaatccggattctttgcagcacttgtttcatctaagaagaagctttcatacacatactcagtggagaaggttaatggagagatcacagaatatacggacccatatgcatttgcaaatgttacgaaaccggaagattacaaagcatttcttgcaggagaagagaaaaatgcagcacatatattcggcgctcatgaaagaactgtcaatggcgtgaagggagtgctttttaatgtatgggcacctaaggcactcagcgtaagtgtcgtaggagagtttaacaaatacgacggcagagtccacttaatggaaagaattgaggatacaggagtatttgaactgtttattccgggactggcagccggatgcggatatatgtatgaaattaagagacagggtaaggggactacaagaaagttagaccctgtatcaagacagatatcatcagttccaattactgcatcagtggtaagtgatgagaacatgcctgattcatatgcatggaacgatgggctatggatgataaagagaaagaaagaagcaggaaagaagaagcctgtaacagtatatgaggtgtcacttactgactggctgaaagaaaaaagtgcagatgagcttgtggattttgtaaagcaggagggatatacacatgtatgtttccttccggttgcagagtatcttaatgaggagatgaatggatattcgacattgggatattttgcggtgacacaccgaacaggcggcagtgatgcatttaaaaagctggttgatgactgccataacgctggaattggcgtaataattgactggaatggtgcttactttggtacagaagttaagggattgtatgattttgacggggcagatgcttacggatatcttaagccatcactagagaagcatcctgagtgggatgttgtcacatttgactacaagaaaggcgctgtaagaagttttcttttatcaagcgtattaatgtggcttaatgattaccatattgacggcatcagaattgacggtgttgcttcaatgctttacctcgattatggtaagcagccaggcacatggacacctaacatgtatggcggcaatgagaatcttgacgcaatcgaatttcttaagactatgaacaaatatattgctaaacgtggcgatggctgttttacaatagcagaagaatcaagcggctggtttggagttactgcggcagataatgatgaccctcttatgtttacttataagcagaataactgctggactaaggattttcttgaattcatgggaactgacccgctgttcagaaaaggtgagtatgacaagctgacatatggaatgctctataattacggagaggatttcatgctctcgctcaatcatgatgatttcagggagaaagcatttgtggatatggtgtcaggcagtgatgagaaggcacatttgtcagatatcaaggctgcacttggattcatgtatgcacatccgggaagcaagatgtttgcagcaggacaggatgcaggacttgagaaattcatgtcggagcttaataagttctatgcgaaaaatgcggctctatatgagcttgacaatgaccctgatggatttatgtggctcgagaattctaatccggaagagactgttattgcaatgcagagagctgacagcaagggtaataagcttgtgattgctgtgaattttactcctgttaggagggaaaactacagacttcacgttgatgtgcgtggaaagtataaggaagtatttaacagtgattggaagaagttcggtggagacgagaaggttaatggacagattatcaaatcagataatgatggtgatgatatggaatatattgatattacacttcctggactttcattcgttatatataacagtgaaccgtatacacagcttgaactcgaggaaatcgctgtattaaagagggctgcaattgcaaagaaggaagccatgagaaaggcagcagaggctgaaatgcttgaacttgctgcagcagaggaagcaaagcgggcggttgaagcaagaaaacaggcagagaaagcctgcatggaagcacttcaggctaaggaagaagctgtaagaaaagcagaagaagcagcgcgtgcaagtgaagagattgatatagagactaagaagaagttagaacagcttaaaaagaagatgaaataatacaaagggggatcagctatgggattcataggacttgtggcagatgcagccacaacaatccagcaggaaacaggtgagataaccagattcttttctattgcccatgttaagcagcttctcaatgatttaggaaactggtcggtttcacttattggtaaaattgttattgctgtcttaatatggtttattggcaagaagataatcagggtacttgataagcttgtaaagaagatactggacagaagcacgctagataaaggcgttgttaattttgtggtatcagtgcttaagtttgtaatgtatgcaatacttatcatgatagttgtggataagctgggatttcagacgacatcactgctcacactttttggctctgcagcacttgcgattggtatgtccctgcagggaagcctttcaaactttgcaggaggaattcttattcttatattcaagccttttaaggttggtgattatattatagtcggaactaatgaaggaactgtaaagtctatagagattctttacacaaggcttgttactattgataataaagtagtaatgctcccgaacggttcactttctaattcaagcattgttaacgtaggtgcagagaatacaagaagaattgatattcagataggaattggctattcatcagatattcctaaagccaagaagcttcttgaacaggttattaatagtgagaaggggatacttaaggacaaggatattctggttgttgtcaagagccttgatgaaagctgtgtaacacttgagacaagagcctgggttaatacagcagactactggaatgtaagatttaacctgcttgaaagatataagaatatatttgatgagaatggaattgagattccgttcaaccagcttgatgtacatatgaagtagtttttttgaaggatgccgcgaaagtggcatccttttttgacttcggctgcatattggactgcagtaattgcttggtaatctgctaaaacctactagatattaagaaaactggaatttagtaggcttatttttagaacttttaacatgagaaattgtcaaagacccactaaaacatttcataccagtgatttagtgggtgtttttgacgttagaagaaagaaaaacaaatgattagatataactaaccgacgctagaaacctactaaattataaagttataagccattagtaggtcttagatgatatatggatgttatcagatgcttttgtaaacctactattctgcaacaaagtaatgtttgtgtgggtttttcacaaaactacactgattttacttattttttacatagattggtcacattttccaattaatatcttacctgtaagaacgaaagagacagaaaggagagcttggtatggcaatcgaagttttcaaccgttatgagaagaaatacattatagatgaagatacttttcataaattgacttaccagatagctgattatatgaatccggatgcgtataacagaaatggtgaggcgtacagaatcagcaacatatattatgatactgagaatgatcagcttataagagcttctattgagaaaccggtatacaaagaaaagttaagactgagagcttatgggatgccagagcttacagataatgtctttgtagagattaagaagaagtacaatggtattgtcaataaaagaagaacttcaatgacgcttcaggaggcatatgattttcttgatgacgacatatgtccagataaccatgaaggaagaataaacaggcaggtgcttaaggagatagattacttcaagaatttctaccatttgcagcctaaagtttatctttcatatgacagattcgcgtactttgagaaagatgatggcgatttcaggattacatttgataaaaatattacgaccagaagggaagatgtaagactcgagcatggaagctatggaaagaagcttttgccggatggtaagtatttaatggaagttaagataagtggcgctgttccgctgtggtttactaagataatatcaggacttaatgtttacccggtatcgttttctaagtatggtactgaatataagcagtatgtccttacgaattacacaagcttaatgtataaaggagaaaatatatgtttgaatcaatctttacatcaacatcagagaatacaatcagcattagccagtcaatgttaggaatattagtagcagttgttattggtttagtgattgcttttgtgtacacacttgtatcaaagaaggatggatataataaaagctttataataggtcttgctcttttaccagcgatagtggcatcagttattcttcttgtaggaagtaatgttgcaagggcgttttcaatggcgggagcttttgctttagtaagattccgttcagcaccgggaagtgctaaagatatatcagtagtgttttttgcaatggcaacaggtcttgcatgcggacttggttttgtgacatttgcagggtgcttcgcagtaataattcttctggtatttgtagtgttatcggtaacaggatttggaacaagagatgcacatagaaaacagttaagaatcacaattccagagaatcttaactatatggcagtatttgatgatatatttgataagtatcttagtgaaaatgtacttagaaaagtaaagacaactaatatgggtacaatgtttgaactttcctatgaatgcaggatgaaagacgagagcgagcagaagcagttcatagatgagttaagagttagaaacggtaatcttaatattacaatggggatgatgccggattcggatggcggataccttaattaatgcattaatcatattatataataacagaactgcccggacaaattcatgccgtccgggcagttttacattttttttacaatcttttttatgtcaggcacttgtataattcgcatatttattatattataaacaatatacgaaagggcgtggtagatatggtagataacaacactcaattttttaaaactcagccagagaagacaatttcagtagaaggaatacttgagcaggtatatcttgcacttaaagagaaggggtacaatccggttaaccagatagtaggttatattatgtctggtgacccaacatatattacaagccataacaatgcaagaagccttattatgaaggctgaaagagacgagcttgttgaagaggttgtaagatatttcattgaaggtaaaggcttataatatgagaattataggcttagatgtcggaacgaagactgttggagttgccttgagcgatccgcttgggataactgcacagcctttcgaaacgataacaagaaaagagaataataagttacgaagaacttatgccaggatagaacagattatatccgaatatgatgtaactgaaatcgtggttggctatcctaagaacatggatgatactattggggaacgggctaaggcctgtgaagaatttgcagcagcactggagagacgaacaggattacctgttacactgtgggatgaaagacttactacagttgaagcagacgaagtccttgaagaatgcgggatgaggcgagaaaaccgcaagacagttattgatcagcttgcggctgtttttattttgcgtggatatatggaatctaaacagaagtaatatttggaggatttgtttttcatggaaaagcttgaatttattgacgagaacggtgagaagacacaattttatgtgattgaagaaactagaattaacggaattaattacctgcttgtatcagagtcagataatgaggacgaagaagcagaagcttatattcttaaggatacatctgatgcggcaagtgaagaagctgtttatgagtttgtagaggaagacagtgaacttgaagcggtaggcaaggtgttttctgaattaatggatgatgatgttgaacttaaataaggtgtgagccttattcatattttatattttatttttattatgaggtgtttatgaaaaaagcagagaatgcgtctgtcaggattataccattgggtggtcttgagcagataggaatgaacattactgccattgagtatgatgacagtattgttgttgtggattgtggcttatctttcccagaggaagatatgcttggtattgatttagttataccggatgttacttatcttaaggagaatcttaataaggttaaaggattcgttattactcatggacatgaggatcatattggtgcaattccatatgttttaaaggatgtcaatgttcctatatacgctactaagcttactatgggacttatagagtcaaagcttaaggaacataatatgttaaagtcagttaagagaaaggttgttaagtatggacaatctgtaactcttggcgatttcagggttgagttcataagaactaaccatagtattgcagatgccgcagcacttgctatatactcaccggcaggaattattgtccacacaggagattttaaggttgattatacacctgtatatggtgatcctattgatcttcaaagacttggagaacttggaaagaagggtgtacttgcacttatgtgtgacagtacgaatgctttaagacctggttttactatgtcagagagaactgttggagctacatttgaaaagatattcaatgacaataagaacagcagaataatcatagctacatttgcatctaatgtagacagagtacagcagattattaattcagcggttaaatatggcagaaaagtctgtgttgaaggccgaagtatggttaatattattgaggttgcagaagaccttgattatcttaagattccggacggaactcttattgaaacggatgagatgaagaattatacacctgagcagattgttcttattacaacaggtagtcagggtgaatcaatggctgctctttcaagaatggcagctaaccttcatagaaaggtatctatccagcctggcgactgcgtagtattttcatcaactcctatacctggtaatgagaagtcagtagccaaggttattaatgagcttggtatgaagggtgctaaggttatattccaggatacacatgtatcaggacatgcatgtcaggaagagattaagcttatatattctcttgtaaagcctaagtattctattcctgttcacggtgagtacagacatcttgttgcacagagagatgttgttatgtcacttggatatgacaaggatcatgttattattgccaaatcaggagatgtgttagaacttaatgatgagcatgcacaggttgtagatcatgtccagacaggagctatttttgttgatggacttggcgtaggtgatgtaggaaatattgtattaagagacagacagaaccttgcagagaatggtattatcattgttgttcttacacttgaaaaatataccggacagcttatagcaggcccggatattgttacaagaggttttgtgtatgtaagagaggctgaagagcttcttgatgaggcaagagcaattgtatctgattcagttgaaaagtgtcttgataagaatattactgactggagtaagattaagaatattattaaagatgacttgagcgagtatctctggaagaagattaagagaaatcctgtaatacttccaatcattatggaggcacagatataatatatgttgccggatattactgcagacagttggagaggtgtttttcatgcgtagaattgatgaacttaagaaagagattatacatgaaattcttaacagtgaagaatatagggaatacagaagacttcagtctgaaatagacaggacgcctgacttgaagagacaggtggatgaattccgtatgagaaattttgaattacagaattcagaaaatgttccagacatgtttgcagcaatggagaatcttaataaggaatatgccgacatgaggaatcaggacattgtaaacagatatcttatgacagagattacattttgcagatttatgagagatatatataaggatattgccgaggcagtagacatggaccttgattttttagggtgaatcatatatagtgtagcttattaaagaagaggagaatcaggttttatgagcaataaatcaatcaggatgctggtatcggtatcactgaatgttttaataattgttttaggaatatatctcgtgttttttatgggaagcaaggcgtattcatttggtgagaagatatttaatgaacaggcagttgattcagatgataatgcccgtatagttgaggttactataacaacagacatacaggctaagaagcttgctggcatgctttatgataaaggacttgtacatgataaaacgatagcatattttcagattcagttctcagattataaggataagtttgtaggtggaacttatgagcttaacacgggaatgacacctactgagattatgcaagtgctggcacagtcagacagtgaggaagaataacttaattgtaaggggaatatatgatagtcaatgaaagagtagttgcctatattaattctctcgattgtggtaattctgatatatgtaatacaattgaaaaagaagcgattgcggatgaagtcccaatcattagaaaagagatgggtaatttgctgaaggtgctgttacagcttgtacagcctgaaaggattcttgaagttggaacagcagtaggttactcatctattcttatgagtgagaatatgccggaaaaatgcacaattactacaatagagaattatgataagagaatacctgtggcaagaaataattttaaaagggcaggaaaagagaatgttataacacttatagagggagatgcgctggaagtgttgaagactctggaaggtccatatgatttcatattcatggatgctgccaagggacagtatattaattatcttcctgatattaagagaatccttagaaaaggcggacttcttatatcggataatattctgcaggagggagaaatagtggaatcccgctatgcagttacaagaaggaatagaacaattcatacaaggatacgggagtatgtgtatgagcttactcatacaaaggattttgtgacatcaattgttcctattggcgatggaattacactcagtgtgaaacagtaaaggagaataatatggcgggacatatgtataatggcagagaaacagagcttctcataccagcaagcagtcttgaagttttaaagatagcagtaatattcggcgcagatgccgtatatataggtggcgaagcatttggattaagagctaaggctaagaatttttcaatagaagatatgaaagagggtgttaagtttgcccatgaaagaaatgtcaaggtatacgttacagctaatattctggcacataactatgaccttgagggtgcaagagcttactttgaggaacttaaggaagtaggacctgacgcgcttattatatctgatccgggaatgtttacaatagcaaaggaagtacttcctgatattgatatacatataagcacacaggctaataatactaactatatgacatataatttctggtggaatcagggcgctaagagagtggtttcagcaagagaattatctcttgaggagattaaggagataagagagcatattcctgatgagatggagattgaaacattcatgcatggagcgatgtgtatatcttattcaggcagatgcctgttatcaagcttccttgcaggaagagatgctaacaggggagcatgtacacatccatgccgttggaaatatgctgttgttgaggaaaacagaccgggacagttcatgcctgtatatgagaatgagagaggaacatatatatttaactctaaggatttatgtatgatagagcatattccagagatggtaagttcaggtattgactcatttaagattgaaggacgtatgaagacagcactgtatgttgcaactgttgcaagaacatacagacttgctattgatgattttatagaagacccggagaagtacaaggctagaatcccattctataagagcgagataagcaaatgtacttatagacagtatacaacaggtttcttctttggaaagccagacgagaacacacagatatatgacagtaacacatatatcagggaatacacatatcttggtatcgtaggagatgttaacgagcagggactttaccatattgagcagcgaaacaagttctcagttggcgagacaattgaagtaatgaagccggacggacagaatatagaagttacagttaagcgtattgtcgatgagaatggtaaggatatggagagctgtccacatcctaagcagaatctttatattgatttaggaatcaagcttgataagtatgatatcttaagacgccaggaagaagaaacagaagtaaacagttaaattaaagagacagttggataggcaattaaaggcacctttacacatatgatatataaaaatgtgtaggggtgcctttttgaaaacatttgaaaaaccattatcggcacaggaagagaaagaattgctgataaaattacgcgaaggcgatagtgtggccagaaatgctcttatagaaaagaacatgcgtcttgttgcacatatagtcaaaaaatatacctctactgaacgtgattatattaatgaagaccttatttcagtgggaacaataggacttattaaggctgttgattcatttgacatagaaagaaatgtgagattctcaacatatgctgccaaatgtatagacaacgagattcttatgcttttccgtcaggataaaaagaaggaacgggaagtgtctcttaatgagcctataggaaaggacaaagagggaaatgagataagccttaaggatattatcggagaagaatcggagaagaaacagccggatgctgtggaagattatatgttttatgagcagattaagtgtatatatggtaatatagaaaaggtacttgcaccaagagagatagagatattaaaatacaggtatggactttttggtgcaaaagaatgcacacagaatgaacttgctgacaggcttggaataagcagaagctatgtgagcagaatagagaaaaaggcacttggtaaattaagagaagtgcttattgagcggaaacttatatgataatatagtcaggaggacatgtaatgcagattacagatgcaaaggtaatagcgggcagattatctaaggtaagggatatcatgaaatcagaaggcgttgatatatatgtagtagtaacaggtgattaccatatatcagagtatgcaggtgattattttaaggaaagagaattcattaccggattcacaggctctgccggaacggctgttataacacaggatgatgcaaggcttttcactgacggaagatatttcgtgcaggctgaaaagcagattgaagggacaggcttttcactgatgagggtcggcgctccgggtgttatgaatgtggcacagtactgtgagagtatagttaaagatggaatgagcatgggatttgatggaagaaccatgccggctgaagaaggaattgagctgtctgatatatgtaaaaaagcaggagcaggctgtttgtatgattttgatgcgattgagaatatatatgaggacagggcggcgtttccacacagcaaagcattttatcttgatgaagagtactcaggagaaagcataataagcaagctttcaagaataagaaagtacatggataataaaaatgctgatatacatattatggcaacgcttgacgacatatgctggacattcaatataaggggatgcgatgttgagtgcaaccctgttattatggcgtattcagtgataactaaggatgaagcatacatatatacagataaggacaggtttgatgataagacactggccaaattcggggaggcatgtgtagaggtgctgccatatgacagcatatatgaagacattaccagaatgaatggaaaagtgcttattgataagagacgtgtgaatatgcgtatatatcagcttatacagtctggaagagatgtggaagcagtactgtctgacaatccagcaatgctttttaaggcaataaagaatgagacagagataaggaatctatacagcgtacatgttgacgatggcgtggctgtaacaaaattcatattctggcttaagaaaaatgttgcatcaggtaatataacagaagcggatgcagcggcatatcttgataatttaagaagcaatataaaagattacatagaactaagctttgacacaatcagtgcatataatgaaaatgctgcaatgatgcattaccatgcagatgaaaccaatgcggctgtcttaaagccggaaggcatgctgcttgtggattctggcggacagtatatgcgtggaacaactgatataacaagaacaatagcacttggacctgtgactgatgagatgaagatgtattacacacttacacttaaaggcatgttaagcctggcaaatgcaaaattcttaaaaggctgtaacggtttcagtcttgatattcttgccagagcacctctgtggaatgtcggaatggactaccgctgcggaacaggacatggaataggataccttttaaatgtgcatgagagtcctaatggatttcgatggaagcacaatccgggcaagaatgatcttgcagttattgaagagggcatggttacatctgatgagccgggggtatacattgagggcaggttcggtataagaattgaaaatgagattgtatgtcagaaagatttcgacaatgaatatggcacatttttaaagtttgacatgcttacagttgttcctatagatttagaacttgttgatgtaaattatcttgatgctgtggatattgagcggctcaataagtatcaggaaagagtatataagacacttgagtcgtattttgatggagaagaaaaggatatgttaagagaggcgacaagaccagtaggagtatgatatggagttaaaagaattttcacataagggtgaagcaattgaaaaggagattaagaaggagttccagtttatgggacggacaattaagaaacgccgcgtaggactgattattgcagcggctggagtgatagcggtaattgcagttgcactttttatacattcacagcagtttgatgtgtgggattatataactataagttatgaaggtgctaacggatatgcaaaaccagtgtttactcttaataaggataagttgtataaggagcttatgggtaaaagtaccgattcagataaatcatacaatgttaaaatgctgattgcttctatagaaacaagtacagatgaagaagatattgccaatggtgatacttataaagtaaggcttgaggttgataaaaaatatgaggatgcggcaggagtcagcgtgggaggcggcaataagaagataaaagcatcaggaatatcaaaaggaacatctgtggaattgtttgataaggttgatgttacatttacaggtgtaagtccgcaggctggcattgttatcactaataactgggaagatgagtatctgtcaggacttacatttactcctgataaaaaagacaatataagtcttggggattcagtgaagataacatgcaatacttcttatgaagatattgcaagacacggatttcttgtacataatatagaaacttcttataatgcagacaagcttccggaatatgttgatgatgtatcgctgattgataaaaaggttatagaacaggttagcaaagaagttctggagacaattaataaagaaacggcagataacacatttcatatgttatataaagcaacaaaggatattgcctatctgtatcacattaatgaggaaacatgcagtgatgcaaagattactggaatatattatttacagaaaaaaggaaatgctggagagactaataattacatatatataactgcttcagcgacaatatctgactcggaagacagcaaaacggtttattttgcattttcatatagcaatgcttatataaatgcagacggaacatttgatatgaaccatgataatgaagaaaagaggtatgtctgcagtacagattacgattcactttacagtgaatgtattggcagtaaaagtgacaactatactataaaagaggttaaatagctgtttgtatattgtatgttgatgtgatataatcttactataaatgcgcaatagcaggagtggagactgcctgcggaaagaggttgaaggtgaattacagaaagaaagttagattgggtgatgttcttgttaaaaagggaattatagatgagaaccagttacagactgcactttcaagacagagagagcaggggaagatgctcggtgagatggttatagcattgggatatgctacccagagagatattaatgaggcactttgcgacagtctggggattgattttgttgatatgcgagagacggagataagtgatgatgttctgtctatgttagatgagaatattatgagaaagtacactctcgtaccattaggtgatgcacctgataatcctggagcaatcagggttgccatggctgatcctactaatattcttgccatggatgacattaatattgtaactggtaaacaggttgttccggttcttgctaatgcaactgatattaatgcatttttagataaggcgtttggacagaaacaggcacagagtattgtggatctgtataagaaagagcagggcgagactgtaagagaagaaactaaagaagacaaggcgagaagagaagagattgagaatgcgcctattgttcagcttatcaatagtgtaattgagcaggctgtaagacagagagcttctgatatacatattgagccgatggaaagagatatccgtgtaagatacagaatagatggtaatcttcgtgaaattatccagtacgataatacacttcttggtgctattacaacccgtatcaagattatgtcaggaatggatatttctgagaagagaaaaccacaggatggacgtatcacaattaacgtagatggaagagaatatgatatccgagtatctaatcttcctacagtatatggcgagaaatgcgttatgagaattgcgtccaaggaaggatttaacattgataaatcaaaacttggacttacaccggctgatcttaaggtatttgatgatatattaaagaatccacatggaattattcttgtaacaggacctacaggatctggtaaatctacaactctttatactgcgttaagtgaacttaatacagaagatgttaatattattactgttgaagacccggttgaggctaatattgatggtattaatcaggttcaggttaataataaagcaaatcttacatttgcaactgcattaagatcaatcttacgacaggatccggatatcattatgattggtgagatccgagatggtgagactgctgagattgcggttagagcatctattacaggccatcttgttgtaagtacactgcatactaatagtacggcaagttctgttgcccgtcttgaagatatgggaattgagtcatacctcatagctgattcacttgttggtattatcgcacagcgtcttgtaagaaagctgtgtgactgtaagatgccaaaagaggcaagtgcagctgagaaggagatgcttggagttaatcctgacgagccatttacaatatatgaaccatgcggatgtaagttatgtaatggaacaggatactatggacgacttggtatatatgagattatgaagataacaccgtctataaagagacttatatcaaggcatgcagaagcagaagagattaaaaaacaggctataagtgagggtatgaatacgcttaagatggctgcggttaatgcggttaaagatggtgtcacaactatagctgagatggttaaagcaacttatgaagctgaagaagatgattcaagacctaaggcagcagatacatcagcttcttctggaatatcagtttcttccggagtagaagaaattgaacttgagcagattgactaagaatctgccagatatacaattatagatatatgggggcttaataatgtttactgtagagcaattactttcgatagctaaagaaaagaaggcaagtgatgtgcatgtcactgtaggacttccaccaagagtcagaattaatggtgaacttgtggatcttgattatcctaagctttcaccagatgactgtgaaaagcttattcttgatattatggatgacaggcagcaggcaatgtttaaagacagaggagaacttgatttttcattctctgttcataatattggacgatacagagttaatgtattcagacagagagggtctgtggcatgtgccatgcgtattgtaggaacagagattcctaagccggaaagtcttggtgttccaaagtctgttgttgaattgtatgccaagaaaagaggactggttctggtaacgggtccaacaggttccggtaaatctacaacacttgcttctcttatagacaaaattaatgatgaacgtaatgctcatgtaataacactagaagacccaattgagtatcttcattcgcatagaaaagcaatgattaatcagagagaaatcggtcttgatacgcattcatatgctgatgcactccgtgcagcactgcgagaagatcctgatgtaattcttgtaggagagatgagagatctggaaactatatctactgctataacagcagctgaaacaggtcatctcgtgttctcgacacttcatacaattggagcggcggcaacaattgaccgtattattgatgtgtttccaccgcaccagcagcagcagataagaattcagcttgcagttgttcttgaagcagttatttcacagcagctgataccaacagcagacagatgtggaagagttgctgcatttgaagttatgcatggaacgattccaattaagaatcttatccgtgaagccaagacatatcagatatccagtgttttacagacagcaagaaaagagggcatgatatcaatggatgatgcacttcttgatctgtataataagggagtgattgattctgataatgcaattggatatgcacaggatgtcaattatgttactaagagagttaatcagttctattaatggtggtatatgcagataggtgagagaatatataagtatcttgaagaaaaaggaatgtcgcaggcagagtttgttagtaggacaggaatttctcagagtacagtaagtgattggaagataaagaagaataatccgtcagcagataagataatggtaatatgcaaagcactcgatatttctccatatgaactgctgactggcacagaagatatgaataattcaagaaagtatatggattatgcatatgttgataaagactctaaggaatacacattgatagaaacttatcaggagcttagtgatgacgcaaaactaaagctggaaagatatatggaggctttaagaaagtctggggaatagtgattgaagagatgacaatgctggtgatgtgctggcattgttttttttattggggactgttgcactaaccgctagtattaagcatgcaactttgattgtgggggtatatgtaagaaaatagaagaaagtgtcggcttgcgagctgtctgcggtaaacaactattattatggggatttcctataagaacaataaataatcaatctatataggtaaatttcatgcagaattacatgaaattgcaggaatatacctatcaggcaggcacgaggaagcttatctgtaggtagataaatagagaaagtgaaggttagaccagaattttgcctgaatatgtcctataagtcaagtggaaatgcgactaccaataggtatcaggtaatataatgtgcagtataccgcaattgcggtattgacaaaaacttatattaattgtatattaaaaatgatttatggttaaagattcatggcatactgcttgcatgtgaatgaaagagaaagatataacacaaaaggtactagaagataataacgatatatttgcggatattgttaatgtgttgttatttgatggaaagccagaggttgaagagaatgaacttgttaatacgacagttcattcacagtataaggctgatgatggaaaagttcatgaacaggaacgcgacattgctaagtattggaaaaaagaaggtacagacattgtcctgtatggcatagagaatcagacgaaggttgagaaaagaatgccagcaagaatatcaggatatgaaggcgcttcatacagaggacaatgtgataagaaaacaatagtgccggtaataacgatggtactgtattatggtacggacagaaaatggacggcaccaaagaatcttaagtctctgattaaagttccggataatctggataagtatgttaatgatactaaagctaatgtatttgagatagcgtggctgacagatgaacagatagcaaagtttacgagtgattataagatagttgctaatttctttgtgaacaagagaaagaacaaagattacataccagatgataagacagcaattaagcatgtggatgagatactaaagtttttatcagttatgacaggggatagcagatatgaagagatattgtcagataaggaaggggtgagcaatatgtgtgatgtagcacagaggcttgaagacaggggaattgagaaaggaataaaagagggacttcagaaaggaatgaaagagggacttagtcttggcggcaaccagatgatatattcactggtcgaagataagagcataagtattgaaaagggtgcacaaaagcttgggataagtgtggaaaagctgcgagctaatatgattaatgcaggatataagtgtccggatatggagtgacagctgataagaaagacagaataacaatataatatataaagataaagcaatgttaggaagagtggatactggcattgcttttcttttatggagaagccagcttctgttcatggacttgtttctacgtgttcctataagaacaataaataatcaagctatataggtaaaatacaggcagaaatacatgagaatgtaggaaatcacctatcaggcaggcacgaggaagcttatctataggtagattgggagggaaagtgaaggctgaataaggattcagcccggatatgtcctataagtcaagtgataatgcgactacctataggtatcaggaacaatgaatcaataaagcatttaattatttcttgaaaatagctagaaaaatagatatattatagtaaagtattaatctaaaaggggagaaaaataaaatgcttacaaaattaaaaaagtgtaaaacacttaaagaaatatatgaggtgctggggagaattttttttgaaaagatagcaatgtacatagtgatgggatggtgcttattgccgatactatcaatcttctttcacataagatggatggggatggctgagcagacatttatgtatagattgaatatattgtcaagctatcagacggcagttttgcttatgggtgtgctgacattggaatttctgatagcatactttataggcatgatactgacacggagcaatgattggaaaaatgagctgtttgagtttattaaaagagaaccatggaatgtattttttttgatgctgtttgtatggattatcatatgtacaatgcattcggctgataaatatacttcaatatttggaacagagtacagatatgaaggtcttgtgacatattgctgctatgcggcggtttatatgtgtgcgcatatagttaaagaagcaaaatatagaaaatgcatattcaatacatacgcggtaacagcagttatacttggaatatgtctgctgcttcaagataatcatctattatatatgcataaaatatttgtttatgatagagcaactgtattcagccagtttaatcattttgggtattatcttaacatgtcaattctggtaatgacagggttattcttaacgtcagatattaagaaaaatgaaattatgtatgcagcaggaatagcgttccagttattttgccttttggtgaacaatacatttggtgcgtatcttggctctatgtttggtgttatagctgtatgcataatgtatgctgtaagaactaacaatataaagaaaatactagtgccgataattatatatatttcccttagcacagtcagcatgttaggaatcattccatcaagcagtggacagaacttaaaagttaatttatcaaccttctctcatgatgttaatgcagtcatatcagatgcggaagatgcagatggagcagggacgggaagaatgagattatggaaagcttgcttaaaaatgataccggaaagtccaatattaggatatggaccagaacaattgaatgaaaaatatgctggtgaattgggaggcgtgttagcaggaggcactgacagaccagaaaatgaatatatacagtatatggtgtttatgggaataccagggtttgtaatgtatatgggtgcattaatatcaatgatgatatgccaattgaagaaaattaaaaaaatggaacttataacgatagcttcggcaggatgtgcattggcatatgcagcaggtgcatgctttggaaattcaatgtattatacaacaccatatttctatatgtttttaggaatgacggcaagaacgattaagctaaaaaatacgaaataaaagtgaaaattacccacttttagtgtgtagtatgatattattaagacatgttataaatataaaagtgaatttaaaaagaatttattttttgttaattttgtttgttaattttagtaaaattattgtcctgattgtgcttatgtgttatactaaatgcactaaaaaggaaagattttactaagaatggggagtgtgatatggaaacattttcatacaaagcggttgacgcttcgggaaaagatgttaagggtgctattgaagcagaaagtaaagatgaagcagccagaaagataaaggaacagggctttactcctatatcaataggtaagcagggagctttggataaagatgttaatctgtcattttttggcccaaggaaaataccggcacgagatatgagtgtattctgccggcagtttgcaagtattcttaaagcaggtgtaagtgtaattaatgcattggagatgcttggtgaacagacagagaataagagacttaaagaggcaattgagagaacccagtccagtgtagaaaaaggtgaaaacctttcggattcaatgagggagaatgaagagtttccaagtattcttgttgatatgattaaggctggtgaagcttctggtagtttggagaattctcttacacgaatggcggtacagtttgaaaaagatgccaagttaaaaggtgttgtcaagaaagcaatgatgtatccaatagttcttatctttgttatgataggtgttattgtagtaatgcttacatttgttataccaagctttatgacaatgtttgaagatcttgattcagaacttccaataacaacgagaatgattcttgcaatgagtgacagtgttaaaggatactggtatgtatatcttattgttgtcattggaatagttgtgggagttaagttatatggtaatacggagaatggaaggcataaccttgataaattaaagttaaagattccagtattcggattgttacagactaagtcagcatgtgcttcatttgcaagaacaatgagtacattgttacaggctggtatgccaatgattgatgcacttgagatatctgcttctactatgaagaatgtattatattatgatgcattagaaaaagtaaagagcggtgtatcattaggcttgcctctttctaatcagttaagaacatcggggctttttcctccgatggttgtacatatggtaggtattggcgaagaaactggtaatgttgaagagatgcttaccaattcagcagtttattatgaagaagaagttgaagtccagacacagactcttacttcgttaatggaaccaattattattatccttatggctttagttgtagttatgttaatacttgcaatctatcagccaatgattcagctctataatacattaggagcacaggggtagtatataatctgttctgcaggtcgcttaacgagaacggatttatataaatatatttcaaaagggagatatgaaacatgaaaaagacacagaaaaaattaggtaacaaaggtttctctttagtagagcttatcgtagttattgccatcatggcagtacttgttggtgttttagctccaacacttatcaagaacattgagaaatcaagagagtcaaaggacgctcagaattgtgaacagcttaagagttcagtagagattgctcttcaaaatgaaacagcttactctactaatgttaaatcaggtggaaaagatattgtgacaataacttcatcaggtgtaacaatagctagtgatgcaggaacagattttacaacagagtttacaggacagattgacacttctaagacaaagttaacatctaagaagtacaaagatgttacaggtggtataaagattaatgttaatgaaaaaggacaggttacaatcgtaggcttaccatcataaaattaaactaaggaaacattaaatcatgcaatacgaattaccactgtacttcattatctttctatacggaatcgtattcggaagttttttgaacgtactgatttacagattaccattaaaagagaatatagctacagaacattcgcattgtatgacatgtggcgaaaaaatccagtggtatgatctcataccactggtaagctacataatacttggtggaaaatgcagacactgcaaagctaagatatcaccgcagtatccaatcattgaagcgaccaatgggatagcatatgtgatagtattcttagttcacggatttaatgcggtaagcatattgatgtgctttgcattttcaatatttcttgttatttcagtcattgactggagaactttcgagataccattttcacttaatgtggcaattggtgttttggcagtgataagaatcatattagatcacaagaacctattagactatctaatagggttttgtgttataagtggattcatgctcatatgtctttttattggacgagcgattaaaggaattgacgcttttggcggtggagacattaagctgatggcgtttgcaggattatttttaggatggaagtgcattattctggcatttctgattggctgcatcttgggtgcagtcattcattccatccgtatgaaagttacggatgctgaacatgtactggcattcggaccatatttgtgtgcagggcttacaatagccatgctttttggtacgaatataattaactggtatctttcttttatgggattctaactaatctgtgtatttatgtaggagagttttggactatatagaaaggacaggaaatttatatatatttttataactagaaatcattagcttattatgtggggagctggataggaggattttatggctgcatctaaagccaaaggtaaattggtaagtatcgttatcaataacgagtatattaaaatatgtgaaatcactaaatcaggtaagaacagtgtcgttcataagactgttacaattcctgcaccggaagactgctatgttgagggtgtaattgagcagactgacgtacttgctaaggcaatcaaggttgttatggacgagcatagatttaatgctaataatgtcgcattttctatcagttctccaagacttgcaactaaggaagttcttattcctaatgttaaggctaataagattgataaacttgtacaggctaatgctacagagtatttcccagttaatatggatgagtatatcattcagtatacggttcttgagaaagtagaagatcagggacaggaaaagattaaacttatggttgctgctgtaccatcagaagttgtagagtcttactatggacttgctaaggctttaggacttaaggtggcattcgttgattatgctggtaacagtacataccagattatgaagcagcagattggaccagaagtcagccttgttattcaggttgagaatgatggtactgtaatcaatattttcaaggataatgtattgcagttacagagaaatgttccttatggaaagtcaatgcttgttaatgcagttatggaaaagtatggacttaagtatgaggctgcgacagcaaagcttcagaatgaaacacttcttcactcaagatttgatggagatgaggttacagaatcattaagatatatggcaagtaacattaaccgagttattgattattatgtatcgcgtaacagaatatcaatccagaaggcatacttaatcggacattctacatctattaagggctttgcaacacttctttctaatgagcttaatatgccaatcgagaaggttgagagacttaagaatattgcactggacaagaaagcgtatgttgaagaggctactcttacaagttatgtaactaacttgggtgctgttattgatccggttgattttattcctaagagacttattgagagtggtgccagaaaagaaaatacaaagactcttatcgtaggatttgttggagcccttgcggtttctgcactccttgttcttattccacttgttcaggttgttgctcttaatgcagagattggatctcttaataagagtataaagaagctgagcattattaatgatgttgttaatgaatattattcagctaaagacaaatataatgatatcgcagcatttgcagcacttacatcagacagcgatgacgcattacaggattttgttgattatcttgaaaagaatatgccaagtgatattactatccagtctttcaatgttgcatcaggagcaattactgttaatggaacagcgggaagtaagtcttcagtagctaagttcattcaggaacttcagaagaattcttctgtacttaatgttgatgcccctactataacagagactaaggataatgcaggtacaattgaagttacattttcattatcatgtacatttgttggaggaacatctaatacaactgatatgaagtcatctaatacatcaaacagtactaaaaatagcagtactaagagttcaacaacaaagtaggaggggagtcagatggataagttaaaaggtatgttaaaaatctctgaaagagacaaaaagttattggttgttgtattagcagtgcttattatggctcttgcttatttctttggatttcagaatctttcagaccaggtagatactttatctactaaaaagactactcttgagacaactcagagagacttaaaagaaaagaataacaacaaacagaagtatgttaatgatacaatgaattatcttaagcagtatgataatcttcttgacagatatgcggcagggagcacacagcctaattcaattgatttctttaacaagacagagtctgtaacaggaacatgggtaagaagtctttctttatcaccaacaactgttctttacaagttcggtcagattgcttcaagtaatgtaaatggaaaaagcaattatacttctaatcttaccggctataagtcaactattaatattgcttatgaatcagattatagtcagtggaagaattttattaaatatgtcaatacatatgctgataagagcacaattgatgctttatctgcatcttataatgaggcaacaggtgttgttacaggaacagcatctatttcactttattcaattgaaggtggaaagcgtgattataaggaaccatcatttgatgttaagacaggaacaggaaatatattctcaacagttacaccaactgagtaataagagaattcagggagagggatatgaaattatatagaaagaatagaaaattgaataattccggtttttcactggttgaagtactggtagcgattgttattcttgcaatcatatctctaccggtattgagtacattttctaatgctgcaagaattaacaataaggcaagaaggactgaaaatgctaatactgcaattaacaatattatagaggaagcaaagagtatgagtttggacaggcttgctggtggcaatggacaatatacttatcagcagcttggtgggattgacagcacaacatattctgtgggtaataagaaagatgcttctaatattctttattatgagggtgtaaataaagaaaaattttacattaaagcagaatttgatccttcaccttatacaacacctgctgacagtacggttaaggataatcctaataataatattaattcagcaggaatatcagtatatgcagatgtttcagcggacagttcactcgtttatcgtgatgataacagtgataatcaggcagttgcacattttaaatattatacaggtgagcaggcatttgacaggtctaagattactaagagtacatctattgatgttaatgtaacaagaaatacttcagatgcatctaaggttttatttgaccagacagcagttattacagttacatatcattatgatactgtgcttagttatcctgattatgttaagacaactacacttacaactaatacttttgaagcggaagaacgtgaggaagatgtaagtggtacaaagcagactgtttattacgtttcaggaaagattaagaagaatataaagaatctgtatgtattctatactccgtttgatgattatatcagtactaataagaagggtacaacaactacagatggtactatggaagtatatgttaatgataagattaatgtaacatacaaatatccggcagaacttaccaatgtaagatatagtgaccttaatgtatatcttcttgagcaggaaaagataacgcaggaaaagaatgcagatggttcagtagcatcagcacagaaatacagaatgttggttgatcataataaagttaaagttacatttaatactcaggttatgggtaatcttgctgataaagcaggaaacaaggatactgcagcgagaatttattctaatattaaagactggaagtctggttcttcatcaaaaacagaagattctatgtacagacttacagtgacagtatattataatgattcaactatgtcagatgattcaaagattgcaactatgacatctactaagattaattagtcagtgaaagaatggagacagtttatggggaaagtattattgaatttgaaaagaaaaagaaataattctggttctactattgtaatagtgcttattatgacttcatttgtattgattctttcaacactgattactacaactacaatggtcaaccttaaaatgaagatgatagcatcacagtctaaaaagacgttctacacatcagaagaggctgttgatgagatatatgctgcacttggaaaagcttcaatggagtgctttaatgcttcatatgaggaacagcttaccacattatcaagttatagtaaggtcgtttctgacaagcataataattttgcaactttggttgagattgataatgaaaaagcaaatgttgctttaagagaaaattatatgcagaagcttataggaaagctgttgccagattttaagacaacagattttagtcctgtatataataataattatagctttgatggacacaaggagaagttcattgaaatattgaattcatatctggagaattattctacaggtgttgataaggatggtaatgctacgggagatcctattcttgtggtgcaggatgtcaatactatccgtatgagaaatacgagtgataagaataatggaacaggtcttaatgtgtatgcaatcacatttacagattgtgtcgttaagtatctgacacagaatggggactattcttatattacatttaatggagcagttgggcttcctgatatatatgttaatttcatggacgaagaccttgttggtacaacattctttggtaattatgcgttagttggtaatactggtattaatattactgacggaggaacagcgataattaaaggaaatgcatatgctggaagagcatcaggccttaatattaagggttcaactcttgattttacaggcagttatcttatctgtggaggtagtcttaaccttaatattaagtcaaaaggagagacaggagcattatctgcgtcacagcttaaccttggtggctcttcacagttatggtctgatgagattgtacttggaaataatgccacatttaatggcgctggtgcagtcaatgttaaggatgaccttactattgagggggatgattcaagtgcagttcttagtggttcttatgaaggctttggatatgaacctaaggaaaatgcaactcattatgacagtagtgcggtaattattaatggagaaagagcgacaattacattcagttcatctctttcaaagcttgttgttgctggccgttcatatattaaatttgagacatcagtaccgcttgcaacaggtgaatcaatttcagttaatactaatcaggaaatatatcttgttcctgcacagcttttaaagagtggttctaagaatccatctaagaagcagacagcaggcaacggaatcaagtgcgagactaagataagtgagtcaacattctttggatttgatttgttaagcaagaatggtgatgattattatgtgaccagagattatgatgtagctggttctggtcttaatacaattgattatgataagtcaagaacatattattatttcagtttcaaggatacagcatcacttaatacttatgctaagattatatatgattatacagattctcagtttgaggaattccttaataatacttcttatgcacagaaatgcagtgctgcagagaaaaatgattatattaaggaatctaagtctttaagaaatgctattaagaaatctgtaggtacatatgccggacttagtggttcatcagttgtaagaagtgaaagtcttacagatggagccagccttggtatctttgctgataattcaagttttgattttaaaactgaatattcagacagatcgaatagatataatgtgtttaataagatacttgcgcctcttggggattcagtaacatatacaacaactcagcaggcagaggaatatcttaatagtattgctcataataatattgctattgatcttagcaagtacacacctgatgatgtttatgacaatattattaataaagatggttttgcagaagttactgatggtaaggcattcagcaaacaggtagaaggaaaatggtttatagcttatgcgttatctgaagtatcagcatcaaaaggtatagaacttgttatagatagtaattcgtctgaatcaaaatcaaatattcttaagataacttcgggcgttgttgtctgctctggtaatgttcatattaagagtgattttgatggaattgttgtttctaatggaataattacgattgattcaggagtgacagtttctaataacatattctctgattcacttttcagaacatttattgatgaccatgaagcagagcttacagatactaatggaaaaggcaagacagtccactataaggatattttcagattctggaatccgcatgttgaatctaagaaggattcatcacttagtgtaagcaatatgacttataaggatatggttacattcagtctctggaggaagtacgaagatcctaagggaactaatgttgagtctacaacggaggcacctactaatccgtcataatacggaatattatagaaagattatttaatggagatgtgatgatgagcaggagagggaacagacattttaagaaacaattaaataatcagggattttctttattggaacttcttgtagtaatcgcaataatcgcagttgtttcacttcttgtaacagtcggacttacagttcttaacaagggaaatgccaagaaagctaataagaatctttattcaagtcttagtgagttaaagacaagtactatggctaagaatgggaactggtacatggagattggtaaagatggagattcttatgtatttactacatataaggatacaggaagtccattagaaacatacaaatgtagtgcttcaaggatttctattgtatatgaagctggtacttcgtcgtataatgttgatgattatacaattatggttaagttcagtaaagcagatggttcatgtgacagtgtgacagctactaagtcaggaatggatccggttgaacttaagaatacagcaacttcaggaacatttaaggttacatcatctggtgttgattatgaatctaagctatggtataagaccggaaaagttacgacatcgaactagtttattaatatggagtggagttatgaagaaggataacaagggattctcattagtggaactgcttatagcgatagcaatatcaagtattgttcttatggcacttgtaatgcttattacacaggcggtcagaagttacacgaagcagacagctctggcacagatacagagtgatgcggatataagtcttaatcagatgtcaaagaatattcttgaggcaacagagataaagattgaaaagctgaatggggatgtaactatatatactaataaggttattgagaaaaagaatagtactgaggtaggcattgaatggggatactattatgaaagtgcaacacagcagctatggtatatcaattcagataagtcagaaatgagtcttgtatgtgataatgttacatcatttgatgtaagaatatcaaaggatagtatagagcttgatacagcaacaattaagtcaattgacaggaatccgcagattgttatttcgttaggcttacagaggatgaatgaaaagagaattgtttcaagaacattttcaacaagaaaccagcttaatgataatataacacttggcaagtctgttacatcgattgaaggagataaggacgatgttgttaatacacttaaggttggcaacacgttatcagcagcacagataattgattattttacagataattaagtaaacgggaggtaatctttatgaagtcaaagttcaaagaaaatggtaaaaacagaatattggcagtgattgcttctgcagttatgttttgtcttgttgtgcttctgataattgttacacgaaagactgatgcggtggcagatacttcggttattattaatggtaaggaatattcacaggataataagatgaagattctggagattgtttctgaagattattatgatgagttaggaccgattataggtaattcatctggtagtgtcaagtgggatgatattgtagcaaaggctactgataaaaaggtagcatctaatagtgatgtacagaagaatatggatgtgtatcttcagtatgttaatggtattcttttaaacggaactaattataatttatgccttgagtataaaagtggcaactcatacaattattacactacttctaatgatgcaatacagaaggttggcactttagatgttgataatataaaacttattttctgtaaaaaagatggtaatagctatatacctatgacaacaaaaaacggttctaagttaagagatgcattttctttctttgtatttggtgacaaaggaatggaaggatttgttgatcttgtaatcaagaaaccgtcagaagttacaaccaaggatatagatgatgcgactattgtatatttttcatgtaaaatacacaatgcaggaatattatctgcatataattatctgaatggaactaatgtatcttctacagagaaaaaatggacattgggagacaatgacttatcagcggaaacagcactttacttatatatgttgaatgctactaaaggaaaagccataatgtataattctgccgataaaggtcttggaagtgataataagtattctaatattgcaagaatatgtcttactatgtctggtattgacagagatcagtttgttacagattttgcccataccaaagaaggcataagcggaggtgttacaggtaaatattatagtggaaatgtaggatatattaatattgatgacgaaaatggcaagaaggtaattaattattaccttgaatctggagaaaaaagaagctttgaagatgccggtggctcaggaccatttgcttactggagaagttatcagatgatttttgaaccggaaaattttaaaaacaataagtcagattgggttactacatttcctatatataatgcaacggaaacaaacagacagaagtatatagataagtatgtatgggaattcaattcggataatgctattacatcagaacttatgtcaagtaatgtgtatccaagtaatgcccaagaaagtgatattaagtatggtacaacatatgacgaagctaagacatttactaaggacaataagactatagatgctgaacttaccggagcaaagataattcagtatattattggtgcatataagagaacacctagtgaatctgtcaatgtacttgaaattgagcctattggtgtatatggctataatactgatggcggtaaggatattattaagacatggtatggcttgccaaagacatcaagtgtaacggttaatgttacaagtatgtcaataaatgcatttgcaggacttaatgaagatattctttcaaagtatgatcttgttattattggtgatagaggttctgcgcagacagttggcaaagtatttggttctcatatgtataatactgacagaacatttacagaatcatcaaagacatataatctgaatgctaatgacctgactgagaaagcgtttaataaactttttgaatttgcacagaagggtatgccgatagcacttgataagaatgtatattatggcaataagtcagttgtagacagtaacactaacatgtataagatgagaaaatctaatcttgcaatgcagcttacaaagacaggatcatctaatattgtatgggtagataatgatgagatatcagatacattaaattatatctataaaccgacaagcaacatttcacctaatatgaaagagtatgatggaactgaggcaagtgttaatgaaagagattttgacaagagcctgttagttacattttcaggaaatgtaactgttccggtaagggatggttcatataaagttaagatatacattgacagaaactgtgacagtatgttttcagaagatcatacaacagatgatactgagttattctattgtgaaagtgatggtacggggatacagtggactaatggaggttttagtacaacattgtctctgccaagtggacttaccggttatgttggctggaaggttgagataactgatacagatacaggattaagaacttatacttctggtgcatttgcattgaagaataaggagagaacaataaatgttttacagattaagagtaattcacaggagtcacatcttaatcttgctcctggaagcaagtttgatgaaaaattcaagtcagaagctgggattacagggtttaatctgaaggttaaagaaatgaccaaaacagaattttcagaagaattaaagaagaatcctaagcttcttgatgattattctatgattgttatgggatttgctgataactatggtaatgataatgatttatctgtcgatgcaattgatgctataaaaacttatattgatgatggaaaatctgtactgatgacacatgactgtatgtcttatagggagaatggtacaggcaaaaaagcagctggttcatatgagaaacttaattatgctacccagcagttgaaacctttgattggaatgaagggtggatatagtttaacagatactcttatatataaattatcgggtgtaggaccatttactggttcaggcgatacaacaagtaccagaatgacaagcagcctttcaaagctgaatactggtgaagttacatcttatccttatggaattgattcgtcaataagtgttgctccaacgcatgcacagtattttgcccttaatcttgaaacacaggttaatggttcagatcctgttgtatggtatactcttgataatggtgataagaattatttttcattatcaggtcaggatgctgttaataattactatatatattctgctggtaatgttacatatactagtgcaggtcattctgatatggataaagaaggcactgatgcagagatggagctttttgttaatacatttgtaagagctattcttgctggtaacagtgcaccacaggtttcatatacggatgctgtttatgatgacacacagaaggcatatagtagttatattaagtataattacacaaagttcgctgacaggcagcttaactttaatttcatgatatcagatgccgaccttattgatggcagaggtattattaatgaggctttcatgtatgtgtataatgaagaggcgcgtactgaagagtcacagaagaacggtaagtttgattcgtctaaggacaagagacttggctatatcagtatagatggttctggaaatgtttcacttacgtcgatgcctgtatcgtcaggttcatctaaggttaaatctggtgtggaatatacggttgataatttctggagtctgtcaggggcagatgatgcatcattgagacagaagctttcggatggaactcttaagataggtattcaggcaactgatggtcacaatggagttggttatgcaatacttaatcttcaggtaaaagatttgtttaatatggattaatttaatatcagtatggattaaactccggtggatgaactctcatatagagaggctctgccggagttttttgttaggaatcatacaggagaggtattctatataaaatataatgatatatatattgacattgattatacataatgataatatattaatacattatatacgcagtgcgtattataataaggattatgcgtttagaggagatatatggggaagagtgtagacaggaaacaggtagatgattataagctgtcacttgtaagattcagggatgttgttaagaagaattttgatggaattgagcttgtagtattaggattggaactgcaggagcatattcattatggaatgccgctaagaactatgatatatgactcacttgggtatctgaaagaatttgagggagtaagaaaggggagtcggttattatgtgtgaagcatggaaagagtattatgatgaagcaagacaggatgggtttaagtctggtaaagaacagggatttaagacggcaacaatagaagatataatatttatgataagatatggaatatcaaagaaggatttattaaagaagtattcagaaaaagattacaacgaagcactttctaagatggctgcgaagtaaagatgaaccaaccagattatcaatataacacatgaggtctggttgggatttttatacaatgaatatatattgataattgttttgagatactataatcataaaagctgaacaaatacatatttaagtattgatagtaaaaggaggcggtatttattgtacagtagtgtattgagtggggtattatatggattgaaggcagagattgtacgggttgaggttgatgttggcaatggtattccaagttttgagatgagtggttttcttagcaatgaggttaaagaagcgagagaaagagtaagggttgctatccgtaattctgggtatgagcttcctccacagcgcattgtggtaaatatatctcctgcagatatcagaaaatgtggcacaggttttgatttgccgatagcactggctatattatcagcaaatggttacatagatgaagttaatgttgataatatgattatacttggtgagttgagccttgatggaagcattaatggtgtaagcggggtattgccatgtgtatgtgaagcaaagaaatccggaataagtaaggcacttataccagtgtctaattataatgaaggcagaattgtggagaaagtgaatatcattccgactaacagtctgaaaatggcggtgcaatatatcaataatggtataattgagaaccagagacaggataatccagaacaatgccgtacaatagataaacaagaaattaattatgcagatatatgtggacaggaggctgcaaagagggcgactatgattgctgttgccgggatgcataatatcatgtatatcgggccgccgggaagcggaaaaactatgatggcaaaacgtattccgtctatcatgcctgatatgacatttgatgaaaaattagctgttaccaatatatatagtgttgcaggacaattaggagagtatggcgggatgattgaagacagaccattcagggcaccatatcacaatgtaactaagagttcattctttggtggaggcatgtttccaagaccaggagagataactcttgcgggtaaaggtgtattatttcttgatgagatgacggagtttaagccagaaatattagaaggattaaggcagcctcttgaagataaggatataacaattgtcagaatgggcaggacatatacatatccggcagattttatgcttgttggagcgatgaacccgtgcaaatgcggttattatccggataggagcagatgcaattgctcagaacaggatattaaaagatatattgggaaaataagtatgccactatgggatagatttgatatgtgtatcaagacagatgaaataggatacgaacagataaggtgcagcagtgataatggtaatgtgccagattcagaaagcatgaaacaagctgtaatgcgtgcaagacttgcccagcttaagcggtttaatgggatgaatataaagtataattcacagatgagtacaggagatatgaagaaattttgcagacttggagaagaggaagaaaaattaataaaaaggatatttgcaaagaagcgtctgactgcaagaggatattcaaagatattgaagactgcaagaaccatcgcagatatagatggtaatgttaatataacaacggctaacataagcgaggcgttctattatcgtggaataccagaggtgacaatacattaaagaagcaatacactaggcaggaggtttatcttgaaagatgattattattggttttggattaataatattacaggaatagctaacattaagctgagatatttatttaaggtattcgatacaccagaggatatatataaagcatcagataagatgtttgagggtgtcatgggaataaaacctgatgatatatattctataaaggaatctagaaaaagtgagtatatatatagggaatattctgaactggataagaagaatattaaattcacatatccgggtaaatataattatcctgaaagattgatgaatatatacgattatccttatataatttattataaaggaaggctgccacagtcggacgttccgtcagtagcaattgtcggggcaaggaactgtacagaatatgggaggtcagtagcaggaagatttgcagaagattttgtagacatgggaattcaggttataagtggaatggcacttgggatagatgcggcggcacagaaaggtgctgttagaaaaggcggttatagtatggctgttcttggatgcggggttgatatatgctatcctagaactaatatcgaattatacacacaacttgagagcaatggtgggattatttcagaatattcaccggggacaccgcctaaagcaggtctgtttcctatgagaaacagaattattagtgcaatgtcagatgcacttattgtagtggaggcaaagcaaaagagcggctcactcataacggcagatcaggcacttgatcagaatcgtgatgtttatgtcgttccgggaagaattggggatactctgtcagaggggtgccttaaacttttgaaagaaggagcacagctgattacatcatctaaggatatatatgcaacagaatccattaacagatatattaattgtagcaaaaaagatgataattgtaggaatagtttgaataataatggtatatttgaagagaaatttaaaaaatcaggacttgcaagccctaagaatatggtgtatagtcaaatcaatttgtttccagtaagtctggagatgatagttaataattctggattgaatcttgtagaggcggaggggattctgcttgaattggagttagatggacttatagaagaggtttctaagaattattatataaggaagcatatttgatatggagggttattaatgcataagtatttggttatagtggagtcacctgccaaggtaaagactatcagtaaattccttggggcaaactacaaggtaatggcatcacagggacatgtaagagatcttcctaaaagccagatgggtgtagatgttgaacatgattatgaacctaagtatataacaatcagagggaaaggagatattcttgctgctttaagaaaagaagcgaagaaagcagataaagtatatctcgcaaccgatcccgaccgcgagggagaggctatttcatggcatctggcagtggcacttaagttagaagacaaggatatatacagaataacatttaatgagattaccaagaatgctgttaaggcatcgcttaaggaagcaagaaagattgatatgaatcttgtagatgcacagcaggcaagaagagttcttgacagagtggttgggtatggaatcagtccacttttatgggctaagattaagagaggacttagcgccggaagagtacagtcagttgcattaagaatgatatgtgacagagagaatgagattgatgcatttattccagaagaatactggactatggaggcttctcttaatataaagggagaaaagaaaccacttgttgcaaagttttatggggacagaaacggaaaaattgatattaagaatgcagcacagatgcagaagattcttgatgaagtcaaaaactctggtttcagtatagaaagtgttaagaaaagtgagaagattaagaaatctccacttccgtttactacaagtacactccagcaggaagctgccaagacacttaatatgtctacaaagagaactatgaacatagcacagcagctttatgaaggtgttgatattaagggcagaggaacagtaggtcttataacatatttaagaacagattctacaagagttgcagatgaggcaaaagttgcttcaaaagattatatcagtgagaattatggggaaaagtatcttccacaaagttctaatgccaagaaggatgataagaagattcaggatgcacatgaagcaatcagaccaactgatctttctttgtcaccggcattagttaaggaatcattgcagagagatcagttcagactttatcagcttatatggaagagatttgttgcgagtcagatggcacctgcacagtatgagacaacttctgtaagaataggagctggtgaatatatatttacagtatcagcatcaaagattgtttttgatggatttatgtctgtatacaagactgatgatgataatgaagaaactaatacacttgctaaaggacttgacgagaattcagtccttacacttgatgatgtgaatggtacacagcattttacacagccacctgcacattttacagaggcatcacttgtaaaagcactcgaagaacagggaataggacgtccaagtacttatgctcctacaatatcaacaataattgcaagacattatgtaattaaagaaaataaaaatctttatatatcagagcttggcaatgctgttaataatattatgatgacagcttttcctactattgttgatgttaagtttacagctaatatggagtctcttcttgatggtgttgctgagggaaccgtggaatggaaggaaattataagaaacttctatccggatcttaaagttgcgattgatgaggcagaaaaagaacttgaacatgttaagatagaggatgaggttactgatgttatatgtgacaaatgcggcagaaatatggttattaagtatggtcctcatggtaagttcttaggttgtccgggatttcctgagtgtcataataccaagccttatcttgaaaaaataggtgttgcatgtccaaaatgtggaaaagatgttatattaaagaagactaagaagggcagaatgttttatggttgcgaaggatatccagagtgcgattttgtgtcatggcagaagccttcagataagaaatgtcctaagtgtggcggatacatgattgagaagggcagtaaacttgtatgtgctgatgaaacctgcggatatgtcgaatcaaagaatgataaagagcagtagctgatatatgtgaattgctttttaaaagaaggatgggggatttacaatgagtgttcagcttctcgacaaaacgaggaaaattaataagctgcttcacaataatcattctcacagagtggaatttaatgatatctgtgaggtgcttagtggaatattagagtcgaacattctggttataagccagaagggtaagatactaggagcggcttcatacagcggaattgacaaaataggtgagcttataacagctgatacaggcggatttgttgataatatgcttaatgaaagattgttgggagtgttatcaactaaagaaaatgttaatctgcttacattgggcttttcaggtggaagtgaacgtaagtttaaggctttaatagctcctgttgacatagctggggaaagacttggaacattatttatctataaatgtgttgctgattatgatatagatgatattattctatgtgagtatggtgcaacagttgtaggattagagatgatgagttctgttaataatgagaatgcagaagatgagagaaagaaaaagattgttaagtcagcaataaagacattatcggcatcagaactacaggccgtcaaagcggtatttgcacatatggatggaatggatggcattctggttgcaagccgaatagcggatgatacaggaattacaagatctgtaattgttaatgcacttaagaagtttgacagtgctggtgttatatcaacaaaatcttctggaatgaaaggaacaaagataaaagttcttaatgaagttgtatatgatgaattaaaaaaacttgaagattgagagtatacattgtataattgatagagcttaaaggattgagcttgagatgatgggatggatccaatgtctgattgggttcatctttttgtataagtatacatattgatacatgataatccaatgaaatgtggcaaaatatgaaaaaaatcttgttttttttatattataatttataatgtatgtagtgtttttatgttttcgtagtaggcatattttgtgcttattgaataagaaaggaaataaatatgagtacaggcgcttttggatatgttaatttgttaaagtcagcggcagatgcgagctggacaagagaggaagttcttactaacaatatagctaatgttgatacacctaattataaaaggcaggatgttgaatttagttcgtatcttgccaatgcactccagcgttcaggaaagaattcagcatctcttacacagagagttaataatgttaattataatgatctggctataaggacttacactgataacagcacattatcgtatagaactgatggcaataatgtagatctttcaacagagaatgttgaacttgcttcagaacagattaactataatgctcttattgacagtatgaataatgagttttcaagatttaaggcagtgcttaaataatatataatgtgattgatatatggaaggagaacaggactatgtctatgtttacggcatttaatattagcgcatccggaatgacagctcagcagttaagaacggatgttatatcagagaatatagctaatgcagacacaacaagaacgagtgatggaactccctatgtaagaaaagcggttgtgtttaccgaaaagacaatgactggtacagcacttggaaagtctgcgtatggttcatatggtacaggagcatattcaacattttcagatgcattaagacttgccaatggtggtgttgttggaagcggcgttaaggtgacatctgtatatgaggatacatcaacagatatggaaagggtatatgatccttcacatccggatgctgatgagaatggatatgttacatatcctaatgtgaatgtggttcaggagatgacagatcttatagatgcatcacgttcatatgaagctaatatatcagcatttaatgccagcaaatctatggcaagcaagggactttcaataggttctgctacataacatatgtgaataactggtttaattcatacgattaatactatatttgaacaaaaagaggagatttaacatggatcttactagtgcaataggaagccttggcggtgattatgtcaataaggttacatcggcaatgaaagagaatgcgtcacttagtacatctaaaagcaaaaattcagatacaacatttgatgctatatatgactcagtggcagggttgctgaacagtaccaactcatatgtgcagaaagcacagcaggcagagatagattatgctcttggcaatatgactaatactcatgagcttggagtttatcagcaggaggctaatattgctctgcagtatacagtagcaataagggataaggcattggaggcctataactctattatgaatatgtcaatgtaattaggggttttatatggataaattaaaacagattccagccagatttcttgaaatatggaaaagctggtccagaaatcagaagataataattgtgagtgctgtagctgtatttattgcggcggttgttgttattgcagttgtgttatcaagaccaacatatcaggaacttacaagatgtgaagattataatgagatgaatacagttacttcactgcttacagataatgggtatacatatcaaattgataatatggcggttaaggtaaaggaacaggatcttactaatgctaagatgcttattgcttctaatgatattaaaccttcgggatattcattagatgatgctcttaatagcagtcttacaacaacagagtctgataagaataagaagtatgccaaatatcttgaaactaagtttgaaaatgatattacttctttagacggaatcaaatctgcatctgttacagtacatttgtcagatgatacgaattcattctattctacaaagaaagatacaactgtagccgttacgattgatactaataagacagttggagaagacacagcggaaagtatagcagttcttcttgcaacagcagtaggaagcagcaatactaatggtattacaattattgatacatcaggaaagacattgtttaatggagctgataattcgggttcagtttctaatattgcttattcaagcaagttaaagtataagtcacagattgaatcaacggtagcagcaagtgttaagaatacagcactttcaacatcactgtttaatgatgcaacagttgctattaatcttgatcttgactgggatactgtgaataagattgctactgagtatacagcacaggaaggcagagaagaaggtctgtatgatacttcttatgaacttgaatcgaatggaacaaatggtgcaggtggaacaccaggaactacgagtaatggagaaacaggaacaacctacgatcttacagatggtacatcaagttcatcaacatatactgtaaaacagtatcagtatcttcctaaccagcttgttactacaactaatagtgatcctggaaagatagtatatggtacttctacaatggctgtaacgcttataaagaatgttatttataatgaagaagattgtaagaatcttggatatcttgataatatgacatgggatgaattcaaggctcagaacgcaaatcctgttcaggttaatgttgataatgactggatgaatatgttttcaagtgctacaggaatctcaactaataacattactgttttagcatataatgtaccttatttctatgatgcaccgaagactagcgtattaagccgtgcttcattctggattcagattggactggctgttgctatacttggtattcttgtgtttatagttttgagaagcgcaagaccacttacagtagaagagaaggaaccggaactttctgtagaagaaatgcttgcttcaactaaagaaaaccagccttctgttgatgatattgatcttcaggagaagtcggagacgagaaaagctattgagaagtttgttgatgagaatcctgaagcagttgcattactgcttagaaactggcttaatgatgactggtgattattatgatggataggacctgaaaggtcaattgattacatatgattggagatggaaacatatgccaaagacatcagctaatgctgaaagaggaatggatggtgtagaaaaggctgctatattgcttattgcacttggaccagagaaatcagcacagatttttaaacatttgaaagaagaagaaatagaacagctgacacttgagattgcaaacacaagcagtgtctcacctcagacaaaagaacaggtgcttaatgagttctatgaggtatgtcttgcacagcagtatattgctgagggtggtatcacatatgccaaagagcttcttgaaaaagcacttggagaagataaggcaagagatgttattggaaagcttacagcgagtctgcaggttcgtccatttgagtttatcagaaaaacagattctacacagcttcttaactttatacaggatgagcatcctcagactatagccctgattctttcatatcttcctgcagcacaggcttcgagtgttgtttcagcactgccacctgaaaaacaggcggatgtagccaagagaattgccatgatggacagaacatcgcctgatgttatcaagcaggttgagaaggtacttgaaaggaagcttgcctcacttgttaatcaggattacacaattgttggtggtgttgatgccattgttgaaattcttaattctgttgacagaggaacagagaagcatattatggaaactcttgaggttgaagagccagagcttgctgatgaaatccgtaagaagatgttcgtatttgaagatattctttctcttgataacagagctattcagagagtactcagggatgttgataatcatgatcttgctcttgcacttaagggggctacagaggaagttcagaatgttattcttaataacctttcaacacgtcttgcttctatgattaaggaagatatggaatatatgggacctgtacgtatgaaagatgttgaagatgctcagcagaagattgttaatattatcagaaagcttgaagattcagcagagattgtaatatcacgtggtggaggtgacgagataattgtctaatctgttaaaacgtgtatacacggtgaataaggacgaaagagtaattgattataatgatctgattaagaaaaagctagaggcaatcatggagtctaaacatgcagcagttgatacagatggatttgttagcggactcaatgcggacgttgttgaagaacttatatcagatgatagttcggaagaactaatacaggatagcggagctgattctgaccagtctgcggctgcattggaaaatgctaatgctgaagcagcaagaattatagaagatgccagacttcaggctgaacagattgtttcagaagcaaatagaaatgctgatactgcatttgaagaagccaaacagaatggctattatgaaggctgttctaaggcagatgcggaaattgaaaagaagcagcaggagcttgagacggagtacaataagaaaaaatcagaacttgaaaatgaatataacgagctaaaggactctatagaacctgaacttgtggaagttattacagatgtattcagaaaagtcacaggtgttgtaacggaggataatcatgatattatcctgcatctcattaacgatgtcatgcataacgcagatgcaagcagagattttgttataaaagtatcgcctgatgattatagttttcttattaataatcagggcaagatatattgtgcaatgtcaagagaggtcaatatagatattgtggaagatgttacgcttgaacggaatcagtgcatgatagagacgaatacaggtatatttaactgtagccttgatattgaacttaataagcttattaataatattaaacttttaagctgcacaggctgatgttacaagtatgatcagaactaattttattgttaaggaggatgatatgtcatcaattaataaaaacaaatatttatcgctgacagaaaaatccttctataagaaacttgggaaagtgactaagattgttggtcttactattgaatcggtaggaccggacgccaagcttaatgatttgtgcagaatttattctgcggataacagtcaggaattatatgcagaggtagttggatttaatgattcaaatgtgcttcttatgccatatgatgttgtggatgggataggtccgggaagtgttgttgagaatatggaacgacctttgtcggtaaaggttggtgatggcatactaggacatacacttgatggacttgggaatcctacggatggttctgaattagaatatacagatgaatatccggttgaggcagcaccgccagatcctatggacagggagataataagcaaggtgcttcctcttggcgtaaaggctgtagacggattacttactgttggcaagggacagcgaataggcatatttgccggaagtggcgtaggaaaaagtacacttcttggtatgtttgcaagaaatactaaagccgatattaatgttattgctcttataggagagcgaggcagggaagtaagagaattcgttgagcgggatttaggcccggaaggtatggcacgaagtgtccttgttgttgcaacatcggataagcctgctctcatacgaaataaggctgcgaagactgcaacagcaatagcagaatatttcagggatcagggcaaggatgtgcttcttatgatggattcactcacacgtttttctatggcacagcgggagattggacttgcgtcaggtgaaccgccagtgacaagaggctatccaccgagtgtatacagtgaaatgccaaagcttcttgagagggcggggatgtcggacaaaggttctattacagggctgtatactgttttggttgatggtgatgattttaatgaacctataacagatactgcacgaagtattcttgatggacatattgtgttgtcaagaaagttaggacagaaaaatcattatcctgcaattgatgttttacagagcatatcaagatgtatgagtcagattgtagacaagaagcataaacagatggctggcagaatgaaaaatgtaatggcgacttataatgaagcagaagatcttattaatattggtgcgtataagagcggctctaaccgtaatattgattatgctatatataagattgatgcagttaataagttccttatgcagcagacggatgaaaagtttgattttgaagatgaagtcacacaactgtcagatatatttgcggattatgaagcatttgaaaatggctcacttcagttaaagaaatagtggaggcatgaatggcaaaatttttatacagcatgcagaatgttcttgatattaaagaacgcctggaaacacaggctaaaactgaatatgctgagatgaataacaggcttttcattgaagaggaaactatgaaaagactcggaaaaaggcttgattcatatgaaaatcttgcgagaagctctgcatcagaaagacttgatattatggaaatgcgcagatgtaatgaggcaattgatattatcaagaaccagatgacacagcaggcggtcagaataaggattgcacagcgcaatgttgataatgcaatgaagaaactgactgaggcagtgcaggacaggaaaattcatgaaaaactgaaagagaaagcatttgaacagtttaaacttgatattaatgctcaggaaatgaaagagatagatgaaacggtgagctttaaatataataacaaagatgagtaattgtttttgggagaaagattgatatggctaagaaaaaagatgttaatattgatgaacttgatgatgaatcaggaaagagtggaaagctggtaagcatactggttgcaatgcttattattgtaatatggcttgttatatttgcacttcttattaagatgaatgtcggcggtattggaagtagtttacggccatatcttaaaaatgttccggtagtgaataagattcttccagcagctacagatgaagaaattcaggaagaaacagggggaaagtacaagagcctttctgaagcagttgacagaattaaagaacttgaagcacagcttgatgagaacaataataatgggaatgcatcagcccagacaattgctgagcttcaggctgagattgccagactcaaagtgtttgaagagaatgcacagcattatcaggaacttaaagataagttcgatacagatgttgtatatacagataatgctccagatataagtgaatacaaatcgtggtatgaaagtattgattcagaaaatgcagcaaagctttacgaacaggttgtaaaggatttacagtactcacagcaggttaaggactgggcagaaacatattctaagatggatgcgaaaaatgcggcagctattcttgaagagatgactggagatacagaccttgtttctgatatacttctttgcatgacgtctaaacagagagcagcaattcttgcagagatggatcctgtatatgctgcaaaacttacagttattatgtatccagctaaaggttaagtctgtagcacagactaccgatatataatatggattaggtctatcctgattctaatatgaagaaaggaggaggataatatggtaagttcagctgttacaggaatggttcagccggttactaaggtggcaggaagtgttggaagccagtctggtcaggataattccgggaatgttgattttgcaaggataatgaatagttctgtaagaaacgatgtgactgggaattcatcaaagcagactaatacatattcagcagctccatcagattcacttgtaagcatgggtgctaataagtctaacaagaatgcagatattgttaccactaattcaactgtaaaaaatgtaaaaacagataatgcggttaaagaaaacagtaacaaaatgactcaggatgtgcagaatgcagtgtcggacattaaagaaaagattaagaaaacaatgaatgtatctgatgaagatatagagagtgctatggagaagcttggaattatagcagaggatttgcttgacatgcagaagcttacggatcttgtagttgctcttagcggaaacactgattcacttgagtttttgacagatgcagattcagtatctatgctcaatgatatactggaatatgcaaagtctgtgacagataatctggaagatgtgtataatatggacattgattcaattaaagaaatgcttgtttctgcgaaggatgatgttaaacagtatgttaaacagtctgtggtgaaagaagatgcacagccagaagaacggccggaagcagcatcacagtatgagttaagcaatgtaattgcacagaagactaaagtgcaggctgataatgacaataatgcggatgataagcagcagactcatatgtctgataaagcatctgtgcaaaatgaaaactttaccgggaatatggcacagaacatccagaatgctttcagcgagattattgatgaagtttctaatgttaatgaagctgatattgtaagacaggttgtagaacagattaaggttacaacaggacagcagctttcaagtattgaaattatgcttaatcctgagaatcttggaaaagtacatatagctgtcacagcaagacagggagtaattacagcacagcttacagcacagaatgaacaggtaaaagctgcccttgaaaatcagatgacagctttgaaagaacattttaacaatcagggtgtgaaggttgaatctgtagagattactgtacagagtcatggctttgaatcacagcagaatctcgaaggtaataattcagaacaggctggtcaggaaaagaagactcatagaaagcttgatcttagcagtcttgaagaactggaagaatctgatatgactgatgaagaaatcagggcaaaagatgctattgttaatggcgacagcagtgttgaatattcagcatagaataagatgagaaaggagataatatatggctagtacgataggtgcatggtcttatgtgaagaatgatggttcattaagtacaaaggacgatgttaacagcaacttaagttcaacaggaaagaataagagtactactaataagacaacgcttgatgttgaacagtttttacagcttatggtagctgagatgcagaaccaggatccgctagaacctacagataattcggattatatggcacagcttgctacatttacacaggttgaagctactaaagaaatgaatgataatacattacaggatatggcatctaaccttgtgggtaagcaggttataatgactacaacacagaacagcaatggttatataggcggaactgttgattattgggaaacaataaatggaactgtttatcttggaattggtggaaagctttatgatattgcagatcttgatactgtaatggataaggactattttgacaaatggaaaggaaatggttctacaacagatactaagacagaggatacaaaacctggggagtgaccgttatgatgaataatatgataggtaataatattgcttctatcgaaaagatgacggacattataggaaagaagaattctgataatgttgataaaatgtataatggcaaaacatttgctgatatatataatcagaagcgttcgattgaagaggttatttccgacagtgatattaaatcgtcaaaagggttgaagttctctaaacatgctggtgaaaggcttgaacagagagatatccggttatcagacgaacagatgacaaggcttgaggaaggaaccgaaaaagcaattttgaaaggaatcaaagaatcgctcgttatagttgatgatctgtcttttatagttaatacaagaaacagaacagtgattacggcgatggatcagaataacaatgaagacaatatctatactaatattgatggagcagtaattatttagctggaccgcaaggaggcgaatgtccctgaatgccagaagggacgatgctttattgatgaatgcatcagatatatgtctttacatatttatggaggaacaaatattatgatgagatcaatgtattctgctgtgtcaggtcttaaggcacatcagacaagaatggacgttattggtaataatattgccaatgttaatactgtggcatataagtcacagtctatgactttttcagaagttttttatcagacaactcagattgcgtcaggacctaatgcagaaacaggaaagggaggaactaatgctatgcagattggtcttggatcatctgttggttctatctccacagcaatttcttcagaaggtggttctgagagaacggataatgcatttgacttaaagattggtggaagttctttctttatagttaacagtgcgggtaatacattcttcacaagagctggtaattttaaggttgatgagtcaggtgctcttgtaacaccaggtggcgctaatgtaatgggctggcaggttgatgaatctggtaatgcaaaaagagaccttgtatcaaagctgtatgttaacagtccggatgttgcatatacttcaccagaaagaacttcatctgttacggtaacaggtaaccttaatgcaggttctaaggatacaagtactacaactattaatttttatgacagccttggtaattcttatcaggcaacagttaatcttgtgtatgcaggcgttcagggagataatacacagtatacaattgagcctgtttcggtttcaaagaatggtaagccgacagaccttacatttactgcgtcagcaccattatcatttaatacacttacaggtcttgccgatgcatcaaattcagatattaagcttacattttctaataacgggactgcatcagatgctattgaaggcgttgatttgagagttatcggtgaaagtgagacaagtcctgtacttacgatggatgcatctggaattacaatgttttcagaaaagactaatcttaattcagagcttggcattaatggacttggaaaaggcaaggcagtaggtaagatgacatcggttggtgttgattcatcaggatatattgtggcaagctatagcaatggtgttactaagaatattggacagatagcagttgcttctttctccaaccctgaaggtcttcagaaagaaggcgataatctttattcagcaacacttaattctggaacttttgatggaattggtcaggatgttacagaaggtgatggaagtatttcatcaggagtacttgagatgtctaatgtggatctctcttcagaatttacgaatctgattacaactcagagaggatatcaggctaattcgagaattattactgtatcagatacattacttgaagaacttattaatcttaagagataattgacatgaaaagatatttatggcgaattattacaagtattccttgcaataattcgccataagtgttttaatatatatagttgattttaatagaggtactataccttatgtggtatcgggaggaattatgattgatgtaacacggtttaatggaaaaagctttgtgcttaacgcagaactgattgaagttatggaggaaacacctgatactgttataaccctgacaacaggacataaatacgttgtcaaggaaagcgtagaagaggtatatagcaaggttattacttataagagaaatataattggtaatctgtatgcgtctggtacagatactaagtgataatatatatagaatactagagacttggaaggggcaattatggatttagctacactgttgggaattattattgggtttgtcatggtcgttatcggaattataacaagtacgactaatcctacactaaagggaattatggacacatttgttgacataccgtcaatcgccgttactattggtggttcaatggctggtatgctcacatcttatacatttaagacattcttaggacatcttaagggatttggcattgctatgaaagatcctaagcttgataatggacaggttatttctaagattattgagctttctaacacagccagaaaagaaggccttcttgcacttgaagaagtggcacagggacttgatgatgagtttatgaagaagggtattcttctcattgttgatggtactgagccggagcttgtgagaggcattcttgaaacagaactggttaatcttgatacaagacataagagtacaattggcttttttgataattgggcagctcttgctcctgcatggggaatgattggtactcttctcggacttgttaatatgttaaagaacttatctgatacagcatctatcggacctaatatggctgtagcacttcttactacactttatggttctttgattgctaactggatatgtgttcctatatctaataagctcaagcttcagaataatgatgaatatcagcttagagagattattattgaaggtcttctttctattcaggcaggagagaacccaagagttattgaagaaaagcttaagtctttcctttcaccatctgccagaacagcattatctgaacaaggaggaggtgaaggctgatggctaaacagcgtacagagaatgtaccaccagcggcactttggaaagatacgttttcagatcttatgaatcttctgctgtgctttttcgttttgatgtttgctatgtctaatattgattctcagaagtttgaagagattgcagcttcactttcatcaagctttagtgtacttcctcaaggcggttctgcactgtcaaaggaaggaattcttgtaagcagtggggcgagtcagctgaatgaattgagcaattactataacaatatgggccttaacaatgatggcgatatgtcacaggatgtacagaatgcttatgaagagattgaaaaagaaggtcttgagcagtctgaaaatatggctgaggagattgttgataaacttacagccagtggagttgcagattatgttgatgttactgcttatagtaaatatgtaatgcttaatgtaagtggtggaattctgtttaattcgggaaagtcggagcttacatcagaggcacgcagtcttcttgacaaggttgctgatgcacttattgaatatgatgataatgttattaccatagaaggtcacactgatagtgttcctatcaatacatcactgtttcctaataatatgatgctttctctttacagggcatacagtgtgtttgatttctttgtgtctgagaaaggcttttcagatcagacaatgagttcatccggaagaggagatgcagtgcctattgcaactaatgatactccagaaggaagagctcagaacagaagagttgagattaaggtgtataattcaattaacagctaaggaggattactcatgaaaaagagtatgcttaatgtgattattttggcacttgtacttgtgaatctggtacttacagtgattcttacattttcacttgtatcaacaaataagaagacaaattctcttattaataaagtggcacagattattgacctggatgttgcaggcggagtttctaataataattcatctacaggttcaggaattgaaaatgtaagttatattgatattaagaacaatgacagcacggatataattgtttcatatgttgataatggaaaaacaagatatgccgtactttcagtatctgtcggacttaattcaaaagctaaggattatagtactgtatcgacttcagttgataatgggatgaaggtccttgttaataagataaccaatgaagctaataagtatacttacagcacaataagtgctaataaatcaaccatggaaacagaccttttaaaggaattccaggaattattcaagactgagacgatacaaagtgtactgattaatattgttgtccagtaaacattaaagaatatgataaggaggtgaggaagatgggagaggtactttcacagagtgaaatagataacctcttaaaagctttaagcagtggagaattagatgtagatgagatgaagaatacagaagaaaagcaagtcaagaattatgactttgcaagaccttctaagttttctaaagaacatctaagaacactggagataatatttgagcattttggaagactgctgagtaccaatcttccggcatatcttagaaagacagtcaatgttgaggttgttaattcagaagtggttatttattcagaattttctaatgccctttctaatccggttcttttaggtgttgttggaatgcaaccattaagtggtaacataattatggagatggcatccaatctggggtttgcaattgttgacagacttcttggaggtgcaggtaatgctttggataaagagagagatttttcagaaattgaacttacaattctggaacgtatctttacagtgtgtgttaatcagttgcaggaaccatgggaaaatgttgtaaaggttaatccaagacttgaaagaatagagactaattcgcagtttgcacagattatatcaccgagtgaaacaatcgcaattgtaactattaatattaagattggtgatgtggagggacttatgaatatatgtcttccatatgcaactcttgaaccggttatggataagcttaataccaagtattggttttctaatatgcaggaaaaagattccaatacatatgaggatgctattgaaacagttattgataaagcaatgataccaataaaggcagtgcttggtacatctaagattagtgtttcggattttgttaatctgcaggttggagacgtaataaaaattgataaaaaggttgaccaggaattagaggtatatgtaggtaatattaagaagtttacagctttacctggttattttgagaataaatacgcagtaagagttactaatgtaattagagaggagagtgaagaataatggatggaatgttatcccaggacgagattaatgcacttctgagtggcatgaatacaggaggagatgacacatctgattcatcaacagcaacaacaactataccagaggataatgctaatgataatacagatggcggctttacacttactgagtcagaaaaagatgctgtcggtgagatatctaatattagcatgggaacagctgctacaacacttagttctcttctttcacagaaagttaatattacaacaccaaaagtagaagttgctacatgggatgatttatcaagtaaatatgacagaccatgtgttatgttgcagatttcttacaaagaaggtcttgcaggcaataatgttttaatattaagagagaatgatgttaagataattacagatcttatgatgggaggaccaggtaatgttgatccagacgaaccattgacagaacttcatcttagtgcaatcggagaggctatgaatcagatgatgggttcagcagctacatctttatcatcaatgtttaatagaaaaattgatatcagtccaccaatagctaacttagtggagacatacaatgaattagatgataacctgccaggattccttaaaaaccattttgtaatggtggcttttaagatgcagattggcgaacttatagatagtgagattatgcagttatatcctaaggaatttgcacaggaacttcttaacatgtttatgccgtcagcagaacctgaacagccacaggtaagtcaggaagatacagctaatcatcaggaagagcagttgcagcaggctccggcacagaatatgacacagacaatgccacagcaggatgtaccggtgcagaatactacagcacagacagcaccacaacagggaatgccgatgcagaatatgggaatgccttatggttatggaatgccgatgcaaggtatgcctatgcagggtatgcctatgcagggtatgccaatggcagggtatgcaccagcacaggatgttaatgtatctccagcagcatttcagccattttcaacagatgtcaatcctttgacacagaaggaaaatattgaacttattaaggatgttccacttgaagtaacagtagaacttggcagaacaacaaaatctataaaagatatacttgaatttgctcctggaacaattgtagaacttaataaaattgcaggcgaatctgttgatgttcttgttaatggcaaatatgttgcaaagggtgaagttgttgttattgaagaaagttttggtgtacgtataacagagattatcaagtaattgttatgattttctaaaaaatcaaaaaaagagtaggaaattgatagtatttgttgtataatatattcgaatgatttttgtgaataatttgtttttgaataggagaaagtttatggcaaagaatattttgatttgtgatgatgctgcattcatgagaatgatgattaaggatattctcacaaagaatggatacaatatagcaggtgaggcagagaatggacagaaggcagtagaaaagtatgctgagttaaagccagatcttgtgcttatggatataacaatgcctgagatggatggaattgaagctcttaagagaattaaggctgcagatccttcagcatctgttattatgtgttctgcaatgggacagcaggctatggttattgaatctatacagtcaggagctaaggactttattgttaaaccattccaggcagacagagtaattgaagctgttcagaaggttgttggataataatggttgcattagctgggttgaatagtagatgggaagcgtttgcacagttgcttacgcttctcgttgtttttatatttgttttggcacttacatattttgctacaagatgggctggtaatatgcagaaaaccaaaatggctgggcgcaatatccagatacttgaaacaatgagagtgtctaatactaagtatattcagattattaagattggcagtaaatgttttgcagtagcagtctgcaaagatactatcacttatttgagtgagattaacgagcaggaactgacttattcgtcagagtcaaagacaatcaatactgatggatttaaagctatacttgaaaagtttaagaaagacaaaccagataattaattaggcaggaacgagagagttatgttacagtggattagaaagcatagaaaggcattagcaggaatatcggttggggcaggagctttttttgcagccatttcatttattacatataaggtaatggctgctgaggaaacaacagcatcagaaaataatcttattaatataggcatttctacgagtgatggtaatgatatggctagtgttttgcagatgcttcttgtacttacagtaatttcactggcaccttctattctgattatgctgacatcatttacaagaattgtaattgtgttgcattttacgagggctgcgcttggaacacagacagtaccacctaatcaggttattataggtttgtctttatttttgaccttttttgttatgtcgcctgtttttacggaagtttatgacagtgcactaaaaccactatccaataatgagatatcggtcgaggaagcgtatgaaacaggagtaaagccattgaaaagctttatgttgaaacagacttctacaaaggatcttgatacattttttaagattgcaggatatgaggaaggctctgttacatcggaagatgatatttctatgacagtgcttgtaccatcgtttattataagtgaattaagaattgcatttattataggattcttaatatacataccttttattattattgatatggttgtatcgtcaactcttatgtcgatgggtatgatgatgcttccaccaaccaccatatctgctccatttaagattttactttttgtaatggcagatggctggaatctgataattggaaatcttgtagcaacatttaagtaacgcaggaggtaaagaatatggatgctggacaggtcgtaacagtagcaagacagactatatgggttatagtgaagacttctgtgccacttttacttgtttcaatgattgtcggacttattataagtctttttcagacacttacatctattcaggaacagacacttacatttgttccaaagcttcttgcaattatgattgcacttatgattatgggaaactggcttcttaatgagatagtttcgtttatgcagatgctttggggaagctttggtcagtatatatgatggcaggatagtgtgttatgaattttacatttgcattggagcaatttgaattatttgttttgatattaataaggctggcatcttttgtatttgctgcgcctttttttaatatggcaaatgtaccaagaaaggtaaaggctggatttgcactgtgccttacagttttggtatattcgctttttcctgatatgacagttgagtataatggcatgattgattatgcaataattgttgttgaggagatgattgttggaattcttcttggggcagtgacgtctttttgcgtgcagattattatgtttgcaggtaagattattgatatggatattggtatatctatggcacagctttacgatcctacaacaagaatgcaggttggtatcatgggaaatttctattactatatgatgatgcttctgcttataatttcaggtatgcatcagtatcttgttgctgcaattgttgagacatataaagttattccaattggcggggtgaaattcggtgcaggaatatatactgccataataagttttatgtcagatttttttgttataggattcagaattgcacttccggtattttcggcgattcttatgttaaactgtgtgcttgcgattcttgccaaggtatcacctcagatgaatatgtttgttgttggtatgcagcttaagatatttgtaggtatatttgtaattctgtttacgatttcaatgcttccatcagtatctgactttatacttgatgagatagaaagattatttgctatgttagtaaggggaatgagctagtgcgaagaacttatctttacatgaacctccagttgtttgctaaagacggaccaggaggagaaaagacagaaccggctacaagtaagaagctggatgatatccgaaaagaaggtcaggttgccaaaagtaaggagctgataacggcagtttcacttatggcactgtttattatacttaaagtgtatgttggaaagataggaactaaactgatagatgcatttacaacgatatatgctcttatgggaaaggttattaatgaaagttcacagggactgacaattaatatggcatccagcattgtaagacaggcaattataattattcttaatattattatccctgtgcttattgtcgctgtaatcatagcaattcttgggaatatgcttcagcaaagatggatggttacagcgaaaccgcttgctccgaaggcaagtaaaattaatccacttaatggatttaaaaggattttttctgtaagacagttatttgaactgattaaggctattgccatgatgagtatcattggaattatggtgtacaattgtgtaagaaagaatatgaatattctgcttactttttatgatgttactttatatactgcgctttctttggttggtaatataattattaatcttggaatccagataagtgcggtgtttcttatagttggttttgttgaccttatatatcagagacataagtttaagactgataatatgatgacaaaacaggaagttaaagatgaattcaagaatgcagagggtgatccgcaggttaagggacagattaagcggagaatgcaggaaatctcaagaagaagaatgatgcagcagcttccagaggcggatgttgtaattacgaacccgacacattttgcagtggcattaaaatatgaacctgattctggaaaagcacctgtggttatagccaaaggtgctgattatctggcttttcagataagggataaagcaaaagagtacaatatatctgtagtagaaaataagcctcttgcgagaattatttatcataatgttgatataggtatggaaatacctcctgagttgtactatgcagttgcagaaattcttgcatctgttttacgcacaaataatagataaaagtcagattatgtgatattatgtaaataatgactaaattgaaaggagagaaatgatgaagattaagaagaatgatctgtttatcggaatatatctgcttgccgcagtattattcttcattatttcaattccttcatggctgcttgatattctgcttgcaattaatatcctggtagcaatggttgtgctttttaattcactttttgctaaggaagttctggatatggcatctttccctacgatgctgttatttacgactattttcagaatttcccttaatgtatcttcaactaagcttatattaaagaatggtgatgcaggtaaggttgttgatacatttggtaagtttgttggcggcggtaatctggtaattggtattattatattcattattcttattatcgttcagtttatagttattaataagggctctgagcgagttgcagaggtaactgcaagatttacacttgatgcaatggctggtaagcagatggctattgactcagaccttaatacaggagccattactgataaagaggctgctgagagaagaaagaagctacagcaggagaatagcttctttggttctatggatggtgctaccaaatatgttaagggagatgcaactgcaggtcttattattaccggaattaaccttgttggtggtattgtcatgggaatggtatatggaggattatcaattaatgatgctctttctaagtatactattcttacaatcggtgacggattgagttcacagataccatcattgcttatatcacttgcaacaggtattcttgtaactaaagcatcaagtgatggagaacttggtgatgagatagttggacagcttttttcgatggacagggtacttattatggttggtgctgcactttctgtccttggaatattaacaccgttaccatggtacatatttgttccgttaggagcagctcttattttttacggaaggaagctaggaactaaagcaggagaagctaagattgaagagagcgctgagcaggaagagaacgaggcacaggaaatccgtaagcctgaaaatgttgtttcactgcttaatgttgaccctattgagcttgaatttggatatggaattattccacttgctgatgttaatcagggaggagatcttcttgacagagttgtcatgataagaagacagattgcacttgagcttggtgcagttgttcctattatcagactgcgtgataatatacagctcaatccaaaccagtatgtcattaagattaagggtatacaggtgagtgaaggtgagatactttttgatcattatatggctatgaatccaggatatgttgaagaagagataaccggtattcctacatttgagccatccttccatctcccggctatatggataactgagagccagagagaaagagcagaatcacttggatatacggttgttgatccgccatcaattattgcaacacatcttacagaggttataagacagcacattgctgagcttcttaccagacaggatgtacagaatctcattaataatattaaagataacaattcaacacttattgatgaacttgtacctaagcttatgggtattggagagattcagaaggttttacagaatcttcttgaagagggaatatcaataagagatcttgttactatattagaaactctggcagaccatgcagctgttacaagagatccggatatattgacagagtatgcaagacagggattaaagagagctatttcgagcaagtattttacggtaggtgaagtgacaaatgttgttacagttgaccctgcaattgagcaggagattatgaattctgttaagaatacagaacaggggtcatatctgtcgcttgaccctgaacgcagtaagaagattgttgaagcattaggcaatgaactcaagaagcttgaggatatgggtaagaatccaatagttatcacatcgcctattgtgagaatgtatttcagaaatctggctaaggattattataaggatataattgtgatttcatataatgaggtggaatctaatgtagaattacaatcagtggggatggtgacagcataaatgatagtgaagaaatttcaggcggagacagagacagaggcaatattaaaagctaaagatgaattaggaagcggtgcagtggttcttaacgtcaagacattaaaacagagaggtgtattcagactttttaagaaagatgttgttgaggttactgctgcacttgaggaaaaagaatttattaatggcattaataataaaaggccaaccatggaaaataaaggtgctaatagtggatttataagcagtcagcctatgaagaatattacgggaggatcgcagattaatcttgtcgcagatgaaaagattgatatgaattctaatgctgctaatattgagaagaaacttgattcactccattcacttcttgaaaatcagatgaatccaggaggcagcagtgcaaagagaccggcagcagcaactgtcatgcatgaagaaatacatgcacaggatacaggaaagaagatagttaaagagcgtgagaatgccaattataaattcttacagcttatatataaaaagttggttgataatgaggttgattcaaaatatgcagatgaaataattgctgatattgaggcttcacttaagaaagaatctaatattgacagcattctgtctgctgtgtaccagaagattatactaaaactaggggaaccccgtacaatatctcttggagacaaaccgaaggtgatattttttattggaccaacaggcgttggaaagactacaactattgcaaaaatagcgtcacatttcaaacttgaaaaatacacaaaggttgcttttataacctctgatacatatagaatagctgcagtggaacagcttaatacatatgcatctataattgactgccctgtaaatgtagcatattctccggatgaaatggatgagtgtcttgatgaattcaaaacttatgagcttatacttgttgatactgcaggaagatcacataagtcagaagaacagatggaagagctggataagctcattgagacggttgagcaaagaaaggatgaatttgattttgagatatatctgacattaagtgtcacaaccaagtataaggatcttgtaaatatagcagataaatataagcatattaaggactgggctattatatttactaaattagatgaaacatgcagccttgggaatatgcttaatatgaagctttatacaggcgaaccgctttcgtatacaacttcaggacagaatgtacctaatgacattgaggtaattaatgagcagagacttgctaaattattattgggaggtaaatcatgatggatcaggcagagaatcttcgcaatataattaaaaaacaaaatttaaaaaacattacgaattcgcgagttattgccgtaacaagtggaaaaggcggtgttggcaagtcaagtacttctattaatcttgcagtgcagtttacaaggatggggaagaaagttattatactggatgctgatttcgggcttgctaatattgaagttatgtttggtgttattcctaaatataatctcagtgaccttatgtttgcgggcaaggagcttgacgagataataacagaaggacctgaaggaataagattcatatcaggtggttctggaattgcaaagcttgtcaatcttgataaagagcaggtaagaaggcttgttaataaactctcagaacttgaaggaatggcagatgttataattattgataccggtgcaggaatatctcctgctgttatggagtttcttgtcgcaagcccggagacgatacttgtgacaacaccagaaccaacatcgataacggattcatatgcgctccttaaggcattaagcatgaatgagaatttcaaaaaagatgaaacaacaattaagatgatagctaacagagttgattctgaagctgagggtagaagcctgtatgaaaagcttaatgttgtggttatgaaattccttgaaattaatatgcagtatttaggtgcggttccacaggataataatattaaaaaagcaattatgaagcagaaaccggtctctatgatatttccaaatgccacatcgtcaaggcattttgaagaaatagcaacacggctgatgtcagaaggcgcagatgttcctgttcataagagaggcataagaggatatctaaggtctgtatttgcaaagaatatgtgattaagaggaaatgaggtgcgggaatgttcgaacagcttgttgtaggtgggaaggttgaattatttaaaaagagcaggcgtataaaagagaacggagaaacaaaagaaatgcttgtaagccagataatggatatcaatgatgagactattatctgtacgatgccttcaagacagggaaaaatgatagtgcttgaagttggaactttgatagaagcttttttttatacaggtaattacatttataaatctgactgtactgtaaaatcaagaggaaaagagggaaatatatttacagttgaattaagacctgaaacagcacttgtaaagttccagagaagggaattctacaggctgaaatgcactattgatgcagatattataccgctgacagatgaagaacggaagatttttgatgtaaccggaaaattgccggataattttgtcatgccggaagataaaggaataattgttgacataagcggtggcggactgagacttttttcaaagaaacaatatgatgcggattcgattgttaatgtaagttttccaatacaggtaggggacagaagcagatatatgaagctgatggcaaaggttgtaatgtcaatgcgcaatcagaattctgacagcgtatatgacagcagacttcagtttgtgaatatgcagaaggaagatacggaggatattgttaaatacgtttttgcccagcaaagaatgattcgcaagaaagaaagggggctgtaatatggcaaaaaaaatacttgtcatagatgactctgcactcatgagaagagtaatatctgatataataaacgaaggtaatgagtatgaggtcgcagctattgctaaagacggacttgagggatttgatttgattgtatctaatcctaatctgtacagtgcaataattcttgatattaatatgcctaagatgaacgggctggaattattacagaagctgcaaaagaatcatattgagcagactgttattgttgtaagtacagtagcaaaagaaggcgcaaaagaaactattcaggctcttgaatatggagcgtttgattttgtaaccaaaccagagaattattttgaaactaagggcaatgactttaaaaagcgtatacatgatatgcttaatgttgcaacaagttccaaagcgtctgtggaaaggacaaggtcagctacaggtgtaaagccgtcgggatattctggcagcaggcttacatcaggaaggacatcatcattaattccatcggagaaaaaagcttctattgatgcaatatctgctttaagacgcaggaatgagattaatgatacaattcctccaaaggttaatccatcaagatttaccaatattaaaagtggcagtaagaaggttgttgcacttgcctgctcaacaggtggaccaaaatcattacaacaggtaataccaatgcttcctaagaatctggatgccggagtggtacttgtacagcatatgccggcagggtttacagcatccttagcagccagacttaacgaaataagtgatattaatgttaaggaaggggcagatggtgatgttatacagaaaggctgggtatatattgcgccaggaggaaaacatatcgaggttgtcaagaaagcatctgagtatgtgataaagcttaatgacgagcctcctatagatggcttaagaccatgtgccaatgttatgtataagtcacttgtacagtgtaattatgatgagattacatgtgttgtccttacaggaatgggagcagatggtacggaaggaataaaaactctttctgccagccataagaaaattcatgttatagctcaggatgaagatagctgtgttgtatatggcatgcctaaggctatagcacagacaggactggttgatgaggttgttccgttgaataaaattgcagaaactataacgaagaatgtgggggtatcttaagatggatgtaagccagtatttagagatatttatcgacgaatctaatgaacatttgcaaaatttaagtgatggtatcatgattcttgaaaaggaacctgataacagtgatacaattaacgaaatattcagagctgcacattccctcaagggtatggctggaactatgggctataagagaatgcagaatcttactcatgatatggaaaatgtattttcagaggtccgcaatggtaatattaaagttgattcaagaatggtagatgtattgttccagtgccttgatgcattagagcagtatgttaataatatccaggagacttctgatgaaggaactgatgataatgagccaataattaaggcacttaactcatttatagttaataatgaagataagggagtattacctgaggaagctaataaggaagaagctcctgcagaagagaagaaagaagaaagcacagatgttgcaggtacttatgccagatataataacatggtatttgctgattttgaaaagaatgctgttaacgaagcaattgagaagaagatgaatgtgttcatcattaaagtaagtgttgatgaaaactgtattcttaaggcagccagagcatttcttgtatttaagaatcttgaaggtcattgtgatattatcaaatcagagccatctgcacaggatattgaagatgagaaattcgagcttgatttcagcattgttgttgtaacggaagaaagttatgaatcaatagttggaataatcaagaatgtttcggaaattaaagatgctgcaggagaggctataacaactccttttgcagatgaagatgataaagaagagaagcaggatacaccaaagcaggaagaaaagaaggatgagtcagagacaaaaccatctgcatcagtgacggcaaagaagcaggctcctgcagctaacaataataaggcaggcaaaacagtgagccacacagtacgtgtagacattgaaaaacttgatgttcttatgaatcttgtcagcgaacttattattgcaaagaacgggcttgtatcagccagtgtatcagaagatggtacaacatctgttaatcagaaatttggtgaacagattgaatatcttgaaagagtaacaactaaccttcatgagtcagttatgaaggttaggatgatgcctattgagagtgtatttgccaagtatccaagaatgataagagatctcaacaagaaacttgggaagaagatggaactttatatgtcaggtgaggagacagagcttgacagaacagttattgatgagataggtgatcctattatgcatctgttaagaaattctgctgatcatggacttgaaagcgcagagataagagctgagagaggcaagccagaggttggttctatatggcttgatgcatatcaggagggcaacaatgttgtcatagaagtaagagatgatggtaatggtattgatgtagagaaggttaaacagaaagctgttgaaaaaggaaaccttactcaggagcaggcagatgcacttacagaaaaagaagcaattgatcttctgtttaagccaagtttttcaacatcagataaagttacagatgtatccggacgaggtgttggtcttgatgttgtaaaatcaaagattgaagctcttggtggagatgtcgaggttaagactaaatatggagaaggcagtacattcagtataagacttccacttacacttgctattattcaggcacttatggttaaagttggagaagaaaaatacgctattgcacttggctcaattgagacaattgaagatgtaccggtaagcgagattaaatatgttcatgctaaggaagttattaatcttagaggcaatgtaattcctcttataagattaagagaacttcttgatgtacctggcgaaccggaagagtctgacaatatagttatagtaattgtccgtaagggagataagcttgccggacttgttgtagataatcttattggccagatggaaattgttattaagtcacttggtaagtacattaatattaaccgcatgataagtggtgctacaatcttaggtgatggttcagttgcacttatcatcgatgccaatacacttgtatagaggaggaacggataatggagaatgttaatgctatagaagataagaattcagaatcaacaacttctgtacagtatattgttgttaagataggtaatgagcagtacggaattgatatcaaatatattgacaatattgtaagaagccagaacataacaagagtgcctaaaacacagtcatattataaaggtgttattaacctaagaggcgagatttgtccaattatgagcatgagacttaaacttggattagagccggatgagcttacagataaaacaagatttataatagtaaaggttgagggggcttcgattggtgttatagtagaccaggttaaagaggtcgttacacttgaagaagaagatatagagcgtataagcagatcaaccaatgatgatgcggcagctaactatattaatgcaataggaaagaaagatggggaactgatttcacttctggatattgtaagccttattgtagaaaataattagtgtttgaggtgaaggtatgtcaaaaattgatttgaatcagcttaatgatattcagtatgatgttttaaaagaaataggtaatataggtgcaggaaatgcaacaactgcattatcgaagatgctcaaccaaaagatggatatgtcagtacctaaggttgaacttgttccttttaatgaaatatcagatataatgggagacgaagatcagacagtagttggtattatgcttggatttgagggggatgtgtatggaatgatgatgttcctttttgatacaaaatcagcacatcatcttgttaatacacttatgatgcaggatacagagtcaggtattgaggcagatactcagtttaatgacatggaaatgtctgctcttaatgaaataggtaatattgtatcgggttcgtatcttacagcaatttctaagcttactaacctcaagatggtatctactgttccagaaatgacaatagatatgataggagcattgcttagcgttccagcttcagaatttggtaaatatggtgacaaactgctacttatacagtcacagtttggtgaactggattttgttaatggatattttcttatgattccagaactggagtcatatgacaaattgttagaatctttaggtgtgtaaaagatatatttgaaagagtaacgattatgggaaacatgataaaggttggcatggctgacttaaaggcatgcaaatgtcctgatgcactcactacacttggacttggttcatgtgtaggagttgcattatatgatccggtaacgaaaataggtggacttctccactgtatgttaccggatagtacccagtttagaaataattctaatattgctaaatttgcagatactggcatagatgaacttataagacagatgaaagcactgggagcggttgatacaagaattgttgcaaagattgccggtggggctcagatgtttgcaaacagatctaatagtgaagcgttgagggtaggagaacgcaatgttattgcggttaaggcaaagctaaaaagccttaatataagtatactttctcaggactgcggagaaaactttggaagaacagtggaattttattcggaaacaggagactatgttattaaagcggtagggaaaccactaaaaacaatatgattttagtggtacataattgttacgagtggaggctttatgaataagttcagaaatgtaccagccataataacattactggcaggttttataaccagtgttatcatgataaaatacagatatacactggttaattttatgtggatacttatatgtgttatgcttgcattttatatatgcggaatgcttataagatttgcacttaataaagtagcagaaaagaaagagaataaacaaaaagcatctgacgaagaaaaagaagatgtatctaatatggaggaatctgcccagcaagaataattgtagcatttgggcagattttgtgttattatctgagtatattttattaattgggggcactgaccatggatgaggcaggcagagataaactgtggaagaattacatatccacacgtagtgcagaatacagggatgagttgatagttgagtatgcacagcttgttaagctggttgctggaagactcaatatgtatcttggatataatgtggaatatgatgatcttgttggatatggaatatttggacttatagatgcaattgataagtttgattatggcaagaatgttaagtttgagacatatgccagcttaaggataaggggcgcgattcttgatcagataagaaagatggactggataccaagatctctaagacagaagcagaagagaattgaagctgctatggcaaagatagaaagtgaaacaggtcatatagcaagtgatgaggagcttgctgctgaattagagattacgatagatgaactggcggactggcagggaaagatgaaagcatctaatcttatatcacttgatgaatatacagaggcaggcagtgaggttaagatggagtctgttggtaattcacattttgaccagccagaggaagctatagaaaaagaagaacttaagaaaatgatggtcagagcaatagattctctcactgagaaagagagaagtgttgttgttttatattattatgaagatatgacattgaaagaaatcagtctcacacttgaagtgtcagagtcaagggtgtcacagcttcatacgaaagcattgaataagatgaagaaaatacttggtgattatgtattttctctttaatataagtatgtaaaaggggttacagcatatggtggaaggatgtagaacagggtattttcagtttgattcaaggaacgatgggttatatataatagtatatccgccacagaatggaggcagaactgcaaatatagacgatgttatgtattatcttgataagaaaaagattgaatgcgacacggctaagctggcacaggcagtcagggcagggagcagtacgaagacggaacttaaggtttcagatgagaaggtacatcagtattctgaattcggggattacaggataagtgcagattgcatgaaagttgaagctgtattctatccaccgtttgttggaggaggcgtacttacttcaggagagattattaaggatcttcagtatcttggtgtgaaacatggtatagataatcagattatagaacagatattaagccatagagaatatggagaggcttataagattgctgtcggtacacagccaagagatggaagcgacggatatattgaatataagtttaatacagaactgaaaccacgccctaagatgaatgacgatggaacagttgattttcatacacttgagaatattaatcatgttaacaaaggtgatgttgttgctgtacttcataaagaagacaggggagatgacggaatagatgttcttggaaggagagttcctccaagaaaagttaagcatgtaatattcaggtatggaagaaatctgtcacagtctgaggatggaacagagcttgtgtcacaggtaagcggacatgtcgtacttgagaatgataagatatttgtttcaaatgtattggaactagtgaatgtagataattccacaggagatattgactatgaaggtgatgttgtagttaaaggcaatgttcttgcaggatttactgttaaagcaacaggagatattactgtgagtggaattgtggaaggggctacagtaatagcagggggaaatattacatttaacagaggaatccagggaatgacaagggctgttgtcaaggctggcggcaatattgtatccaaattcatagagagtgcggaaaatgtatcagcaggtggaagtatcgaagcggattcaattctgcacagcaaagttacagctaagagtacaattaaggcttcagggcgtaacggacttataataggcggagatgttaaggctgttaatatgatagaggctaagacaataggaaatgccatgggaacaaacacatctgttggcgttggagtagatccgtcaatgaaacgaagagtagatgaattaaagaacagccttgggaaactgggcgataataagatacagcttaaccaacttcttaatgcgttaagaaagaaacaggattcagagggtgggcttgatgaagcaaagcacgaattacagatgaaaacaatgcgcaatgtcataatgcttgaacaggagattaataaacaaaagaaagagcttgaagaattaagaggtcagataggcgaagaaaagcatgcatgcattaaagtaagtgatgcagcgtatgctggtgttaaacttacatttggtgaccagtgcatgtttcttaaacagaaatatgattactgtcagtttgttaaagagggtgcagatataaaaagtgcgccaatttagacacatttgatacaggaggcagaatatggttattaaaccggtggaatttgcaatgatacaacagcagaacaatgttgccaaatcacagtataatgctgaaaacaggcctatgacagagcagcagactataacgcagcaggttcagaaggacatcaatgctcactcacagcaggttaataagaaggataatgctgataatgaaactggtaaatatgatgccaaggataagagtaataatgaatattccagtgaaggggattcacggaagaaaaagaaatctgatggaaaagtctttataaaaggacagggaagtgctgatttcgatgtaaagatatgaaacaatgaggtgtggaggatataatggtcgcaacagaaatatttcttatagcggctggcgtaatatgtgttgttgtcagcgttgttatgagttttggagatgataaagagaatgtggagagcagtgctaaatcggaactgacacaggcacagcttgatatggtaaaacatcaggttgatgaggttattaagcagcagataagtggtctgtctgaaaaaacggaagctgcacttgataagatatctaacaccaagattcttgaaatgaatgaatatgcagagagtgtgcttggtgagattaacagaaatcataatgaagctgtttttttgtatgacatgcttaatgaaaaatcaaaagaagtaaagacaacagttaaagatgttaattatgcaaaaaagcaggttgaacagattagtggaagaacttctgatatgtctgataatgcagtcatgtcagaagaacatgaacaggaccgcacagatgatgggaaagaaccggcatatgaacaggcggttaagtctggtaaagatacaaaggatatagcaaaggaaaggcttgcagcattagtaaagaaaagcaatcagaaagctaagaatgctgaagacagaattaatacacaggcagacagtcttaataaagaatattcgaataatgaaagaattctccagatgaatgcatccggtgtatctgttaaggaaattgctaagaaacttaatatgggagttggcgaagtaaggcttgtgattaatctgtataaaggtggtaaacaacaatgaagttcagatattatataagaggttttggagctggtcttatagttgcagctgctgttcttttaattgcaggtatgatagaaaagaataataattacattgtttctgataataaagagacgcaaagcagtggttctgttatagcatttacaacggaaagcacggataacaaagagaaagaaacgcagaaagctacaggaaagtcagatgaagagacgacgcaggttaataaagaaactacgacgactgtggtggcaagagaaactgagtcacaaagacctacggcaagtattgttatcggtgatggaagcggactagtccagattgaattcaagggtgtaggaactgcatctgaggcagcagatatactgtatagtgcaggaataatcgaagataagctggcattctatacatatatggatatatcaggatatgctgtcagaatcagagatggtgagtattctcttaagcctggagattcatatgagactattgccagaacaataacacagtcagattaaaaaaatgcttgcattatattgaatgtattgttataatgcattttgtgtgaaaaaacatgctggtggattttacggctggtgccggtatacgcgccggtggtcgaaaaagaagaagcccgcaaaagattaattaaccaatggaggtatcaaaatgagcgtaatttcaatgaaacagttacttgaggcaggtgttcatttcggacatcagacaagaagatggaatcctaagatggctgagtacatctacacagagagaaacggaatccatatcatcgatttacagaagtctgtaggtaaggttgacgaggcttataaggcaatctctgatatcgctgctgaaggtggtacaattctttttgtaggaacaaagaagcaggctcaggatgctattgctacagaggcagagcgttgcggaatgttttatgttaatgagagatggttaggcggtatgcttactaacttcaagacaatccagagcagaattgcaagacttaaggaaatcgagacaatgcaggaagatggaacatttgatgttcttcctaagaaggaagttatcaaccttaagaaggaacttgagaagcttcagaagaaccttggtggtatcaaggaaatgaagagacttccagatgcaatcttcatcgttgatcctaagaaggaaagaatctgtgttcaggaagcacatgcacttggtatcaagttaatcggtattgcagatacaaactgtgatccagatgaattagattatgtaatccctggtaatgatgatgctatcagagctgttaagttaatcgttgctaagatggcagatgcagttatcgaagctaatcagggtgaagaagcagctccagctgtagaggaagaagtagctgaggaagcttaatatttaagtattgacttaagtttatgtatgcttcagcctgacatattatcaggttgaagcatttttaaaattatttttattggaggataatataatggcagcagttacagcagcaatggttaaggaacttagagagtctactggcgcaggtatgatggagtgtaagaaggctcttacagagacagatggtgatatggaagcagctgttgatgttcttagaaagagcggagcagctaaggttgagaagaaggcaggaagaattgcagcagaaggtattactagagttgcatctgaaggcaatacagcagttgtagtagaagttaattcagagacagatttcgtggctaagaatgctacattccaggaatttgtacaggctgttgctgacaaggcacttaaggcttcagttgataaggctggagatggcgaagatgtatgcgctatccttgatatgcagtcagaacttgaagagaagactcttacaatcggtgagaagctttctatcagaagattccagaagattacaggtgactgtgtagcttcatatattcacggtggcggaagaattggtgttcttgttgcagcagatggcgcttctaatgatgcaatcaaggaagcacttactaacgtagcaatgcagattgcagctatgaacccacagtaccttagcagaaacgatatgtcagcagatgaacttgctaagttaagagagattacagagaagagtgcattaaatgatccagcttctcttccaaagccaatcttaaacaagttaattgataaggctattaacgataaggtatggagcgatgctgatattgcaacatacgaagagcataagagcaacatgcagtacttattcaacttcctttcaaaggaagcagctgcacagttagcagagcttgcattagctgatgaggctaatatcgtagcagataagatctttaatggattagtagaaggtcgtgtatctaagcagcttaaggaaatctgccttatggatcaggtttatgttaaggctgaggatggaaagcagtcagttgctaagtaccttgcagaagttgctaaggctaatggtgctttcacagttaagggatatgttcgttttgagactggtgaaggtcttgagaagaagaacgaagattttgcagcagaagttgcagctcagttacagtaatatttaattataatatacggtgagtattaaaaatcctccggagtttatataagactctggaggtttttttagaatgatattataacaaaatgttgtcataagacttctaaatttgtcgtgcgtatgctataatcttatcaaactgtgatattgtgtaaaactgcagtatacgatatggaggataatttgatgggattattttttaaagatttgaaagatgatttatcagaatcagtcaataatttaccagatgatactaataaggcatctgatgactcagatgatgtaatggtaaatacattagatgatcctgaacttgccaagatggcagaggctttcaagatggaagcacaggaatatgatatgtcagaagatacttcttccccagaaacagatatgggaaatgtgtctgataaagatgagacaaaagaagatataaagaatgcagcagagaatcctgaatatatagctgatgagactgcagttattacggagggactttcaataaagggagatcttgactcactaggttctattgatttatttggtacagtagaaggtaatgttacatgcagaggaaaacttacagtaagcggttctattacaggaagttctaaagctaacgaattttttgcgaatgacgcacaggttgatggcgatatagaggcaaaaggtgctgtaaagattggacagggaactgtagttgtaggtaatataactgctacatctgcggttattggtggagctgttaagggcgatatagatgtacatggacctgtgataattgattcatctgctataatttctggagatattaagtcaaagtcagtacagattaataatggagcaacaattgacggacgctgctcacagtgttatgcggatgttaatatggaaagtatatttgatattaaaggaaaaaagaataaataactggaggcacgtatggataacattaaaagagtaatacttaaacttagtggtgaggctcttgctaagaaagagggcggctacaatgatgagcttatagagaatattgctaatcaggttaagacaatagttaataaaggaacagatgttggtgtagttattggtggtggtaactactggagaggccgttctaatgataatattgacagaactaaggctgaccagataggtatgcttgcaacaattatgaactgtatatatgtttcagagatattccgttcacagggacttaagactaatattcttacaccattcgaatgtggaagcatgacaaagcttttctctaaggacagagctaataagtattttgaaaaaggcatggttgtattctttgcaggaggaacaggtcatccatatttctcaacagatacaggtattgtattaagagctattgagcttgatgcagatgctattcttcttgctaaggcgattgatggaatatatgacagcgatccaaagcttaatccagaggctaagaagtatgatacaatctcaatcaacgaagttgttgagaagaagcttggagttattgatatgacagcttcagttatgtgtatggagaataagatgcctcttatggtattcggactcgaagaagagaacagcatagttaatgctttatcaggaaagtttaatggaacagtagtaactgttgattaatataatattaatggaggattttatggaaaatattaaagatattgaaggaagaatgcagaagtcagttgacaacttaaaggaagaatatgtaacaataagagccggaagagctaatccacatattcttgacagattaagagttgattattatggaacacctacaccaatccagcaggttgccaatgtttctgtaccagaagcaagaatgattcagattcagccttgggaagcaagccttattaaggatattgaaaaagcaattcttgtatcagatttaggacttacacctaacaatgatggtaagacaatcagacttgtgttccctgaattaacagaagacagaagaaaagaacttgctaaggatatcaagaagaagggtgataatgccaaggttgctatccgtaatatcagaagagatgccaacgatgcaataaagaaagagaacaaggcaggagatatctctgatgatgaagctaagaattcagaggatgaaattcagaagattactgataagtatattgctatgattgatagtgctatagatgataagacaaaagagatacttacagtttaagaaaatgtcagggctgttggatattttacaacagcctttttgtaattgaatgaattgcgagaggaatcatagatatggatacatttaacgagagtctcggattaaagattccggggcatgttgccgttattcttgatggtaatggaagatgggctaagaaaagacatctcccaagaacaatgggacatgtgcagggaagtaaagttgttgaagatatgctttatgtcgtagatgagcttggtgtaaagtattttactgtatatgctttttcaacagagaactggaaacgttcaacagaagaagtaagtactcttatgggaatcttaagaacttatcttaaggattgtgttaagaaatccatgaagaataatgtacgatgcagggttattggaagaaaagatgaactcagccaggatattatagacagtatcaataatcttgaagagaaaaccaagaataatacaggacttaattttactatagccattaattatggtggaagagatgagataacaagagcggtaagaaagattgccgacaaggtatcagaaggaagtcttaagcctgaagatatagatgaagatacaataagtaataatcttgatacatgggaattgccagatccggatttacttataagaacaagcggtgagcagagattatctaattatctgtgctggcagcttgcttatacagaattttatttcacagatatttattggcctgattttgacaaggaagaacttattaaagcatttgagaaatataataagacggaaagaagattcggcggagttaaggaggagtagattatgcgtacaagaattatgagcggagctgtgctcatagtcatacttttcacatgcctgtattttggaggctgggttacattcgggttcagtctgtttatttcacttgttggaatgtatgagcttattaaagttaagaagcttgagaagacaggactggcagttgtaggatatatagcggcaattacttattattttattcttttgcttaatgatccggcatatattttactgcttcttgtagcttcatgcatacttatgatgtcagtttatgtatttacatttccaaaatacaagacagaagatgttatgtgggtattcttcagtatagtgtatgttgctgtaacactttcttatatctatcaggtaagaatgctgcaggacggaatatatatcgtatggcttatattcgtgtcttcatggggtaatgatacatgtgcatatttcacaggtgtatttcttggaaagcataagatgactccaaagctttcacctaagaagacttacgagggtgcaataggaggagttgtcggtgctacacttcttggctttggatatggatttgccataagctctaagatgtcagatgtacttgtacatcctgtatatacatttgcaatagccagcttcataggtgcattcctgtctatattcggagacctggctgcatctgctattaagagaaatcatgatgtgaaagactatggaaagttaataccgggacatggcggaattatggacagattcgacagtgctatattcactgcacctgttgtttattggtcaatagaggttattaacaaagtctttggaggttgataatgaagaacgtttcgatacttggttcaactggttcaattggaacacaaacattagatgttattagaagaaatgctgatattaacgtagttgcacttgcagcgggcacaagggttgctgaccttgcagaacaggtccgtgaattcaagccacagcttgtatgtataggtaaagaagaacttgttccagagttaaagactcttatcggtgatatggatgttaagattgtaagtggtgacgaaggtcttattgaggctgcaacaattgagagtgcagaaattgttgtcacagcggttgtaggtatgatgggaattacacctacagttgaagctatcaaagcacataaggacattgcacttgccaataaagagacacttgtgtgtgctggtcatattattatgagtcttgctaaggaatgcaatgttaatatatatcctgttgacagcgaacattcagcaatattccagtgccttaacggtgagaaccgtggtgagatagagaagattcttcttacagcttctggtggtccattcagaggaaagaaaagagctgaccttgaaaatgtacagttagaggatgcacttaagcatcctaactgggctatgggacgcaagataacaatagattcttctactatggttaataaagggcttgaggtgatggaggcacagtggctttttggagtacctgccgagaaggttcaggttatagtccagccacagagcataatccattcaatggttgaattcaaggacggagctgttatggcacagcttggaagtcctgatatgagacttcctatacagtatgctctttattaccctgaaagaagagaacttaacacagaaagacttgatttctatgaactggctaagattacatttgaaaagccggatatggagactttcaagggacttaagcttgcttacgaggcagcagcacgcgggggaaatatcccgactgcacttaatgcagctaatgaagtagctgtagcaagatttttagacagaaagataaaatatctggatattccggatattatagaatacgccatgaatgaagtggattatatcaataatccaacagtagagcagattctctctacacagaagatagtaacagacatgatagaaagcaggtggtaggagttggttcttaatgttattctggcgattcttgtacttagtataattgttattgtccatgaattcggacattttataatagctaaggctaatggcataactgtagttgaattctcaatcggattcggaccgaagctgatacatttcagaaaaggtgagacggaatattgtattaaagcacttccttttggtggtgcatgtacgatgcttggtgatgagtttcttgagatgagtgttatacagtcagaagaagatgatgacgaagagcttacggatgaagaaaaagaagctaagaaaagaaagcttgctattgaaaatggctatgacatggaaaagtcatttgcaagtaaatcagtctgggcaagaattgctgtcatagcagcaggtccggtatttaatttccttcttgctttcgtgtgtgcagtagttattgtcggaagtcttggctatgatccatgtgacattgacgttgttaaagataattcgccagccacagaagcagggcttcaggaaggtgatgtcataactaaggttaatggacataaggtaacattttacagggatttttatttctacagggcttataatgcagataagactcttaatataacatttacaagagacggtgaaaagatgacaacaactgttactccgcagcatattaagcagcagaagtatcaggttggaattatgatgaatgagaattgtctcataagttctgttaccaaggattctccggctgaaaaggcgggacttaaagctaatgatgttatcaaagcagttgatggtactgcaatggagaatagttccaatgtgacagaagctattacatcaagcggcggcaataaggttgtattcacggttgcaagagatggaaaaaatgttgatgtgacagttgagcctaagatggttgaagttgaaagctatgatacaggctttgttgtatatggagacagggtaaagacttctcctattggtacgcttaagtattcagtggaggaagtcggatacagtgtcaagacagtaatacagagtcttggaatgttatttacaggaaagattgggtttgattcattgttaggacctgtcggaactgtcagcacaatgagtgagattgttgaagaaagtaaggcagatggtgcattttatgtattccttaatcttatgaatcttgcagcacttattagtgccaacttaggagttatgaatctgctgccaattccggcacttgacggaggcagacttgtattccttataatagaggcattaagaggcaagccggttaagagagagcatgaaggaattgttaatttcataggtatgatacttcttgttatacttatgattgttgtattgcttaaagatataatggcattgttctaatacagaaaggacacaggggttatgtacagagataatactaaggttgttaagataggaaaccgcatgattggcggtggcaatcctattcttatccagtcaatgactaatacacatacagaagatgttgctgcaacagtagcgcagattaaggagcttaccaaagctggttgtgaaatcatcagatgcacagttccaactaaggaagctgcacttgcaatcaaagagataaagaagcagatagagatacctctcgttgcagatatacattttgattacaagatggctattatggcaatggagaatggggctgacaagattagaattaatccgggcaatatcggcggaacagacaagataaaggctgttgttgatgttgcaagggaaagaaatataccaatcagggttggtgtcaacagcggttcacttgagaaagaccttattgagaaatatggtggagtaacagcagagggaatcgttgagagcgcacttgacaaggttaagattattgaagacttaggttatgataatcttgttgtcagcatcaaatcttctgatgtaatgatgtgtgttaaagcacatgagcttattgcaaaacagactaatcatccgcttcatgttggaattactgagtctggaacaatattctcaggaagcattaagtcatcaatcggacttggtcttatactgaatcagggaattggcgacacaataagagtttctcttacagatgatcctgtaagggaaatagaggctgcgaaactgatacttaagactcttggcttaagaaaaggcggaatagaggttgtttcatgccctacatgcggaagaacaagaattaatcttatagaccttgcaggaaaggttgagaaaatggtttcagggtatgaccttgacttgaagcttgctgtaatgggatgtgtagttaacggaccgggagaagcaaaggaagctgatcttggaattgcaggcggtgacggctgcggagtacttattaaacatggagagattattaagaaggttccagaagaggaacttcttgatacactcaggtatgaacttgataattggaatgagtgatacatatgtacagattttttgaagtgtttaagacgctgaagctgccagaggatctggcggtgtattttgagaatgttgaagtaactaaagtctcgaaaacatcgaccaattctctggcacgcgtttatataaagagtgacagggtaatagaaaaaccaataatattcaaggttgaggatgcattaaagaaacagatattccgtatatccaacatggacgtgcggattatcgacagatatgttttgtcagcacagtatacgccacagactgtaatggatatatattatgacagtatccttgcagagctggagaaatactggacacttgaatataatcttttaaagaattcccagtgggagttcgagaaagaggatatgcttgtattcacgattgaggacagctttcttgcgcatcagtatgcggatacacttacagattatttcaagaaaatattcctgaacagattcgggtttgagatagatgttgagtatcagtatgccaagaagaaggaaagccagtacgagagagaaaatgcatacaggattaatcttcgtgtcaaagaaattgagaataatatgatggcggcagcagaagataatgccgacggcagggatgataagaagcttacatctgaacagaaggcagcaaagaaagctgagacagcagccaagcagaaggcggctagagcagcattttttgcaagcgataacagaggcagggaagagcttaagacatacagcagaaagcctgctaacgaagatgttttatatggaagagattttgacggtgatgtaacaccgattgaacagatagatacggcaatcggagatgttattatctctggtatggtccgtaatgttgaaatgcgtgaaatccgtaacgaaagaactattattatgttcaatgtcacagattttacagacacaattacagtaaagatatttgcaaaaaatgagcaggtaccggagctttcaggtgttatcaagaaggggaatttcttaaagattaagggtaatgctacatttgacaagtacgaccaggaaatatcaattgccaatgtgtggggcataagaaaaggctctgatactagacaggtgcgtaatgacctcgcacttcataagagagttgagctgcactgccataccaagatgagtgatatggatggtgtgtcttatgtatctgatattatcaaacaggcaatcagatggggacataaggcaattgcaattactgaccacggtgttgttcaggcatttacagatgcattccatacgatgagcgacctcaaaggctcttatgccaagaagggtgagaagcttgattttaagataatatacggagtcgaggcttatcttgttgatgataccaagcagatagtaacgaatccgagaggacagagctttaacgatacatatgttgtgttcgaccttgagacaacgggattttctgcggaagttgacagaattatagagataggtgcagtcaaggtatgcaatggtgagatagtagacagattctctacatttgttaatcctgagattcctattccgttcagaattgagacacttacgcacattaatgaccagatggttatgaatgcacctaagatagaggagattctgcctaagttccttgaattctgcgagggtgctgttatggttgcacataatgcggaattcgatacgagctttataatcaataaggcagagaagattggtataaatgtggatactaccattatagacacagtgcttcttgcacagtttcttatgccaaatcttcataattataagctggatacgcttacaaagcatcttaatgttgtacttgaaagccaccacagggcggttgacgatgctgctgcgactgcagacatatttgtcaagatgattaaaatgctttacgacagggatattcctgacgttgataagcttaatgaagaaggtaagatggatgagaacgccatcaagaagcttcatcagtatcactgtataattcttgcttctaatgagatgggaaggattaatctgtacagacttgtttctgcatcacatttgcagtactttaacagattccctaagataccgaagagtcttgttaaccaatacagggaaggtcttattataggaagtgcgtgtgaggcaggtgagcttttcagaagtcttgtaaatggtcgttcagaagcagagatagcgcgaatagttaatttctatgactatcttgagatacagccaattggcaataacaggttcatgattgagaaagaggattgctatgtccagaatgaggaggatttgcgcaatctgaaccgcagaatagtagaacttggggacaaattcggcaagcctgttgtggcgacctgcgatgtgcatttcttaaatccggaggatgaagtgtaccgtagaattatcatggcaggaaaaggctttgatgatgcggataatcaggcaccgctgtatcttcatactactgaagaaatgcttcatgagtgcgattatctcggaagcgacaaggcatacgaggttgttgtaaccaacactaataagattatggatatgtgtgaggagattgagcctgtaagaccggataaatgtcctccgttcattgagaactctgatcagatgcttcgtacaatctgtgaaaatagagctcatgagatatatggtccggagcttccacagatagtaactgagcgattagagcgagagttgaactcaattatctctaacggatattccgttatgtacataattgcacagaagcttgtatggaaatctaatgatgacggttatctggttggttcaagaggttcggttggttcttcattagcagcaacaatggcgggtatcaccgaggttaatccgttaagcccgcattatctgtgtccaaaatgctactataatgatttctattcagatgaagtcaaagcatttgccggaggcgcaggctgcgatatgcctgataagatatgcccaaaatgcggagcgaagcttaataagatgggatttgatattccgtttgagactttccttggtttcaagggaaacaaagagcctgatattgatcttaacttctccaatgaataccagagtaaggctcatgcctatacagaggttatctttggaaaaggtcagaccttcaaagccggaactatcggtactgtcgcagaaaagacggcgtatggtttcgttatgaagtactttgaggagaagtcagcaaagaatgcacttgagggcaagcctcctattgttaagagaaaatgtgagatagaacgaatagcagaaggctgtattgatattagaagaactacaggacagcatcctggtggaattgttgtacttccaattggtgaagagattcattcatttacaccagtacagcaccctgcaaatgatatgacgacatctatagtaacaacacattttgattaccatagtattgaccacaacctgttaaaactggatatcttaggacatcttgatcctacaatgatacgaatgttacaggatttaacgggaattgaccctcttgagattccacttgattctaaagaggttatgtcgctgttccagaatacatctgcacttggaatcaagcctgaggatataggcggcacaaagttaggagcacttggaataccagaatttggtactgactttgctatgcagatgcttatggataccaagccacagtatttctcagaccttgtacgtatcgcaggacttgcgcatggtactgatgtatggcttggcaatgcacagactcttattaaagaaggaaaagctactatttcaacagctatatgtacacgagacgatattatgatatatcttatccagaagggacttgattcagaggaatcatttaagataatggaaatggtccgaaagggtaaggttgcatccggcaaatgtaaagaatggccggagtggaagcaggatatgattgaccatggtgtaccggactggtatatatggtcatgcgagcgaatcaagtacatgttccctaaggcacatgctgcagcgtatgttatgatggcatggcgtgttgcatactgtaaggtattttatccgcttgcatattacacagcttactttagtataagagccacagcatttgactatgagaaaatggctatgagtcctgtaaggcttgaacactacattgctgagtacaaagccaagaaagcagaaggtacaatctctaatacagaagaagatgaacttggtgtaatgcgtattgttcaggaaatgcatgcaagaggctatgaattcacacctatagacatatataaggcaaaggcaagaacattccagataattgatggaaagattatgccatcattcaaggttatatcaaaggttggtgaagtcgccggagagtcaatagagatagccgccagagatggcgaattcttatcaaaggatgacttacgccagcgagccaagataggacagtcagcgatagataagctttcagagcttggaatacttggagatatgacagacagcaaccagctgtcactgtttgacctgtaatggggaattgaggtgagtgtgatgatggcttgggctgaggaataatgttatggggatgcgcgatggcgctgtgctatggtgatgcgttattgtgatacattacggtgatgcgctattgggcaaacgcctactagaatgtagcggataacagaattagtgggtggtttttatataatattgcaatggtttcggagcagagacctacaaaagtatctaagtattgtacttttgtaggtctttttcttcaaatttcatagaataaagcgacacattgcttgtgattgacctacgcaataagctaaattggatgtttgcgtaggtttttcttattgagatatctctattagcaagaaaattcacctactaggattgaatgtaagaatataatagtaggtctttactttctgattacagtgtaaatgtgcagaaagccagtaaacaagcggcttcgcaggcatgtcagtcctgtttaaaagtcaataattgaaaaaaattgaacttttttgaaactttttgaaaaaagttgttgacaatgtgtgtacctgatgatattatatacaagtcgccgcggtaagcggtaacaaataagacttaaaacaccagataaatactgggtttgagtgatacagatctttgataactgaatagaaagacaaccttgaaattctttgagaattttaaaatgtataaataatgtctacaataattgggttggtgtctacttttagattaccacttcaattactgtcgagattggcgcaattttagcaatatttcctgagcgggggcagaaagtgcccccactttcactatttgggggcgaaaagcgtcccacatataataaacaaagggttcaagggaaaagttacttgctagaacagcatttggatggagacatctctaatgcgtatctagccgtcaacctaagaagtatcaaggcagccaaaacagcagattaatcatgcaacatttcctactggttaatcaccatgtcattttcattttgtgttataatgtgttatcagatttttttggtctccgctgccgcttcggtcggtgcaaagcggacatccaccggatgtcctgcacccttgtatttgcccttatcagagttcgtaaacactggtgggacgattcatgcggaaactgaatttgataatatatattacattagtattttaaggagaatgtatggaaggtgaaagaaaaacattgacacagctatctgtgccaatatgcctggaaactttattttatatgctttcaggtatggttgatacactgatgttatcatcagtaagtgatcaggctgtgggggctgttggaacagcaaatacatatataggtgtttttattatcatgttcggggtaatatcatccggtatggtagcagttatgtcacaaaatattggagctggaaaacctggaattgcatatcaggccaggcagcttggacttgtatttaatgcactgacaggtatcctgatgtcttttattcttgctgctttttctgggtggatacttaagatagtgagtattgcccctgctttatttgagccggctgaaacataccttaaaattgttggaggtgcaagttttttaaatgcgcttattccaattttttcgagttatttaagagtgtttggttatacaaaacattccttaataggcacagttgttggtaatgtaattaatattatattgaattcggtattcttgtttgtgtttaactggggagtaatgggagttgctgctgcaacagttttttcaaaggttgtgaatcttattattgtagcagcaatgggagctgtacttataaaagcaaagcaaagtcctgagcgcgcacaaccacgaaagatacttgcacagattgttaaaatcggttttccttcggcattcgaaacagcactttataatgtggcaatgacatttatagtatgttttatgaaccatatggatacggatggaatgaatgttacagctcgttcgtatgctatgcagatagccaatttttcatattgtgtgggagctgcgcttgcacaggcaaatgccattatgacgggctggagaatcggagcaaagaagtatgaggaatgtgacaggggtacgcgaaaagctgtgatatatggtcttgtaacagcaacgtgcttttctgtgacatttgcaattaccggacgttttatcgttcatatatttacgaatgatatacagatgattgagcttgtagtaaaactgttggtagtagatatatttcttgaatttggaagagtgacaaatcttgtatatggccaggcattaaaaacaagtggagatgctattttccctgttataatgggcgcaatatttatgtatctgtttgcagttggtggaacatattttcttggaatacatatggggctgcttgcggtaggggcatatattgccatggcaggtgacgagtgtgcgagagcagttggaatggtgcttagatggaaaagtggaaaatggaaaagtaagagtcttgtagaatagaagagaatatgtcttttcgtatggagaggcagttagaggataaattggaatttactgttgaaaggattaaacaatgccaggttacataatggatttaagaaagcttgtaggacacaggacactgatgcagtgcgccgcaagcataataatagtgaatgaaaagaaccagattcttttaggaaagcgtacagataatcacaaatggggatatgccgggggttctattgaacttgacgagaaagtggaggattgtgcaagaagagagctgtttgaggagacaggtcttattgcagatgagatagaattttttatggtgaattccggtccggaggtgcattatgtgtatcctaatggtgatgaagtgtctaatattgagattatatatgtgtgcagaaaataccatggagaattaaagagacaggaagaagaaattgaagaactgaagttttttaatattgccgaggttgaactggataacatttcaccaccgataagaccagtggtgaaacggtttatagaacagaattcttagcaaatgctgtgcagatgaaatgcattttttctgaattcaataagcccttcatcacgcatttttccaagttccttggaaagtgctgaacggtcaacgttaagataatcggcaagctgctggcggtcgaatggaattacgaattcctgactgccagcttttcttgactcattggacagatatataagaagcctttctcggattgtcttaggtgatgtgcagaatatccggttagacagggtgagattcttctgaatggaaatgtgcagcagattgttaaggattgtatctttgcagtgtgtattttcaaattgtgaattcatcaatttatccatatcaagaaaaagaatcacacttgtttcagatgcaaccgcatctaccatgagcggttcgccagtcagagcatatgtttcagcaaatacatgtcccagagtaatattgctcataatagctttgttgccccacaaatctatatattcaatagttacctgaccagatgcaacaattccaatttcgtgaacgctgtctgttacatgatatataaacgaatttttgcggaattttctggcacgcagaaatccggctgcggtcatttctgatatttcagattcggtgatatctttaaatattggtgatttgataattgccataagttctccttatactgccccggtaaaatccaattttctgacttaaaatacatttttaataaattatcaaaaatgtggttaaaacaacatatttattatgctcattatattattctttaatcacgaaatcaatgagaacacaggagggttaagtgatgataagaagagttattcatattgatgaggataaatgtaatggctgcggagcttgcgtgacagcatgtcatgagggggcaatcggcttagttgacggaaaggcaaggcttatgagagatgattactgtgacggacttggagactgccttccacagtgtcctacaggggcaatttcatttgtagaaagagaagcggcagcatatgatgaagctgcggttcttgccaataaagctgcaaaggagcaggcagtagcacataaaccacatttttcaggatgccctggaagcatgatgagacagtttaacagaaattcacaggtaaatgcggagacagaagattcagcagcaggacacacggcatccccggttgcaccagaatcccagcttgcacaatggccatgccagattaagcttgtgccggttaatgcaccatactttgacggagcaaagcttttgattgcagcagattgtacagcatatgcatatgccaatatgcatcaggaattcatgaagggaaagattactattatcggttgtccgaagcttgatgatgttgattacagcgaaaagcttacacagataataagtaacaataatattcagagtgttactattgttcgaatggaagttccatgctgcggaggacttgaatatgctgcaaggacagcattacagaacagtggaaaattcattccatggcaggttgtgacgatttcaactgatgggaaaatcttagattaaaaaatattagaaataacactaaaatattgccaacacatgaattttgaattatagtattagtgctttataaaattcttataaatatttggaggacttatgaaaaaaataaaagcgcttatgccggaagcatatgattttaatggaaagcttccgctaaaacaggcaataccgcttggacttcagcatgtaatggcaatgtttgtaggtaatcttacacctctgcttattattacaggtgcatgtggaattggggcaggaagtgaatatgcatctatccaggttgcacttttacagaacgcaatgattattgcaggtattgtaacacttattcagttgttttcaatcggacctgttggtggcaaggtgcctattattatgggtacaagctctggatttatcggagtattcagcagtgttaccaagattatgggtggcggaatattagcttatggtgcaattatgggtgcatctattataggaggtctttttgagactgtacttggagcatttattaaaccattaagaaaattcttcccatcagtagtaacaggaacagtagttctttccataggattgtctcttatctcagtaggtatcaattcatttggtggtggaagctctgctaaggattttggttcattggaaaatcttttcctggcatttgttgtgcttgtagttatattatttgttaagcactggactaagggatatcttagttcatctgcaattcttgttggaattattgtgggttatattgtagcaattattatgggactggttcttccacatacagcagttacagctgatggagttgagtatactaaatcatgggtacttaactggaacaaggtagcagaggctaaatggattgcaattccaaagtttatgccagttaagcctgtgtttgatttaagagcaatacttcctgtacttgtaatgtttgttgtaacagcagtagagactgttggtgatatttcaggcgttatggaaggtggaatgggaagagaggcaacagataaggagctttctggaggcgtaatgtgtgatggtcttggttcaacacttgcagcaatgttcggtgtgcttcctaatacatcattcagccagaatgtaggacttgttgcaatgactaaggttgttaacagagttgcacttgcatcaggtgcggtattccttatattatgcggacttatacctaagcttggagcacttatatcaatcatgccacagtcagtacttggtggtgcagcagttatgatgttctcatcaatcatagtaagtggtatccagcttattactaaagagccgcttgatgcaagaagactttcaattgtttcagttgcacttggtgtaggttacggaatgggtgtaagccctgcaattcttgaacatacaccacaggcagtacagcttatgtttggtgagtcaggtattgtacctgcagcatttgtggcaatattacttaatgtgatacttcctaagagcaaaccggctaatgaagaaacttcaaaagacgagtaatatcgtctggagtatcgatatcatatagttcatattcatcccgtacaggaactaatacaacctgtgcgggatatttttttgttaagaacccgccgccttttttctcaggaaggtttagaagctcatcgtaatattttgcaggaaatatacatggagaaccagcattttccttgtaggaaagtctgcatatcttatcatcataataaagaaatgtaagacacagaagctgcaggcttgtccttgtgataagaggctggtctgatggcaggaaaaggattccctgaggctgcagattacctgaagaagcgttatctgatagaattctggtaactccaagccggaccatttcatttctgtatggcatgtcgtgttggagaaaatgtatatttttatcttcacatatatggacaacttcatcatgccgtgttactgcaagtgtctcaccaaagccggcaaaatggcttatagatactgcattttcaaaaagagagcgaccattaaagtctgtaatcagcttattagagccaaaacgttttgacataccggaagccataataatgcaagaaagcgtttcaaatgtgctgtcaatatcaataacaagaacatctttcctgttatagattctgtttagaaattctgtggattgttttctgattacagctaaaacatgtgaattatcaagcagtttttcaacagccttctgaaatgggatgcaagagctttcaagataaccaagctcatcaataacaaataacctttcaggagttgtatcaagatgtgtatcaatggcaggaattgcgcaattaataaatccatcttcaataattgtcatattattgcctttagatgcaggattaattccagatgtccggggtacaccaattacgaattctttattgtcagcaaccagattagatttaatgacaacctgtggtgtatccgttctatgactctgtaacagattgaaagaatcggacatatgttttaacatattattaacaagatgagattttccactgccgcggcttcctgttataaaaatgtgttttctgccggtcatcctgaaaaatgtaattacggcttctgcgtccaaataacaattattcataaatccccctattacaaagcaagaactattctgtgtacatttcccttggtatcagtacattcagtaacattgatattatcatatataagagacattttctcattgatttctgaaagactggctacatgtacatcaatatctgaaacaatttttccatctttcataagaagaatcctgtcgcagtactcaagtgccagttccggactgtgtatacacatgagagcacatttgttatcagaaatgatattccggatatgtttcataagcatatggcggttagaaaaatcaagcgcactgtcaggctcatcaagaagcagaagcgccgaagcttctataagtgtgcgtgcaagtatgcataactgcttctggccttcgcttaatgtgagaaagtctgtatcatataatccggcaaggccaacagaatcaatagctttatcagcacgatgtctcatgttgaaattgtatgattcaagcatgtgaagctgtggattaaatccgagcagacacacttctcttacagtcatacttatgcttattccggttctctgtggaatgtagcttatcatgccggctctttttctgacagacatactttcaagatgaagctcaccaagcatacattttccactatgtttaacaagattcatgacagctcttataagcgaggttttaccacagccgttattgccgataatagctgtgagttgtccgggatgtatgttaaagcttacattctggacagcacatttgcttccataatatactgatacatctgaaacatataattcaggattgaataaatcggacattatgcaacctcctttttgttagctttgataagcaggattataagcagcggtgcaccaaggagtgatgtaaatatgcttacagggagttctgatgatgatacacttcttgcaaatatatcagcaagtgtcatgatgatggcaccagccagtccgcttgatatgtatgtgaatctgtcattgcgtcttgtgagtaatctggcaatgtgaggtgcaataagtccaataaaactgataagtccggttacacatataattgatgatacgattaatgttgcaatcattaatatgataaaacggagaactgtgacattgacaccgagagcggcagcttcatcctcatttatcgagagaatgagaatctgtctgtataataaagtcatgattataaagcctgcacatgttacaaagaaaggaatagcaaggctgtcctttgaaacaccgttaaggcttcccatgatccagtattcaatagaagcaagctgtttttcaggatctgcagcaagtttgagaaacataagaattgtctgtgctacagaatgaatggcaataccagcaagtacaattgtgtaactgtttctgccgggaacaagataagccacaagtaatgtgattataagggcaattattcctccggcaaatgcggatattgatacaacaggggttaaagacgaaaccgcaactatagcaaaagctgcgccggcacttgcaccggaagaaacaccgacaacatcaggtgatgccagtggatttttaaatatcatctgatatacataaccagatattgaaaggccaaagcctccaataatacccataatggcgcgtggaagtcttagtcttttaaagaccataattgacatagtgtcccctgacagcagtccttttaatgtgagtggatactgtccggtaagaactgaccatgtaaacactgctataagaagcagtgcccacatgacagataatagtataattttgttccggtaattattaatattcttgaacataaatcatccttaattattttgcaggtgtaaatccataaaagctttcatagaatttagttacacaagtttcatagaaatctttagttaccttttctgggtgaagaacagaagcaatgtatatacttccaaggaagcttccaggaactggagaatcccatgcttcgatatcgttaggaagctttactacatttttgttcttaacagcattgcagccggcaagattagcatcgtttaagatgtcatcagctgagtaagttgcatcagcagcgataacgatgtaatcagggttccatgcaagaatctgctcgtaagaaacatttgcccagtaagtatctgtaagttcagaagcaacatttttaccacctgcgttagtaagcagagtattctgatacatcttgcttccggcagttgagagaacagagctgttacctgcaaggtatacagatggtgtattttcgccagaaacattagtcttgttatcagctaaaaatgtcttgattgaattattaagtgcttcagcacgaccgacattgttagtaatctttccaacaagagttatacattcctctaaaagtgactggtcttctggattcacaacaacagccttgattccaagactttcaagagtatcagctgttttctttaattttattggaagaaatacaacatcaggtgtagcagctacacatgcttctgtattaaattccttggctgttcccatgttaggaaggcttacgattgcaggagctgcaagcttgtaaatatttcttgtgttagccttggcttcgattccaacgagtttatcttgtaatccaagtgcaagaagaaggcttgttgaaatgtagtaagatgatgcaatcttttctggagccttttcaaatgttacggttctaccagcctggtcagtaacagtaagaggatagcttacgccaatctcattaaactgtgacattacgtcaaatgctgaagtagtagcttcttctgtgcccttatcagaagttgtagaattgccgcatgctgctaatgaaaaaagcatgagcattgctaaaaagagggcggtaaatcttttaaaattcttcatgttaaaatcctttctgtgaattggtttgtggagatgtattagaacggacgacttgaaaaattgttgagtccaacgcaggacacgctttcgctgctatacgaatcgtaagattcgtatttcgctcgcaacggtactaggttcgcggaaatttgttgtcacttcgtgccaactattcccgcttaccaaatactggcggctccaaagcatcctgcgttggactcaacaatttttcgtggctgacttcctaacaattatccaacaaattaatttacataaatagtagcgaatgaattttatcagattgacaagggttttacaagccgttatatttatataaggaaagagaatgagattatttatcaatttagtagtgaaggatgacagacaggttgtggcgggcacaggcccgatgccagcaggcgagggctcgatttgcagcgtgctgtgtgggagttatgccgccatatgcttaaaggtgtgtgcagaaaatctcgttcaagcgtagcgcgtttgattttctgcacactaataggctttgcagatggcggcatctactcccactaagctaagctgccatgagagccatcacctgcaggtaacgggtctggttgccacaaccgtccgtctgcctctcactaataaatagattggagtttttatgcttactatacagaattataagaaagtagaaagccttgaagaagcctatgagcttaatcagaaaaaagctaaccgtattgtcggcggcatgatgtggatgcgtatgggcgacaacagaatgaatacagctattgatatgtcagggcttggacttgataagattgaagaatcagatgaagaatttaagattggctgtatgacaactttaagacagttagaagttcatgagagttttaatgaatatacagatggctgtgctaaggaggctttaaggcatattgtaggtgtgcagttcagaaatcttgcaacagttggtggaagtatatatggaagatatggattttctgatgtgcttacgcttttaatcggactggattcttatgtagaactatacaagggaggcattgttccattaactgagtatgctgaccgtgattatgacagggacattgttgttaatattattgttaagaaaagaccggtgaatatgttttatgaagcagtgagaataacagaaacagatctgccggtgcttacatgtgcaggagtaaagtttaaaaatactggagtctgcaatatctgcataggtgcaagaccgggaagagcaattgttgttaaagatacagaaggaatacttgcaggcggtattaacgagaagtcagtagaagaattcagtacatttgttaagaaaaatgtgcctacagcgggcaatatgagaggaagtgctgagtatagaagccatcttgcaggcgttcttgcaggcagggcacttcagaatattaacagagattaattggtgattacggattggagaatatatgttagttgatattaagttgaatggaaaatctgttaaagcagatattacggcagacatgacactctatgaattcgtgagagagcatggctgttacagcgtaaaatgtggctgtgaaacatctaactgtggcttatgtacagtatttcttaatgataagcctgttctttcatgttcagttcttgcagcaagagcagacaaatgcagtgttacaacactcgaaggattacaggaggaggcgtctgaatttgtcacatttatagcagatcagggagcagagcagtgcggattctgtaatccgggatttgttatgaatgcattggcacttttcagagagaacccttatcctgatgaagaggagataaaggagttcctttcaggaaatctgtgcagatgttcaggttatgagggacagttaagaggaattatgaatttccttgaggcaaagaaagcaaaggaggctgaatagatgaagtcggttaataaagctatcagaaagaaagatgcgatggaactgcttcttggaaagccggtgtatacagatgatattgcacctaaggactgccttgttgtaaagcttctgcgctcaccatatgccaacgcatttgtaaagaatattaatactgatattgcgatgaaggtgccgggaatagaagcaatatttacatataaagatgttgaccagaatatgaaaagattcacatgtgcaggtcagacatatcctgagccaagtccttatgacaggcttattcttgataagcatgtaagattcataggtgatccggttgccattgttgcaggtgctgatgaacgctgtgttgataaggcaatgaagcttattaagacagaatatgaagtacttgaaccattgcttgatttcactaaggcaaaggataatgagattcttgtacatccagaggataactgggaggcattatgtccggttggagctgataataaaagaaatctgtgtgcgcatgatgagagcggcaacggagatatcgataaggtactagacgagtgtgatattgtgattgacaggacatatcatactaaggcatgccagcagagcatgatggagactttcagaactttctgtacaatagatacttatggaagacttcatgtcgtaagttctacacagatagtattccattgcaggagaattatttcacatgcacttggaatatcgccatctaagataagagttaccaagccaagaatcggaggcggatttggagcaaagcagacatctgtgtcagagatatatcctgcatttgttacatggaagaccaagaaaccgtctaagattatattttcaagggaagaaacacagtcagcttcatcaccaagacatgagatgcagatgcatgtaagacttggtgcaactaaggatggtattgtaaaaggaattgatttatacacattatctaatacaggtgcatatggcgagcatgggcctacaacagtaggtctttctggacacaagtcaattccattatatggaaaggcagaggcgttccgttttgtaagtgatgttgtatatactaatataatgtcagcgggtgcttacagaggttatggtgcgacacagggtctttttgcagttgagtcggctgtaaatgaactggcagacagacttcatatggacccgtttgaaatcagatttaagaacatagtaaaagagggcgatgtaatgcctgcttactatggacaggttaatacaagctgtgcacttgacagatgtcttgcaaaggtcaaagagatgattaaatgggatgagaaatatcctatgagaaagatttctgatactaaggcacgttttgtcggaatgggcatggcaatgcagggctcaggtatatcaggagttgatgtcggcagtgcgacactaaagcttaatgatgaaggtgtatatactatgaacatcggagctgctgatatgggaacaggctgtgatacaatacttgcacagattgcagcagaggttcttgaatgcagcacagacgatataagtgtatttggtgcagatactgacatatcaccttatgattcaggttcatacgcatcaagtacaacatatgtaactggtaaggctgttgaaaaatgtgcattagagcttagagacagaatcgaaaaacttggtgctaagatgttaggctgcgagaaatgtgatgtcacatttgacggaaagaaagtaatatgcgaatcaggtgagaacaaggataaatgtgtaaccctggccgatatatcaacagcatccatgtgtggtaatgatatagcactttcagttaccaatacacatacatcacctatttcaccaccaccattcatggttggagcagcggaggtcgaggttgaccttctcacaggtgagagccgtgttgttgagtatgacgcatgtgttgattgtggaacacctgttaatcctaaccttgcaagagtacaggcagagggtggtatcttacagggaattggaatgacaatgtcagagaatatcacatattcagataaaggcaagctgtatgagaactcatttttacagtacaagattccatcaagaatggatattggacatattaatgttgagtttgagagcagttacgagaatgcaggtccttttggtgctaaatcaatcggagaggttgtaattaatacaccgcttcctgcaattacagatgcattaagccatgcggcaggaaagagattttacgagcttcctataactcctgaccagattgcaatggcaagtgtaaaagataattaaaactgattgaccatagagccttgtaatgttagaataatttcttataatatgacagataatttacttacgaaaggaatcattactatgaattttcttgaagaaagaattatgaaggacggagttgtcaaagaaggcaacattcttaaagtagacagttttcttaatcatcagatggatgttaagcttttcaagcagatgggcgaagaatttaagagaagatttgccggaaagaatattaataagattataacaattgaggcttcaggaattggtattgcatgtatagttgcagaatgctttgatgtaccggttgtatttgcaaagaagtcacagagtgtcaatattgatggtgatgtgtattctgcggaagttgaatcatttacacataagtgcaagaatcaggttcttatatctaagaagtttgtaggtccagaggatcatgtacttattattgatgattttcttgcaaatggctgtgcactccagggacttatatctattgtcaatcaggcaggcggaactgttgaaggtattggaatcgcagttgagaagggcttccagcagggtggacagattatccgtaaccttggataccagctggaatctctggctattgttgatggaatgaatgctgcagatggcagtattaatttcagagaggagtaatcatgaatgaatatcagtttttttcaccagtagatgtcgtatttggatgcggaagtctttctaagcttcatactcttaagatgccaggaaagaaagcacttcttgttataagcaatggaaagtctgcaaggatgaatggttcacttgacagaacaatagatgaacttaaacaggctgatgtttcatatgtgctttataacggaataggagctaatccgctgaagtcagcagttgaagaaggcgcaagaattggtcgcgagaatggagttgactttgttgttgctttaggtggcggttcagttatggatgcggctaagaatatggcaatgttcattccacagccatcagataatctgtgggattatgctaatagtccatcaggtggcaagatgacacctcctaatgagatgcttccatggattgcaattactacatcagcaggaacaggctcagaggtcgatactatcggagtaatttctaatcctgatactaatgaaaagattggtattggtggaatggcggggatgtttgcaaagtatgcaattgttgaccctgagcttatgaaaacagttccaccgaaattcactgcatatcagggatttgatgcacttttccattcattggaagggtatataagcaacaaacataatattatgggagatatgattcagcgtgccgcgattgaaaatatcggacattatcttgcaagagcagttaaggatggcaatgatattgaggcaagagaacatgttgcatacgctaatacaatgtctggctattcaatggttgtaacatcatgtatatcagaacattctatggagcatgcaatgagtgcatatcaccctgagcttcctcatggagcgggacttatcatgctgtctaaggagtacttcacattctggattaataagcatgtatgtgatgaacgcttcattgatatggcacattttcttggaatgaaagatgcgtctaaaccggaagatttcatcacagcgcttcttgaattacagaaggcatgtggagttgatgaccttaagatgtctgattacggaataaagaaggaagaagcaatgacacttgccaagaacgcaagggcaacaatgatgagattgttcgtaagagaccctcaggaaactacggatgaagagattgcgggtatatatgagagagcgtatagataatatttattaattataggtataatattcacatgatgaatgttgtacctttttttaataaaaatgaggtatttctaatatttagataatatatattgacatatataattatatatgatattaatatatttaaagaataaaatcttttctaaagtaacttggtgttgattgcttcaataatcaacaccggttgcttatcaaagctggatattcatagattaacatacatctatgtaagttcgtttatgaaaaacatttatggacattcattcagcaaaatccacataaaacataattgaataatgcaggcttgttttagatatctgtagatgctaatatacttatatagacaaatacaatattagtatatgtgcgtggatatcagcctgcgaaagagacgaggaggatattctatggcagagaagaaagacaatgtaacatctaaatttaaggacaatgtattctgtatgctatacagggataagaaaaatcttttagagctgtataatgcacttaacaattcagcttacacgaatgtggatgatttgcaggtaacgacattaaacggcggttcatatatgaagtataagaatgatgcttcatttttactatgtatgagcctgtatatgtttgagcagcagtcgagtaagaatcctaatatgccgttaagatttttgcactatgtatcagatgtgttcagagagttgttcagtaattccatgcttcacagaagaagcatgattaagattcctgttccgcattttgtgacattttacaatggtctggaaaaatggattgaagatgaggatgaaatcaggctgtcagatatgtatgagattccgacagataatccagagctggagcttaaggtgcgtgttatcaacattaacgaaaatgtacatatccttaataagtgcaaaacgctgcgtgattatatgacatttgttaataaagtaagattcaagatgggagttgaaggggacgatgtcaggattgcagtaacagaggcaattgacgaatgtatagatgaggatatacttgtcgatttttttgaacagcatagggaggaggtcgtcgaagtgagtatatatgattatgatgaggaagatgtcagaaggacattatttgaagaagcaaaggaaatggctaaagaagaattaaaagaaacagttatagaagaattaaaacgagaagcaaaagaagaattgacccaagaagtatttgcagagggtgaacagagcggagaacaattaaagatagttaatcagattataaaaaaggtaaagaagtcaaaaactctggagacaatagcctcagaactagaggaagaagaggcagatataaagccaatatacgaagcagtagtttcatctgccccagattatgatattaatgtaattaaagatagattagacaatatgtgaggaagttatttcttcataaatgaaacaaaatcaaatttcttatcaagccatctgccgacaaggccgatggcttttcccattgtaaatgcagcaacaacagtaccgatgccaagacctttaacatgacctaatatcaggccggtaagacatgcagttacggcaaggcatataacatcgaaagaaatcttgatgcgtgaatatgcaacgccagttatgtcagcaagttcacgagggaacaggtcggtagggataattggaagcttacatctgttagaaagagctatgccgagacttatcaggcagtagcttataataaagtacacaattctgaatccgattgcagttgggagcattggaacccacagattgtgcatgtcgatgcattcaccaaatatgaatccgacaacgaatgaaaacagatatgatggtacgaacttctttcgcagaatcataaggctgagtacaagaagtccctggaacatatatgtaaatgtaccaagagtaatcttagggaagacttcggaaaaagcatatggaacgcttgagattgcagatattccagttcctgagtaaagcataagcacaactccaaggctgttgattataacagcaaaggcaagaacaagctcacctctaagcgtagtcttaacattttcagaaacagaaccagcatttaaatctattgcactatcaattgaactcataaggaatcccctttctttttaataaagaacataatcacagtctctaagtgtagtttcattattgattaataacaaatgaataattttaatgaaattatagattttgtctatagaactgtttataattaagataataaatgtgcataggaggctgtctatgaatatatataatctgagatatttcgttacacttgcaagaatccgccagtacacgaaggcggcagaggaattatgcattacacagccgagtcttagtcatgcaatttcacagatggaaaaggaacttggtgttaaactctttgaaaaaaacggacataagataactctgactcaattcggagaggagtttttttcttatgcagaaaagactcttgatgtgttagatgatggaatcgcttctattaaaagaagtgcaatgggaaatggaacgataagattaggacttgtaagaccattgggaataagctatgtccctcggatggcggcagcatttataaagaagaatccgaagcttgatatagattttacgtttcacacagatgttacgggcaggctgcttgacgatatgcagcttggaaagtatgatttgttgttctgttccaagccatcagaagaatatcattttacggctgagcccgttatgaagcagagactggtgcttattactcccaaaggacatccgctggctaagaaaaggaaaaggagcattaatcttgcagagacagccgggtattcatatgtatgttttgacaagaactctggaataagaagcatatttgatgaaatgttgaaaagatcggacataacagtaaaggttgcatatgaaactgaggaagatcaggttattgccgggctggttgctaatggattcggaatagcggtagttccatatatggatatattggaaaagatgtctgtagaaatatttgaaatcgagtcacctgaatatgagagaagcttttatatggttaatgataatagtacatacatgtctcctgctgtagagacgttcaggaactttgttatagagaatacaagtgttttaacggctttgtagagattaatataattaatgaataaccggttatatcttaattaaatgacaaatttgtagaaaaattaacagattttattgatacatttttgacaaattttaatgaaattattaaataaaaataaagtttgccataattcaatgtaaaaaataacaaaaatgaacgctggtcataaataattttttgttaaaaatgtacgattattaaaggagaaaatagtgtcaaacctaggcagaatctaggcttgacattattttttttgtggaataaaatccgtgaacagaaaagaaatatgtttcatatttagaaaggaggtcgtgcagatggatgctttggtagaagggcttatggaagaacttaattgcgagacagtgttcactatacctttgtttggtggaatcccagtatatgaatccgttgttgttacatggattattatggctgttgtgtttctgttgtgtattctgctaagccgaaatctaagtgtggaaaaccccagtcgcagacaggtagttgtagaaacagcaataaaggggctcaatgatttcttcactgagacggtaggagaaaaaggaaaggcatacattccatatctgtcagcaattgctatttacataggaattgcgaacctgataggactgcttggtttcaagccgccaactaaggatatgaatgttacagcaacactggcattgatgagtattgtgcttattgaggtcgcaggaatcagagccagaggaactaaaggctggcttaagagttttgcagaaccaatgcctataatacttcctattaatattctggaagtatttatcaagcccttatcactttgcatgcgattattcggtaatgttttaggttcatttgtaatcatggaattattaaagatggtagttccggcagttttaccggcagtattcagttgttacttcgatatattcgatggactgatacaggcgtatgttttcgtattcttaactggtctttttataaaagaggctgcagagtaagagtatatgtaacaagaataaatgttttaaaaaggagattattattatgtcaacaattttagtagcaatcggagcaggtatagcagtattaacaggtatcggtgctggtcttggtatcggtaaggcaacaagcagtgcagtagacgctatcgcaagacagccagaggcagaaagcaagattagtaagtcacttcttttaggttgtgcccttgcagaggcaacagctatttatggtttcgttatcgcccttcttataatccttttcttaggctaataacatttatgggaaagataactaagacaagatagaaaggaaggcgaagctagtgttaagtatagatccatggaatatattatggacagtagtcaatctgctcgtcttatatctggtgtttaagaagttcctgtttaagcctgttatgaaagtaatcaatgcaagagaagatatgattaagcagcagtgtgatgatgctaagaagagtcaggaagaagcagatgcattaaaggcttcatatgacgaaaagcttgaaagtgcgaagactgaagctgatgagattattgtaaatgctagaaacagagcacaggaagagcatgaggcagctttggaaaagaccagaaaagaaacagaagtaatgcttgaaaaggcaaaggctgatatagctacagagaaagagaaagcaacggaagctgcacaggcagatattgcaagactcgctctcatagctgcaagaaaaatcgtaaagacaggtgatgctcatgacgcaggcagcagtaaataatgcaatagttttacaccggttgtctgtgagcagagaggatgtaagaagggctgatgagttatacagcaaaacttcagaacttcagaaaattctcacgaatcctgaaatacctcttgcaaagaaatacgacatcattgataaagtgtttgcacttaatgataccaaggagcttatgaagaattttattaaagaaatgtgtaagcttggttattgtgatgagatgagagacatatttgattcatattacagaattgatgatgaagcaaaccacattttaaaagcagagcttataagtgcagacagcagtgatgaagatgataatgcaaagcaggcacaggatttcttaaagagcagatatccggattatacaattgaactgacaaagacagtggatgcggatctcttaggcggatatcttataagagcgcatcacaaggaatacgacagaagttttgaaggacgtttttgtcagcttgaaagaaaattaactgggaggtgacccctgtgggcgcaattagtgcaacagatattatctccattatccagagtgagattgagaatttcaattgggatgaagcaagccgtgagaccggtaatgtaatatgggtcggtgatggaattgctactgtatacggtattgaccatgcaatgtatggtgaaatcgtagtatttgataatggagtaaaaggaatggttcaggatatccgtgagaatgagataggtgttatcttgttcggcagggatacaggaatcaaagaaggaactaaggttgtaagaaccaagaaaaaagccggaattccggtaggcagcgcatttgtaggaagagtaatcaatgcacttggcgagcctattgatggaaagggcgatattaaagaagaagattacagaccaatcgaggaagatgctcctggtatcgtagaccgtaagtctgtaagcacaccaatggaaacaggaatactttcaattgattcaatgttcccaattggccgtggacagcgagaacttatcattggtgatcgtcagactggtaagacatcaattgccacagatacaattattaaccagaaaggtaaaggtgttatctgtgtgtatgttgcaatcggacagaaggcatctacagttgccaaggttgtatcaacacttactaagcatggtgcaatggattattcaattgttgtatcttcaacagcaagtgatcctgcatcacttcagtatatagctccatatgcaggtactgcaatggcagagcatttcatgcatcagggaaaagatgttcttattgtatatgatgatttgagcaaacatgcggtagcgtatagagcactttcccttctgcttgaaagatcacctggacgagaggcttatcctggagatgtattctatcttcattcaagacttcttgaaagatcaagccgtttaagtgatgcgttaggtggaggctcaataacagcacttcctataatagagacacaggctggtgatgtatcagcatatattccaacaaatgttatctctatcacagatggtcagatattccttgaaactaacttgtttaattcaggtatgagaccagccgttaatgtaggtctttcggtttcacgagttggtggtgcagcccagactaaggcaatgaagaaggcatcaggaagcataagaattgaccttgcacagtacagagagatggaagtatttacacagtttgcatcagatcttgatgatgcaactaaggcacagttacagcacggaaaagcccttatggagcttttaaagcagccactctgccatccactttcaatgcatgagcaggttatgacacttgttatggctaacaacggcgtatttgatgagatacctactaaggaagttaagaaacaccagacagaattacttgaattcatagatctcaagcatcctgaaataggaaagcagattgaagataagaaagagattaatgatgagctggttaagaatattctggaagcagtaaaagaatttgcataatgcatgtgtgctaaaagaaaggtaagcgtatagatatggcaaacacaaaggaaattcaggatcgaataaaaagtatcaatgatacattaaagattactaatgccatgtatatgatttcttcttccaagcttaagaaatctaagaaaatgctttcagacacggaaccatactttttcactctgcagtcagaaatgagccgaatcttaagacatatacctgatataagcagtatatattttaagacaaatgaggataaagacgcagcggataaaaaggtaggctacatagttattactgctgataagggacttgcaggttcatataaccataatgttttaaagattgcgcaggagcagcttgaaaagaatcctaatcattcattattcgtattaggagaacttggacgacattattttgaacagcgcggtattgagattgagaagcagttccactatacagttcagaatcctactcttaacagagcaagaaatatttcagaagaaataatagaactgtacagaaaaggtgaacttgatgaggtgtatatcatatacacaagtatgattaatgctattcaggaggaaacacagattgaacagcttcttcctcttaagaaggcagatttcaatatccagataccggttgatttcaaaagagaggaacttgcattaaaaccttccccagaagtagttatggacagaattgttcctgattatatagttggtttcgtatacggagctttggtagagtcattctcctgcgaacagaatgcccgtatgatggcgatggaggctgcatcaaagagtgcaaaggatatgctgcacgatcttgatatacagtataacagagccagacaggcttcaatcacacaggaaataactgaggttatcgctggtgcgaagtcgcagaagaagaaacgaaagaaataatgcgacggataggagataatatgagtaataaaggaaagattatacaggtaatgggacctgttgtcgatgtagcgttcgaagatgagaaccttccggcaatcagggacgcacttgaagttaataatggtgataaaaaatgtgtaatggaagttgcacagcatatcggtaacgacacagtccgctgtattatgcttgcttccagtgaaggtctttgcagagacatggaagtaacagctacaggcagtggcattaagactcctgttggagagaaaactcttggccgtctctttaatgtattaggagaggctattgatggtggagagcagccagacacagaggagaagtgggaaatccacagagaacctccaacatttgaagaacagaatcctgcagaagagattcttgagacaggtatcaaggtaattgaccttttggcaccttatgcaaagggtggtaagattggtctgtttggtggtgccggagttggtaagacagttcttattcaggaacttatcagcaatattgcaacagagcatggtggatattcaatattcacaggtgtaggagaaagatcaagagaaggtaacgacctctggacagaaatgaaagagtcgggcgttcttgaaaaaactgccctggtgtttggtcagatgaatgaaccacctggagcacgtatgcgtgttgctgagacaggacttacaatggctgaatatttccgtgatgagaagcatcagaatgtgcttttattcattgataatatattccgtttcacacaggctggttcagaggtttcagcacttcttggacgtatgccttcagccgtaggttatcagccaacacttgcaactgagatgggtgaattacaggagagaattgcttctacaaagaatggttctgtaacatcagtacaggcagtatatgtacctgccgatgaccttactgaccctgcacctgcaacaacatttgcacatcttgatgcaactacagttctttcaagaaagatagttgaacagggtatctacccagccgtagaccctcttgattctacatcaagaattcttgagccggacattgtaggtgaggagcattatgaggtagcaagaaaggttcaggaaatcctccagaagtacaaggaattacaggatatcattgctattcttggtatggaagagcttgcagatgaagataaggttacagtattcagagcaagaaagattcagaaattcttatcacagccattccatgttgctgagaacttcacaggtattcctggtgtatatgttccattaaaggagactataagaggtttcaaggcaattattgatggtgagatggacgaatatcctgagaacgcatttttcaatgtaggaactatagatgatgttattaaaaaggctgagaagatgcagtaacatcctgccagaaaggaaaaactaatggctacaagttcattttatttaaaagtaatatcagctaaccgggtgtttttcgctggcaaatgccgttctctgattgtgcctgagttcgatggacagaaggaaattcttgcccatcatgaagatatggttattgcaattgatgaaggtcagatgaagttccagccagagggcagcgacgagtggattcatgctgttgttggaatgggatttgttgaaatcgtcaacaaccgtgtaactcttcttgttgagacagcagaaaagccagaggaaatcgatgtgaggagagctcaggaagccaaagagagggctgaggagagacttcgccagaagcagagtatccatgagtattatcactcaagagcagcacttgcaagagctatggcaagacttaaggtaacatctggaaagtagaatttatgatacatatatgggtttgcacctgccagaatgcttgtgaatagcattctggcaggtgctttttgtcgtgcagggataatgggagccgaagcatgtagaattgtacctcataagatacttgtaaataaatattcagcttgctataatatgcaagatgtattttgtatacacaaataaagtgattggaattaacaaaatacacaatcagggaggaactaaagatgttatctatgaaagaagcgatagagaattatgtggaaggttgtgttgctaaggttgactgtccagcatacaagctttttatgaaagccatacttgcaggaatgatgattgcatttggcgcagccggaagcagtgtggctgcacatgatattgctaatgtaggacttgcgcgtctggttgcaggagttgtattcccaatgggacttatgatggttgttatgacaggtgctgagcttttcacgggagattgtctggcaattatggcaactgtacagaagaaacatacagcacttaagcttatacgaatgctggttgtagtatattttggcaatcttcttggctcgttaatgcttacatgtattgattatgtaagtgggcagtataattattcatcgggaatacttggtgcatatacaattaaagtagcaattggaaaatgtaatcttgattttacaacagcacttgcatctggaatattatgtaatatacttgtgtgtgcagcagttatgcttgcggcacgtgcaaaggatgtaaccggaaaactgttatgttgtttttttataatactgctttttgttgtaagcggttatgagcactgtgttgctaatatgtattatgtacctgcaggaatgatagcaaaacttaatccgttatatgtgaaagatgctatggagcaatatggttatacagcacagcagcttagtacattgaatataccgaattttatatttaataatcttattcctgttacaataggtaatattgttggaggaatggcattcttcggaataccgttgatgtatatcaatggagttggtgggaagaaggcgtgagacatatcttaaagatgatttagaagaaaatatattattacctatgattattcctttagaaaccattaaagcataggaagatgtgcagtagaagaatcacagacgaacacagacttacgtataatatggacatgaaccaaaatctgataatatattcctgcaagttccattatgaagattagcacctgaaacatggtgcttttttctttacacaaaaatcacatggtttcagagaatattatatcgggggataaaaatgttatcatctactacgaaaaaatatgaacataaatgatggggcaaaatagtgtatcgtccaactaggtgatacatttgcatctgacagcaagatggtcgcagaatatagagcagaacctataagaagatattatttctattgcttataggcagaaatattaggatttctgctcataaagcgcagatttcattgtaaatacctataaatgatggaaaaccacattatctataggcaatctttagctttctggcaaggataatgtctgattcgagagaagaatgtatagaaaatacctataagctgtcagaatatacgactacctataggtatcatgacaaaaaaatcagacaagacatttcttaatcaataataatatgcctataaatcttgaaatatagatattcttataggaaatgtttaacaacattatagtggatttatccaatatatgctacaaaatcagagccagcacccatacagctatcatcttgaacgttattcagtaacagatttcttggcagaacagcaagtcttaacccgacatatgtcaatacagatttaatatcttatgtttcagttggcattgcgtgtgcaataatattgcaactcatatatataaagctgaagcgcagagcataagaaaacacctcttaatcagcaatatacattctgattaagaggtgtttttcttcgtccattattagtaagtatactcatggcgagggcgataataaaatgcctgaagctgactgttacggttataggtaactgtataacaatcggctggtgcatcagcataagtctcaggattaactctgatagttattgtctgtctgtgagactgtccactgttaccgtgttctgcactggtattatcctgtcctacccctttgagattactgatagtctggactgggtacacttttgaattgcgaataactccatttgctgcaataatccctccttggaccttatttcaaaatgttacttctacattatatatcggtcaaacgtgttatattattacattgaatttctttataaaaatgtatgatagaggaagataatatgcatgatgatggagatgtttatatgggagaatacaagcccccttttgctataaaactcatgaaatgtgatggatatattaaaatgggctcataaaatgtgattacagcggggaaattccctcatagtactataacagaataaagatatatacaaaatgccccattccggattaatccggagtggggcttattatacgcataagcagttaatgcttaattaatcaatttcttttttcttaattctgtcaagataatctttagtttctttagcaaccacaccgtttaaagcaacgagtgcaataaggttaggaatagccatcagaccgttaaatatatctgcaattgtccatacagcagatactgtcatataaggaccaatgaatacgcagaggatatatatccatctgtatgccttgatgcatttcttcttaccattagtaaggtattcaaggcagcgctcagaataataatcccagccaagaatagttgtaaatgcaaagaatacgaggcataacataagaataaatgaagcaactccatcagggaatggaagtcctaactggaatgctttagttgttactgcaacaccttcaagtcccatatcgtaagctcctgtaagaacaattgcaatacctgtaattgaacagatgataatagtatcaataaaagtagctgtcatagatacaagaccctgacgtacaggttcattggtacgagcagcggcagcggcaataggtgcactaccaagaccggcctcattagagaagatacctcttgcaatacccttctgcatagctacaaccatggcaccaagggcaccaccagcagcggccttaagaccaaatgcactctgcacaattgtaaggatggcagcaggaacatctgtaatattaaataaaataataagaatacctgctaaaaaatatgttgcagccatgaaaggaacaataacctgagcaactttagaaattctctggattccaccaataagaacaagagcaacacagaatgtaaggataagacagcttataactacagtccatgaatatgttcttccaaataatgaaacagtccatgcgttgttagaatcaaagaaattattaacagcagaagagattccattcacctgtgtaaatgtaccaattcctaaaagaccaacgcctataccaaagaaagcaaatatcttggcaagccatttccacttaggtcccataccatgttcaatgtagttaaaaggaccaccaacaacatgaccgtcttcgtcaacctgtctgaacttaactgctaagagacactctgcgtacttggtagcagtaccaactaaggcagcaagccacatccagaataatgcaccaggaccgcctgagacaatagcagtagcaacacctacgatattacctgtaccgattgttgctgaaagtgctgtacatagtgctgcgaaactgctcacttcaccatgctttccatcagtttcgtctttgaaaatgtacttaaaagcacgtccaagattagtaaactgaacacccttaagtctgatagtaagaaacagaccaactgaaagtataaggacaatgagtggaattccccagacatatgcgtcaatagtaacgagaatagtattgattttactaaacatattatgtattctccctttttataaaaaattaagataaattttatcataaaacaacatttttttcaattgaatactgttatttcctaatataataaataattttgttaaatgttgcttattgacaaactctgtcaatttatatattattgttgaaaacgaaggcgttttgcagataaagcaagacgcttttttccttattattaaggtaatatccggaagatataatcgggagagactgtgtaaaaatgcagcgccgaaggtgacagcgaaaactctcaggcaaaaggaccggttatggacggaactctggagagctgtaattatcagcaccgaagaagcaatttctaagcatagagatgagaaatattgaggctgatttgcttggggagaatctttcaggtttttaacagaggcataggtgtattaaagtgcgcctgtagcctcttgtttttatgtaaagatatattaggaagggaacttcttaggaattttgataaggcaggattgcaaggcacgaaaaggctaaagcaaaggagagaaacattatgaagacagatattgaaattgcacaggaagcagtaatggagccaattaagaatgttgcagccagatgcggcataagcgaggatgatcttgaattatacggaaagtataaggctaagatatcagatgagtacatcaacagtgtcaaagacaatgaagatggaaagttaattcttgttacagccataaatccaactccggcaggagagggaaagacaacaattactgtagggcttggagaagcatttggaaagcttggcaagaaggcagttatagcacttcgtgagccatcacttggtccatgtttcggtatcaaaggtggagcagcaggtggtggatatgcacaggttgttcctatggaagaattgaatctgcattttacaggcgatttccatgcaatcacatcagctaacaacttatgtgcagcacttcttgataaccatatacagcagggcaacgaacttggaattgacccaagatgtgttacatggaaaagatgtatggatatgaacgaccgtgttcttagaaatatagttgtaggtcttggctctaaggttgacggaactgtaagagaagatcattttgttatcacagttgcgtcagagattatggcagtattatgtcttgcaacagatatgaaggatttaaaggaaagactcggcaagatggtagttgcttacaattatcagggacagcctgttacagcatcagatatcaaggcagtaggttcaatggcagctttgttaaaggatgcattaaagcctaaccttatccagacacttgagcatactccagcattagtacatggtggaccatttgctaatatcgcacatggctgtaattcagtaagagcaactaagactgcactcaagatggcagattatgttatcacagaggcaggatttggagcagatttaggtgcagagaaattctttgatataaagtgccgtaagtcaggcttaaagccagatgcagttgtattagtagcaacagtaagagcacttaagtacaacggtggagtacctaagacagaattatcagcagagaatcttgacgcattaaagaagggaatcgtaaaccttgaaaagcatattgagaatcttcagaaatatggtgtgcctgtagttgttacacttaatgcgtttgtatcagatacacaggcagaattagattatatacagaagttctgtgaagataaaggctgtgaattcgcccttgccaaagtatgggaaaagggtggagaaggcggaattgagcttgcagaaaaggttcttaagacacttgagacaaagaagagcaatttccattgtctgtatgagacagaccagccggttaaagcaaagattgagacaattgccaaagaaatatatggcgcaggaagtgttaattattcggcagcagctaataagcagattgcacagcttgaacagttaggatttggtaatcttccaatctgtatggctaagacacagtattcgctttcagacgatccaacattacttggccgtccggaaggatttgagatgaatgtaagagaagcatatgtatcagccggtgcaggcttcatagtagtgcttacaggttcagtaatgacaatgccaggactttcaaaatcaccagcggcatataatatagatgttaatgatgatggggtaataactgggttattctagaaaaagtgactcccgggagtgggaggcaggtggctgggtagtgtattttcaaacgcgctttcgctcggacgaaaacgcagcggtactaagattttgagaggcttgtcgcctttggcgactccctcgcaaaatcaagtgccggcgtttccgtacggtttgaaactacactacacaaccacctgcctccaaacttccgggagttttttgatttacagtggaatggacgttaaagaggagggaaggcacaccgaagtcgaaaaaaggacgcgccagcggaccagattggacttcctcccgccccaaccttgccaaaggcggggcggagcagttgtccggtaaagaaaagcccagccgtgtatattagtaaaatcaaaaccgtatgaagacgccggcacttgatttataaaggcagccgccataggcggcaaacctttataaatcttagtaccgctgcgtcggaatccgagcggaagcgtgttttgattttactaatatacacggctgggcgtgctttaggggagcaacttcctacagcataacacccgacttctccttacttctctcaatcatatgattcagcttctcaaatggtttctgtaagaacaatccgataatcagcgaaacaactatatatattgaaagaaaagcgagattcttaatgtaatcatatctgtacattcctgctatacattctcttaatgcatccattgaatatgggaagagcaggaatcggtatattatctggtaggcgttaggaagtacttctatagggaatgtaccgcctgagccggcaacctgtataacgagcaggacaattccaagtgcttcaccgatatttccaaatgcaacagtaaggctgtacataaagaaggtgaatacgaagcttgagaatgcacatgcaacccagtaaaggaatgggtggtaacactggattcctatgtagagaagatttccaagtgttataagcagtgcctgaagctgtcctactgcaaagaagataaaataccttccgaagaatttttcatatctctttgcatctgctggaatgtccggagcaggatgcacaggtgtgtgcataatagcaacaagtataagtccaccaaaccacagtgcaagtattgtgtagaatggtgaagcgcttgttccatagcttttaacagcatatacctgctctgttgttatatttacaggtgcagagagaaaatctcccaaagtattggcatctgcatttaacatctctgataataaaccgtatgtatcctgttcagtgattgtgtttaatgtattaattgcattatcaagctttgtctcaaggtcactgagaagctctttagtctgagtgagtgagcctgatgtaagcttaattgcagcagacaggtctgcaacatccatgttcatgtcagaataaagctctgttaatgaactcataatgctttgaatctgggacatctggtttgaaagagcagatgataattcatttaaagattcagcggaattaccatttacaagtgcctgtaaggttattaactgctgctgctgtaactgtaattgtgtataaacttgcggtgcagcactgtttgaactgctgcttattgatgatgtaaggtcagtaattgcaagcattgagttaagaattacatcgtatgttgaaagtgtagtccttgcggatgtaagtctgttaataactgcatccataagagaaccggtttctttatctgcatctttgataactgagtcgccagtaccggcaatcgtagatacgattgtatctataaatgtctggtttacctgctgctgaactgctgttttagccttgtctgttatcttaggtgcaatagcgtttgctttctggttacagtaatattttaactgaggatgttccatggaatcacttaagaagcttataagattcttggaaaaattctctggaacaacgagggctgcataatactcaccgctgtatacgccttcgattgcttcatctgatgaagcaacaaactgccaaccgatagtgttattagttttaagtgcatcaattatggtgtcaccgacattaagctccgttccttcaagagaagtacctttgtcaacagatacaacggcaactttaatcctgcttgtggaagcctgtccatatggatcccagtttgacaggatattaaaccacgaatacaatgcaggaataacggtaagaccgataattacgcatagtgcaattacatttgtttttatgtggcgaaggtcagcccgtataatcttaaatatatttttcataactgtacctcacttaaaaatgctttgatactgtctgtaagagaagtatcagcctgtttttccttaatctcaatattgagctcattgagctttcttgcgagcttgtcatcaatataatcaataactataagataagcacagaatataaaaagtgagattacccaaagaagcagataaacaaccttagctgtatccatggtaaacataagcaccatgaatactaaaggaattatcatcatacatcttaagcagacctttttcttgtgctggttcttagcgtgcatattttctgcaaacgctgtgatttccgcaataacaacatctatattaaaatcatcattttgcataaattcatttctcctttacataaaatgtgtttctttcatacggcgttcgaagaactcgcgtacttcaagaagtgactttctgattccaagtcccagaataagggaaataacagcataagcgcataatttcacaagaaatacagcgtaatcacactgatataatccgcttattgcctccctcatggcattgattgcataagggaatgggaagtaaaggtacacattctggaagaattcaggaagaagttctattggataagttccgcctgaaccggcaatctgtaacacaatcataactacagcaatagcttttcccaaatcaccaaatgtaagaacaagtgtatatataaataatgtaaatacaaagcttgttatagcggctgcaagccacagcatgaatgggtgggtgcagtcaatttttaaaatatacaaatcaccaagaacaactacaagagcctgaagctgtcccattgcaaggaagagtaatgcacggcctatatatttctggtgttctgtggcatccttgaattcatcatcctcatagtcaacctttactttcataagggcaactaaaacaattcctccaacccagagagcaagtgttgtatagaaaggtgtaacacttgttccatagttagtctgcatatagacgtagatttcttctacctgtacaggttctgacaggaatgacgctattgactgtgcgtctgagttgatgaaatccattatcagtttatatgtagaagatgaacttatatctcctactgaaccagatatggtatcaagtcttttattgagagaatcaagtaatgtttttgtgctttctagagttgtattaatatttactgatatatcacttactccaaggagcatctgtgatattccgttaatactgtctccggcactgcttatattagctgcaaggctgcttacggcattcttaatggaagccttaagaaggttaacattagttcttattacagtctgcataattgtctggctcttctggagctctgtgcggcactgttcaacaacagacttgattaactggtattttgcctgaagtgtttcaggtgaatcagtaagaatatcggcacactgctgaacaaggttgtatgcgatattctccatagcgttaacagaagctagagctgactttagggcggtgataactgccgggtcaatgccatctactttgctgagggaatcaatagcatcttcaagagccttattctggtctataagttcctttaactgtttgttggctttactaagctcaacgccagcctgtccgatatcagttattgaaagctgtacagctttatcaagagaatcaagtgcgctgtcagttaattcattcatagctttaagctgcgcatcaatctggtttgcaatatcatctgtgacattatcaagagatttattggcaatatcagcaacatcagttgttccggtaagaacatctttaatctgtggaagaacctcctgaagttttgcaagattatctgccaggtctgaattactcttaataaacatgtcaatcatggtatcgtaagaattaatattggcagatacactctgtaaatccttaactgtcttttcaataattgaaggatcattttcagctatttcgttaagtccctgcataatagtcttaacacacacatcaatgaattcggaattgatagtgttctgaagagtgctttttcctgtatctgtaatcttggaagcaacagcatttttcttggaattctcataatatgtaactgttggtggattaagaccattgtcaaggaagtcatacaggcttcgtgaaaagtcctcaccaacaacgataacggcatagtacttcccggcattcagtttattcatggcttcatctttagtttccggaaaacgccagcctaatttatcattcgaatgaagctgttcaacaatctgttctcccatattgatagtggaatcatcagattcagagtagccttcatcttcagaaacaatagcaatctggacagacgcagtgtttgcgtaaggatcccagttggaatatatgttaaaccatgcgtaaagcgatggaataaggcacagaccaagcgcaatggctaaagccagaatattcctgctaagacctttcaaatcttttttgaaaatcttaaatatcataacattcctcaattctttaattatcgtttaaaacttatatgtattttacttaagaaactggggaaaatcaatacagagaggataaatcagacatatttaataaattaagaaaggatacggatttatgaacatattgtattgtggtgataaaccaatgcagaaggggattcttttatcttcaatgtctcttattaaaaatgtggatgaaccgttaaatatatatattctcacggttgattacagggaaaaaggtattaattacaagccagttgataaagcatttgcaaaatatctgaaagaaaaattgaataaatcggacattaaagtaaatatctttcttgttgatgttacaagatattttgttgaggagctgccggaggcaaatatgcagagtagatttactgcgtgctgtatgttgcgcctttttgctgataagacagatattaaggatagagttctttatctggatactgatgtgttgtgcagaaaagatttcagggatttttattatcagaatatggatggcatagagattgcgggagtttctgattattatggcagatggcttttcggtgatggttacattaattccggagtaatgcttatgaatatgaggatgataagacagaacgggcttctggaaaaatgtcgtgaacagtgcataagaaaggaaatgtttatgcctgaccagacggctgttaatacatttgcaacaagagttaatctgtgcggacgaaagtttaatgaccagaggaggctgcatgacaacactgtttttcagcattttacaactaccttccgggtgtttccggtgataaggactgtttcagtcaagccgtgggagattgataaaatgcataatatacttgggcttcatgaatatgatgagcttctggattcttataacagggagcatgaagagtacatggcagtttcacgtattcctgtgtttttctcgattaatgaacagtacgcaccatatctggcagtgtgccttaaatcgctggctgtacatgtggcttgtgatgagcgttaccgcataatcgttatgtgcgataatgtgaagaatattacgatgattcagcttcgtaatgtgataaaggattatgaaaacatagatattgaattcgttgatataagaaagaaaatgtacgaatattctgaaagctttggacagacagttactgacagacaggaaaacaggctttattcaggcgagtttacactgacgatatatttcaggttatttattgcagagctttttccagagcttaataaagctgtgtatattgactctgataccgtaataaatgatgacattgcaaagctttattcagttgatatgggagatgcaatgtttggtgcagtaagagatacatttgcaggaaagaatacaatactggctcattacattgaaaatgtagtgggaatagagcggaatgaatatgtcaattcaggagtgcttcttatgaaccttgataagataagacaggctcatctggcagacagattcttaaagcttatggctgaatatcactttgacagtgttgcacctgaccaggattatattaatgctatgtgtgcaaaagaaatatattttcttgataaggaatggaatgttatgcctaacaagggcggggagtatatagcaagaccgaagctgatacattataacctgtttgacaagccgtggcattacagcgagattccgtatgaggagtatttctggcagtatgcggcggagtcgggattttatccgttgctgattaaacagcgcaagcagtatggggataatgaaaggaaagctgaccgtgagaatttaaagaaattgctttcaagggctgagaatattgcggacggtgatggggttaagttttctgatgttgtgggaagcagaattgttgtggatagtggtttcgtgaaggatagcagtgatgctgcaaaataaattatgtcggaggagatatgattggtgatagggagcaggtctatgaaaatattaggacggctgtaagccttaatcagttgaattcaaaggttgagccgggagaccctaagctgttacgcgaagataaagaagcattactaagacattatattgattaccgcacagcatatggtttttgtgtgaagaaatatattgcagaagctatatttcatgccgggacttctgcggtggggcttataacacaagttgacggacttgagaatctttctggaatcagaggtcctgcgattgtaacatgcaatcatttcagcccgttagaccctgcaattgtcaggtttgcaatgagaaaagctggattcagaagaataagtattgttaatcaagattctaaccttgcaatgaaaggttttgtcgggtatatgcaaaaatatgccgacacaatgcccgtaagcagcctgaaatggtttatggagactgagtttcctaatcagattaagaatgcacttgatgaaaacaaacttgtgcttatatatcctgagcaggaaatgtggtttaattatcggaagccccgtccatgcaaaagaggtgcatatctgtatgcggtaaagtttaatgtgccggtgatttcactgtttgttgaacagcaggttaaaagtacacatttgcacacattcagggtacatgtcctgccagtaatatatccggacagacagcttgatgaaagaacagcaagtttaagaatgcagcacacagactatgatcagaaatgtgctgcatatgtcatggcatatggaaagaagctgacttacgattttgaagagggcgatattgtaggaagataaaagcatttgacgcggaaagaattgaagtgtatatatatttgaagaaattacaaagattgagaggaaaatgtatatgaaggtacattcagtggcagtacttggagcaggagcagtcggctcttatgttatatggggactttcagaaaagaaggatataagtttaagcgttattgcaaagggcgaaagagcggaaagacttaaggcagaaggctgtctgattaatggaaagacataccacccggaggtattgaccccagaggaagcaaaaggtgttgaccttcttgttgtatcattaaaatacggcgcacttgcaggtgcattagatgatattagggaagccgtcggtgagaatacaattgtcatgagccttatgaatggtgttgacagtgaagagataatatctaccaagatagataaatcacatattatttattcacttataaaggtggcgtcacaccgcgaaggtaaggaatatgtgttcaatcctgagactacaataggcattatatatggagaggaaactgcaccatttgagagtgagagagttgcggcaataagagatttattttatggaacaggacttaattacagagtgactgaatatatcaaagaagagatatggagcaagtatagacttaatatctgtaacaatcttccacaggctattattggagcaggtgttggctgttatactgacagtgagcatatgaaagcaatcagcaaaggattacgtaaggaggttgaagcagtagctcttgccaaaggcattgatatgagcaggtgtgcagataactcaagccgaggaagcgctgttccgccaacagcaagatattcaacactgcaagatattgacgctggcagacacacagagatagatatgttctctggcgcaatgatgcgcatggggaaagaacttggaattgatacaccatataatgaatatacatatcacatcatcaaggcacttgaagagaagaatgatggcatgtttgattatgatgagaatagtgaggctgtgacttattctaagtagtggcagacggatttagcaggcatgtggggtacaagacagaaaatataagatattaatcatggcgcagcctttttaagggctgcgcttattgcttctataaagacggaatatgtatatctgttggctgaatcataggttatgttggttgtgccggcttccatgactttagcagcaacttcatcaaatgaagttgtgagcttagggtacatagttgtgattgattcagaaagattaacaagctcaatgctgttaatgttagaggaatcaactgtgacctggatatcaacggggttgccgtctaacagaatagaggcggtatatactccggggcagaatttaggagcgtcggcattatcaaggggtgtctcaatattagaagaagcagaagcatttacagtgctgctcttaggtttagtagtattcctggaattatcagaactattgctgccaagacggataacagcgaatataataaaagctattataatagcagcgataaccgctccaataaggagctttttaaatggaataacaacaattttagtctgactcatcacaaagaaacctgcccttcatattcattattacaaaatatatggtatggagtgggagattatgattaaaatgtggtatattaaatacaaatgtattggatagtgtaaaatggcacattaaattaatgcatagcttgaaaaacctactaaattgttaaatatgatgaaatggtaggtttatgaagaggtgaatgattatgaacagtaaatttatcaaaacatttgcagtaatagtgattatagcggcaggcatgacagcatgtggacaaaagaaaaatgttacaacagatgatgtatcaggaaaagagatggcgaacatacaggagactgcagcacaggaagtgacagcacaggaaattataacacaggagattacaaccgaaaaagaaccggaagatgacgaatatgttcttgtaaataaatacataccggatatatatgtcgaattgatgtatgcgacagacaataactttacaggtgtcagaatatatgatttcacagacgcataccttcgatacggaacagttaagaagcttgcaaatgtgcagaaagaactgaaagaacaggggtacagcttaaagatttgggatgcatacagaccgtttgaggcacagcagaaattgtgggaagtatatccggaccctaattatgtggcaaatccggctaacggaatgaaaaagcataatcttggaggaacagtggatattacaatggttgctgctgatggaagtgttatatcaatgccgacagaatttgatgatttttctttgaaagcagatagagattattctgatatagaagatgaagaggctgtgaaaaatgtgatgattctacagaatgctatggaaaataacggatttacaggctatcagggagaatggtgggactattcagatacggtggaatatgaagcggttgatttcgaaccatgatgagacatgatatgaaaaagtgcattatggtaaagtaaatgatggtaaagtctattatagaaagattaggggagtaacacatgtcattacaattaattctgggaagctcaggtgcgggtaaatcgcactatctgtatacgcatataattgaagagtcaatgaagaatcctgacaggaattatatagttgttgtgccggagcagtacactatggcaattcagaaaagactggtgtccatgcatccaagaaaaggaattcttaatatagatgttgtgagttttgaaagacttgcatataaagtatttgaggaagttggtgaggacaatcttgaagtccttgacgatacaggaaagaatctgattattaaaagagttttagagcagaacaaggacagattaaaatattttggaagtaatctgtctaatacaggatttgtgtcagagatgaagtctgttatatcggaaatgcttcagtatgatatcaagccagatgttatgcaggatgcggcaggtgcagcatacagtgattcagagggaagtgcagcacttcagtataagcttgatgatatagtacttgtatataacgcatttgcagagtacatagacaagaattatataactaaagaagaaatactggataaattatgcagcaaggttacagagtcagagaaaataaagaattgcgagatagtatttgacggattcacaggctttactccggttcagtacaatttaatgacaattcttttatcaatgtgtccgaagatatatgtttctctgacaattgatgcatctgagcgtgaaaattcagtaagaggcagggaagaactttttttcatgagtaaggactgcgtatcaaagctttataagatatgcgatgaagaacatgtgaaagtccttgaacctgtgtatattgcaggaaaagcagtaccgggaaagaatgtaattgtaaatgtaaactcaagatttaagaattcagaagaactggatttcctggaacagaatcttttcagaaacaattcgggaagatttaaccagaagactgataacatagttatatatgagggagctgttgccaaggaagaattaacatttgcagcaggagaaataataagacttacaagactgtgtggatacagatataacgagattgcgatagttactgcggacatggatggctacggcaaactggcggctaatatattaaagcagaacgatataccatatttcttagattacaagcgccatgtgacggacaatccatttattgcggcaattaacggtgcacttggaataatagagaataattacagctatgacagcatattaggattcctaagaaccggaatgagcggaatggagcgcgaagatattgatctgttagacaattactgtgttgcagttggaatcagaggcaggggaaaatggcatgaaccatggataagaaagttcaggggaacagtcaataatactgaccttgagaagcttaattcactaagaacaatgataacggatatgttggatccattggaagaagtgcttaagtcaaaggattctaatgttgcagatatggtaaaggctctttacgaattccttgtgcgtgaagatatggagcagaaggtaagtgtgcttaatgacagcgagtacactggtgatgaatatgcgcagttatataagaaagttatagaagtattagataaaatgtatgcccttcttggaagcgagaaggttggtattaaagaatttaacaagatacttgcgtcaggatttcaggagattaagataggacttattccgcagaccaacgactgcgttgttatcggagatatagaaagaacccgtcttgacaatatcaaggtcatgttctttgtcggaatcaatgacggcaatgtacctaagaaggctgattcaagaagcgttctgtcagaaagcgacagggagtatcttgaggataagggaatagttatgtcagcttccgtgagggagaaagcatttacacagagattctatctgtatcttattatgacaaagagtgcggagaagctttacatgtcatatgcggtaaaaaacagcgagggtgcggcgctgatgccttcatatattataagaagcatgagaaaaatgttttcacattgccttaagttatcttacaaagacacggcacagcagaattcatatgtgacaataccgcgggcggctaacagctttgataatattgaaattgctgcaaatgtagatgaggatattattgattcacttactggcggcaggcttgtcggaagcgtcacatcttttgagaactttgcagagtgtccattgagatattacttaaggtatggagttgatttgaaggaaagggaagaattcacattttcaccggtaaacttcggcgtcgtactgcatgcggttatccgtgaggtgtgcgacgaaatcaagaaaaacggtgagtcgtactatctgatatcagaggagaagcgccgcgagatggtaaaaagaagtgtcgctgcaattactgacatataccagaacagtatccttaaggattcaagccgtaattcattcatgattaagcggatggaagaccttgcagaccgtactatatgggcgatgggtaagcagttaaaatgtggtgatttcgtgccatttgtattcgagcataagttcaatatggaagtcggggacggagacagaaagcagcttatgagtggaacaattgaccgtgttgacatatgcgaaaacggcacagatgtatatgtaagaattatcgattacaagacaggaaagaaggatttcaacatagtaaagacttactacggaattgatatccagcttatggtctacatggaagcggcaatgaagcttgtggcgaagatgcgtccgggtaaaaatgtgattcctgccggagtgttctactataacataagtgacccgattgtatctgcgacaacagagagtgcagaagagatagaggataagattaagggtgaactgcgtcttaaaggaatggttaattcggataaggatattgccgagaagatggacaataccgagggtacatcacttaatattccagttagcagaaaggctgacggcggatttgactcacgaagaagcaaggtgatgaatacagagcagtttaatatgcttggaagattcgttgatgtaagggcggttgataccgcggatagaattgcaggtggtgatatcaggagaagtccttataaagacggacagttttcaagctgtgacagatgtccttatggggcagtgtgtggattttcagtggatttgccgggctgcaattacagaaaattaaagaaatttgatgatgaagtgttatggaataatataaaggaaggggttgatgagaatggaaagaaaatggacaccggcgcagaagagcgcgattgatacaagagactgtaatgtgctggtttcggcggctgccggttcaggaaagactgctgttctggtagagcgaatcatttccatgattacagaccctgacaagaatatagatatagacaggctggttgttgttacatttacaaaggcggcagcagcccagatgaaagacaagataagaaaagcacttgattcaatgcttgacgagaatccgggggatgtgaaccttttaagacagataacactgcttaacaacgcacagataacaactatagacagtttctgtctatggataatcagaaatcattttccagaggttaatctggacccggggttcaggataatggacgagggtgagaagaagcttattgaaaatgatgtgttagaagatgtacttgaggaattctatgccgaagcagatgaagaattctttaatcttgttgatgcatttggcatgggacgggacgattcagggcttgtgagcattatagataaaatataccgtttttcaagaagcaatccgtggattgatgagtggtttgacgagtgcatgttagtttatgatgatgagacttacgataatcctgcaattaaggagctgtatgattcaattaaaaatgcacttcttgattaccgtgataaatataatagattagtagatatctgttctgagccggcaggacctgcagcatatacaggtgctttgcagtctgacctgcttggaattaatgagatgattaattcacaggattttggagagcttggcagaaggataagaatattttcatttgaagctctgtcaagaaagaaggatgcaggagcagacccggatattaaggaatatgttaaggggcagcgaaagttgtttaaagattacataggacggcttaatgataagatattcttgaaagatgatgagggaatatttgcagacatgcagggggcaggcatccagattcggactttacttaaagtggcaaaggtgtatgcaaagcgtgtttcagaggtgaagcgagagaagggcataattgattttaatgacatggaacatcttgcactttcaatacttgtaaagaaagaagatggaaagtttgtatacacagagactgccgacaagcttgcgaacagatttgaagagatactgatagacgagtatcaggattccaatcagctgcaggaggttattcttaatgcggtgtcgaagacgagactgacaggtgagaataacaatatatacatggttggtgatgtaaagcagagcatatacaagttccgtcttgcctgcccggagcttttcatagagaagtacgatacatacggcgagactggcgataatgttagaattgaattacagaagaatttccgaagccgggaaaatgtacttgagtgtgccaatgatgtgttcagtcatatcatgaataagaatttttcaggaatcgggtatgacgaatctgtaaggcttaatgctgggtttccatatcctgaatacagtgacagtaattatggtgatgaagccaacaagagtacagatgtaattcttatatcttcagagaatgaagaagaagctacgacaagagagcttgaggcagacaggcttgcaaaactgattgaggaaatagttgcttctggtgtaaatgtgtatgattcagatgagaatatatacagaccggcagaatacagggatattgtaattcttacaaggtcagttacaggctgggcagatacatttgcagatgccctgatggacagggggataccggcgtatacagattcgtcaacaggatatttcagcgtgcgtgagatacaggtaatcttaagcatgcttacaatagtagataatccggttcaggagataagccttgcggcggcaatgatgtcttattttggaggatttacggcagcagagcttggaatggtgagaaagcttggcagggagcatgcagataagaatacacataacaacctgtatgaacatttgaaagcagttgcagtgcttggcggagcagataagatacaggagacggatgttaagcagctgtccggcaaatgtgcattattccttgcaaagctcacagaataccgagacaagagcagtgttgagtcactatatgatctgtgctgggagatgatatatgattcaggctactacgattatgtgggaacaatgcctgccggagtacagagacaggctaacttaaatgtcttgctggaaagagcagcgggatatggaaagtcaagttattcaggtctgtttaatttcttaagatatattgaaagacttaagaagtttgacgaagattttgcagagggggctgccagccttgacaatgagaatcttgtaagaattatgagtatccataagagtaaaggtctggaatttccgattgtaatacttgctggggcgcataagagcattaactttatggacgcaactgcgcctgtgcttgtagaccagaacttaggaattgcagttgattatgttgaccttgaaagaagaacgaagacacctactattattaaaggtgctatggcaagaagaattgtaagggagtcgatagctgaggaagagagacttctctatgttgcaatgacaagagcaagagaaaaactcataattaccggagttgtaaaagatgcagacaagacacttgataaatacaggggaagtgcaaagcaacttgcagcagatggaatgttgtctttcgcggacagtgagaatataaagaactatcttgatatgataatgccagtgtgtcttatggattcagataaattgaaaggcagctttaaagtgatggttgatgccggagaggattcttgggctgatgtggatgaatccggggagatggctggtgaagcgaatgctgttagaatcgggggactggctgatgaaattatggaagctgtgtcttatcctttattagaggagcttccggagtatgttcctgatgataacgcagccggaaggatgaagctgacggtttcgcagcttaaggctatgcaggcggatgatgattcagaggaaaatgcttacatggatgaatctgtgaagacagcacttaaaaaggaagaatgtgatgagacaaacagcataattccaaagttcataagcggtgaggaagttaagcttgctgctaatgagcgtggtagcgcatatcacagggttatggaatgtcttgactattcagtgagtgtgaaccttgatggagttaaagcagatattaacagaatgttagaaacaggcaagatgaatgaattacaggtgaaaagtgtcaatccgtgggatatatatacatttgtacaatcagatacaggcaggagagttgcaaatgcggtgaactgtggcagtgtcagaagagaacagccttttgtatttgagtacgaaggacagcttatacagggtataattgacttgtgttttgaagaggacggagaacttgtgattgttgattataagactgacagggttatgaagggcaaagcgggggaaaaagagcttgtcaaaagatacgcaatccagcttgattactatgcaaaagcgctggaacagcttaccggaaaaactgtaaaagaaaaaattgtatattcatttactttaggaaaagaaataatgtgttaaaattacgaaaaattttctctaacatgtaaaatgcggttgaaaatattgtacaataatggtaatataaacataatttatgaataaaacatatcaaatttgcacaaaaatgtgcataaaatggaaaaggagaggaaaaatgaaaaagcaagtaaaaaaatttatgagtgcattacttgcatgtgtaatggtggcagtgtcagttatagtatttgacatgaatccagtacatgcagcttctggcgcaataacagaagcatcaggctggcttgagacagcatatgttaagtggacacctgtaacaggagctacaggttacaatgtatatgttaagtctgcaagtgcctcagattcagcttatgtccagttggacgatgagcttatcagaaagtatccatcttacatgagagcggatgctgtaggattaaaagcaggcgattatgttatgaagattgttccgctgaacaatggcaaggagaatacatcagctgctatcgtttcagataagcttactgtaaatgcacatgacagaagcggatttacattttcaagtaattcaccggtaaagaatggcgttggtgcatataacaacgatggtacattaaagtctaatgcatctgttctttatgttacagaagctaataagaatacagttaagatgaagattggtaacacagaatatacaggtgtagcagctattacacaggcaattaaggctaagaataactgccagccagttgctatccgtattataggtcaggttacattaagcggacttgcctgcaaagatgtatcatcagcatatgcaattggtgttaagggagcagctaacgtaacatttgagggtattggtgatgatgctactttatatgaagcaggtgtggctgtattccagtcaacaggcatagaagtaagaaaccttggtcttatgaactggggcggtggaggcgacggagatggtatatctcttaagcagtcacgtggtgtatgggtacataacaacgatgtgttctatggtaatgctggttcagatggtgaccaggctaagggcgatggctctatggatttaaaggataattctcagtatgtgacagtatcttacaatcatttctgggattcaggaaagatgtcactttgtggcatgaagtcagagtcaggtgagaactggattacatatcaccataactggtttgaccattctgattcaagacatcctcgtatcagaacaatgtcagttcatgtatataataactactatgatggtaattctaaatatggtgtaggcgctgcaaaggatagtgaggcattcgtagaggctaactatttcagaaactgtaattatccaatgctcagttcaatgcagggaagtgatgttctggcaggtggaatattctcaggagagaatggtggtgtcatcaaggcatacaacaactatatggaaggtcagaagtctgttatatatgctaattcggatgctggtacaacaactgcaagtgcaactgatttcgatgcatatcttgcaacatcaagaagtgaaacagtaccttcaacttataaggcaaagcagggtggaaagacatattctaattttgatactaaggttgatttaggtgttgatactgctgatattgatgcacctgcagatgttccttcaattgtaactaagtatgcaggacgtattatgggcggagatttcaagtggacatttgataacagcgttgatgatacaagccattcacttaacaagcctttaaaggataagcttaatgcatacaagacatctcttgtatcagtaggtggtggaagcgtatcatcaggagaaaagcatatacataattatgtaagtactataacaaagaaagctacatgtgctgaagaaggagaaattacttacacatgtacagctactaatggaacttgcgataagaagacatacacagaagtagttccaaagacagctcatacatatggtgaatggaaagtagttaaagaagcaacagagacagaagaagggcttaagagtcattcttgtacagtatgcggggctgaagaaacagcatctattccaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttaagagtcattcttgtacagtatgcggggctgaagaaacagcatctattccaaagaagggttcaacaggtggaacagagacaccagaagtaccaacaggagattctaaggtacataattttacaacatcagatgcaaatagttcattctttgtgatttctggtaatcttgcatcaaacaagggaacagtaacgtataatggacttacacttacacagtgccttaagatggagtcatcaacaagcattaagttcacagcgccatttgctggaaagcttacacttgtatttggagaaagtggtaagaatgtaaagattaacggaaaaaagaacgcatcagattctaattgcatagtaacagttgatgttgcagctggaagtgtagagataacaaagggagatacaatgaaccttttctatatgatatatacaccatctggaacatcagagacaacacatacacataagtatgagtcaaagataacaaagcaggcaacatgtacagaggcaggagtgcttacatatacatgtacatctacaacaggtacatgtgacaagaagacatacacagaaacaatcccagcaaagggacacagcttcagtacagagtggacagtagatgttgaagcaacagagacaacaccaggaagcaagagccaccattgtacagtatgtgatgcgaagacagatgtaacagagatacctgcaacaggaatagtagagaagccgttaacaattactgcatcaaagacagaagcagataagacggtaacatttacagcaaaagctgcaggtggaaaagaaggatatacatataagtttatagtatataacaagacaacaggaacatggggagttgtacagaactacagcagtaagaatacatgcacatggacaaagggaagtgctggagacagatacttctatgtagatgtaaaggatgctacaggtaatgtggtaagaagcgaggctcttaatgttaagattgatgcagagacaccaaaggtaacacttacgggaagttctacatcaatagatgcaggagcaaaacttacacttacagcacatacaacacttggaagcggatgcacatacaagttcataatctttaacccagcaactaaccagtggtttaagttacaggatttcagttcaagcaatacattcacatggacagctggaagtgatggaacaagacagttttatgtagatgttaaagatgctgatggcaatgtaacaagaagcaaggttcttaatgttactattggaagcggaagtgctgatagacttacagttaatgcaacagtaagtgataatacaacaaatgtcggagaaaagattacatttacagcgcatggcattggaggaaaagcaggttacacatacaagatggttgtatacaacaagacaactaagacatggggacttgtacagaacttcagtagcaataatgctataacatgggttgcaggatcagcaggagacagagaattttatatcgatgttaaggatgctgacggcaatgttgcaagaagtgctgttatgaatgttataacaaaataataaaaacataataatggtagaaaggcacatagataggattatctgtgtgtctttttcgtacatatatatgaattttttgtgaataaaccttgaataatttgtgcaaaaatggtaatatgagtctagattttgaattttgattattcataattcacaattgtatgcatatttggaaaaaggagaggaaaatgtcatgcaaaaaataagaaaagtgtttgctaaggttgttgcaggattgttaatcgtaagtaatcttgcaatagcagcaccaagtatgacttatgcagcatctgcaacaagttttactacttatggtggatggaatgaaatgatgtatgcaactatcaaaggtgttaaggatgccgatgttactgcagtatcatattcaggtccagttagtggttctcttacaggagaggactttgagtatcttgtcagagatacagctgacggagcaagagttgatgtaatggggttaaagccaggtacatatactcttaaggttactactaagacaggtacatatacacagtcaggaattgaggttaatgcacaggatagatcgggatatgcgcattacaattatactgatggtgtaggtgcttataatgatgatggtacattaaaggataacgcaattgttctttatgtaacagatgaaaacaagaatacagttacactttcttatggtggagtaacagtttcaggcattggtaatattcttaactcagtcggtaaggcatgtggtgaagcaggtcatgagacagagtgtaagaaggtatcgaaaggaaagacatattacggcaagggtaatactaatcagggtattctccagttacttgctgagaataatataccattagtaattcgtatggtcggagcagtatcagagtctggtctttataagacaggaacatgggcagcagctaatgcaggacttattgatggccttacagattatgattctaatgattatggcggaagtgttggcgacaacggtcatatggcacgtatgaagtcagcaaaggatgtaacaattgaaggtgttggtacagatgcagctatggatggatggggaattcattttatgtctgagacatcaacaacagcagctggattaggaaagaactttgaggttcgtaatcttacatttatgaatcagccagaagatgctattggtatggaaggtgttcaggaaggctctgttataacagctccagttgaaagatgctggatccacaacaatgagttttacagcccttctataacaggacctgcagaatcagataaggctgaaggtgatggatcatgtgatttcaagcgtggtgaatatttaacagtttcatataactactttgaaggatgtcataagactaaccttgttggttcatcagatacatcgttacagtataatcttacatatcatcataatatctggaagggatgtaaagcaagacagcctcttggacgccaggctaatatgcatttctacaataaccagtttataggaacaacagattatgccatgaatacaagagccaatgcatacatatattcagagtacaatttgttttttatgacaaagaatcctatggatgtaagatcaggagcaattaaaagctataatgattcattttcgtcttgtattggagcaatgacaggaacggttgttacagataagtcaactaaggttacatctggcaacaaatatgagaattttgatactaatgcatcactttcatatattccaagtggtgattatcagttacagacaagtgttacagatgcagccaaggttcttaaggtatacaatggctgcatgccagagacagttaagaaaacagagaatgttactgcttcagagtgttcattgttatcatattgtgcacctggtgtaacaccaattaatatatctgattatccatatacagcagagccaggaaagcttagcaagactgtatatgcattcacggtaggtggaacagtagatgttactgtatcatttgcatcagaagatttaactacaacaggttgtcttgttaatgagactggtgagtgcttccaggtaggaagtggtactgttacaggtcttccggctggaacgtatatggttatgccatataatgttcagtcaggtggtaatggagttaatccggcagcaggtacatttaaggatatgactattaattcaattacaattaatgcggctgatcctaatgcacattatcatcattatgtatcagaggtaactaagcaggctacatgtgcagaagaaggcgttattacatatacatgtacagcaactaatggaacttgtgataagaagacatacacagaggtgattccaaagacagctcatacatatggcgaatggaaagtagttaaagaagcaacagagacggaagaaggacttaagagtcattcttgtacagtatgcggggctgaagaaacagcatctattccaaagaagggttcaacaggtggaacagagacaccagaagtaccaacaggagattctaaggtacataattttacaacatcagatgcaaatagttcattctttgtgatttctggtaatcttgcatcaaacaagggaacagtaacgtataatggacttacacttacacagtgccttaagatggagtcatcaacaagcattaagttcacagcgccatctgctggaaaacttacacttgtatttggagaaagtggtaagaatgtaaagattaacggaaaaaagaacgcatcagattctaattgcatagtaacagttgatgttgcagctggaagtgtagagataacaaagggagatacaatgaatcttttctatatgatatatacaccatctggaacatcagagacaacacatacacataagtatgagtcaaagataacaaagcaggcaacatgtacagaggcaggagtgcttacatatacatgtacatctacaacaggtacatgtgacaagaagacatacacagaaacaatcccagcaaagggacacagcttcagtacagagtggacagtagatgttgaagcaacagagacaacaccaggaagcaagagccaccattgtacagtatgtgatgcgaagacagatgtaacagtaattcctgcaacaggaacagtagagaagccgttaacaattactgcatcaaagacagaagcagataagacagtgacatttacagcagaagctgcaggtggaaaagaaggatatacatataagtttatagtatataacaagacaacaggaacatggggacttgtacagaactacagcagtaagaatatatgcacatggacaaagggaagtgctggagacagatacttctatgtagatgtaaaggatgctgcaggtaatgtggtaagaagcgaggctcttaatgttaagattgaagcaactgcaccaaaggtaacacttacaggaagctcagagactgttaatgcaggagcaaaacttacacttacagcacagacaacacttggaagcggatgcacatataagttcataatctttaatccagcaactaaccagtggtttaagttacaggatttcagctcaagcaatacatttacatggacagctggaagtgatggaacaagattattctatgttgatgttaaggatgctgatggtaatgtaacaagaagcaaagctcttaatgttactattggtaacggaagtgctaactggctttcagttaaggcaacagtaagctctaatacatctaagactggagacaaaattacatttacagcagaaggtgttggaggaaaagcaggatacacatataagatggttgtatacaacaagacaacaaagatatggggacttgtacagaacttcagtagcaataatacaataacatggatagcaggaacaacaggagacagagaattctatattgatgttaaggatgctgatggcaatgttgcaagaagtgctgttatgaatgttacaactactaaataatagttcaactctataacatttaatcattattgaatgcacgggcgtttcatttgatacgctcgtgtatttttttactaatttgttaaaatgatttttgaaaaatatattgaatattgataataaatcaaaatgcatatataatataagattgacagataataaatatataatgagagggatgaattatggcaaagataagtgttataacacctgtctataaagtagagaattacttgagaaaatgtgtagacagtatacttaatcagacatttaaggattttgagttaataatagttgatgatggttcaccagattcatgtggaagtatagcagatgaatatgctcagaaagatgaaagagtaagcgttatacataaacaaaacggtggtgcgccaagtgcaagaaacagggggattgatatagcaaagggagaatggctgtattttccggattcagatgactggcttgagccggattatcttgaagcattatacaatactgctataaaaacagatgctaagctggttgtgtctggttatacaatggagtattttgaaaacggtgtagcacacagctacagtgtatcaacacctgagaagaattataattcacaggagttagtaagaggtaatctgcacaattattttgataatatgatgatggctgtaccttggaataagttatataaggcagattatatattagacaataatttaagatttccagagttaaagtgggatgatttacattttaatatggaagttattatggatattgataaggttgctatatgtagtaatgccggatatcatttctttcgttcaagaccaggctcagaaactactacagtttttgacagcatgctgtataagaagagaaaagaacagtttgagcatattatgagagtgtaccgccactggaatattaaaaacagagagattctcagtgttatatatggatattatgcttcaagacttgtacattgtgtgcaggagatatcaataagtaataacagcaaagcagacaagaagagaatgatttcagatatattgaacgacaagcttagttatacagctattaagaaaggcagaattgaatctaaggtattgtcaatagctgctacaccaatgagaatgcgcaatgtgccattatgtatatttatgggtaaagcgattggattcgtaaagattaatatgtcatctttattttataagataaaatcaaagtgtgttaataaggcaaaagttataaattaattaaacgagatggagaaaatttgatgattaaatccacaattagaaagataatggacgatgttcagactatttcatataaacaattagaaaataggcttgaaaaatatagtgagatatcatttgatatatttgatactcttataaaaagagatgtacctaagccaacagatgttttcagactcatgggaaaatgcatgagagacgatagtttctatgaaaacagagtcggagcagaaagaattgcaagacaggctttaggcgaggtatcacttgaagatatatatactattatgtattcgaataatgaagataataagcagaagctcatgttgaatgagatagagtatgagaatagtctgtgtacagttaataaagacatgattgatatatataatagaattgtaaaagataaaagagtatttcttatatctgatatgtaccttagcagagaagttatacagtcaattcttgataataatggaataaagggatatgaggcattaatagtatccaatgagataggaaaaacaaaatcaagtggtgaattgtatgaatacgtgaagtcagaatacggctgtaagaacatgtgccatgtcggaaataattttatggcagattatgttgcggcaaagaaatcaggactttcatcttgtaaaattaaaactaatacatacagacttgaaagaaaatttgatattgaatcggataaggatgcatatttaagtgcatttttaagtaatcaccattcatatgatgaggattatttctataattttggatatgaaagattcggtccggtattatacggctttattaaatggatgtatgaggatcttgtaaaagaaggaatacaggaagtatattttatggcaagagatggtttcataatgcgtaaagtatacagagaattaggatatgataaaaagatttctgacagatattttgaggcatcacgacgaagcttaagagttccttcatatcacaataacaacagcatagagtacgttattaatgaatcaccgctgttgtcaacgacgaatatggaacagcttctggatagtcttggactagaggcttctgattatgaaaatgtaatcaaggaatacggatttactttgagaggacatatcaggagagatgaattaaaggataatcccgattttgttaagttatatcaaagaattaaatcagatgtgattaataattccagtatggaatttgagaatcttattaattaccttaaacagtgtgatttcagtaagaaaattgctgttgttgatataggctggggtggttctatgcagaagaacttgatacagacactcaataataatggaatatctaacaatataacaggttattatcttggtttatctaagaaatcaagagaaaatctcggcaagaacggatataaagcaaagggatatctgtttgactgtcttaataacagtaacgataaagatattgagattgcattcagaccattatttgaaacattatttttagaacagtcaggttccgtaaaatgttatgaaacaagagaagacggagtggttgctgcagtaagatatgagtatgaatatcttaaagatggtgaattgtcacacgaggcacagaatgtaattaatattcagaagggtgcagttaattttgcgaaagactttaaggatagtaaagtttcagattatataaacagtgacgttaaaacactgtttaaatatatgtatacaacaggtaccaatcctaatatgcaggatgtaaaaatgtttggagattttattttctttaacaatggcagtgagaattatcttgcaaggcctaagaaagtattatcttatgtacctaatcccaagaaatgtttaagagatttatcggaagcacagtggaaagttggatttttcaagcgtttaatgaaaataccatttccatatttaagattatatatgaagctgcatcgtatgaataataatgaagaggattgagcttggaagggacaattaaacaatgatatacattttaatgcttagtgtattagtgttattaattataaccatgcagttgtttaataaagatatgacagcaccggcatttttgattacagcagcatttacggtatctctattgtgttgctgcatatatgcggatgtatggggatttaatgattacagacttatactggtcatattggctggtttgataggatttaatatattcagttatattacatatatacttgataagaacggcagagagcctgcttcatacagatttgagcctgtagcggttaatggatataagttatgtatctatctgttttttcagtttgttttatatggattgtatataatcatgattatgaaaacgacaggaagtttttcattatcgggcatgtctgacgctattggagcctattataatgccggtaaaagcggaaaacaggtgtatagttctggtctggttaatattggtacgattatcaatatgccgggtatctattatgtaatatatatcgcagtaaataatataatatgcagaaagaagaataatatacttatatatattaatatatttgtgggaatgacaggtgcgcttctcagcggaacacggactacattttttatgtatattattgcaacggtgattatttatatagtacttaaacagagatataacggctggaaaaagaatattaatattgccagcgttattaaaggtgttttgtttattatggctgctataattgtatttaatatgctctttgcaattcagggaagaacattgtctgatataactgtagtagatcttatagcaaattatataggtgcaccagtcaagaaccttgaattgtttattaaggacggaagaattaaaggtaatgggtttggattaataacatttcgtgatacatattcatgggtaaatgaaatgcttggttcagaacatttcatcatacctaaagtatataagtatagatggattgatggtaagatacttggaaatgtatatacacagctcatgccgttatacaatgattttggtataccaggtgtatttatatctatgggacttttaggcatattctgccagaagatatacgacagtataaagtacaagaaaagcagaggaaatattgattacagactgctgatatattcatatgtcggatttgcaataatcttcagctttttctcaaataaattttttgaacttatatttgcaagagcaatgatatattatcttgtaggcatttttatatttgatatattcttctgtcatatttcaataagatatggaacatttgtattgaattttagaaaaaagagtaagggtggaaaataatattatgaatggactggtatcaattatagttcctgtatacaacagtgagcactggcttgacagatgtgtaaaaagtatattgggacagacatatcataatattcagataatacttatagatgatggttcacaagatggttcagccgctttatgcgatgaatatgcagcagaatatgaaaaggtaaatgttattcatcagcagaatcttggtgcaggaagtgcaagaaatgcaggactgcagtatgctgatggcgaatatatatgctttgtggattcagatgactggatagagccggtgcttgttgaaagattagtgagcggaattgctgacgcagatgtgtcaatatgcggatacagcatatcagatgactcagaaacagacagtgattctaaaggcacggtcagctgtgacaggcttgatgtattaaaaaggatgcttatgcccggttatccaccagaagaagcgtgttacggatatctgtggaataagttatttaagaagtcaataattgaaaagtacgatataacatttaataattcatatattatgtgggaggacatgctgttttgctgcagatatatggctcatattgagaatggaacatactgctgtgatagattgtatcattacaatatggataatgaaacgagcctgagtcataaagtgacagcagaggttatggattcgtggaatcttgcagcgaaagagatagaaaatattgtaacagatatgggggtaaaaaaagaaattcagtatgatgccgtgacagcagatttatatatgaagacattaattgcgtatgctaaagagaagaaaatccgtaatctgcaaaaagaaactgtacagtatcttggcagacagaaacatctgctgagaaagaaatatagaatatatttaatgatatataaaatatctccggtattattacagagtattagtaatttattaagtgtataaatgaggacatatatgattggaattataactttatattataacaattataatattggtgggcttcttcaggcctacgcattacaaaagacacttgaagataacggaattgagtcagaacagctgtcagtgtggcattataagaaagagactgtcagctttagcagaaaaataataagtaaagcaattcgcatgataaagaatccggctgcagagataaaggcaacaaaacataaccgggagatggaatggcgtaaaaatgtgatatcagctgatatagaaaagcgtcagaagcatatgagagctttcatgcaggagatacctcacagcagtcagatatatacaccggacaacataaaggaaagccttaaagactattcaggatatatagttggaagtgatcaggtatggaatgatgactatattgataagaataacatgatgataaatatgcttcagtttgtaccggaagactatcctaagatttcatatgcggcaagtattggaaagaacagcggttttaaggactggtttgttgaaatgcttggcgggcttaagcattttgattcggtatcagtaagagaaaagtcggcagcagacataataaaacaatatacaggaattgattcacaggttgtattagacccgacacttatgcttacagatgaggattggaaagcattagtacataaagaagataataaaagtgataaaaaatcatatatatttacatattttcttggacaagataaagcaaacagagagtttgcagaagaattaagcaaaaaaacatctatgaaaataattaattttgcacatgcaatcaattatttcagggatgaggataaagagtttgcggatgaagcagtaatggattattcgccaaaagattttatagattatattgcaggcgcatcatttgtaattacagactctttccatgcaacagtattttcgttaatattccataggcctttctatacactgacaaggcagagtgcagatggaattaagtcaatgaattccagagtagttgatttacttaatacatatggattgcctgacagattaatagatgcacaggagcagctatttgacggtaatgttaatgatattgattttagcacatttgataatatgattaatgagcagagaaagaaatcaatgacatttataaaagacagtcttttaaatcgtaagggtggaaataattaaaatgaaaatagacagaacgaaaaatgcgggccgtaacatagtgtttggctgcatgcttaagatatatcagatagttatgccgtttattatgcgtacacttatgatatattacatgggtatccagtatctgggacttaacagcttattcacatctattctacaggttcttaatctggctgaattaggtgttggaagtgctatggtgtacagcatgtacaagccaatagcagtagatgataagaaaatgatatgtgcattaatgaagctgtaccgcacatattacagagtaattggaataataatagcatttttaggattatgccttgtgccttttattccgaaattaataaaaagcgatgttccagcggatattaatatatatgttttgtacatattaaatttgtcggttacagtgctttcgtactggctgtttgcgtataagaactgcctgcttgatgcacatcagagaacagatgtggcaagcaaggttactcttgttaccaatacattacagtatatagtgcagttctttacattatgcattttaaagaattattatgcttatataattgtttcactggcagcgcaggcactgacaaatatacttacagcggttgtagcaacccacatgtatcctgattacagaccagagggaaatctttcaaaagaagttatatcaggtattaacagaagaataagggatttatttacctccaagttaggcgtggtaatagttaattcagctgataccatagtaatatcagcatttcttggattgacaatgcttgcaatatatcagaattatttctttataatgaattcaataataagcattgtgacaattatatttgcagcatgtaccgcgggaattggaaacagcataatcgttgaaactaaagaaaagaattttgcggatcttagaaaattcacacttataataacatggatagcaggattctgtgctatatgtctgctgtgtctgtatcagccgtttatggagatatgggttggaagtgagttgaagttaaactttttggcagtagtgtttttatgtatatattattttgtttatgaggtcaaccagttatttacaacatataaggatgctgcaggaatgtggcatgaagacagattcagaccgcttgttacggcattggcgaatctttttatgaatcttttgatggttcagttctggggtatatatggcgtaattatatcgacagtaatatctacgctttttataggcatgccgtggctcttacataatctctttacagtaatatttacgaaagaccagatgatacagtatgtaaagaaattgctattatatgttgctgttactgcagctgctgcagttgtaacatatggtttatgcagtctggttaatgcaggagcagtaatacagattattgtaaagggagttatatgtcttatagttcctaatatgatatatctggctgcttattatagaatgtatgaatttaagcagactgcagcacttgcagataaaatgcttaagggtaaggctacatttttaaagaaattaatgtaagaagaaagaatggggaaagatatgattaatataattgataaaaaggactgctgtggatgcagagcatgtgaggtgcagtgtcctgttaattgtattaagatgaaagcagataatgaaggcttctggtatcctgaaatcatgattcaggaatgtgtacgatgcggaatgtgtgaaaaagtctgtccgattcttaataagacttctaagacaggaaagacagagactcttggaatacttgctaaggatgataatatcaggaagaacagctcatcgggcggtgtattcagccttatagcccaacatgttttagagcagggcggtattgtatttggagcttcatttgacgagaatatgatggttcaccatattggtgtcgagagcagtgaaggacttgaaaagctcagaggcagcaaatatctgcagagtaatacagagaatacttacacagaagcacaggaagaattaaaaaaaggaaggctggtgctgtattcaggaacagcatgccagatagaggcattaaaaaatgttctgggcagagaatatgaaaatcttattacaatagacatactgtgccatggagttccaagcccgaagttatggaagaaatatcttgattatcaggagaaacaggctgggtcagcagtaagaaagataagcttcagagataagagcaagggctggcgtctgtttagcgtaaaactggaatttgataatggaaaagaatattgcaaagaccttaatgaagatatatttatgcagatgtttcttaagaatatatgtctgcgtccatcatgccatgactgcagatttaaaggtataaatagaaacagtgatattacaataggagatttctggggggttgaaaatgtacttccagagcttgatgatgacagaggaatatcagttgttcttacacattctgataaaggcagggaattgatacagaaaatagcgggtgaattgcagataaagcaggttgagactgataaagctcttccgccgtcggctgattcaagacgttctgtaccaatgcataaaaaaagaaaaatgttctttaataacatagatacttatgatataacaaagttagcagggtatgtaaaagaatccaatataacaatatttatacataaagttattcgcaaattaaaaagaatgatgaagataactgcataaatattaatggacaacagatgaggaggattaatatatgaaggtcaaaaaaatgaaacagatactgagcagaattgctatggtattaagcgttgtaactgttattgtttcatcgtcagtggtaatggcggatgctgaaattgtaaccagttcggactttgtatctacatcatattcgcatgattacagcagatgggcatcgtttatcaggtcatatcttgtgggctgtgatgatggacggttgatgagagtatacttaggaagcaaaggttattatgttgaatattatgattctaattttaatttgttagaaagcaaaacaattgataaggaactgagcttatcaggtggattctatgcaggaaaagatgcttattacattgtgtcaggacagaataacccagatgagttggcagatgttgaatgtttcaggataactaaatatgataagaactggaacagaatcacatcggcagggctgtatgattgtaacacatatgttccttttgaggcgggaagtcttagaatgacagaagcatcaggatatctgctcataaggacatcacatacaatgtataaaagtgataatggatatcatcatcaagctaatgttactattcagcttgatgagagcactatgaagattacggattcatttactaatgtaggtaatagttcatatggatatgtaagccattcatttaatcagttcattaagacagatggtaatcatattgtaactgtggatcatggagatgcatatcctagaagtctggcattaattaagtataagacagattttactggtggacagttctgctctaatataggatattggtgggatagtaataagcatgcagttgtaaataatagttgtgatgttacggatttacttacaatatcaggacagataggagataatacaacgaatgcaacaataggaggttttgagataagcgatacttcatatattgttgcagcaagttctattaatcaggaaaagcaggaaggcttaaaaaatatatatattcttacagaatctaaggaagacggaactgtaaagtctaatcagattacagatataagcggtaaatataatgctacatctccatatcttgtgaagataaacaataacaagttcatggttatgtggacaattaaaaatgataacacagtatattacacatatattgatggagatggtaatgttataagtgatatcaatacaatgagcggacagctttcagactgtgaaccaattgtttataatggaatggtgttatggtatatatgcagcaataagaagattactttctatggaattaatacagatggtacaacatttggagatgagcttaaggcttctatgacagcatctgatggtggcagcactattacattcacagctgatgcacagggcggaatgggaacacatacatacaagttccttgtatataacaagacaacagatacatgggcaaggattcagggctattcagagaataatacacttgtgtggacaaagggaacatctggagacagagatttctatgtcgatgttaaggacagcacaggaaaggttgtaagaagcaaggctgttaatattaagattgataagcctacagcagtacttaccccaagtgcgtcaacagttacagccggagataagctcacgcttacagcatcaactaataagagtggctgcacatataagttcttaatctacaatccatcgactaaccagtggtttaagctgcaggatttcggaagtaagaatacatacacatggacagccggaagtgccggagcaagacagttctatgttgatgttaaagattctgacggtaatgttacaagaagcaaggttgctaatgtgacaattaaaggaacgttatcagtaaaggcagcggtaagtgcaaatacatcaaagccgggagacaagataacatttacagcagaaggatcaggcggtaaggcaggctacacatataagatggttgtatataacaagacaactaaaacatggggacttgttcagaacttcaacgccaataacaagataacatggacagccggaagtgccggagacagagatttctatattgatgttaaggatgctgacggcaaggttgtcagaagttcagtgatgaatgttaagacaagtaactaattgaagcaaaaagtataaatatagcggggttacaggaagtcttgaggcgtagcctcattgggactgtcagtaactccgcttgttttctacttattattaagagccttttcagcttttaaataatctttctctgagtatttagtaagaatttgttctttggtaagtcctagttcaattattgtaataattgcagtctggcgttctttctgtttgcctttctgaatccattcattttccatctcttcaacgcatttccacatggcagtttcacctccattatctgattcattaaatatatctgataacttggaaaatccagttattgtggttatcagattgatgattttgctatcaataggtttgttagtgtattcttttgataaaccttgaagattctttgcatatatcttctgtgtaatgtcaaacacacatctgacatcttcattataaaattgataacgccctgaatcaagtatctgtacgagatttatcttgtaatcggagaaaaatggacgcagttcttccgggatatctgtcatcatatcagataagctaaccggaccatcccatggcgattctccataatagaagataagtgtgattattgggtggattttgtctgatttattaaagccagagaggaagcttttgctagagtcaaagtcattctccgacctgtgtagtctgcggaattcattgcattccttaagataaccgagtccgtcataaagcagagctcttacaggcatggcataatgaggattggtctggagttctaatccaagaatggtgaattcaataccattgtagaactttttgataatgtctcttgtcctgacaagagattcattgtaatcagtgaattggatgacgcctgaaacatcagtgtccatctcagtaagttcatcaggattgataacctgcctgccattgaaagctacagcattaaagaggtcggcaaaacgctcgttgttgcgccagaaggttttcatggcagtgtctggtttatcaatctttttaatagtgttcttttttctcataaatcgcctttctaagtattaaatgatgtgtcatatataatatattaaaaatattaatgcataaacataaatgtgtcaatagtatagatataaactaaattaaaagaatatcaaaatgctatatgaaaatataaatatacatgatataattaattaataattttgaggaaaggaaatatgttatatgaaaaggttgttaaaagggagtctggcgatagcttcggctgcagtaatatttgcaggaaatatgccatttacagcggttaatgtattagctgatagtaacgaaacggaagttattccatcaattgataatactgtttatacaggtacatggggaacatgtaattggacctatgataatggaatactaacaattagcggaggagttgcagagggctcgaaatcatgggacagttataagaacaatattgaaaagattgttataacaggaaagattacatttaacaaagaaacatcattgtatggattgtttagcaagatgacatctttaaagacaattgaagggcttagtaaccttgatacaagtaaagtaacagatatggattcaatgtttcgtgactgtagttctctagaaacattggatgtcagtggttttgatacaagcagagtaactgacatgagcggaatgttttatgagtgtaattcgttaacaacacttgatgtgtctcattttgataccagtaaggtaactcgtatgggttcaatgtttcatggttgtagttctttagaaacattggatgtcagtggttttgatacaagcagagtaactgacatggatggcatgttttatgaatgccgaaagcttcagattatagatgtatctaagtttgataccagtaaagtaaagagtatgggatttatgttttcatattgcgagggagtaaagactatagatgtaagcaattttaatacagaaaatgttacaataatgtgtaatatgtttcagtctgcgtcacagtgtgaagtgcttgatgtaaagaatttcaatacatctagagttacacgtatggatgggatgttttctggatgtaaatcaataacatctcttgatgtaagtaattttgatacatctaatgttactgatatgaacactatgtttcaaagcatacaatgtgaagaacttgatttaaagaactttgatacatcaaaggttacgaatatgaaatatatgtttggcaatgacactaaattgaaaaaagttgacgtaagcagctttgatacatcaaaagttattgatatgagatatatgtttggtaatacaaaatcattaaaagaactggatgtatctagctttaatactagtaatgtaacagatatgtctaacatgttttatttatgctacaaattatataatttagacattagtggttttgatatgagcaaagttaccaaaatgactgagatgtttaatggcgccagcctggtaactataaaggttccttctaagctttcagaggatagagatacatttttgaaagaaatgaaatcgggaatgagatccggaaaatggattgatgaaacagccaatattaattatgataacaaagcatcagtcgaattatcagaaggacattcatataagtttaatccgggaaaaatgtatgtcatgttaaatatgactaatacaactgaaggcaaggaactggcagcaagtgttaagggaggggcatatgattatacttacaagtttataatgtacaacccttctgctgataagtggacacttcttagtgactatagttcatcacgttcatatattcttaatatgaaaggaaacggcgaaagaaagatatatgtagatgtcaaggacgcactgggtaatgtagtaagaacgtcaaagacaataacacttacagggcaggagcctcttacagtcgaagcatctaagaatgaaacagacaagcaggtgacattcacagctaatgcaacaggcggttcatcagattatacatataagttcattgtctacaacaagacaacaggaacatggggcatagtacagaactacagtgataagaacacatgcacatggactaagggcagtgccggagacagagatttctatgttgatgtcaaggattcagatggcaatgttgtgcgaagcaaggcaatgaatgtaaagattgaaagcaataagccgacagcagtgctcacaccaagtgccacggtactttcaacgggagacaagcttacactcacagcttcaacagataaaacaggatgcacatataagttcttaatctataacccagcaactaaccagtggtttaagttacaggatttcagcagcaagaacacatgcacatggacagccggaagtaacggaacaagacagttttatgttgacgtaaaggatgccagtggcaatgtgacaagaagcaaggttgttaatgtaacaattggtggagaaggagcattgtcagtaaagacaacagtaagtgctaatacaacaaaggttggagataagataacattctcagcagaaggagccggaggaaaggcaggttatacatataagatggttgtatacaacaagacaaccaagacatggggacttgtgcagaactttaacgctaataacaagataacatggacagcaggaagcgccggagacagagatttctatattgatgtcaaggatgctgacggtaaggttgtcagaagttcagtgatgaatgtgaagacaagtaattaaataagaacaattgaataattggtgacgaaaagggcaggaactctaacgattgattttgaattgttagggcttctgctttttattgctttgctggcggaagcagcagaggagatactttttgagggcctttaaggctttttaagggtggggtaaaactttgattaattgatgaaagcctactaacttacaagctatgagtgatttcgtaggtgtttttttgaatgtgttttgctaatgaactgtcagaagcctactaatcaagaataaagtggaattatagtaggtctttttcacataaaacaggcaacgatttaatcaagaaaagagaaaaagcacgagaaagacctactagattaggaaatattaagaatatagtaggtcatcagactagtagattagtggcgacacatgggagaagacctacgaatttgataaattgatgcagtttcgtaggtcttttgcagagggaattatttttgcctaacatttctacattataagacctattgctgacacataatgacgacatatgcatgactttgttatatattagactaaattacttgattattagatgctatcgggtgtattattttagtgataattattttatgtttcttaaagaaacgggaaggggaatatgaaaaagaagattaaaagagcagttgcgactggaatgtcgttggcaatgggaacagttattatgacatcagacgtaatggtgtctcctgttatggcatctcagattaatggagagaagccttatgctgtagagttatatgcagcaagtaatgcatcatataatggattgtactactccactagtggttcatatgcaacaattactggatatgatggacagagtacagatattgttattccggagaagataggaagttatactgttaatacaattgagtatggggcatttaaggataataataagataacaagtgtcaagattccatcaacagtaacacagattggtaattcatacggttcgggagcgtttgagaattgtgctaatcttaagtccgttagtatagctgctggtgcagagacagcatatattggtaatgcagcatttaaagactgtacttctcttgaggagataacagtaccgggtaattatacaacaatatattcagatgcttttcgtggatgccgttcacttaagaaattcgtatacaatgataatggtatcagcagaaagatacagaacagagcattttatgagtgcacatcacttgtaagtttgtcgttaccaacatcattgaattctattggagatgaggcgttttcaggatgcagttcactgactgcggtagatattccagagggagttaaattaattgaatatggagtatttaataattgtaaattgctaaaaaaagttgtaataccttcaacaatacagagaattggaaatagttataatacaggagcttttcaaaactgtacatcattatcaacagtaacaataaaagagggaagtcaggcagctacaataggaagcaatacattttctggctgctcagcaattacttctattgtgattccaggcaattacagtaaagtaatggatagtgcttttaaagattgtaaaggactaaagacacttacatattcaccatcaataaatggaataacacataagattggaagttatgcttttgaaaactgccagtctcttgcacaggttacattgggaacaggtctggagagcattgatactaaggcattttataatgatagtatgataacagaagttaatataccggttggagtgaagagtattggacaggaagcattttctaattgcacaagattgtcaaagctgacacttccagaaggacttactgttattaaatcaggagcatttgcatcatgcaaatctctgaagtcagtagtaattccatctacagtaaccagagtgacagatagttatgttgcgggagcttttgagaactgcacaggtcttacatctgtaacatttaaagaaggaattgcagaagcagtaattgggcaggatagtttcaacggttgtcagtcacttttatctgttattattccgggtaattatggcaaaattggagatagtgcatttagaaactgtacatcgttaaaaagttttaaatatgctcaatcagtcaataatattgaacatacagtgggaagttcagcattttgggattgtaaatctttaacaagcataacacttgaaaaaggacttaagacaattgattcatatgctttctgcaatactaacgtcgataagcttgatgtaccagaaggtgtaacacagattgctgctgcgtcatttatggactgtaagaatcttgcatctgttaacattccttctacagtaagcagtattggaggagcatattatggcggagcattcgaaagttgtgctaaattaacagcagtcaatattgcaggtaacaagaatattgaagcttcgataggttatagtgcatttaaagactgtgttatgttaaagaatatagttatccctggcaattataacagtattggagagtatgcattttcgggttgttcaagtcttacaggctttgaatataagaagagctcatatgattttgctaatcagaatattggaagtcatgcattttaccagtgcataaaattaaatgatgtgaagcttccaactacattaggtactataggaagctatgccttttatggctgctctgtattgcaaaaggctgtgattccagatggcgtaaagacaataggcaataattcatttgaaggatgcaaggcactggaaactgttacagttccatcaacagtggaaagcatttccagagcatgctttgaaggctgtacaagattgaagaatgttataatagctaaaggtgatactgatgctaagataagttcttatgcatttcaggattgtacttcattaactgatatatctgtaccaggtaattatgttaatgtagacagttatgcgtttagcggatgtactaatctttcaaagttttcatgggaaaagggaatgtatggttataacaatcagtctctgagtggatatgtttttgataataataataatctttcagtggcatcactgccttcaactcttggaacaatagataagaattcattttataatgtcaaatcaacatttgtgattgaaggtgaaactggttcagaggcagagagttacgctaagacaaaaggaataacattcagaaaatattcacagccattatcaattaatgctgtaatatcaccatcaggcagtgccaaggatggagatgttattaatattcaggcaaatgcatctggtggttcattggattatctgtacaagcttgttgtttataatgaagatacgggtaaatggggcattgtcagagattatggggagacaagcggattcacatgggcatcctcaactggtaacagaaagttttatgttaaggttaaggacagtacaggcaaagaagtgttaagtccggctttgattagcattaacaaaaagcttgaagctaaggcatcatataagtatgtgaataataatattgagtttacagctttagctaattatggcagtggtaattaccagtacaaattcattgtttacaatgtagatacaggtaaatggggaattattcaggattacagcagcaagaatacatgtgtatggaatgcttctggagcatcagcaggtaacagaaagttttatgttgatataaaggattctaacggaaccgttgcaagaagcgcggcaatgaatgttagtacccagacaggtcttaatgtatcgcttaaatcatcagcagcacaggttaatccgggtgcttcagtaaagcttactgctaatgccacaggaggaaacggaagctatcagtacaagttcattgtttataatacagcgacaaagcagtggggtaaggttcaggattacagcagcagcaatacatgtacatggattgcaggagcagcaggaactagacagttctatgttgatgtaaaggatgcaagtggtaaggttgtaagaagtgctgttaatactgttaatgttggaaacggtatgagtgtcactgccacaattagtacaaatgctaataaggttggaggtaaggttacaataagcggtgcagcaacaggtggagcaggcagctatcagtacaagtttattgtatacaataagacaactaagacttgggggcttgttcagaacttcagcatgaacaacaagataacatggacagccggaagtgccggagacagagagttttatattgatgttaaggacgctgatggtaaggttgtaagaagttcagtaatgaatgttaagacaagcaaataaaatagtgttaaataaaagcggcaatcatgagtaatgcataggttgctgcttttttaattctaataaaaaatttacattggatttttcaccccattgcataatcccaaaacatgttatataatataatgacatatgagattatattgctacgaagagccaataggaggatatgatgacaagaacatacgctgttaagtataagagtaaatcaaagatgttaacaacacctgagcaggttgcccagactgaggaggatatcaaggcattagcacttgttaaggatgcagttattaaggaagacggacaggttgttactgttgaggttgagaatgaggaagatttcgaaccggttatggacagagtagtcaacattttcagaagaattgatgacaagtctgaggtttcatacaagttcggtcttaaccgtgaataattcgaagactattgattagagtaagcctgtgaagccgtagactgcgtcacaggcttatattatgtgtatgccgaaacgggtatgaattgtttatgtattatgtttataaaggagtaaaacagtgagtttagaaagtgaaattaagaaaagaaggacatttgccattatctctcacccggatgctggtaagacaacattaacagagaagttcctgctttatggaggagctattaaccttgcaggttctgtaaagggtaagaagactgccaagcatgcggtttctgactggatggagattgagaaggaaagaggtatttcggtaacttcttcagttcttcagtttaactacgaaggctactgtattaatatccttgatactccgggacatgaggatttctcagaggatacttatagaactcttatggcagcagattccgcggtcatggttattgacgcttctaagggtgttgagaaacagactatcaagctttttaaagtatgtgttatgagacacattcctatatttacatttatcaataagatggatagagaggctaatgacccatttgagcttcttgatgagattgagagcgtacttggaattgctacatgcccaattaactggcctatcggctgcggtaaggaattcaagggcgtatatgaccgtaaagagaaaaatgtttctttattcaaggcagccatgaatggtcagaaggaagttgatactgagattgttgacgcatcagatgaggctgttcttaaggacagaattggtgatgctttctatgacaagcttcaggaagatatcgaactgttagacggagcaagtgcagagtttgaccaggaaatggtaagtgctggtgaccttacaccggtattcttcggttcagcgcttactaactttggtgtacagactttccttgagcatttcttatcaatgacaacttctccgcttccaagaaagtctgaccagggagttattgatccatttactgaggatttctcagcatttgtattcaagattcaggctaacatgaataaagcacacagagatagaattgctttcatgagaatatgttcaggtaagtttgaagccggaatggaagctaaccatgtacagggtggcaagaagataagactcagccagcctcagcagatgatggcggaggagagacatattgttgatgaggcatatgcgggagatattatcggtgtatttgatccgggaatattctctatcggtgatactatctgcaaatctaacaagaaatttgcatttgagggtatccctacatttgcaccagaacattttgcaagagtaagacagattgatactatgaagagaaaacagttcattaagggtatcaaccagattgcacaggaaggtgcaattcagatattccaggagttcaatacaggaatggaagagattatcgtgggcgttgttggtgtccttcagtttgaagttctcgaataccgtcttaagaatgaatacggtgttgatatcagacttgagccgcttccatacgagcatatccgctggattgagaatcctgaggaaattgatgtgaacagaattgttggtacatcagatatgaagaagattaaagaccttaagggcaatccgcttctggtatttgccaatagctggtctgttaatatggtacttgagagaaatgagggcttaaagctttcagaatttggaagaaactagttaatactatacattcaggagtcaggtgattacatgaaatcaggatacaaatgtagtgcaaaaagaatagccgcaattggtgtcatgttatgtatgcttgtgctgacatgccttacggttacttctgtgcttaatactaaggcggaagagtccattggtcagggacatgttaattatgatgttacagatcttcgtataaggacatcaccagtcagtggttcagtcattaccaaggtggatggtggctttaagtttgatatatacgaagaggtcgacacaagttcaggattatggtatggaataggattctatcttaacggtgattattacagaggttacgttacttctgaatatgtaactgttgataagagaaatgattataagccggatgcagatttcgaggagtaccttgattcgcaggggttcccggatagttataaggatgggttaagacagcttcatgtgcagtatcctaactgggtgtttgtggcggaccataatggaaaagactggtctgatgttctggaaaaccagaatgtgattggccgaagccttacatatggttcagcaaagtcatcatggaaatcggttgctgatggctgctatgactgggaatcaggacagtatacacagcttgattcaggtggctgggttcaggcatcatctgcacttgttgaatatgcacttgaccctagaaacttccttaatgcagataatatatttatgtttgaaaatctttcatttgacagttcattacaggatgagagcggccttgagagtatggttgatggtacatttatggaaaattcaagccatgacctgacatatgatggaagaaattatacatatataaccggtctgctgcttgcaggacaggaatcaggggtaagcccatatcatcttgcttcaagaatattacaggagcagggtaacagtggatatggaagcagcatatcaggaacacagtctggctactactggggttattataattattacaatataggggcatatgctagtggaggattgacagcagtccagaatggacttaaatatgcttcttatccagattcatctacattaagaccttggaatacaagaatgaaatctattattggtggagcaatatatcttggaaaaagttatataaacagaggtcagaataccctttattatgaaaagtttgatatgactggaagaggtcatcagtatatgaccaatgtacttgctccaagaagtgaatcagttaagagcgcacaggggtatagcgacagtaataagaacaatatagcatttatattcagaatacctgtatatgagaatatgcctgaaaatgtatgtgaaattccaacaggagacggcagccctaataacagattatctgacttatatgttgatggttattcattgactccgacattcagcctgtataaaacagaatatagtcttattgttgattatgatacttcatctgtatatgttggaggttcaacacttgattcttcagcagatgtaagcggactgggatatcatgatctttcagttggaagtaatgatattacaattactgttacagcagctaatggcgatgatcaggactatactataactgttgtaagacaggataaagaacctgatccaacaccggaaccagatccagaaccggatgttgcttatccgggattttcaacaacattatctgttgatgaggatgaaaaatacataagtggtttaactgtatcaggttatgtccaagatgtgcttgataagattgataattataatggtgcttattctaagatacttaataagaatggcaatgagaaagatggattagttggtactggcgatatccttataacatataattcttctggcgaagaggtcagcagatatgagattgttatatatggggatgtcaatggcgacggagagattgatttgtttgattttgcacagataaagagatctatattaggtatagcagacccgtcaggagtatattggaaggcggccgactgtaacagagacggagaacttgatttgtttgattttgctatggttaagaggtatattcttggggtaggaagcatcaatcaataattacggtttgaaaggatgactatgaataagataaaaaaattacttgcttttataggtgtactggcaatgtgcattgcattgattcctgcgtattacgctaaggctgacgagcaggcttctatatctataagttcagcaagcggaacagttggaagtaagataacggtaacagttactatatctgcatctgatattatagatgttgcgttagttccagtatcatatgataagtcgattataaaaccagtaggtgctggtaatagcggagttgtatcatttgcacttcttgatgcatcggcatatggttcaacagaatctatatctatggaatttgaaattatcgctgcaggaacaacaacacttagcgttgcaggagatgcaaagatatctgttaatggagaacctgcaacagtcagcagttcctcatcaggaaaggtcactgcaaaagctccagccagctactcatcagacaacacattaaagtccctgcagataagtccgggaacgctttcaccagcattttcaccagacaggacaacatataatgcaactgttgatgctgatgtcacagagcttgttgtaagtgctgtagctaatgataatgctgctaaggtaagcataagtggcagaagaatggatccgggaagcaatacaacaacaattacagttacggcagaagatggttcagttaagaggtatataatatatacaacaaaacttgtggatggtcaggaagcaacaacagaggctgagtcaaagacagaagctgttacagaagatgcatcacaggcggttaataatgatggaactgtgacgatagatggcaggaagtattctgttgtaaaggaatattcaggaatcacaattccggatggatatcaggagattgactatgattataatggtcagaagataaatgcggttaaaggcataaagacaggtcttatccttatgtatcttgaaagtgaagatggaaaaggcgggttctacatctatgatgagactgcgaaaacattttcaccatacaatactgttgcagaacctgagataacatatgttgtgctgccaataactaactcgttagaaaaaccggcaggatatgcacttactaaatttaccatgaatggcaaagaggtgcaggtacttatggacgctgacagacagtactgcctgttctacggagtaagctcacttggcgagaagggctggttcagatacagggtaagtgatggaactatacaggcatattctgttgttaaatctgatactgctaatgctgatgttaaggctgataatggaaaaacatcaggaaacaacagattctggctgacgatagtattaatacttggactgataatagctgcatttatagtgattactattgttctttgtactaagcttgcgaaagttaagaaggtgtttaacatggcatcaaaggatggtgttgaccttgatgaatatacagagaaggtaattgatggatatgcagaggatgaagatgacagttatgaagaacttgatacatcatctgataagatatcctatggagacgataagtcaggtaagagtgatgttgaagagttgaagctctttgatgttgaggatgataaataataaaaaagccttagtgaaatcattgacggtttcactaaggtttttttattcttctggaagcgaccagttatcagcctgattgtaataatcgtcagacatttccttgtactgtgcgcacaggtatgcgtcatctgaagtcttttcaagttcttcatagcatttgccaagcaaagataaaggcttttttccgctgcttgccacatcaagtatgctttctgtctcaaatgcagcattatacagccacagcgcagcttcttcatagtctgtctggttcatgtaaaatgttcctagaatcagacacatttcagcaggaggattgtcggcaactgcttttaaagtggtcttaaagaatgcgtcagtgtcaccgtctgccatatatatcttagcaagaatacagttgatttctttcattaaatcattgcttctgccttcttttgatagaatattttcaaatatattcctgaaagcaataaagtcggaatcttcaccggatataagaagttctttacacagcatggtaactacataatcttcaatgtggatacctttttcaaatgctttgaaatatgttgaaaagtctcttttactatggtcgcccgcctgcatgtgaagaatttcaatgtcactgtcatatacgattggcgtgagccgtactgtttcatgtattggtgaaatccatgtgaatggacggagtcttttgaaaagcttcgggcggagttctttgtgtgcattgtatacagaattatattctgatgcattgacataatacatctgaacaatgtctatctctggaagaagcatatgtttcaattctcttaatgcgtagttgttggtatcatcaagcacttcgtctgcgtcagcactgaatatgtagtcacatccagctttggaaaatgcaaaatttcttgcggctgaaaaatcatttatccattcaaaatcatatattttatcggtgtagtgagcggcaatttctttagtattgtcagttgagcctgtgtctacaataatcaattcatcataagttcctgcgtatgaatcaagacaccttgcaagaatgtcctgctcattttttacaatcatgcacatgcttattgatatcatgtttttctcctgttcttaattggatttatataggttatatcggtaaatgccttgatttttttaggtattcgtaagatacttgttatcaatgataacatatatctgatacgaggtacacaatgtcaaaaaagaaatctgcagcagaaccagttgaatatatagacagtcaggcttttgacgcggcgaaagagaagataatcggcaagagccataatgacaaggggataggtactttgtcggaaaagacactgcatgcagtattaaaaatgtattatgaacccgatgaggataatcatgaggttgcaatagatggttattttgcagatatatataacgagcatgggataattgagattcagacgaggcagcttaacaagttaagggataagttgtcagtgttcctgaatgaatatcaggtgagggttgtatatccaatgccatatgagaagtatttaagctggattgagccggaaacaggggacattacttctagaagaaagtctccgaagcgatgttctgtgtatgatgcgatgtttgaactgtataagattaaagcatttttaaagaatcagaatcttaaggttacattgatgctgattgatatggaagaatataagcttcttaatggctggagttacgataagaagcgcggaagtgtgcgttatgaccgcattcctgttggaataagaaagatagttgaactggactgtccacaggattatatgcagtttgtaccagagggacttgagaagaactttacttcagcggattttgcaaatgcagcgcatattgacaggcagactgctgccagtgtacttgcaatgcttaattacatggaacaggttaaaagagtcggaaagacaggcaatgcctatatatatgatattgaagaacattattgaatggagatagtatgtactctgtaaatggaaactgctttcgaatatctgtaagaaatcttgtggaattcatgtgtgcagaaggtgatattgacaacaggaatacaggcagcaatgatgtgaaaatcatgcaggagggagcaaggattcacaggaaaatccagcacagcatgggaactatgtatcatgcagaagtgcctttaaagattgagataccgcttgtatctgacttagggattgagtatgtattacaggttgaaggcagggctgacggtattattgcagatattaattatgacgaggatggcaataaagagccggagaacgatgcaataattgatgagataaagactatgcagacagatgtttctctgctgaaagaaccggtctatgtgcataaagcccaggcactggtatatggttatatatatgcaagccagaagaagctgtcaaagattggaatccagatgacttacgttactcctgagcctgagacaatcaacaagtttctggaagaatatacatttgaaagaattgaagagtggtttaataagctgattacaggctttaagagatggactgattatacatttgatgagaggcataaaaggacggaatcaatcagagaacttaagtttccttatgaatacagggaggggcagaagaatctgtgcgtgagtgtatacagggctattgaagataataccaatctatatattcaggcacctacaggtgtcggaaagacgttgtctactgtgttcccggctgtgcaggcgttaggacagcagatgtcagacaagatattttacctgacgtcaaagacaataacgagaactgttgcggaggatacttatgctatattaagagataacgggcttcatatgagaactgttactcttacagcgaaggacaaaatatgtccacttgatgagcgcaactgcaaccccgtggcatgtccttatgccaaggggcattttgacaggattaatgatgctgtgtacgacataataacgagccagatgattatcggaagagataatgtcatggaatatgccaacagacataatgtctgcccgtttgagatgtcgcttgatgtttcgtactggtgtgatggaattatatgtgattataattatgtatttgacccggatgcgtcgcttaagaggtattttggcaatggtgcgaaaggtgattatgtgtttcttgtggatgaagcacataaccttgtggacagagcaagagaaatgtacagtgcagtgttgaaaaaagaagattttcttgcggctaagaagcttgtcaaagagatggacaaacggcttgcaggcgcacttgacagatgtaacaagcagttgctcgaatataaaagacagtgcgatacattcatggttgtgagtggtcttggaacatttccagccagccttgagcgtgtaatgggacttatgcagaagtttatggaaaggcataagggtgagcctgtgactaacgagctgctcgagtttttctttgcagtgagacattttcttaatatgtatgactgtgctgatgaaaaatatgtctattataatgaacatgataatgatggaaactttcttgtacatctgtactgcgttgacccgtctggcaacataagtgagagactttcacagggcagaagcacggtattcttctcagcaacgctgcttccggtcaattattttaaggaaatgctttcaggtgatgtatcagaaagagcggtgtatgcacactcttcttttgaacctgataataagagaattgtcgtggctactgatgtgacaagccgttatacaagaagaaacgcaagggaatatgccaaggtacatgattatattatgcatatgatttctggcagaagcggcagatatatggtgttttttccgtcatattcttacatggagagtgttcttgagtgcttcaggtggaaaagtggtgttaatgtgaccgaatgtggtggagaagatacatttttaccagaaagctgtgtgaatgtgcttgtgcagggaaggtttatgaaggaggctgacaaggaaaatttcttatcagcattttacaaggaacttccagaaggggcttcgcttgcgggcttctgtgtgcttggaggaatattttccgaaggaattgacttaaaggatgagagccttatcggagctgtcattgtcggaactgggattccgatggtgtgcagggagcgtaacattctaagggattattttgatgagtttggcaaaaatggatattcttatgcttatgttattccgggaatgaataaggtgcttcaggcagcaggaagggttataaggacggatacggataagggcgttattgcacttctggatgacagattcatgactggtgaatatgagcgtatgtatcctagggagtggaataggatatttccagtcagtctgggtaatgcttataaatgtattaaggatttctggacggaacaggatatgtagagcattgataaaaaatgtacaatgttagaacttgtagtcggactgtatgtgtgataaaatttagacagatattattaaggtccggatatatgatgatttggtttgattatgggagatgggcttatgcagaacgtggaagagattaataagaatatagaaagcaaaactgtagacaagcaggtctggcagtctctgggatttgatgaattacaggctattgagattatcagaggaattgagaatggcgttgatgtgagtgtgtattgcaaagaggaattcaatgctgcccagatgaaagcattaagacttggtctggaagaaaaacttgatgtaagcagatttgcagatgcacagtatgattatatgcagatggaagaactgaagcaggctgtgcgtagcggaatgaatatggatgatatatgtaatcctaagttcagtcattctgttatgagagagataaggcttgcatcagagcttaattatgatctgaccaggtatgcaaagcttggttattcaggagaggtattaagacagataagacttgcaagaaaagaagagattgaccttacattttttgttgaggataattatgatgaatatcagctcaatgagataaggctgggaatacacaattgtgtcgatataactaagtatctgcttcatgaatataatgggaaacagatggaacagattagacttggacttgaggaagggattgatgttactccatataacatggttggattttcatcaggacagatgaagcagataagacttggacttgaagaaggaatagatgtttctgaatatgcagatccgtttattgatgcggtaagcatgaaagaggcaagacacagaatttctgataaatggaatgatgagaagcctgcacttaatgaattgcagtcacaggaaattcttatgggacttacaagcggtgtggatgtttctttatatgctgatccaagatatacctttaaagagatggagaagataagacttgcacttgagaggggaagtaatctggatgggctgcttaagtatggatgttaagatgcagctattacagcacagtgttttgataatgaatggataagaccttcggaaagggggaacagcatgagcaatacagaaatagttaatgaaacagctgatatagatgatatcgagttacatgaggtttatgtatatattgcagatgataatatgagcgcatcagtcaggcttggcagatgcgaggatggttatacatatgatgaagtcatgaataagctatcgcttaatggaattaagacgggaatagatgaagaaaaaattcgatggatgattttacaaaaaatatatgaccagcctgttgaagttgcttttggtaaaccggtagaggcaggaaaagatggatattatgagtttttctttgatacagatgcaattaataataacagacctacagtaagagaagatggttctattgattactttaaccagaagagatttgaaaaggttaatgagggtgatttgctggcaagatatcatgagccgactaaaggggagtttggctttgatgtatgtggaaagctgctcgttcctaagcagggtaaaccaaagccaagactgcatggtaagggctttaagacatctgatgatggtaaagaaacttatgctgcaatatctggaaagattgaatactgtaactatgatttaagtgttgttaatgtatatgaggttaatggtaatctagatatgagcatggggaatattgactttaacggggatgttaatattacaggcagtgtgagaagtggtgtaacagtgcatgccatgggaagtatatatgttggaggcttcgttgagggagcaacacttattgctgggaaagatattgtattaaaggatggtgttaatactaagaattcaggaaaaatcgaggcagggggaaatatatcaggcagattttttgagaatacagaggttattgccaaaggagacttacagtgtaattatattcttaactgcagggtgcttacatatggcatgatatttgttgagggacccataggttctattataggtggtgatgtaactggagttatgggaatcagtactacatcatgtggacatgaaagcaatgtaaagactttgttgagagttggttcgaccaaagaaatcagaaaagaatatgcagaacttattatggaacttaaggaagtagacggacagattgaaacttttgaaatggctaataagaagtttgagatgattaaacagaacatgcctgaaaagtatgatagtaaaatggcattgagagttactcagtcaaagattgtaaagatggctcagaaagccaagcttgaagaaaagagcaaggcattatacaatcttataagagattcagagagagcagttgttaaagtaaagaatcatatatatccgggaagcaggatatatatggatgataagacttacatgccaagttctgtattttcacatattattgttaagaagacgccaagcacgattattcttagggattatgatgaataagtatattacagggagagtattatgatagaagaagttgtttcggtggaattgccggtgcatgaaaggctggtagtaagaaagaacagacttacgaatgaagaaaacggcattgatatgccaaggatttctatagttacaggcactcatggggatgaacttgacggacagtatatctgctatgaggttatcagaaggattgaaagagagaagaataagcttaaaggaattgtagatatttatccagatattaatcctcttggacttgatacaggttcaagaggaattcctatgtttgaccttgatatgaacagggttttccctggcgataacaatggtgctatggctgaatatgtggcagcaggtattattgaagatattattggaagcgatctgtgtattgatatccattcaagcaatatatttgtaaatgagatgccacaggtaagaattaatgatgatacgcaggaaaagcttcttccttatgcgaagatgatgaatgcacaatttgtgtggatatattcgtcaattactgtgcttgatgcaactcttgcctatagtcttaatcatcttggtgtgcctactcttgttacggagatgggtgttggaaacagaattacgccaaagtattgcagggatattgttgatggtatatttaaccttatgtctcatatggggatatgggatgatgagccgaaagaagtgaatgaacctattatctctacagagggtgaggttacatttcttactgctaaggaaagcggaatattcgtatcagcagttgattctatgggaaggattggaattggaacgcatataggagatattatcgaacctattgagggaagaataatccagagaattgaatcgcctacagatggaattatatttacattaagagagaatccggtagtacataagggggctcttatagcaagagtttatggtggcagataatgaagaaagagattatttattcgttaaagggtatatatagagaagattatcagatagaaggctacagattcggcggtggtgagaagtcggcatgtattgttggtgcattaagaggtaatgagatacagcagctgtatatatgttcgcagcttgtcaaggcacttaaagagcttgaggctcatggtgcaatatcgcacaatcatgagattcttgttatcccatctgttaacagattttccatgaatgttggaaagagattctggcctacagataattctgatataaacagagcttttcctggggatgttaatggagatacaacaaagcagatagcaggaacactttttgacagaattaagggttacagttatggcatacattttgcgagcttttatatgccgggtgattttattcctcatgtaaagatgatggatacaggatttcagagtgcgagtcttgccaatctgttcggacttcagtacgttgttattagaaagcctaagccaatggatacagtgacacttaattataactggcagatgaatggtactaatgcgttttcaatatatactaacagcacagatatgattgatgagaaatctgcaagacaagcagtgtcatctgttctcaggtttttaaccagaatgggtattcttaagtacaacaatcacagtggatatattgcaagtgttatcaatgagtttgatcttatggcagtcaagacttatgatgcaggattttacaagagacttaaagagccgggtgatcctgtatatcatggtgagcttatagcacagattcttgacccatgtgagggtactgttaagagtgagataatatcacagacagacggtattgttttcttcgcacatacaggaccaactgtaatgggtaatcaggttgtttacaagataataagaagaatgcatgaatagttgtttgaaaatatgttttattgtgatacaatggttaaatattaataattaatataactaatctcaggaggaagatatgagcggcgtaaagagagtttttgtcgagaaaaagaaaccatttgcagttaatgcgaaagaattacttgaggagataggaggatatcttggaataaagactattacagatgtaagagttcttatccgatatgatattgagaatctttcagaagaaacatataagaaagcacttactactgttttttctgagccaccggtagatgatgtttatgagggaacatttccagcgggaaaggacgatttcgtgttctctgtagagtatcttccaggacagttcgaccagagagctgattctgcagaacagtgtgttaagttctttaatgagaatgagacacctgttatcaagactgctgtaacttatgtattgacaggaactgttactgatgaggagaagaacaggattaaggaacactgcattaaccctgttgattcaagacaggcagcagaggatattccagaaactttagttactgagttcaagactcctgctgatgttatttattttgacggattcaaggatatgccagaggataagttaaaggaattatatgattctttaggacttgccatgacatttaaggattttaagttcattcaggagcattttgctagtgttgagaagcgtgatccttctatgactgaaatcagagtacttgatacatactggtcagatcattgccgtcacacaacatttgcaacagagcttacagatgttaagtttaaggacggattctataaagcccctatggaagctacatataacaagtatctttcagacagagcagaaatatataaggaccgtaaggacaagttcgtatgccttatggatctcgcacttatgggtgctaagaagttaaaggctgagggcaagttagctgatcaggaagaatctgatgagattaatgcctgctcaattgttgttccagttgagattgatggaaagacagaggaatggcttgttaactttaagaacgagacacataaccatccaacagagattgagccatttggtggcgcagcaacttgtcttggtggtgctataagagatccattgtcaggacgtacatatgtatatcaggcaatgagaattacaggtgcagcagatcctactgttccggtatcagagacaattcatggaaagcttccacagagaaagcttgttacaggtgctgctcacggatacagctcatatggtaaccagattggacttgctacaggatatgttaaggaaatctaccatcctgattatgttgccaagagaatggagattggtgcagttatagctgctgctccaagaagtgcagttaagagagagaattctgacccgggagatatcattattcttcttggtggaagaacaggacgagatggatgtggcggagctacaggttcatctaaggttcatacagagaagtctattgaggattgtggtgctgaggttcagaagggtaatgctcctacagagcgtaagatgcagagactcttcagaagaccagaggttactaagcttattaagaaatgtaatgattttggtgcaggcggtgtatccgttgcaattggtgagcttgcagcaggtcttaaggtagatcttgataaagttcctaagaagtatgaaggtcttgatggaacagagcttgctatatcagagtctcaggagagaatggctgttgttgttgatcctaaggatgtcaaggaattccttcagtatgctgctgaggagaacttagaggcagttgaggtagctgttgtaacagaagaaccaagacttgttcttaactggagaggcaaggatatcgttaatatttcaagagcattccttgatactaatggtgctcatcaggagactaaggttgtagttgatattccttcacaggaagacgattaccttaagccggttaaggttacagatgtacgcggtaagtggttaaagactttagcagaccttaacgaatgctcacagaagggacttgttgagagatttgatggttctatcggagccggttcagtatatatgccatatggtggtaagtatcagcttacagagacacagagcatggttgcaaagcttccagtgcttaagggttcatgcgatacagtaactatgatgtcttatggatttgatccatatctttcatcatggagcccatatcatggagcaatatatgctgttacagattctgtagctaagattgttgctgccggtggtgatttcagtaagatcagattcacatatcaggaatacttcagaagaatgacagaagatccagaaagatggagccagccatttgctgcacttcttggtgcatatgaagcacagatgggattcggacttccatcaatcggtggtaaggacagtatgtcaggaacatttgaacatattgatgttccaccaacactctgctcatttgctattgatgtagctaaggaaggagatattattactcctgaacttaagaatgatggtgatgtattagtcagatttgatattaagaagaatcagtatgatcttccagatttcgaacaggttaaggcactctacagtgcaatacatgagcttatccagaagaaggcaatcgtatctgcatatgttcttgatgctaacggacttgtgccagcactcagcaagatggcatttggtaataagttaggttttgagatcagcgcagacgttaaggaagatgacctctttgcaccagcttatggctgtatcgttgcagaagttccatcggacaagcttagtgagattactacagcttatactaaggttggtactgttaaggataatggtaagttcacatacaaggaagtttcaattaatgtagaagaagcattaagcgtatgggctgatacccttgagggtgtattcccaactaaggcttctaaggaaactacaccggttgaaagcaagttatatgaagcaccaagcgtacatgtatgcaagaataaggttgctaagccaacagtatttatcccggtattcccaggaactaactgtgagtacgatagtgccaaggcatttgaaagagctggtgctgatacaatcgttaaggtgttcaagaaccttgatgctgagagtatcagagagtctgttgatgaatttgagaaggctattaaccaggcacagattattatgttccctggtggattctcagcaggtgatgaaccagatggttctgccaagttcttcgcgacagcattccgtaatgccaagatgaaggaagcagttgagaagctacttaatgagagagatggtcttgcacttggtatctgtaatggattccaggcacttatcaagcttggtcttgtacctaatggtaagattacaggacaggatgcacagtcacctacacttacatttaatacaattaaccgtcatatatctaagatggtatatactaaggttgtcagcaatttaagtccatggcttgctaatgctgaacttggcggagtatactgcaatccagcttcacatggtgaaggaagatttgttgctcctaaggaatggcttgataagctctttgctaacggacaggttgctacacagtactgtgaccttgatggtaatgtatctatggatgaagagtggaatatcaatggttcatacatggctattgaaggtatcacaagcccagacggaagatgcttcggtaagatggcacattctgagagacgcggtgacagtgttgctattaatatatatggtgagcaggatattaagatattcgaatctggtgttaagtacttcaagtaatagtgcattttggtttaaataataattgtataatataaataaaagaccttgcagatgactgatttatctgcaaggttttttgtattctcagtaaatatattatactattaaatacgaaacaatattgatgatgaatatagttcatagtataattaaaggggataatgtatggggaaaacaaaaaataaactgaaagcagatgttgttgtaaaaaactattggcgtaataatgaacagtttgcggattttttcaatgcggttttatatgaggggaaacaggtaataaaacctgatgaacttgaagatatggatacggaagaatcttatgtatcagagaataaaaaatatgttgaaagtgtattggcttcaagagataatataaagatacgaaagaaatcaacaaaacatgatgtcgagttgtgcatacttggaatggaaagtcaggaacatattcattatgcaatgccgatgagagttatgggatatgattatggttcttataaaaaacaatatgacagtaatgctgttaaatataagatagcaaaaggattgtctgatgatgagtttatttctaaaatgaagagaacagataaatttataccgataataactatagttatatattatggggagaaggcatgggatggagcggtatcattacagggaatgttggatattcctgaagatatgaaagcatttatcaatgattataaaatgaatttggttgaagcaagaaaaaataatttgaaattacataatattaataataaggatttgttcaatctttttggaattcttttgaacagaaatggtaatttgaatgaaattaaagaaaaagcaataaattatgcagcagagcataaagtagaaaagaccgttataatgactgtgacaggtgcagttaattgcaagatagattataatatgcttgaaaaggaggctgatgctgatatgtgtacagtattcgaggaaacacgcaaagagggagaagctaaggcaattattgaattaggatttgaatttggattatctgaagaagaaattcttgacagacttcagaaaaaactcaatatatcattacagaaagcacaagaatatttttcaatgtttgctatgaaaaaagtgataaaagatgagaaatattaatttaattatagtaagacgtatgttataattaaaaatactatttaatatagtgctttatgaaattaaaggtaaaggggagatatttaaacaatggcaagagataaagtcagcacagatatattatggaaggacaggaagagaattctcttcctcggacttccatggtcatttacaagatatagtgtatctaaggacagattctttataagcaaaggatttttcagcgttaaagatgatgaggtaagactgtatcgtattatggatatttcattggagcgctcattcatgcagagacttgtcggagtaggaactattaaagtatgctctggagacaagacaatgggtgactttgagattaagaatatcaagaggcctaaggctactaaggagctgttatcagatcttgtggagaagcagagagatatcaagagagttgtcaacagagagaatatgattgacggtcatgaccattcagatggtcatgcggatattgatgactttgacaataatgatgacgatgcaccatttgacagataatttgtaaaaatgtattgacagctatatagaaagatgatattttaatagttagttaaggctaactgatataacgggtatccagttaggatatccgttattttataaatacgggttagacaaagctaacaaaagtaaggtgaatgaaaggacgagaatatgagcgtagttattattggtggaaatgaatgtatggaacgccagtatcagcagatatgtaagaaacacggctgcaaggcgaaggtatttgttaaggaaaaaagcggattttccaagcagattggaacaccggatcttatgatactgtttactaatacggtttctcataagatggttttatcagctgttacagaggctaagaagaatgatgtaaatatagtaagaacacattcaagcagtgcggcatcgcttacaagtgttttagaaacatatttaagcgaaagcagggcatgctgataaagaagagaataaagtgcaatatggaaggaaaagaaaaatggtctgtacagatgtattgggaagaattgagcgggaagttataaaagagtgttctccgacgcttgccggattaaagacgggcaacctttttaattacagatatgataatatatctgattttaggaaagagcttgcaagtgtaaacagaaaacttaacgccaaaggcgtgtatgttacatttttaaagcgaaatgaaaagagtgcacttttatatgtgttcagacctgacagattagagaaggatttgtcacagccagcagtacaaaatgtactgaaaacatttggatatacagattataaagttggagcaagcatcaagcatcttaaacagagagtgggggagaacacatgctttccacatgaaataggactgttcttaagttacccggtggaagatgtaatccagtttataagacaaaagggctgtaattacaaatgttgtggggtatggaaggtgtattgtgatgaggcatttagccagaagatgtttgcacgttacagaaaatgcacagaagtatatttaagagtctttgaccgaggcagaagcatatctgcattaacggtttaagcatataaaaagtaaaaaggagagattggataatgagtaaagtagcagtagtttattggagtggaacaggtaatacagagacaatggctaacgcagttgcagaaggtgctaaaggagccggagcagaggttgatgtacttgtggcaaatgattttaattcaggaaaggttgctgaatatgatggaatcgcattcggatgcccggcaatgggagcagagaatctcgaagaatcagagtttgagccaatgttcacagaggtagaaggaagccttagcggtaagaaaattgcacttttcggttcatatggatggggaagcggcgaatggatggctgactgggaagaaagaagcaaggctgcaggtgctgttcttgcaacagacagcgtaatctgtcaggaagcaccagatgatgatgctgttgaaaactgcaaaaaacttggggcagcgttagcataattatttattgcctgtaatatattgaaaagattgcacattttgcccctggttggttatatcaatcaggggttaaattgttctaaaaaatattataaaaatataacaaaagttgttgacatctaatgaccattagaatatactaaccaaggtggtaatgaaaaacattatcaatatgctaaaaagaggagatgagcttatgccattaactatgattgatgaaggaactccatacacaatccagcggattggtggaaaggaagaaataagacgttttcttgagaatcttggattcgttccgggagcagtagtaacagttgtttctaaagctggcggtaatgtcattgttaacattaaggaatcaagagtggccataggaaaagatatggctaataaaattatggtataaaggactgaatatgccagttcttatataaaactaaaataagaaggagataaactatgactttaagagatgtatctgtaggccagactgttaaagttaccaggttaaatggtgatggtccggttaagagaagaattatggatatgggaattactaagggagttgaagtctatgtaagaaaggtagcacctttgggagatcctgtagaggttacagtaagaggctatgaattatcgcttcgtaaagccgatgccgagatgatagaggtaggctgattttttttacatgcaggttagcataatctaattaatgtaagaattgtcaaatgtttgttagcaaatgcattagcatttatataaaagaaatgaggtagtcaaatgtcaattaaaattgcattagcaggtaatccaaactgcggtaaaacaacattgtttaatgctttgaccggttctaatcagttcgttggtaactggccaggtgttacagttgagaaaaaggaaggtaaattaaagggacataaagatgtaactatcatggatttaccaggtatttattcactttctccttatactcttgaggaggtagtagcaagaaattatcttattaacgaaagacctgatgcaatcatcaatatcgttgatggtactaacattgaaagaaacctttatctttcaacacagattatggaactggggattccagttattatggctgttaacatggtcgatatcatggaaaagaacggagataaggttgaccttgccaagttaggaaagaaccttggatgtgaagctgttgagatatcagctcttaagggaactggcatcaaggaagcagcagagaaggctgttaagcttgcagagagcaagaagctcaatacaattgctcacaagtttgatgataaggttgaggcagctatatctgcagtagaagataagcttggtcttgatattgttgaagaacagaagagattctttgctatcaagcttcttgagaaggatgataagattaaagttcttatgaagaatgttccagatgtttcaactgagattgagactcttgagaaagaatttgatgatgatacagaaagtattatcactaatgaaagatatacatatatatcttcaattatcagtggatgttttgcaaagaagtctgagaagaagctttctacatcagataagattgatagaatagttactaacagattcttagcacttccaatatttgcagttgtaatgttcatcgtatactatgtatcagttacaacagttggtacatgggcaacagactgggctaacgatggtgtgttcggtgatggctggcatctcttcggaattggcacttcagcttacgaagaagtagctgatgagtatggtgattcagatgcaatcatcggggcatatatcgacagccttggtgataaaggtgaagagtatgcagatgctattgatacagaagctgatgattatgattcagatgcagcagtagcagcattaaagaaacttgaaaacacagttccagctaatcttacattagattatgatgtagaagatgaggaaaatcttagtgtaacaacagagacaacagatgcagctggtgttaaggaagctattgaacaatgtatagacaatgatggtgcagctccagatcctgctaattatggtgtatgggttcctggtatcccagtgcttcttgagtcaggacttgatgcaattggttgtgtagactggttaaagggtcttatccttgatggtattgtagccggtgttggtgcagtacttggcttcgttccacagatgcttgtattattcatattccttgcattccttgagtcttgcggttatatggcacgtatagcattcattatggatagaattttccgtaagttcggtctttcaggtaagtcattcattccaatgcttatcggttcaggttgtggtgttcctggtatcatggcttcacgtacaattgagaacgacagagaccgtaagatgacaattatgacaacaacatttattccttgtggagctaagcttccattcatagcaatggttgccggagctatctttgatggtgctccatgggttgctccatcagcatactttcttggaatattctcaattatctgctcaggtatcatcttaaagaagacaaagttattcgttggagatccggcaccattcgttatggagcttccagcataccatcttccaacagttggtacagtattaagaagcatgtgggagcgtggatggtcattcatcaagaaggccggaacaatcatcacactttcaacaatcattatctggttcacaacatacttcggatttgttgatggaacatttacaatgcttgcagatgatcagattgacttctctattcttggcagaattggtaaggcaatcgcatggatatttgctcctttaggatttggtaactggcaggcaactgttgcttctattactggtcttgttgctaaggagaatatcgttggtacaatgggtatcctttactcagcaggtgagggaacagtatatgctaacatggcagctacatttacagtagtaagcggatatgcattccttgcatttaatcttctctgtgctccatgcttcgcagcaatgggtgctattaagagagagatgaacaacactaagtggttctggattgcaatcggataccagtgtggatatgcttaccttgtaggtcttgtaattaaccagattgctggtcttattactggcgacacagcatttaatgtattcacagtaatcgcaattcttataattgttggcttcatttatctgttattcagaccatataaggaaagtaagacattaaaggttgattctaagaaacttttaaatgcaacaaagtaattaaatgatatattatcggaggtgtaattatgctgggaacaattatagtaggagttatattagtgattatagttgcgcttattgtacgcagtatggtacacgacaagaaaaacggtaaatcgttcacatgtggtggcgactgcggtaaatgcaaaggccactgccattaaaaggaggtaacgggtggtcagaaatcctgataaagacaaagacattattatttctcgtctcaagcagcagggttgcaggataactaaacagaggcttatgcttcttgatgtaattcttgaagaggactgctcaagctgtaaagagatttattacaaggcagtaaaaaaggatcctaagattggggctgcaactgtatatagaatggttaatacactggaagaaataggtgcaattaaccgtaagaatatgtacaggataacttgtgatgagaatgataatggcggttatactgtaagattaaacgatgattcgtcaattaatttatcagaaagcaaatggagtaaaattattgagtcagggctagaagcctgcggatacattaagaatcagaagataacaagtgtagttgacaggaaaaaggcagtttcagttaataaataatatttactaataagggagagatgaaactgtttcatctctccttttgctatattgagaagatttctcaataagtggatttatgtagaaatgttacataatgtgtaatataataaccgtcaaacttaagaaacatttattgtccaatgtggacagagaggagcacagtatgaaaattgataacttaaagaaaccaggacttttcgcagcaggtgtattatttggaacagcaggaattaagattcttacaagcaaggacgcaaagaagctttacactaactgtacagcagcagttttaagagctaaatcatgtataatgaagacagctacaactgttcaggaaaactgtgaggatatatatgctgatgctaagacaatcaatgagacaaagtataacacagaagaagttgtacttgattcagtagatgaaaatgaggaagcgtaacagagtatgaaattcacaataaagcatgatgtgcccggaagaatccgtgttcacatggatgcttctggcatgacttttgcacaggcagataccttgcagtattatcttaagaatctgcagggcgttacgaatgccaaggtgtatgagagaactgctgatgcagtcgtcgagtacagatgttcaagaaaaaccgtgattgaagctattgctaagttcagatacagcaacatagaggttcctgaagatgttcttgcaacatcaggaagagcaatcaattctcattatactgaaaagctggcggatcaggtgttatggagaatgactaagaagctgtttattccagcaccggtatgtgcggtattaacaacagtatcttcaatgaagtacatttataaaggaatcaggacactgcttgacagaaagcttgaagtgccagttcttgatgcaactgcaataggagtttctatcttaagaagagactttaatacagctggttcagtaatgtttcttcttggtataggtgagataatagaggactggacacacaagaagtcggttgacgaccttgcaagaacgatgtcacttaacgttaataaggtctggttaaagacagatgatgcagaagtacaggtatctgtgaaagatgttaaggacggagataatgtaataatccggatgggtaatgtaatcccatttgatggaactgttatcagtggtgaggctatggttaatcaggcttcacttacaggagaatctgagcctgtaagaagaggtgagggaacttctgtatttgcaggaactgtagtagaagagggcgagatagtattcagggttaagcgtgccggaggctcaagcaaatatgacaagattgtcaggatgattgaagaatctgagaagttaaaatcaggtcttgagtcaaaagcagagcatcttgcagataagcttgtaccttattcacttggcggaactgcacttacatatttgttaacacgaaatactactaaggcattgtcaatacttatggttgatttctcatgtgcattgaagcttgctatgcctattacggtacttgcagcaataagacaggcaagtcaggcgagtgcaacagtcaagggcggtaagttcttagaggcaattgctgaagcggatactatcgtatttgataagacaggtacacttacaaaggccaagccaacagtaagcagggtatattcatttaacggaatgccggaagatgagctgttaagaatagctgcgtgtcttgaggaacattttccacattcaatggctaaggccgttgttaatgaagctggcagaagaaaccttatgcatgaagagatgcattctaaggttgaatatattgttgcacatggaatatcaacatttatcaatacaagcaaggttatcataggaagccatcactttgtatttgaggatgaggcatgtgtaattccagcgggaaagcaggagttatttgacagtcttccagatgactgctcacatctttatatggcaattaacggtcagcttgcagcagttatatgcataattgatccattaagagaagaagcaccggaggttattgaagggcttaagaaggctggaatatcaaaggttgtcatgatgaccggagacagtgaaagaacagccgcctctattgccagaaaggttggcgttactgaatattattcagaagttcttccagaagacaaggctaagttcgtagagaaagagcgggcagccggacgaaaggtaattatgattggtgatggaattaatgactcaccagcgctttcagcagcagatgtaggtattgccataagtgatggtgctgagattgcaagagagattgcagatatcactgtcggcgcagatgatcttaaccagatacttatgcttaagaaattaagtgacagtctgattaagaagattaacagaaattaccgtgtgattgtcggattcaattccgcacttattgcacttggtgtaacgggcgtcatacagcctacaacttcagcacttcttcataatacatcaacacttgttataagtcttgagagtatgaagaatctgccggtttaagactatgaaacggactcatcttcgggtgggttcgttttttatttgaaggcaaaaagttctgaatggataaatatatactatacccataaggcacaatataaattaataatcgcaggatattattttattacaacaaaatgaaattatgtaacaaaagaaaattgactaagccgtacggcttatattataatgcttttatcaaaacaaagccgctcggctttatttatgagagaatatgtataatagagccgtacggcttattttaatgctggagtgattatcatgaaaataactgattcagaagaactgggaaatataatcaggaacaggagaaaagaattaaagtatacgcaggcatttttgtcagaatatactggtcttagtgtaagttttatatcagatgtagaaagaggtaaaacaactgttgagattggcaaagtaatgcagttaatttcaattttgggacttgatattaatattaatgtaagggggagataatgagaaatttagaggtatatattgaatgtaatggaaatatgattaatgttggcagtattacagggcataattctgacgatgctgtattctaggacaccagatagttttattattaatcttaatgataaagaagatgattttttatttgcaactgaaagatatgacagaaagattttagatacatccaaagaattaatgggaagaaagttccattaagacttcatcaggaggattttgcacaggcacttggaattacagcgtcacaaaaatatgagaaaaacgggaaagattatttagcagatgcatttgaactaataaaaaattatatatgatttattaagtactgttatatatgacagcagcacagagaaaatgtcgcttaacatagatggcgaatatgatataaggaatataaatcagaagtcgtttgagaatgaggcaaagaaacttggtcttggaaaaggaatagcaacgcagcattttttaagtatggttgaaaaatttgagatggcacttgaacaatcaacatatgaacttgaggagcagggatatggagttgcagtcgatatacagaaacaaatattaaaaaaagcaggaattcacaactttaaattgactaatccgtaatttaattatatcataagtaactagggacactttgtttcactaaagtataatgggaggaagttatatgtattcatttgatgaagtattaaactatgatccagaccttgctaaggctatggatgatgaacttggaagacagagaagccacatcgagcttatcgcttctgagaaccttgtaagtaaggcagttatggctgctatgggaagccctcttactaataagtatgcagaaggatatcctggaaagagatattacggcggctgtgagtatgtcgatgttgttgagacacttgcaattgaaagagcaaagaagctttttggttgtgaatatgcaaatgtacagccacattcaggagcacaggctaacttagctgtattcttcgcacttgttaatcctggagatacagttatgggtatgagccttgactgtggtggacatttatcacacggttcaccagttaatatttctggaaaatactttaacatcgttccttatggtgttacagcagacggatttattgattatgatgaagtattaagaattgccaaggaatgcaagcctaagatgattattgcaggagcttctgcttatgcaagaacaatcgacttcaagaagttcagagaaatctgtgatgaagttggcgcattacttatggtagatatggcacatattgcaggtcttgtagccggtggtgcacacccaagcccaattccatatgcagatgttacaacaacaacaacacataagacactccgtggaccaagaggaggtatgattcttgcttcagcagaggcagcagagaagttcaagcttaacaaggctgtattccctggaatccagggcggacctcttatgcatgttattgctggtaaggcagtgtgcttaaaggaagcgcttgacccaagctttaaggtatatgctgaaaatgttgttaagaatgcatcagcacttgctaacggacttatgaacagaggttttgatatcgtatctggtggaacagataaccaccttatgcttgttaacctcttaagcaagggaaagactggtaaggaagttgagaagcttctggatgcagctaacattacatgtaacaagaatacaattcctaatgacccggcttctccattcgtaacaagcggtatcagacttggtacagcagccgttacaacaagaggcttcaatgaggctgatatggatgttgttgcagaagcaattgctatgcttgttgatgatgtagatgctaaccaggctaaggcaatggagcttgttaagggacttacagataagtacccactttatgaataaagattttttcttataattacattaataattaaagaaaaaatgcatatttttattattgcaatttcaggcacttggtactatagttagtgtcgaagtgcaaaggggcacgaaggtgaaagctttcgtgtccttttttgtattcaggaaactaagaaaggtgcgtggcgttatgggaaagttagaaggaaaagttgcagtaattaccggagcatccaaaggcatcggtgaaggaatcgccaaagtgtatgcaaagtatggcgcaaaatgtgtgcttgcagcaagaggacctaaggtacttgaacttgcagagcagttgaaaagcgaagggtatgaggcaacaggtgttcaggttgatgtatctgattacaagagtgttgaaagaattgttgaagttgctgagaaaacatatggaaagattgatgtacttgtatgtaacgcaggcgtatgtgttcttgaagactttcttgaagatgacacatttgaaaatagggacttacatcttgatattaatgtcaaaggtgcatggaatgtggcaaaagctgttattccaagcatgatagcaaatggtggtggtgcaatcgtagttacaagctctgtaacaggagatatggttgctgatcctggagaggttgcatatgcaacatctaaggcggcactggtaggatttacgaaggcacttgcaagagaatttgcagataagaatataagagttaatgcaatatgtccgggatatgtaaggacaccgcttgttgaaggaatggcaaagcagtcagacccggagaatccggagagagcaatacaggcaattgcagatgcagttcctttgaagaggctggctgaccctgaggaggttggagaacttgcagcattccttggatgttatgaatcaagctacataacaggaacacagatagttattgatggcggaagtacattgccggaaacaacatctatgggacagtaattaaatataagaaaagtacaaaggcgtacatgaatcggagagatttgtgtacgccttttctgattggaggataatgacatggcatttgaaaatgttgatttatttgatgcggttgcaaatgcttcgcttgaaaaatacggatggaaggacagatgtgaggcgaaactcatagtactgtcagagaatgcaacctatatggtcaagaacaaagaaacaggtgaaaaagagggagtgcttagaataagcagaccgggttaccacacattggacgagcttaattcagagatgaagtggttaagacagattaatgactacacaccgcttcttgtagctaatcctataaaagggcttgatggtaagaatatacaggagattacaggaccggatggaaatgtatatttctgcgttatatgtgattttcttccgggagaagcacctgatgagaataacgaggagcagatggtaaagcagttcagatatctcggtgagacaacggcttatcttcaccgtcagacagagatatggaacggaacagacaagcttgaccgtatggtatggacttacgacacgataataggtgaacatgctgcatggggtgactggagagcatttccagagatgaccccggaggcagaaaatatattgtcagaggtttcaagaattattaagagaagacttgaaagatatggaactaatgagaataattttggactcatacatgcagatttaagattagctaatctgcttattgagggcgaccagattaaggttattgattttgatgactgcggttttggatggcacttacatgaccttgcgtcagcacttagttttattgaggacaagccaattgttccaaagcttgtaaatgcatggcttgcaggatataagaaggttcttccgttcaatgatacggattttgaagaaatagacacatttataatgatgagaagattacagcttacagcatggcttgcatctcatcaggaatcaggtccggtagcagaattaagtgttggctggatggacggaaccatggaattagccgaaaggtatcttagattattcggctaggcacataagaaatcttcgtgacaacaaatcatgaacaacaataagggaggaagctattatgggcgaaaagaaaacaaatgcattatctaaatcaatgaagctgatttatgtatatgcgatggcaacgggagcaatatttacatttatgtgttactgggatggtatattcatgtcatatacaggtcccggaacgttcttggcatttgcacttatgacactggcagtactgccaacagcatttgtgtatgctgaattctcgacaatgttaccaagtacaggttcgtgtctggtattcaatacggtaggtattaacaagcatgcaggtttctggtcagcgtggcttatcatgtgtgcatggatagccgttcctgcagcaggtgtacttggaattattgaatggttaaatcatcagtttggtctgggacttacaggtggcaaggcagttattgtcggttcattagtactgtgcttctggtgtgtactcagtctttataaaaatgttgtagcaggcaaggttcagtcattcatgcttatggctggtatcgcaggtattcttatatgttcattacttttcctgttcagtggacactggagcattgctaatttcgcagatttctttacaagcagcaatgaaaagcagtggggtggtaactttgcaaccggtattgcatgggttgttggctgttcatttatgataacaccatatttcggattcgagacagtaccggcaatggttgaggagggcgacttcccaattaaggaccagaagaaagctattcttggttcagttataacatgtggtgctatatatacaattttctacttctgtcttgcaggtgcaatgccttgggcagagcttactaatggcggtgactgccacccattcatcacatttgaagcattacagtactgcttcggtgataagattgcatggtttgtccttataatgggtattgtcggagttgtattcccaattggtacatcagtacttggtttctggtattcaggtgtccgtatgatatacgctatgggtcgtcagaatttccttccaaagcagttctcatacactaataagtacaaccagccaacacttcctaacatacttattcttgttgtaagtatcggattcattgcaatgcagagtattacagcattctttgacctgatggcattcgcgtgtgcattgtgttatgtgattacttcaatatcttcactggtgcttttaaagaagcatcctgaatgggagagaccatacaaatgtgcaacaggacttaagatagcatctcttataatcatggcaattattgcattcttctgtactatcggtatcggaaaggcaacatggttaggatttgcaggatatatgggtgtaggtcttatcctatggctgtatatgattcttattaagtggaagcatgaaaaggtgtggatgaagacacctgatggtgataaggaatattaaaatgtgaagaaaagaggttatggattatgaaagaattagagatagttataaagcctgagaagctggagaatcttaaaaggattcttgacagtgagggtgctagaggtgtaatgattacaacaatatttggctacggtcaccagaagggtgcaggtcaggtatatacaagagatgaaactccgggtatcaatcttttacctaaattaagtgtaagaactgtagtaaaagacgagatagttgagggtataattaataaggtattggaagaacttaatactaacagttttggtgatggtaagatattcatcaaggatattgagggagtagtcaagataagaaccggtgaaaccggtaacgacgctctgtgataaagctttcttacttccctaatctttttgtagaggcagccgtcctgtttgatcaacagggcggctgcttatttttgagaagtggtggcatattgaattccatatatctgaatgaagattgtatgaaattatgaaaagtaaaatttggaagtgaaaatatcagtcataggtgatataatcaacgatagtttaaatgaaaaggaattagaaattatgagacatttttcgagaacagaattaaaggcagctattaatatgcttaaggagtttacttctaagggcaattttgcagttcttatgtatatgggtgacactgataagcttgaggtatcacagactcttaattcggatatgagctgctttttattatatggaagcatccagccactcgcatttttctttgcagaaaatattcctatgactgcgggtgagttagaagagattattaacaaacagtcagcagtgtatgaagaagagatggacaattacagaaatgcactaaaggaaagcggtgcagataatggactgtttattactaaatatgaaagtatgattcatacatttattgcatatgatcctgaccagagtggtgacagagactgttatgcaccatttattgagggtgcattcaatgttgaaccgggtaagggacagtttgttaatgaagttatgagacttgaagtgtatgatgatgaatatgaggatgactgtgtaatccagaagaagcattttgtatatcttccatcagtaaaattcatgggagcattcaatatgcgaatgatgatgagtatggttgatgcacagtataactaacattttacaattcttaaatttatataatatgtttgaatcccggactcctgtatagtatattagaagtaactttaaagagtggaggggttgtatgaacaaaggacattttaaagacagtcaggttgttaagggaattacgattggtgcagtgctaattgtaatatatcttgcccttaacaatgtgactggaattcttgattctatatcatatcttgcaggacttgtaatgccatttataattggcgcagtcatcgcatttgtattcaatgtacctatgaaagcaattgaaaaaggacttaacaggctgtttgacaagcgttgtaagaagaagcatcccagacttataagagtgcttgcttatatgctaacactgattttgatactggctattattgcaggagtactttttgtggttgtgcctgaactggtgaacacaatagctgaccttatagggcaggtgccaacagcagttaataatcttatcaactggctgcaggtcaagctgtctgcatatcctgagtatgaggaaaagttaagcagcatatcaatcaactgggattctgttctttcaaatgttatgaatttcctttcaataggaactaaaggtattattaatggcggaattggtgcaataagcggatttttctcaggagtcactaatttctttattggatttgtcttttctgtgtatgtgctgtttcagaaagagaggcttacagcacaatgcaagaagcttatgtatgtgtgcttgcctgagagcagggcagataaaatcattgaagtgttaagacttaccaacactacattctctaatttcctgtcaggacagtgccttgaagcatgtattcttggaacgatgtttgttattacattgtctatattgagaatgccttatgcgcttcttataggaattattattgcggttactgcacttattccgattgttggtgcatttatcggatgtatagtcggtgtgattcttataatgatgacaagcccgttaaaggcacttatatttgtgggagtattccttatattacagcagattgaaggaaatcttatatatcctcatgttgtcggaagttcagttggactgccgggaatatgggtgcttgttgctgttacaatcggtggcaatctgtttggtataatgggtatgcttacttttattccaatcagctcagtgtgttatgcgctgcttcggacatatgtgaataggaaagtggaagagaaggagattgataagggaaagtttaaggggtgatgccttccgggaatggaagtcaggcggctatgcagcttgttttcaaacacgcttgcgctcgttctacgacgcagcggtactaagctcgctgggattcgttggcgttaagccaactgtccaagcttactaagtgccggtgtcttcgcaacggtttgaaaacaagttgtatagtcgcctgacttcattctcacggaagacttttgtgcggtggattggcaggtggagtgtaatatgcggtggagctgtggtggcggattggacgctggagtggtgaagaggcatgtggaagtccaaattgagtgagaaagtgtggaggattggaccttacaagcaagagaatgcactagtcaacaaaaagtagacatcactttatatttttatacatcatttaatgagcataatactccctatactgttttgtataaataatgtctacaataattgggttggtgtctacttttagattaccacttcatcggtcattactaattcatcggcttaggctctcattattgtctgggcgcagttgcttaccatcggtgtttcatttcttaactgcattgctttatctatatgtctattcattgattgtcatccaattacattttagaatatttggtaagtatttcctcaatctgcatatttatgctttcaggaaatgttcctgaattatcatcagaaattcttatccaaaagtcaagattcttgtatttcacattgtgtcttgtgttgttcttatcctgtctggcggcaatctggactttcacctgtgctcttttttgttcaaggagtggaattattatgtaatagagcctgtcgtccctgaatgatatatagcctgcggcatttcccgatttggtctttaaatatagacggtgatttttaagtgactgtgggtatagagtcatacctgcccgcaaaaatggggcattggctagcatttcaagcattgagtctatataaaatatctgtgcattattctgctttactggtgtgataagttcattaagtgtgtaggttgcatctatatactgctgggctaaaaggtatgcaagctgtgcttttataactgccctgcttgtatccgatatgcttcctttccttctgttatctatacctgataacagcttatcactgctttctgatatactccttatgaataatgaaaaatcttcttctatcgtccagatatatttgccttttgctataacaaagcttccagtaatatttactcttgcaccttctgcataatgatatatattacggcttgtatacgcattatcattaacaggtgcatcccaattactgccatcggaagcatatgtattatagtcctgataatattcttcataatatgtgtactctgatgaataattatcatcgctggaattattgaaataaccggacattttattatcagataaattcttaataataattgaatatgcctcattaatctcctgcgcactatattgatatgtattcttccctgactttaatgaatcgggatgcacctttaacatcagttttctatattttttcttaatcgcttttatatcagcagactggggtactgctaatattttatatgcctgttctacactcatcttcgtagggttatcctgatatgttctttctattgattacatttattaactcattaaatcaaatttcttctgaataaaatccacaagatactcagctgtaccctcaacgcccagagagctgctgtctatcattatagtcttgtgcttagggtctgatggaagaaatcctgcatagtgcatatggtaattatctcttgcctcatctactgaccttatcatcttcttggcttcttcttcgcttaaatgcaaatcattgacacagttcttaactctctgttcatatggagcataaatgtatatatgcaccgcattttcttcatcagaaaggacaaaatctgaacaacgtccaactattatacagctttctctctcaactaagaatttcataatattctgctgggcttcaaatattctgtcctgctctgtgcttgactgtgttccaagaggatacatcattctcttatatgaattagttgatatcttcttaaccttttcttcaagttcatctatctgtgatactggaagattaagcttcttagctgcctgctccactatatccctgtcataatattcaactccaagcttgttactcataagcttggctattggacgtccaaggctgccaaactgccttgctattgtaacaacatatttcttatcactcataactgcctccattctgaaattattcttataattcctatatacattttataaaactaacacattttacataacaaatcctaatacaatgaaaccaattatacttattccagctcctataagtacatatggaagctgtgataccgcgtggtcaaagttatcaatacctgaaccctgtgaagcaagaactgttgtgtcacagtagaagcaggcgtgattaccaaatgcacaacctgaaagaattgctgccattataagtattgcattggctcctacacttgcaccaagtggaagaagaactggtgcaacaagtgtacatacgccccacgcattggctatcataaatgctaatataccagtaatgataaatgcaagcattgggaaaatctttgctgataatattggctgtgtaatatctatgaagaactccgtcatctgcatctggcttgcaattgtctggaatgtaagtgctgctataaggagaattataataggaagcatatctgcaaatccttttacgaaattatcccagtattctgtaaatgtcatcagcttttctgcaagatacataacaagtgttactgcaagacatataatctgtgctactacaaggttacctgtaacacaggctacaactacaagtacaagcattggaacaaggaaattgaatatgttgccgtcctgttcgcattcgccatcgtccatattgtacttcttacttgcatcactgtaaaccttacctgttgttgcaactctttcataagccttcttcattccgccaagcttaggaaatacacctgctgagaaaagaattacaataagtaatgcaactattggatatatacaaaatggaattgctttaatataagctcccatccaggtctttgcaccaagtgcctgaacactctcctgtgcgaagaagatagctccaaaatatgctgcccaggatgagaatgggaacataacacagactggtgaacctgtactatcaagaagatatgcaagtgcttctcttggtacttttactttatcatataccttcttcattgctgtacctattgataatacattaagataatcatcaataaatataattacacctaatataaatgttgtgaataaagtctttctttcgctgttacatatctttgaaacaatctttgcaaatccaaaatgtcccttagaggctgtaagaagtgctattatacttccaaacaaaccacatacaagtattaagtatgcttcatcactcataacaccttcaagtgtattaacccattcggttataaaatcctgcttatataaaaatattgctcctataattgaaccgcctataagaaatggctcacatttcttagtagctatagcacctatgacaataccgattacaattattactgctataagaccgtagctcataatcatttcctcctgttatataaatttttactaatacacaaaaagggacttccgctaatattaccattagcagaagcccctttgcttcttgtctatgttcaagaatatatcactaaaacatatatacttgaacattcttttataaatattttattgttatgacttctaataacaatcttgtattacttcatttgttctcacagcacaaatgtctatcttacctcgagacatatcaaagcattcataaactccagacgtgtcatcgcatcatcaaaattcctgcccgtaagctcagttattctctgtattctgtactttactgtattacgatgcgtaaataactgttcggaagcgtgaagcaggctgttattgttccaaaggtacgcttttaatgtctgtaaaagattcgtattattctccttatcatagtcaataattattcctaatgtactgtcaacaaagtcctgtataagctttttatctccaaattcagagaacaggttatatattcccatttcttcataccagaacacacttccattaagctgtatcttctccgaaaggattacacaccttgaagcctccgtaaaacttttctgcaaatgtgatattccattatattcacgtccaattcccataacaagctttatatccgtatacctgccctgcacgtatccagataatgcttcgtaagattgattaataagaccgtgtgtatcatcagcattttccaaacaattaaaacagccaactatgttattagcatatcttgataaaatgagacttccattgttctgtgcaaaactgtccctcagtttattcataatgaaatcataatcaaaattctctatcttattatctgaatgaatattaatcataaacatacggttattaccattgatgtcatagccagcttcttcaaatttaatagaaaatgcttctatattgatgtcctttccgaatataattcctgaaagaatatcataacttaatacatctgagtctttattatacgcaatagcgtgtccgatttcttcaaaaatgtcaacaagaggaatttcacctgatatgacaaatatcggaaaatcgttaagattggcataggatattattgtactgtctatactggcaatgtacttatcaccaacaagaagcaatgcacctgccatatcaagcttcttagctttcttaataactgcttgcagatcaaaatccttactctgtataacaggcgtgcttataatcaaaagctcctgtccctttacccacttcgcaaaattcatattctcaggcttatatacccaccttattctattagacaaaccactctttcctgctattattctggctttcgccattgaggggagagtgagaagatctttacattgaaacatattgctgctcctatatttttttctttttatctacgccataaattcactcaaagcctcataagcagctggtgctttcttaaacagatattcaccattacggacacttgcaacaacatcggctctttcgcatactgcctcgaattcactcctggcatcgacaacaataaagttagctggcttgcctgcctcaattccatatgtgtctgatatgttcatggtcttagcaccattaacagttataaggtcaaggcagttatccatttcctcaaacgacatcatctgggctatatgtataccattatcaagcacattcataagattgccattgcctgccggataccagggatcctgaattgaatcctgtgcaaagcatacatttattccattttcatataattccttaactcttgtaagacctcttctcttaggatatgtatcctgtctgccctgaagatatatattctctgttgggcaggaaatgaagttaagtcctgctttcttgaaattcttcatcattctgaatgcgtagctgttatctactgaacctaatgaacaggtatggcttgctgttgtcttaggtccgattccttcaacaattgaaagtgcagtaagaagctccacaaacctgctcattgggtcatcactctcatcacagtgtacatcaataagcttgtcatacttcacagctaattcaacaaccttatgaattgatttctcaccaaattccctgcaatactcaaaatgtggaataccacctacacaatcagcacccattttaagtccttcttcaacaagcttgtcgccatctttgtaagaatacattccttcctgtggaaatgatacaatctggattgttacaatatcttttaattcttcctttaattcaagaagtgcctttaaggctgtgaggttagggtcagttacatcagcgtgtgttcttatgaactggacaccgtgtgacacctccattttaactgcctttattgctcttgcctttatctcatcaattgttaaatctgatttagtttcactccacctttgaattccttcaaataatgttcctgttccgttagttgcaccctgctttcttgcggtgaatacataatcaagatgaatatgtgggtcaacatatggtggcagtgtaagcttacctcccaaatcctcaatttcacaatcactatctacatctatatgtggtgcaattgccttaaataccccgtcctcaacaagtatttcctgtaattcatcatatccttttaactttgcgttaataaatttctttccagccatattatacctcttttcctgcctaagatattaacactgaattcaaatatcaaatggcattgattaatatggtctgactataacaatcaatataacaaacaacaagcatttgttccaaagtaacaagcgttttatgctgttttaacaacattttataattgtatttgtgctggggatacataattatactctcagcattctgtatcctataccaatatgcgtctgtatatactgcggggaattgacatctttttcaattttctttcttaatgttgccataaatactctaagtgatgccagatcattttcccatgaactcccccatatattcttagtaatataagtgtatgtcagcactcttcctacatttcttgataataatatgagaagcttatattcaataggtgtaagatgcagctcctctccattcagatatgcacagccagctgcatagtcaatttttaaatctccgttctcgaatacacttgtattctgagtcatatccgtctgcataagcgacagtcttcttactgttacacgtaatcttgcaagaagctcatctactgaaaacggctttgtaagataatcgtctgcccctgcatcaagtgcctctatcttatccgcatcttcagttcttgcacttataacaattattggtgtattagtccatgtccttatcttttttataacttccaccccatctatatcaggaagtcctaagtctagcagaattatatcaggattatgtgatgcagtctgtgaaatagcactctctccattcacagcagttaaatacctgtaattattagtttttaatgttgttgttatgagatttcttattggtgaatcatcctcaactacaagaatctgtgttttattcatttaaatgtacctcacttaactgcagcttgaattcaaaaatgcatccatgtggtgtattatcccttaattccagttcacttccatgtgcatttataatagttttacataaagataacccaagtccgagacttcttctgttatctgcaatttcattgttacaggtgaaaaatgtatcaaatacattttctttcatgtcatcaggtattcccgcgccattatcttcaatggatataattacatatctgccttcttttcttgctttaatatatatatcagagccttcctgtgtatactttatggcattatcaactatattaataataacctgtattatcagtctggcatccattctcacaagaagcagttctttgccgcaatccacatgtattttatgttcacagctttttctgttaatatgttttaacgcttcagcaataacttcatctataagctgatcagacatattaagagttactgttccatcctcaaatcttgttacaaacaatatattctctacaagactgattaaccattctgaatcatcatatatatctgtaaatatctgctctctcgtatcattatcaagcttatcataattgtacataagattattggcattacctgatattgatgtgagtggtgttcttaaatcgtgtgaaatcgtccttaaaagattagcccttaactgtagtgtcttttccctgtaagcagcctgttctgacatacgaacatgttttttcagtttagatgccagagttcctgtaagcattgacgcagcaagcataataacacatgtgagcggatatcctgtgtcatatgtatgtaaagtaaatcttggttctgtcaggaagaaattcatcagaacaacacttacaagcgaacccgccacactccagatatatccattagtgaatatcgaaatcaaaagcacgcatagaagatataccatagtaacatttgattctgtaaatccaatatatataagcagcattccaattactgttgcaatacttaaaaagcctattgttattaagaattcttttacaagttttttcaatgtcttttccgttataattaccaccttattttattttgtatataataacacattttcaatttaatatctctttttttcgttatcatcactttcattcaatacagcattcattgtatctttgtcattggttcttcttgttctgttcataaatccgtctatcttattcataacataccatcctgctgccataaataataatatcacaactatcagtattattataatcaatcccgtcttcatgctcatgccccctaatcttaaaccttaaagcattttttcagatttttataatctcctaacacaagtaatgtaatatcttctgtaagtacaatatctggttcaacatttacatttattgagtcattatgctttatagccattatgtttactccatatttttttcttatatcaagttcaataatactttttcctaaccacgactcaggaacttccacttcaagaattgcatgagtattatccagttgtattaaatcaagaatatggtccgcagtgtagcgtactgcagcccactttgcttcgtgtttttcaggatatacaaccgcatctgcaccattacgcagcaggaatttttcctgtacatcccgctcagctcttgataccacatatctggctccaagttcctttaacagtgatgttgtttccagcgaattctgaaaactgtcaccaattgtcaccatacacacatcaaaatttccaacacctaatgattttaaaaattcagcattcgtgctgtctccaatctgtgcatttgtgactatattcataacatcgttaattctgttctcatcagtatcaactgccatcacctgatgtccaagctgattaagctgcatagccatatgttttccaaatcttccggctcctataagtaatacattctttttcatattgtgctcctatcctatattaatcttttcttcaggaaattttgaatagctgtttccatttccagaaaaagcagcatatattaaagtaagaccgccaactctgcccataaacataagaataataagaacaattcttgataatattccaagctgtggagtaatacctaatgtcaatccgaccgtacctactgctgatgctgtttcaaaaagacattttcctaatgaaattccatctgtgacatttataataaatgcgcccgtaacaaataatgtaatatacatcatagctatcgtagctgcatttttaactgtatcgttatctattcttctttcaaaaaaatgaatattcttatttctcttaaatgttgcaaccatgtttcccataagaactgcaaatgtagttgttttcataccacctgctgttgaacctggtgaaccacctataagcataagaattatcataatcattacagatgcctgtttcattgcattaaggtcaaccgtattaaatccagcagtccttaatgtcactgattgaaaaagtgccttaaatacaggcattctctcgcttccagtcatcatatcatttatcataaatataattgcaggtactgttataagaacggctgttgtaacaattattaatttgctctgcatcttatatcttttaaaatgatacttattattctcaatatcttcccacgtaacaaatccaattccacctatcacaataagaagcatcaatgtaatattaataacaggattacaggcatatgtcgtcattgaagcaaattgattatccgctgttcctagcacatcaaatcctgcattacaaaatgctgatattgaatgaaatattgcaaaccagattcctttcaatccataatccttgcagaataccggcatcataagcaatgctcctgataattctataatgaatgttccttttaatataaatccggtaagcctgactattccgccaaccaccggtgctgatacagattcctgcataaagcttctctgcattaaagacactttctttcctgacaataaagaaaacgcaacagcaacagtaattacgccaagccctcctatctgtataagcgtaattattacaagctgtccaaataaagaccagtagcttcctgtatccaatactactaatccggtaacgcataccgctgatgtagatgtaaataatgcatcaccaaacggtgttacacaaccactggctgatgaaaccggcagcataagaagcaatgctcctaatataattaatccaccaaatccaattgttataacccggaatgatgacaaatgttttcttatcctgttgtcaaacataaaaaattccccttttctaacataattgaaatctaccagaattatgttaaaaaaggggttaagcatttttatatgatattaagattatattaagattattatctctcccgaatcatgataatcagaagataagctgctccgaatacaactatactcccagccataattaaatacatctgtgacacgccaacaacatgtcccctgaatacaggattacagtcgagagtgttccttatgactgtgaccgcttctgacggaagccctgtgtctgccatctctttatacactccgtttagcatatggttcttaaccagggaagttccgtatgtacccggaaggtaggacaatgctttctgcagccctgaactaaaattagatatcggcatgtatgcaccacacacaaatccataccctgcacttacgattgttccaaccgccgacaactgcccctgcgtctttagcggatagcttacaatgcttgaaagcgtgcttccaaataacaccagcagaatcatatccaatataacaaatattacatctgatgcactcatataccagcccattttcaatatgtaaagcaggcataatgcaagtgctgtgccattaaccataagcgaattaagtactgttgataagaaatatcctatataaatctttgttttgcttacaggcgaaacatcaaaatcttttcttgctccgctggctctgtcctgaaccatcgtaagattgacgcagaatgtaacagttacacagcttactgcaagaagtgctgcagctaactgtgctgccactgtgccgttaattattttgtctgataaatcaatcatgtccttagttgcagaaacgaaggagtccttgtatacatttgctaaaaatgttgcatacaaaacaataagaattaccggagttatcattgatgagaataacattcctttgtccttaaaaaagagttttctgtttctgcttacaagtgcggttatctctttcatcactgaccacctcccaatattttcccagtcacagcaagaaatacatcgtccataccaccttttacgacttcataatcacggaatatctcctgatgtttcacaatcattttcgtagcttcaagtgtgttcttaacctgaatcctgtaaccatcacggattgctttgtactctgttttcaaagctttaatctcatcctctgtaactccatacaaagatatcgtatcatgaacatattcattctttaattccaaaggagttccctctgccacgatgcttcccttatcaagaatcacaacatatccggcacttgccgcctcctccatgtaatgagttgtaaggaataccgtcatgttctcctctgtacgaagtctctcaataacattccatataagaagccttgtctgcgggtcaagtcccgtcgtcggctcatcaagaatcagtatctccggtctgtgaatcagcgcccttgcaatatcaattcttcttctctgtccgcctgacagcttaccaaccggtctgttaatgtaatccccgaaatcaagtatctccaccagttctgccagtcttttttcgaatgcatttccagtaattccatacaacgccgccctgcttttgagattctccttaactgtaagaggtttatcaagaacactgtcctgaaacacaactcccagcagcctctttgtttcactgcctgccctgtctgcttctttatccttaatccacacatttccgctgtccttgcgtaactgcccgcatataatagaaatcgttgtgctttttccagcaccatttacgcctaaaaatgcgaacaattctcccttctttacgcggaaacttaagtcattaactgccttcacatcgccaaaacatttattcagatgttctatcttaataatatccgacatacgcccctccttattgagaattacttcatgtatttattaatccattttaccacatccagcatgccaagttgcattcagacaaaaaagacacaaatcaatgtactttgtgccttaaaaatcatattagtttcataacatttttagaatatatccagcatattatccagatatatatcttctctcacatgtatctggtactccggctttatcatgtaatacaataggaattccaacaccagtgcgctcccaagtccccgtccttcaatcttaaaattggaaaatcccattggcatatatgtattccttatatcatcaacactgataaatgccggattctccattgccttagaaaaccggtatccactctgtgaatccggtgcaacgcatacatgatctggacagtcctcaccaagattctgacggctcacaatctcataacagttctttctgtcgtaacatccgaaccagcagcactcattacacaggaattccaccttatccttttctttatctgtaagcttcaccagcttgtcaaatactttattcagcctgaaatccggcactacatactggaaatcttctctttttacttcattcagaaaatcattaaaatcagtcaacaccttcgttgtcgatgagacaagataaagattcggataatgcttcttgatatacctggcaagaatgtcagaatgtacaatcacgccattgctaattccctcgctgtcattaagtgccttacataacgcattacatttttcatcagctaaatgttcttcgcgaagcagtgaattgctgaatgtcagccttgccgatatcccatattcactcatcagattcataacttcctgcacaccatgttcaccggaacctattcgtccaccgccccagatacagtctgcaggcgcaccatatattgagccaatcccgcaccaatcatagaaatactctctgtgctcccgatatatcggcaaaaatgcttcatacaactcatagaattcaaacagccccggaagatggtaatatgcaatagtctttctcattaaaataatccgtctctttcatacatgattatgattactattgttataccatattcctagggagttctctactagcttattggaaatattgacccatcccggttttcaaatgtttcgtagccccttgaaactatactcgaagcaattccaagctctgttgcctgcaaaatcatattttccattatgcagaatgcatctgctgtcttgaacaaaattaacatttaacatcaaaatatttatctctgaatacattatagggaatatacacatattaccgccatgtcattacataatctttttcgcccgtagcttcgtccaatccttcattctgaatctcaaatccttctctctgataaaaatgtattgctcttgtgtttttctgatacacatttaaacttaattgcgttctgctttcctttacaaaatccagcaaaagttttcctatgccctgcgactgcaatctatcacagacaaaaatcccttcaatataatcaccatttaaacctataaatccctgtatttccccattactctcacacacatagacctccgcctgtaacagcatttcttttaccagctcataattactttcccagtattgcgcagatataaaattatgtgcctttatattagtatccagccatatgtctgctactttagttatatctgctttttgtaattctcttatcataataacttcctctattgaactaagcttacagatagcttttcataattaatcacctgataactttcataatttctttttcatgatttctggtaaattcgcttaattcataagatcggattctcttgttgaccaatataggaaccacaaatccatttttcaccaataccgccagtctgttaataatcgtcttatttgttactgacaattccctgctgacttcaattggagtaaattctcctcgataacttttaatcaaaaattgtaacagttccttttccttccctttcagaaacgatagacctccagcaatatcttcctcttcggaagctaactgtaaatcacaaactttgctggaataaagtttaaccatacgcaaaaagtaattaatccaaatctctggatgcggcggattcgcccttccagaataatacaatgcaggaagtcccatctggatggattcataatattcatcaatatcgtatgcaaaatactcctctaatgatccgattccattaaatccatacccattcaaatccatgatataacctgataacaatctggctgtcctgccattgccatcttcaaacggatgtatggtcactaattggtaatgtacaactgctgccacaatcaaagggtgatcatctgtagtgtttacatactcgattaactcatctaatagcccctggatgtcacaatattctggtggaatatagtcaggatttcctgtcttagaattatacacagcaaacaggactcctggtggcataggtcctctgagtccgattttttctttggaagcccccttttccaccagtttctgcacatctaaaattagcttctttgaaaatttttcactattttttcactatttttcattaatcctgaattattcatgacaaaatcacatacaatccagtattatcttctcacacctgtcatatccaagctgtgaactgttcaggcacaacgtataattactggctttcccccatttctgctccgtgtaaaagttataatttgtcatacgtcttttatctgtgtctgccatcattttgatggcttccttctcttcaacattatataagcccctgatacgctgtgttttttccggcatatccccatgaataaacacatttaacacatcatccctgtctttaagaatataatcagcatttcttccaacgattacgcaaggctcctttccagccaactccaaaataacttttctctgtgcttcatatacaatatcttctatggactttcctgtaatgtcacgtccagcaaatgcatatgcaaataaacctttctttggagataactcagcattttctttaatatactccggtgataagcctgactgttctgcaatctgtccaatgatatccttatcataatatgcaatgccaagtttctttgccacttcttcaccgataaatcgaccaccgcttccaaattccctgctgattgtaataatcctttttttcatttccggttcctccttaattcaaaacatctactttattctttctgattctctttaaaaatacatatcctgccagacatgaaacaacctcagttattgggaatgcccaccagataagagaaactcccatctgaccatttctgacaaacacagaaaaaattccagacagtggcaggataatgataagctgtctcagaagagagataaccaatgattcaacgccgccatccagtgcctgataaattccctgataagcaacatttattccagcaaacagaaagcttattgagattatcctcattgctccaataaaatattctcttgactgtcctgcattgaacaaagttgcaaaagctccaggaaaaatttccgtaattgcaattcctagaatcattagtacaacggtatagagcagtccatacctgatcccatcctgaattctctttttacttctcataccataagcaaatgcaataatcggagtgattgcatctctaagcccaaaggcaagaaacaatacaaactgctgtactttatagaacaatccatatgcagtctgtgctgaagggctgaatttcaaaatcagattcatcacatataccatgatagacataagtgcctgtgcaataattgcaggaagtccaattgcatatatttccttgattattctgctatccggtttcatatactttacatcatgttcaaattccttattcagtttcatatgaaatacaaacaataatattgcagacgcaacctgtccaataacagttgcatatgcagcccccttaactcccatttcaggaaccggtccaataccataaatcataataggatcaagaataatatttaccactgctccaactacctgaccaattgtagaataaagagaacgtccggttgcctgcagcagcttttcaaatagtgaaaagaaaataattccaaatgaaattacacagcatattcttaagtaatctgttcccattgatataacttcagggtcaattgtctgtgatgaaatatatgctcttactccaaaaatcccaaacaacaggcacaccacataaataatcactccaagaaacaaactgtttcccgcaacttttgctgcttttttaccatttccctgtccaagtgttcttgcaagaagtgcatttgttcccacacctgttccgattccaactgctaccatgagcatctgaactggaaacaccagtgtaagtgcattaagtgccgcctcacttcctgatctcatgtttccaacaaaggcactgtctacaatattgtaaaccgcttgcaatgccatagataagatcatcggtattcccatctgaaccatgagcttatttaccggcatctctctcatcttgttactttctgccattttataatcctccttgttttgcgaagcaaaatccgacccctttggtgaggagaggattcagcctcctttttttgcataaaaaaagtgtgtacttatctcataagctggacttacgctgataagctacacactttaaaatgcattatatattttcataatgtgcgacagcagacgcacaaaaaacgagcagcaaaactggatttacgctagtctgctactcgtttagaagttattatatttttctttttgaaaattgtcaaacaaaaattatcttaaccctgccagatatgtacgatcaaaatgtgccatattcagttttccaataaacgctcgcaatgcgattgctttttcaaattataactgttataatctatgtggtgctaccctacacggtaggcggttatcctccatcagagagttatagctctgtttacatagaaatccgacttggaaatctatcaaggaggtttgtgcttatgcttacaacggagctttttatagccatcatcagcttatgtattacttgctttgctcttggttatactattggttctaagagcaaaaaataaacacaaaacaaccgccacggtctgctaaacttggcggttgttttaaccaaaaaatatatcaggctaaccgtctatcggtagcgcctctttaattatattatcattcaacgggttttatgtcaaacatgttatctttatttcaggttcaaaatcttttgaacatcattagccgtcatgccaattaagcacgctcacaaactcatcaatcaactttttcaaccggccatgactttctgagtgccacataggaaatcagaaaatttgcaaaccagccggctggtacagcaagccagacaaactctataccaaaacgcggtgcacaaatcatagcaactgacaggcggattgcaaggttaaccatattagctataagaaatggcctcatgattcccagcccacgaaggactccatctgttgccatcttgatacccatgaaaatgaaaaagtaacctaaccatttcatgtaatcccctgacacctgatatgccaaagctgttccatctttaccaaggaacagcgaagaaatgtgtgtatgcagtgtctcaatgactatgaaagcaaggactgcaaaacatatatctaacacgagtgcagcatgatatccttttttgatacgcccaattttcttcgctccaagattctgggaaacataaggtgacactgcgtttccaatggatacaaatataagtgaaaatacattttctactctcattgtcgcagcataacctgcgagtgcctgtgtaccaaacggatttacaactgcctgtactatcatcatgccaatcgatactgtagactgctgaagaattgatggtatggcaatctgaagcattgaacgtaactccttcctgtcaaaccagtcaaaatgacttttataccgacgcatccggcaaaagaaaattacaaatgaaaataccgctgagataccctgtgcaatcaaggttgcaagagctgcaccaaacacgccaagtcctaagccagcaaccatccaaagatccatcagaatatttaagacagaagaaaatataagaagcaccaatggaatctttgattcaccgattgaagtaaacattgttgaaagaatgttgtacataaacagaaacggaaatcccacaaaataaacacgaagatacagaacagcttcatccagtatatcagccggcgtctgcaataaactcatcattgaatgtgataacccgaaaccaaaaattcccaatagtatacttaaaattaggaaactgattaatgatgttgatacaatagtcttcattttactataatttcttgcaccaaaataacggctcacaagcactccggcacctaccccggcaccaagtgccacacaaataaatacatttgtgagagcagcgcaggctccgacagccgcaagtgcagatgatccgacaaactgaccgacaataattgagtcagccatattatatacctgttggaaaaaactgcccagaatcatgggcatggcaaaaacagtcagtgctttaaggggcgcatcggtaattaaatattcatcctttgacattctcttatttctccttgaatttctcgtttttattctctccccatataccccctgatataattcacagcatcacttatttcatcaataatcttatctggaatctgcagattatactgtcttaaatccacatcctgtaataactgtccaaggcttgtaccctgattgtattgaacaataaacaggctgtatagaggtattttgtccccgaatacatccatataattattaacaagtgagaagttgatagttcctagcattgtgtgacattcaacaagatacaatttatcaggaatgtagtcatacacatgcattttatcattcttaatctcttctaacaataattcctgcccattttctgattcagcatccatatcttcttcataaaaatctgattctgacgcagctgctgtatcctcacttgaagggatttcttctgctgtctccgggaattctgatatatcaattccttcaaacaaagtactcatatcccctagattattatctttttctctctctccagccttgagatcccagtcatcaacaaactgcttataattgccataattgttcttaagaaattccatgttatcatatatttcctgttcattgactctcatctttacaatggtaagaattgcattgccaagctgatcaatcgttcccacatatttgccggtaaatacatcgtcctttaacacaagcgacagaaataatggttctcctgacatatttttataaccggtatcaacaaatacattggttgcatcataacttgttaccatcttaagcttaacatccatatatataatatgttcatatggatcagccagaacataatctattatctttgatatggttggtgtctccactgtttcatccacattttttctaatattatataaaacttcttcttcttttctcagataaatattcttgtatatattggtcattgcccctgcctcccctctcactgtaacaacttcataagttcaggaacaaccgccttcaattgtttctgtacctcataaggaatctttccataatcaatattatctgccatatgaattattgcagtatactgatattgcggaattgttaatgtatatgcacttccgacaaacaaagaattaataatacttacattaatctttccaaataatgtcgttatctctgctattacatatgtacccttcttaacctcatagacaaccggcaaactattaatattcatgctctggataattgtctgctccatctccacggcataattactatcgtcaccggtatacatcatctcctgcttctcttttatcttattactgataaaatcgacagttttaggaatcagtggctttagctctcttttagcacgttgccatccaatcagatagctataataaacaatatcattcttgtgcgccttattaaatggcagtatagataatgaagctgctatcttattaagcgtcccacagtagcttcctacaaatgcgtcgcctcttttagtaagattaatataaataagttctttagtatcaggttttatgtatcctgtttcaaccagggcattagtcgctttatgaacactttgtggagccattgaagcatccatatgataaatcctgttttctatatcttcattgacatatgcaacaatatcttcaacactaacctgaccagcatacacatgaagcagataggctatattattcttaagactctcgattcccataattgtatagccttctgctatggtaacattccttgattctacactgacccctttactttgattactaaaaactctcttatttcctgatggacaataaaatgtgaggtatttggcatcaatttgtgcaaaataattctcaatatcagcattcgctttttctaatgtcctgatacactgcctttttctgctcttctcaagtcttctgttatcaagaatcattgccagctcatttgtcggaatccttgtatcatcaaatgaccacttgataagcggtaatccagcatcttttaatcttttattaaggttattcggattctgtgaataatgtgtatcacttataaatgctttaatttccttatgcttaggtgcattaacatcatataatgcttcactgttcttatgcattacatgcctcatgtcagaggcccattcaagtacatcacactgctgttctgtcaggctgtcagccagattcgcagatgtagctatttccttgttgcgctccattcgcatttttacatattcttttgataaacttataaatatcccttccttctatattatttttaaactagacaaatgctgtttatattataatctttttcacatgtaattccaattaatttattataaatgctgttattcatacttttccccagacaacccacgcactactgaacaaatcctgaaaatacatcataaccaaccccaatcccgtcaaaagcaaaggacacatgcccttcctaaagggtatgtgtccctattatatatctatatttcatcttttccatcaaaccggtttttatacgatatattttttactcccagttactctctgcttcatccagcttccttgcaagtgtatctttaagagctgtaaacgcaggaataaagctgtcgcgtatcagcagaatcaattcatctacttcctcctcattatatatatgaacagaggtgttgcgcttttttaacataagcagccatgtttctgaatcatctataaacccaaatttataaccaagctgcagaatctctcgtggtgatccagtagaagaatcttctacaccatgttttctcataatctcctgcaacgctttccatgcaagttcaaaagtaagattaaattgtccaataacccctgtccggtatatatcattagtttctgccatcttaaaatctgcatttgctaatatagtcagacaattaataaagttatcaagctttttcataaatcactacaccgtccttttctatctcctcttttaattcatctgaaattgatacatctgcctgtacaatatcgaacatcagcagagaatgggttttttcctttacatcccaataaaaaccatcaaaatccccaccatacacagcaatatctatgtcactccgttccgtgttcgtacctcgcgcacgagaaccaaaaagtatgattttagtaatagaatgttccttcgcaaaagaaacaatttctcttaatatccggtctggtaaattgtatttcatattcaatattgcccccttatctgcactcattatacttaattctgttcataagcacaataaacttaccccattgttttccgataaaacatatatgaataaactactggcagaatgcatggtacaatgactagagcaagaaatatccacacattttgaaatggtgaggttacaatcatggcaattcccccaattaccatacattttccgccaaatctatgtgtatgataccagttgtcagaatcattcaatgcccacggaatgcgaaaaccaatgctatagtttggttttacctttggaataaaattgcctaaaataagatacaaaattccaacgaacaatccgcagacaaatccaatattgagcttatatcccaaattatatacatagagaatattgcaattaaccaaagaaatcaccggacaaatccacataacaacatggaatacctttttgcttatattttttctcttggggtcaatattagttgcaactatacatataagatgaaaaaacagcatcattaccggaagtccaaagactgcaaatgctttagaacaatacccatctggttgattgtcaactccaaaatgtgttgcgacagaagctggcagctgtctccataaaagtaaacctataaagattggaagtaatgttatgacagatgttaatattaacatttttttatgttgtttaatcatggtctttttctccttttaattcactaatccataataaaatctcctcaagcacagtagcgttaagctcataataaatgtattttccctcccgctcgtctcgaattaaatcagcttccttcaaaacagacaggtgtctggaaactgccgcacccgaaattgaaaaatgattgctaatctctccagcagacattcgggactgcttaagcagattaagtatctcgcgtcttgtaggatcagcaagcgcctgaagcgtatcctgcatgctcacattcattcctccttcatttaacatttaacttaaatgttaaatgaattataacacaccacctttatttgtcaagaacacaattccttttatcaatgctgagtatctttccgtcttatttttaatattgtcttcattaacaccataataactgtataaatcttttctctcaaactctgctataaacacactagtttcctataaattcatgaaaaatacgctggttaaaaagtgtgggaagaacctaatcttcccacccattgtacatttactattcttatttatcgtattccagataagcacccttcattgggcttgttgcaagttcactgaataatcttaatacgcccttcttatatttgcgttctttaggtttccactgttttcttctttccttaagaatcttatcaatctcttcaggtgtcattctctttcctgcaacacctactatgttaagctttctttcctcaacatcgatttcaataagatctccttcttcaacgagtgcaataggacctccatctactgcttccgggctgcagtgtccaattaccggaccggtagatgctcccgagaaccttccgtctgtaataagtgctatactcttacccagctccttatcactgcttattgcctctgatgtatagaacatctcaggcattccacttcctttaggtccctcatatcttataaatacagcatcacccttctgaaccttatgatgaattactgcatcaagacatgcctcttcgctatcgaatggtcttgcattaagtactgccttaaacatttccttagggcaggctgtatgcttaattactgctccctctggggcaagattacctttaagaacagcaatgcttccattctctccaataggcttatcgtatggtctgattatatcttccttggtaacatttacattgtagcgcttgttgaaatcatcaagccacttattacatctttcatagaatccatttgacttaagttcttcaagattctcaccaagagtctttcctgtaacagtcattacatcaagatggagatgttccttaatttcttccataattgctggaacgccgcctgcataatagaatacttctgctggccatcttcctgctggacgtacatcaagaagataatgtgcaccacggtgtaatctgtcaaatgtatctcctgtaatctcaattccgaattcatgtgcaattgcaggaatatgaagcagacagttagtacttcctgatattgctgcatgtacaagaattgcattttcaaagctatccatagttactatatctgatggtttcatattcttcatctttgcaagccttactgactgtcttcctgcttctcttgcataggctaacaggtcaggacttgtagctggcataagagcacttccaggcagtgctaatccaagtgcctctgccattatctgcaatgttgatgctgttccgataaatgaacatgcaccacagctagggcatgcattacattttgcccagtcaagcttctcttcgtcaatctcgcctctttcatactgtgcactgtacattccaagctgctcaagtgtaagcatttccggacctgcattcattgtaccgcctggaacaaatacagatggaatattaactcttgcaagtcccatcagattaccaggaactcctttatcacagcttgaaagatatacacctgcatcaaatggtgttgcatttgcatgtatctctatcatattagctatcatttccctgcttgcaagactataattgataccgtcagttccctgactttcaccatcgcatatatctgtacaatagtaccttgctccgaatccgccttcttcagcaacaccctttcgaacctcttccacaagtatgttaagatgtccgcttcccggatgactgtcaccatatgtactttctaccatgacctgtacttttccaaggtcttccttcttccagcctgtgccaattctcaaaggatctaattctggggctaattttctcatttcctgacttactaaacacataataattacctgcctttcttcttatcttaataaattcatctgttctaatttttcgtacaccttgtctttctcagtatcatccacacacatctctacattgtcaaactgtggaagactgaatactccgagcatcgacttggcatcaactaaatacttaccacacataaggtctacatctttatcgcagccttctgctatctgtaccagatgctttgcatcagtcatattgttcaaacataccggtatttttaccatttgcaacctcctgttttatatcttcttaattaaatagttacctttaataatatctaagcaaatattgaaatactcagacttacaattaatgctgttatacctataagtgtttccataatagtccacgactttaatgtagttttctcatctatctcaagaaatgttcctacaagccagaaaccagcatcatttacatgacttaatgctgttgcaccaccacatattgcacaacacattgctgctctgtataacatgcttgttgccataactgcaggcatagttgccattattcctgatgccatagtcattgcaaccatagaacttcctacagatgctcttacaagtaatgcaataagaaatgctacaagtataagtggcattccgctcttctccaatgccggacctattatatctccaagtcctgaatcctgaagcatccatctgattactccaccacttgctattaccagaagtatcattccgactgggcgtaatgaatgatcaagtatcttctttaactgggctcctgtatatcctttttttattccaaggaaatacattgcagcaagtgttgctattgtcaatgcaaggaatggttttccaatgaatcccagcacatttttcacatcgaccggaatcggcatgtatttagaaacagtacttaccagtattaatacatgtggtataagaatcactccaagcaccagtccaaatggaggcagttccttagaatcttccttaatctcttccacattaaccggtaatttagtaaacactttgtttccaatgaatcgtccccatattacacctgctactatcatacatatcaatgcagttgggataccaaccataatcatcactccaagattaactccaagtgaatctgccacgagaacagaacctgctgatggtggaacaaatgcgtatccacttgcaaggcctgcaagaagcggtattgcataatataatgttgacttctttgtctgctttgcaacactgaatgcaagtggtataagtacaaccacacctgcttcaaaaaatactgtcgttcctataaccagtcctgtaattcccagtgcaattccagccttcttctgaccaagcttatcaataagtgtctgtgctattctttgtgccccgccacttacctcaagaattccgccaaacattgaaccaagacctacaagtaatgctattccctgaagcgttttgccaacacccttttcaaccgtatctgatatcattgtaagcggcatccctgctccaacacctatgataatagctgctatcatcatcgatataacaggatgaagcttaaatttgattattaacaacagtaacacaataattccgactgctgccgctatcagtaatctggttggatttgcaacaaatactgtctgctccatatcgttttacctcctaatcatctgatgtatcttagttaatacatcataccttttctttgtttcttgtaacttttttgtctttttctgagatttatttcgaaattcatctgatgtatttaatataatacatggtatttagaaaaacaatactgtaaaattgctcaatttttctgtgcttttttgtgcattttttcattttgacaattaaatggaagcattatatcattaatattactaacataggagcataggaatcatatgatgaattttgaatctgatgagagaaatcttccacagaagatttccgaagacataatatcttttatattaaatgaacatttacagtcaggtgacaagcttcctaatgaagcacatcttgctaaagaactcaatattggaagaagttctcttcgtgaagccatgaaattacttgcttcacgtaacattgtgacaatcagacagggatctggaacatatgtagcatcatcacccggtgtagttgatgaccctctcggatttacattcatacctgacaaaaaaaagcttgtccaggatctgcttgaagtccgttttttactggagccagctatcgcagctatgtctgcaacgtatgcagataataatgatattaagaaaattgtttctttgtgtgatgaggttgaagagcttctaaaacagaaaaaagatcatacccagaaagatatagaattccacaccgcaatagcaatgggaagcaagaatcttattatcccaagactcattccgattatcaacagctcaattcctctttttgttgagacaaccggtaatgttcttaaagtagaaactattgaaacacaccgtgaaatagctactgccattgcacagcataatgcaatcaaggcacaggatgccatgaccatgcaccttatgtacaacagaagatgtattaattctaaacagaatttataatatattgtaaacagccttaatataatgctttacatttatatgaatatgtgctttaatagtgcctgtacaaatcaattatataagcagagtaggaatatgtgcgttaagtgccatatggacagggagttgccatacggacgaaaagatttcttgcgatacataatccgcatcccgctgctacatatactggtcaacagcctcttatgtagtgcgaatactactgcaaaggaggttatttttatgtcaattctattaaagaattttgcattttcagcaaaagagttcaaatgtctcaagtcaattgttgctgcggcacttctcgtcgcacttcacactgttttagcagtttttgtatctattaatgtaaccccggcactcagaatttcagtatctttccttgctaactgtgcaattggatacatgttcggtcctgttatgggattcatgtgcggaggacttggtgatatagtccagtatatcattaagccaaccggtccttatttcccgggctggacattaagtgctgctttagctggacttatctatggtttatttttctatgactgcaatatcaaaatttccaaaaaaaaaataacaggtgaaaaacgcagccttttagagattatagatttcaaattccttattagagttgtgcttgcccttactattgatacacttcttgtaaatgttcttcttggaacatactggtgcagcataatgtacggcaaaggatttatgttttatcttacaatgagatttaccaaaaatcttatccagctgcctatcaacattttcttaacttacaatgttataggaatcgttaaagtaattaataataaaatatataaaaacgaataaacaaaacgcaggatatagtgactaactcccatatatcctgcgttttttgatttatcattgcttactgcgtatttaatccgctctcctgctaatctttgcatggcttcaattattggtattgaactcttatgaaacaatatatcctaaaaaagtgagattttccctgtttataccctcttataaataattggttcatcatatccaaaagttctttttccgttaacttccatgctttcagatacttccaggcagctatcagaaaacttttcccaaagcttaaatgtcattaccggtgaaaactggcttatgctgcctccctcccagattccactcttttcatgataaagtgcgggtgtaaacttttcagattttttcagttcagcataatcaacattcttcatagaattatatgaaaatgtattcttgtcttctcctgctggaatttcatatgaagaaagaacaattccgtcgtcagtttccataataaggaaaatatgtggtgatgcatggcgttttccattggtttcataataactttcttcaacaacaaatttcccattaaaatccttaggaatgttttttattttatcattacatatagtattgatgtgttctgcataaggatatatttttcctgccttctgcatcatatcaaactgttctttgttatcaaaatgtcctgtcatcattcctataaatttatcaagtttcatcttattttgcctccatctttaagttttatataattaatcctgcaatttcgtgcttatgcacaccaatagccccctatgaatcacatacaatgccgacatctggctgaaccatagtcttttcatcacaatcaagctgtacatctaccggtgcaataaaatgactacagttaccattatataataaagcatccatatatcaacctgaaaataatcaaaaaatatccaatataaccgcatttgacataataaagttatatagttgtaattctaacagtttgaattataactgttatgttaaaaaagggggagatgctatggataattcactgcactatcttattatggcgaaccagatgcttgtacagaaagctcttcttgataagttaaaagtcaccggtcttacaatcggtcagcctaaaattcttgattacctgaaagaccatgacggaagcagccagaaggatattgccaagggctgctttattgaagccggttttcttaccaccattcttaacaagatggaagaaaagggtctaattacccgccagatgttaaatggcaaccggaggtcttttcacatttttatgaccgaggaaggcagaaaaaagcagcagctaatcgacgaattattcaataaaattgagaaaaatgcattgcagaatatttcaggtgaagaattcgatatgtttatgactgtatacaagaaaatctatcacaatttacaaaatgaattaacatctaaggagtctgctaatgaataaattaaaacgctacatattatttttaatcaggttatttatcaattctcttggcgtcagtcttgtaaccaaagcaaacctcgtacatcgccaatttcttcgattccatatgtactgagcctgaattttccgctgacacttggaaactttacaattatattcagtcttctgcttatcatattgcagattattattttgaggaagaatttcaagctggaaaatatcctgcagattccggtttctattgtattcggttatttcatcgattttacaatgtaccttttagtatggataaatccacagcattattttattaagttaatcgcactgattatcggctgtatcgtgcttggctttggtgtgtatattgaaattctggctgatgtcgttatgcttccaggcgaatcatttgtccgtgcgattgtacagacatggaacactaattttggaacaactaagattatatttaattcatcaagccacatttgtttccagaagattataaaaatgcggtttctgaacctgaaactgctgcttctgctgaagcttcagaccacaaaaatgttatcgttatcggcagacaatatggctgcggcggtcatgacttaggaaaggctcttttgtcattggtctcttatatggaagaagtggctgaataccagcatctatcaacagttttgcaattgcatgtgttttatatcctgcatctgctacaagtgtttttattcctatgtcttttatcttattatacaaacttataaaggttctgctgtcatgcatatttccaggattaactgagtaaccaagaatccagccgaacttatcacatgcagtttcaattgaatatgcgaatacatgcttatgttcgcctttccggaaccatccgctttctggatcagttgtgctgcacttaatagttttctcgtcttttggaacatctgttgtaaagtctttcatccctccgccagaagatggcttatcattatctttatctgaatccttcaaaggcttctttccatgcgcctctctgtcagaatttatttcttttttcaagagttcttcataaaacaaagcttcttagtgagcaatctttgctctcatttttttactgttagcacatgctttcacatgagttgcatcaacaaacacttctgttggatcaacgaatttatacttataacattctgataagatatgagaaaagatttgttcaaacaagtctgtatccttaaatctacgagtgtagtttttaccaaatgtagaaaagtggggaacagaatcattcatttccaatcccaaaaaccaacggtaagcaacattaacttatatttcttttatagtctgccgcatacttttaattccataaagatactgaataaaaggaatctttataagcattactggatccatactaggtcgtccaaaatcaggagaatacttatcctgaacaaggtcataaataaagttccaatctattgctttatcaatcactcttaaaagatgatcttttggcactaaatcatccatacagaacatctgaatctgttctctttttttatctggattgactgtcatcataaagcactcaccatctggtttttgatataataattatatcaaaaaaatactataaagtcagtatttatctgcatttgttacattttaattgatcctgaaatgcgaaaagtccgaggctttcgcctcggactttgtctacagtctgagttgactacaatttgtagtcaaccgactatattcttttttaggaacgtttttaagacactccaatattttactccatgttttctgctattaaaaatcagaattcctcatatccccatctcttactcaaaaattttcgtttttatcatgtcctacaatttttcttaattttggggcaatgacacatagaaaacacataaaaacaaaataaactgccatagcacttaacactatacctatcttcacatttcctttatctataaaagataatacacaatagattagtccaaatattactgcagataatagattcctaaatatccgattttcaattattcttttcataaccattttatccctttccctattctggacaattcttgtcttctcaagccttcgtgcaatccccatcaccatacctctcttccaacaggttctccccaatcatattcaccatcaagcattaacctgccattatactctgccgctctttcttctaaagttttatgtctgaaaggttttgctaatgtaatcactccatctgatactgtaacttctaacatttcgtttaatgctattccagcactttttaatatttccttagataatctgattccctgactatttccccattctcttacttgtgcctgcatacaatcacctctcttctttgtatatacttagtgtatataaacattagagatttatcaatatatttcaaatcaaaatcccatcttcttaagtcccgcaacaacctgcacataaaattcccgaacatcaaatcctttaatgttctccctgttaagatctatcatatcaccatgcgatatgcctcttttgccgctgacagtaagaaactgatagttctgtccccatctaaaggattcttctccaacaagtccgtcatttggtccgtcaaaatatttcaccagtggatatgtaaaattaagtggaaatcttccagaagccggatggtttagtttagaaccaactgactgataataaatgtctggattatcctttatttcattgttgaattcactgcatttttctgatgtaaggtcatatacggcagcaagaaaatcagggttaatgtctccaagtttagccgctccagcgttatatgcatttgcaaccatctgctgctgtttttcaggaattttgccaagaaggtaatcagcaaactgacagcccctgtgtggtgtatttatcgttgtaagagaagccacataaggtgcaatatctgtaagtgctatcgctgccctcatgtccagtccgccttttgaatgggcaattacatttactttctcacagcctgtcttaatgacaatctggtgaatcctttctgccagctctttagcactgtctcgcacggccgccgcactgttatgattgccataacaaatcactgcaccattagcctcaagctctgccggtattcttccccagtaattaagatgttcaaaatccctgaaaaatacgccatgcaccataagaataggatatttagtactgcatatccgctgttctttgcgctgcagatttctcttagcacgcattttctccatgcggacttcctcaccaactgtctttataataatatgaagcatgacaagatgtgcaacaggtatccatccgcacacgattccaagcactctccatctgattccaagctgctcagatgtcgcatacaccataataattcctatccagaaaataatgctttccacaagaattcctatccctgcccggataagccagtaaactggcgtttttactattcctgccggaccgccaaaccatttttcataacagcctgtaatacctaatataagatatattgctaatattactgtcgtccagcagaatattttcagcataattctgccaaagttacatactttaattctccccataattaatctcccctattgtttttctcaactttcttgccgccgaactcaccgggtgtctgctgtcatagacaagacatatatttctcttcggaatattatccttaagagatatcttcacaatctctttcttatcaatcgattcctgcgccattgtctctggtaagaatgcaagtcctaattcacattttacaagaggaagtatctggtctgttgtcgcagcctccgtatcaggctctaattcaaccccgtgcgacataaataaatctttatagaatctgaatgtcatagtctctctgccaaggcatatcagtggataatccgtcaattctcttattgataattcctgacttcccaatgctgtaaatgtagttcctccgacaagtatttcctgaaaagaatgcagcaccaccgtctttagtgatgaatctgcgtacacaggtgatgataccactgcaaagtctaccagtccatttttcaccgcatcaaccgcctccggcgttgaatgattatatatcttaagccggattcctggattgaccatgtgaaatgcttttaacttatcaagaagaaatatattaagcgcagtctcacttgcccctatggaaatactgccatgtgaaagacttgcactgtccgcaagctcttcttctgctgccataagctgtgtcatagccgctgtaacccttatatacagtttttccccctctggtgtaagctgtattccccggttatttcttacaaacagtgttgaattaatctgctgttccagacagttcattgcccttgtaacattaggctggctgcttcctaatgcctgtgcggctttcgtaaaattcttatatcttgccacataataaaatatcttgtaatactcaaaattaacatccataacttatcgctccgtaatatctgacatatcatattgttatagcatttatatcaattatagtttttacttatttctgccacaatagtataatctagccgaaaatgaaaaacaagaaggagctgatgattatgaaagaaaaaactatctttccaagagaagaaaaatctgaggttttatttgataaaattctaaatgacccatgggcttataataaacttttccagacattctgtaacaatctgttttgcaatgatgattctgaagcaatactttctccgcttcaattcacggaagcattattcaactgctattctaataaagacttatctgcatttcttatggctatcacgcaaaataccatgtttgatttactgagaaattcatttcttattccataccgcttcaacgctgatggaaagcaaaatcccataattatgaccgacgataaaggtatgcttcttccagaatttgctgattctgttcacgaaaaagactatcagcatttttataacatttataagaaccttgataataataaaaatatgtttcttgccgaggcttacagatacagtcacacatatggtgatgacccgtctgtagttgagcagcagattcttgagagaagcactggtatactgcttatccgcgaactgcctgacactgtaagaatgaaggaaaccgaggcagaggcctatagtgctgtatgggatcttatgcttgagcttgagaagaatcttccaatggcatatatattctatggtcaggattcattcgttgaacacaatgaacattttgatgaacttggaattttccttcctaattctatattcttacgaaaccttgaacaccatgttaagaaagcagaggcgattatatatgccaaggactaattacattgacattatggaaaaaaatcatatggaaattccgtggcacgactatacggatgccgacagcaatgcattaattgctaatgcagaccttatagaaaaagcctccgttatcggtcgtgtaggtctgattatgctatcatgcggcactggtgcatggcgtgtccgtacatctatgaataagctatccaaggaacttggagtaacctgtaccgtggatgttggccttatgtctattgaatttaactgctttgatggtaatgactgcgtatcacagtcgttaagcattgccaatactggtgttaatacctccaagctttacagaatggaacagtttgttgacaatttccctaatgaagaggcccaccttacaggtgaaatgattcataaaaggcttgatgaaattgaacagatacataccctgtattcaccggtcaagcttggacttgccgccgctcttgcatgttgcggattcacatttctgcttggtggcggtcctatagagatgcttttcgcattcattgcagccggaacaggtaatcttataaggacaaagcttattaaacatcattttacactattcatgaatatagcagtttctatatctgcatcatgccttatatatgcaattctgcttaaacttgctattctgatgtttaatatcccttttgtacatgaagccggatacatatgttccatgcttttcataataccgggatttcctttcatcaccagcggcattgaccttgcaaagctcgacctgcgatcaggtattgaaaggctgacatattcaataattattgtactggttgctactgtgtttgcatggattatggctttattactacatttacagccagaagaatttacaacattacatattggaaaaatgttacatctgatattaagacttgttgccagcttctgcggtgtgttcggattctctattatgtttaacagttccgttccaatggcggcaatggcggctcttatcggttgtattgccaataccctgcgtcttgaactggttgattttacaggcatgcctgccgctgctgccgcatttattggtgctgccactgcaggactccttgcctcatttattaaaaattataatggatatcctagaatatcacttacagttccttccatagttattatggtacccggactttatttataccgtgcaatatacaatttcggcataatgtccctgacagaagcagtctcatggtttacatcagcaattctgataattgttgcacttccgctcggacttatatttgccagaattattacggaccgcacattccgttattgcacttaatattaactatacatttatataaggaggaattattattatgcttacttctgtaacaggtattaactggggcgacgagggcaaaggtcgtgtaattgatcttcttgctgaaaatgcagatatagtcgtcaggtatcagggcggcaataacgccggtcacaccgttgtaactaatcagggaaaattcgttcttaatctactgccatcaggaattcttcacccagatgtaatatgcattcttggtgatggcatggttgttgaccttgaacatcttgccaatgaaataaaacagattgaagacagaggaatacagattaatccaaaacatttgaaattatctaaaaaagctacaatatctatgccatggcacaggatacaggatgaacttgaagaaaacagactggaacgaaccggctctgctttcggttctacaagacgaggcatagcatatgcctacagtgacaaatacagaaaaaaaactctgcgtctcggcgacctgcttcacttagatgatacagctgtacaggcaagactaaaaactattcttgaatccaagaaccttgagcttgccggctgctatcatcaggagccaatgtcttatccggcacttcttgactggtgcagggaacaggctgaaaagttcagcaaatacatatgcgatacaggcacatttatagacaaagcattatcctgtggtaaaaaagttattcttgaggctcagcttggtgcattaagagatattgattacggtatcttcccttacacttcaagttcatcaactatatctgcctatggtcctatcggtgcaggaattcccggcagacacgctgaccatgtcgttggcgtgcttaaagcttattctacatgcgttggtgcaggcccatttgttgctgaaaatgctgtttcagaaaaatggcagcaggacttaagagaagccggaggtgaattcggtgctgcaacaggccgtcctcgccgtgttggtccttttgatgcagtcgcaagcagatacggactcagatgccagcatgcagacaaaatcgcactaaccaagcttgatgtattaagctctatgaaagaaattcctataattacaggctacaatgacccaaacggctctctggttgaatttgaccctactgataaccttgattcatgcactcctgttatatacaaagttcccggctgggaagaagatatatcacattgcaggacatttgacgagcttcctgctaatgcaaaaaattacattaaaacaattgaggatatgcttcatgcagaaatcaactttatatctgtcggtgctaagagagatgaatatttattaaaaggagagtggctatgagacatctgataacccctatggatctttccgttgaagaaactatgaatatattagatcttgcggagcggatatccattggaccacaattatataagcatgttgccgatggcagacagcttgctacacttttttacgaaccaagtacaagaacgcgtctatcttttgaatccgctatgttaagtcttggaggacagacgctaggcttttcaagtgcagctcagtctagtgcttccaaaggtgaaaccgttgctgatactgcaagagttgtaagctgctatgcagatataattgcgatgagacatccaaaagaaggtgctcctctgcaggcatcaatatattcacgcattcctataataaacgcaggagacggcggtcatgcacaccctacacagacacttattgatatgatgactataagacagcgtaaaggaaagcttaataacctgactatcggtttctgtggcgacctgaaattcggacggacggtacactcccttgtcagcagccttactcgtttctctgataataaattctacttcatatctcccgaagaattgcggattccagattatctgagagacgatgtattaaatccatctaattcaacttatgaggaagtgtcaagccttgaagatactcttcctaaacttgatgttctgtacatgacaagagtacagaaagaaagatttttcaatgaagaagaatatctccgtttaaaagatgtctacattcttgacgaagaaaagttaaagctggctgataaagatatgcctgttcttcatcctctgccacgagtcgatgagatttcccttgatgtcgatgacgatccaagagctgcatattttgaccaggtccagaatggtaaatatataagaatggcactaatcatggcattgcttggtattactaatccggtaaccggcagaacagttcttgatacacacagcctataactaaacattccatataaaaactgccatccgctaaacttaatgttaaacggacggcagttttatgtttttatatatttatccccagacttcttccggttctgcgttatgctcccctgtccttaaaacatccggcatatgcataaccgacaatctgtccattgtcaactgccttgatatatggatatctgtctgaaatattcacaattctttgtctgaattcttctacagaaggcacatcatattcaaatgttatcgctgtatacttaacatatggtgcatatatattgagaagttcctctgcatcttcaattgttacattctgaatttccataattttctctcactgtttcaagattagttatcaatgcatatattactcttccatatcgtccattctcaacaattcttccatggtcaaacacctgtatatgaccgccatctgctttctgcatataaaaatgtgtataaccattagtatgtccttcatctatctgcttccatatatccgctataacagcttcccgttcatccactctaatgatattacggaaacttctttttgtatatacaagcagttcatccatgttcttacagcctgcaaatctgataaattcacggtttgcaaaaagaatttcatcatcattcttatctgctttgtatatgataaatgctcctggaagattttcagaaacatctttaagtgcaaaaccaagctgtgtacgaatatcctttctgagtccgttcttatatgccatgcagccattctttccacgaagtttcacctcataaagtgcagtatcagcacaacgcatgagctttgatggtttgtcagcatgaaccggatattcagcatatccaactgatatagtgaactgatactcttcaccttcatatttaaatgaccgttttaactttgtgaattcctccagtttttccttaacatcagcacatgtacaatctggcaggaaaatacagaattcatcaccaccgtttcgtcctaaaagcacatttttatcaaaaaacttctgcattccctcggacaataccttaagtgctacatcgccataagcatgaccatacatatcattgatagtcttaaaatcatcaatatcaaattctactcctacacagtgattatccggattctgcttaagataccttgttactttttcatcatatccatgacggttatttattcctgtcaaagcatctgttatagccagcttcttaaacttctttctatgttcgtcaagcacaagcagagcacatgtaaaccctgtaagaagcagtacaataataattccgcctattccaaccgcatacagatatattctttcagactgagtcttatatggcattatatcaagcttccacttgctgtctcctatatcaaatgtatacgaaacaggattctttaactcttcttccgagccatacacttcttcaaattcagactcccacggaaaagcagttttatataatgtataattataaccaaaatctgaaagtgctttcattgaatcagcaaaaatctcaggaacacggattataactattgtaaatccccagaaatcttcatgtccgttttcttcaatgtatacaggttttcttacagctataccatattctccctgctttaattgaaatggtccctgcattgtaacaactttattatctcttccataacggcatatttcaccacgatttttatcatttaacagatcaatctttcccgcatcattaccttcctgaggataaatatctgtcacaacaccacctggtgcaatctgtatactctgaacagaatctgtcatcatctcctctgctatctcatagaatttattaagctgtccatcatcacttataattatctgtcttaatgtgtccgaaacgcctatgcctttcataatatctgtcttcatacgctcggcataagtcattgcgttaagattcgccattgtcctgttctgcttattctgttcgttatttatgctgcatacaatacctgccacagcactcattccgattataaatacaactagtgaaataataatatttttctttataaaatgcatctcattcactccaaactgctgatttgtaaatatttgtttattatatcactttaaatattattccgcattaaaaatgacgcaggaatttcctgcgtcattgcatatgtccttatatgaaaccgctttatatattaaggaaatcttttctataatccaccttaaagaattctgcaagcttaatcatatcttcgtcttttattgtattctttctctcaagtccagctgtaagcatatatatctgtgcagctttttcaacagtttcaataagtccaaatgtctcatcaagagtttttccagcaccatatattccatgcattgcccatataacaagtctgaattctttcattttttctgctgttgcctcgcctatttcattagttccgcaaagcatccatgggagaatacctacaccatccgggaacacaactatacactctgtacacatctcccaaagtgtatgcgtaaatttcttctcgtcaagttcatgaacataattcatggcaagtgtgttagttggatgtgaatgtataacaactctgttatctttatcaacagaaagtcttgccatatgactcataagatgcgctggtaattcgcttgtgaattttcctccatccttatatccccataataactgcgctgttgttccatcttcagctattcttattattccaagattattctctggatctgtctttacatttttaaagtacttacctgtcccggttactataaatattctgccaataagtgcatctgctttgaaacccgtcggaatctctcttaacacatgattaatatcaagatattgtgcaacttcttcttcatcaagcatatagctgatattaccaccatttctttcgtcccagccaagacgatacatattagctgtagtatcacacatttctttaacaaaaggtgctgttaatatatctttcattatcgtgcctccaatactttcttttcgtaatccataacctcactgacataatcagctgccacattttctctattaagatattcctgccatatatctccaaatggcataatctttaattcttcctgtgctgccataagttctgtgaaccttccttcgttctgaagattgcgaagtgattctggctctaacaatgcatacaaaagagctttctgaacacttctcattccggttatccatgcagatattctattaattgatgcatcgaaatagtcagttgctataaataccttgtcaagcgcatctgctctgacaatttctttagcaatctctctggtttcgtcatcatataaaactacatgatcgctgtcccatcttacaggtcttgtaatatgtaatgctaagtggtcattgaataaaagcattgatgataccttatctgacacaacctctgtaggatgatagtgtccattatccataagtggggttatgcctgctcttgctacataattcatgcagaattcagacgaaccaactgtgtatgattcaacgcctatgccaaatactttagattcaagacacacaaacactttgctcttatcatatggaattgaaagaatttcatctaaagattctttaaatctccttcttggtccaagtctgtctgccggaatatccttatagccatccggaatccatatgttcattacacatggctctcctgtttcattagcaaaatattctgatatctcaatacatctcttgccatgttcaatccagaattttcttacttcttcatctggtgaggataatgtaagtccatctttaaccattctatgtgagaaaaatgttggattaaaatcaattcccatattgtatttcttagcaaattcaacccatctggtaaaatgttttggtttaattgaatccctgtctgaaccgtcatctataatggcataactggcatgaaggtttagcttcttctttccaggtacaagtgtcaatactttgcttatatcctgcataagctgctcaggagtagctgctcttcccggataatttccagtagtctgtataccacctgacagactttctctgctgtcaaaaccaattacatcatctccctgccagcaatgcattgataccggcacattctttaatctttctaatgcagcctcagtatcaactcctatactctgatatatcttccttgctgattcatatcgttcattagtcatatatagcattatcctccttatataatctgaaatttattatcttttctgctcaaatcgtttaatatcaaaggaatctcttacacacgctcttgcttccttcaaattcttaaacacactatctgctatcatctgcgccataatatttccaatagcagtagcctctgctggtcccgctactactgttttcccagtcgaatcagccgtaagctgattaagatatccagcattagcacctccacctattacatatattgcatcatatgtaatgtccagattcttttctatctgcataactgtatctgcataactgtcagccagactcttatatacaactgctgcaatctctccggctgtgtcaggtataatcaaatcattattattgcagtatgatttgattgcctctgtcatattctctggtgcaagaaagcatttattattaacatctatccttgatgttatatagtctgtcttctctgcttccttacaaagctctgcaaatgtatatctgtcttcaaattcatgccttacagattgtataatccagaggcccataatattcttcaaatatctaaatctataatcgtatccaccttcattggtaaaattacatacctggcttttctcatcacatcttgcctttagaagttctgtccccatcagtgaccatgttccagaacttaaatacaaaacattatctgctactgttggaacagccataactgcggatgctgtatcatgacttgcacacataacaacccttgtattgtatccaacaatcttcttaataccatcagttaattctcccagtattgttcccggctgcttaagctccataaacatatttctgttgattccaagcatatcaatcagttcataatcccattgtttagtttccggattaacaagctgtgttgatgttgcattggtatattccgatgctttaacccccgtaagaagaaactgaaaataatctggaagcataataaatgtcttcgcttcctttaactgttcaggtcttataaatttatccgacatgagctggtaaattgtattaaacttctgtttctgaatacctgttctcttatataattctttttcggatatcaccttataaacttcttcatccattccatctgtacgttcatccctgtatccatatacatttcctatgcatttgtcattatcatcaagaagaacataatcaacagcccatgtgtcaatcgacatgcttactggaattttcccgagttctttacattttttcattccttcaataatattggcaaacaagctgtcaacatcccataacttgttgccattatcattaatcatgccattatcaaaacgatatacctcttctattgtcattctgccgttgtccatggatgcaagaatatgtcttccacttgaagccccaatatcaacggcaaggtaatataccggtttcatacaatcttacctcctgtattaaattcatgtattaatcaagatgaaaaacacaccttaaatcatcactcacaggactgtcgtctggattaaccctcataagaggcgccatatatttccaccactttctgttgatctccgtgtctgctgactgtgcccacttttcttcatcttcaatctctatatatccatataatatgttagtttcatcatctagaaatatagaataattatgtccgccatattcgtgtatcattgccttcatttcaggccataattcattgtgacgcttttcatattcatcagcacatccagctttaagatacattttaaatgcttttcttatcattctgtaatgcctccactaaagccagtattgtaagtgactgtccatatgccataggcgctataagtatgttcttataatgctctgcatcatatcccataccagttcctccagatacattaagcactgttccatctgaatcaatatttttaagtattgcatttatcgctttgtcagcaacatctatataagaatcatcaagtattcccattctgattccctttaatataccggctgtaattgcagcacttccggatacttcttcataacttgatgaatctgtaagtactgtatgccataatccgcttttactctgcagcttcttaagagcagctgtctgggctttataagcatctattattatctctttaacaccactgttaagtgttcccttaaacatatcaacataatcaagaattcctaatgtgaaccagctattccctctgcaccagaatataccaccgaaattattcatttcattaaatgtccagccatgataaaacaatcctgtcttgttgtcgcaaagatactttatatgcataagtacctgatgtattgactcatttatccaatcctgacgattatacttctgacccattttattaaggaataaaactgtcataaacagagtatctatccacatttcattctcattgagtcttactccctgtctgtctccattcgcacttgtaacatgctggaatccacgttcctttgttcttggaaggcagttcataagccactctgcccatttgatacacagttcctcgaactgtgtatcattgtaatagttatttaattcaacaagagtaagtaacggtgttgttgtgttgatattctttgatggaagaccttctgctatattttctttaaaccatttgtaaagaaattctctatactcatcattgccattaatctgcattatcttaagcaatccatataaaccgaccccctgtggccagtcccactctttaattccaaagtctcttttaaagaagcctattgactcgccgcctttttccagctcttcatcattatcaggtctgccaagattcataagcttatcaattacaagattaagcttattctcaatttctttcttgtcaggttttttattgttcatatatatgtcctccgtttttatcttatttttatcccaacaatccaaatactgttggcagccacatactaagctgtggtacaaatgttacaaaaagaagtgcgaccaaaattgctacaaagaatggcaccagtttcttaattacctcttctacctgaagatgcgatatactacaacctacaaataatacgcttcctacaggtggtgtaattgttccaattgaaaggttcataaccatcattacaccaaactgaataggattcatacctaatgccttaactacaggaaggaatataggtgtgaatataagtaacgccggagccatatccataaatgttcctacaatcagaagtatcaggttaataattaacagaataacaatcttattatcagacacacccagtaatgctgcacttatagcctgtggaagaccagtgaatgacaatacgaatgacaatactgatgaagctcctattataagcataacaattgctgtcataactgctgtttcttttaaaattcttggaatatctttaatcttaatgctcttataaacaaacacagccagtataaatgcatacacaacagctacaccagatgcttctgtcggagtaaaatatcctgataatataccaccaataataattacaatgaggaaaagacttggtatagcatcccagattgtctttaatacaaccttagctgtaagatgatctctcttgattacatatccatgcttttttccatatacgaaagcaactaccatacacagtaatgcccataataatcccggaatccagccagccataagtaatgctgcaactgaaactccaccacttgctgctgaaaatacaatgaatgaagctgttggtggaattaactgtcctactggtgctgaagcaacatttgctgctgctgaaaatgccctgtcatatccctgttcattctcaagtggctgcataacaccaccaattgctgttgctgctgcaatacctgagcctgatatagaaccaaacattgcgttacctgcaatgttagtcattgctaaagaacctggaaccttacctaaaacaagcattgccagattaataagcctttttgctataccaccattactcattaacagacctgcaagtacaaagaacggaactgcaagtaatgtgaagctgtcaatacctgtaaccattttctgagctgatataaacacaccaaaatgtggtgtaagaaacataattaatgtaacaagtgatgctgatataatactgaatgatactggaacactaaatgccagtaataaaaagaatactattatcaatacaattgctgcctgtatttccatattgcctccttctgcatatatatgcattattcaatcttaattctgtcttaatttcttaaaatgatctacaatcttaaacactccgtaaataaccatgagaactccacataccggaacacatacataatagacctgcataggaatctgcatagctggtgagagctgtcctgctgcattagcagtaaccataattccaccaataatcattactgaaacacttaaaatcataataagcacatctattgcaatctgagcaagtgtttcattctttggcttgaacttcttaactataagattgatagccaaatgactgttttgtccatatgcgtaaggaacgcccatcattgtcagccatatgagcatatatcttaataattcctctgtatatttgcttggattatgtaacacaaatcttgtaattacctgccagcagcatccaagtaccataccggctacaagcacctctaatattatttcaactactttattcaaatacttcatgcttttctcctttcttcctgcaaaccatgggcttatatgcattaatctgcatatttctgaatgtcatcatatagcttcttatatgcttcgcccttgttatagaagttggcatgtattggctgtactgcctcaataaatggtgtcttatctatatccttatatacatgcacgcctttactttctgcatgttcaatggcatcctccatcattccattataaagactcttaaagttatcatttgtttcctcaagtgcttttataagactctgtctctgtttctctgacatcttgttccatgtcttagtacttataatgaatatatctggtgaaaactgatgctctgtatatgtataagacttaacaagatcttcatgtccatcaacagtaagagcaagctctgtgttctctgctccatcaacgacaccctgctgtaatgacgcatatgtctctgatgcagccataggaaccggtgttcctcccattttctcaatcatatccattgatgttgaacttggcattgaacgaattttctttccactaagaactgatgtatctgtaactggaacatcatctttaagatagaaatttcttgcaccattagcataatatccaacagctatatatccatcatctgctgtatcagcaaataattctttaactgcttcactattttccatcgcattataataatgctcctgattcttaaacagataaggaattgcaaatattgcatatctgtcatcaaactgacctaatgtgttagagcttacttttgccatatcaataattccggctttaaccatttctatttcttctttttctgtaccaagaacaccactggcaaatatcttaatatttacctcatcaccagattcttttgcggcaaaatctgataccttagcaattgaatccgctatttctgaacccgctgactgattatgcgccagctgaagaactaatttatctgatgaattaatccctttaaccttaataaatgttactattacaataatgagacacactgcaacaaaagctgtgcctattatctttttataagctttcataaccttctcctttcttatgagacccctttattgttgttactttttatttttgaaatccgcgcgtatttcaaggcttgtttcataagccatttcttatcttgtaactggattatatcaccgcaaaatattacttttcttgaacaatattgctatatatgtttgattttttaaatatattgctctatactttttaattaataataattaattgtgaggtattgtatggcagataataaaatcactttttttggcaaatgcgatggaatatccgtagaacagcttatccgttatagccggttcaatatgaatgtgaagcattttcacaaccagtatgagatattctacataattgaaggagagcgccagtttttcttcgataacaaaagctataatgcttatgctggagatattgcaatacttgataccaatctggttcatactacatgctcaatatcagatgaggataaaggctacaaccgtgttattctttacattgattatgaaaagatgtgtgattttgacaaaaagtatcctggtcttaatcttgttaattactttcataataattatggcatataccacctcaatgaagaccagcgtatagcatttcttaatctatacagggatttaagacatgaattaaccaaaaagaacagtggatatcagtcaagggtggaaattgcaactatatactggctgtataaactgctctccctgaaacatgacagtacgcagatacatgctgtaattaatagcccaaaagaattatctgcctctaacataagtgcctatcttgacgctaactacacaaaagagctcgcccttgatactatctcagacgagctctttatgagcaaatattatatgtgccgcatatttaaagaatacactggatttactatctccgaatatgttaatactctccgcattaagaaagccacccagattctcgaatcctctaatctcagtatatcagatgttgctgctgagcttggttttgaaagtgcgtcatatttcgaaagaatatttaaaaaaataatgaatgtaacccctttaaaataccgtaaaactcaccagtctgttacaatcgaacatgaagagctcaacacacttgatgattctgattatattgactgattatacaattcattaataagccaaatattatcttctcatacccataccacagctcattgatgagtcattgtctggtatttctgagacatatcttgcattaaaggctgcattgacttctgaaatctctttcaccccgtcaatgtagtctttaaaatatgtcattaaatctattccgctgctttcacagccttctgtttcttcccattcctttattaactggattctttctgatttagttgtgtcttttattaatgtgcttttcattgtgtgtctccttatcttaaaatctatcctttataactcaaattattatatacagatgcatctggcattgttctcatacttggtcctactacaacaaatgtgccatgactattgtaatagctgtatcctgatacctgatatacaggtggattgtcatatacaaaatccggtccggttccgccatatggattaccaccaccatttacattattaactgcagttttcgctgtatatcctatgtaagccattgctcccgttaatgcaaatggtaatagtgtaagtaatattacaattggatacatagctatatttctcatagcaagataaaactgactcttatgtgttgtcctgattataacatatgttattactgaaattaataatactggaacaagcaatataattattggaatctgtatatcaaaataaaatttgactcccattggtatcgcttctgccatagccagtgcaatataatacattacattcatcactcctgatttccagttgtggattaaccatttaatcttagatgatgacttaacaacaagcataaaaataataaatataactaataatggcggacacactatcattagaataaacatcaaaatttttattatatatcttgaattatcagcaaactctttatccttaattttcttgttttcaaatttttctttttcttcagccgttaaatgattatatatatactcatcagcttttttcttgttcttctttatttttcttatacttgcaattccaattaccaacaaaaaagtaaatgcaacagcagcaccaaaagcttctcctccatttggaatatagggtccgattgccgcaaataaaaaagtcataaaaaatataatatgatattttatatcagattttttctttccttctgctataatagggataattactctatcctgacctttttcttcctgcttatatcttactttttgttctggtactggtttttgtacatgtatttcattttcattctttgacactctttttaacttattaataaatgcttttccaactgatgacttaaacacatctccttttttattcacggcatccaaaacatttttggcatcctctggattattaatatcatatttttgtttaatcttaagaataacctgcaattcaacttttgcccgctcatattcctgctgcgtatcaaatgtaaacccacccagtgaatattttttatcttccataatctgtgcttcatctgcgaagctgccttgttcgtaaatgtaagcgccacattagatgatggctcaacgaacagttctgttataagatacgctattatatatgtaagtacaaatgtttttcccgaacctggaactgacgcaacccttatgttgccttctgtctgtgttattgcctctgtctgttccttcgttgccttttttcaaccagataatccaagaaactacgcatattctcaggtaaatcgtcccttgaaccttctgcatttacaattacctttgttgcttcatcaccaagtgtcaaggagtggttctgttcacagatattgttaaatgtgtagattggaagatttttaccaaagacatctttcagacatataaatataacatatgtcttcttaatatgagttattatcattactagataatactaatataattacactattatattaccacatttatatgaatattgatatcaataatcttatatagtatatgaatagtttgttatctaatctgtctctggtatgataatgtaatatgttatttcattaatgtgaattaattgaatcaaatgcattaaaaagttctgaaaacgcattcaaatctaaaaatctgaggtcgacaatgtcgctaatgcgacagtcagtatcatcaattctgaatatacaaatgatctcttgggaataagaacctcatcaattactgtaaaatcaatgcattctttaggaatttctcctacagggggatagaaacatttgacttcatcagtatcaaatgaaatacttgtaatgtaatcatttaaggatataaagggtgtattttcaatgcaatatggtagattataattaatagataagaacttatgtgttaaatccagataggatttaataataaagaagtgattaacttgaaatttccagtgcagttttatctattaaatttcacaaaaatgcaattttatgaaatttctatctcactatattttcattataatttgaaaaagtgaaaattctatgctaaaataacattagaaatttcattttccgtttttcggaggaaaggaaacaatcatgacaaatagagctggaacatttgtaagtaatctatcaggcgaaatggcttataaatcttttcgcccggctccccttccacccaatcctcctattgagatatctggagagcttcttacgaaacttattgatgctaataagaaaatagcaacacttgaaggattatcatctcgtatacctaacatggggcttttcgtttccatgtatgttagaaaagaagcacttctttcttcgcagattgaaggcacacagtgtactcttgaggatatcttgaatcctcttattgaaaataacactaatagagatgtttctgatgttgtcaactatattcgtgcaactgaatttgcacttgagcgactaaaaacattgcctctgtgcaaccgtttaattaaagagactcacgcagttcttttggaaagtgcgcgaggacaggaaaaaaatcctggggaattccgatattcgcaaaactggattggcggacagggaagtactcttaagaatgccagatatattccaccaaacccggaagatatgttaactgccatgtctgatcttgaaaagtatataaatagtgatgataccctcgatccattgattcaggcagccttaattcactaccagtttgaaaccacacacccatttcttgatggcaatggacgtgtaggacgactactcattacacttttcttgatggaaaaaggtattttgtcaactccggcactttatatttcatattacctaaagatgaatcgtatagaatattatgatcgtatgactcaggtacgacgtactggtgattatgagcaatggatttcttttttccttcaggcatttgcagattctgcggaggatgcaatccatacaattgaccgacttactgaattacatgataaaaacttaaagttatttgatgctttaacaaagagacagcgtaccagcgcccttaaagtatttgcctatttggaatctaatcctattattgatattcagaaaactgctactgcacttgaaatgtcgtataatactgtggcaaaggtagtttctatcctgattgatgatgaaatattggagcaaacagataaatctggaaaggctaagatttattcatatattgaatatcttaatatccttcgtaaggacacctaaaaggtaagtatcaaacagatgacatttaattagaattttttataatgcgaaaaatgcccaccatcatcatatttaatggtagtccttactaatgcagataccacaacctgattacattcctttgttacatcgaatagttttccgtttggcaaaggaatagcttcagtttccaaattaaagcccaatagatttcggactttattaaaaactgttgctgatgggaaataagcctgatgggtggtatcttctttgaatttgtaatcttcaagttttaaaatgcctgataattcaaaaaaaatatccttttgggattttccctgaatagttttgtccatagacaacctccttttctagcctttggcttaatatttttctatataatcagcatggatttaagcaataaaaaaagcacggaaaatccgtgctaatacatgctgaataaatagctcctgatttgtatgtcacaagtccatacaaatgacaaattctcaacaagagaataaataggaattactgatataatatgaagttatcatgggtataaactaaacgcaagaatataatgatattttagtatgatacataataaatgtattaattgatgtttctcatatacatggttttgcgtccggctccggtttttataatagctccttcttctacaagttttttaagtgcagattcaacagaggagctgccaaggctgggacatgaaaataaggcatcctgttttgaaaattttccaagcgtattttccgtgaatgattttacaatatcgtaagcactgctcttctttcctgtttttgttgcgtgtttctcccaaacgttacatctttctcccaattataatatattttgggagaaaaacaaaagaaacgggagtaacattttactatcttatatattttccacttaaatttgatttatttattgtcttcattattctgttcatgaaagttgaagatacaccatttttggaggggcattcaacagcaatgcagagcaagggaaactctgaaaagaatgattccttattcccttttactccctttgcactaaaacccaagtgctctgctgctttaattacaccatatgcattagttccctgtttatctgttcctgcaacttcacgaatctgggtaatacctatcttgtaaccattctgtttacaaatggtcgcaagacatgcgacaccacaatcagtaatgtcgtgctgttttatacaataatatctcatcatttcctctattttctatttttataacaacgcatcatcctattactaacattagccaagccataaaaatactcaacactaaatttacaataacaaatatactagtgtatttctcttggtatcgttttaaatcactaattttctctttctctcgatcagtcattctccatgttgctggaaataacgctgcaattgaaaaaattataaataataaaattgcaacaaaggacaaagtaattactacacccatatctccatcacaaaaaagtcctttatatatactagatgccagaatcaatacaaaacatacaatttctaagcatttttgccaaatattaaacttgccttccatttttatcacctccttttttctagtgtaccacataaatattactaacaccatatcattttttatcaataatttagtctagttgaacgatacaccatttttggaggggcattcaaccactatatttagtgcaatgttttatttattttctaaacatagataagtgctctgttacaaatcatatttttgcataatatgactatttgttccaactattttttcttgataatccggttcacccgtcaccaaatatatattattatattgcttctctgttaagcgtaaaagtctcaccgttccggttttaggtgcatattcttctattcgtctgaaatgtttttcggatgctttccggttttgcactatccgcatatacacttccggtgcaattcgcaaatagccatctttatgtaaaaactttttaagctttgtatactctgttttggttccccatttctctgtcggactaagaataaaagtaatctcattccgtaatcccctccatactttcaaaatgtacttgtccatataataaatcctccagtataatatattcgcacatacgtcacagttctccgattgccacattctgttatatcttgttatcagattttcttgcccttgtgtttacccttatcagcttccaagggaagaataaaacagtgtgaaatcgtataataagttaaggtgagcattttgcgataaatcctttattttcaaggcttttggaggattttattaaaaccctgtgggggttaataaccacttataaaattgtggttttcaaatttagatttgccggaaccacaggctggagaaaaaacactgccggatggagcgttagatgttacattaaaagatgtgcacttttcttatgaagaggacagagagattttaaaaggaataggcttaaatcttccggcaggaagttttgtatcactggttggtgaatccggatgtggtaagagtacgattgccggaatccttgcagcaaagaaccggggatataacggagaaatcatcatcggtggcgtaccgcttaatgaagtgaatgaaaccaatctgatgcagagggttgttctggttcgccataacagctacctgttcaaaggtacagtagaagaaaatctgaagatggcaaaaccggacgcaacgaaagaagagatggaagctgtccttcagaaagtgaatctcttagggttcttacaaacacaggatggcttgcagacacagttgttggaaaaagcaagcaacctgtccggcggtcagtgtcagagactggtaattgccagagcattgcttcggacagacagtgcggtttatatttttgatgaagctgcatccaatatcgatgtagaaagtgaagaactaatcatgaatgtgattcacgaactggcaaagacaaagacggtacttctgatctcccacagactggcaaatgtcgtgaagtctgacaagatctatttcttaaaagacggagaaatcaaagaaagcggaaagcatgacgaactgatgagccagaatggtgcgtacagacatctgtatgaaagccagatggcactggaaaactatggaaaaggaggaatggcataatgagtgaaaatacgaatacaacaaaacgcagaagtgccatccagatcatgggaagtctgattggtctggtaaaacccttgctccatatcatgctggcagcaatcatccttggaacattgggttatttatgtgcaatcttcctgacgatactggcaggacaggttatcatgcatggtcttctgacaggagtagccggaatgattgttccggtggacaatatgtggcgggtatttactccagtaaaaacgattattacagtcatgatcgtaattgcagtgcttcgtggaatcctgcattatgtggaacagtattgtaatcattttatcgcatttaagttgttggcaatcatccgtcacaaagtgtttgcggcactgagaaagctctgccctgcaaaattggaaggacgggataagggaaatctgatctcgattattacaaccgatatcgaattactggaagtgttctatgcacataccatttctccgattgcgattgcaacgctgacctcaattattatggtgatttttatcggaagatatcactggctggcaggagtgattgctctggtagcttatctgattgtcggtgttgtcatcccgatgtggaatggaaaacgtggaagccagaagggaatggaatttcggacaaacttcggagaactgaacagttttgttctggattctttacgtggactggacgagaccatccagtacggacagggtgaaaagagaaaagagcagatgtctgagcattccaaaaatcttgcaggaatgcaggagtcattaagcaaaatggaaggctcacagcgttcatttacgaacatggttatcctgcttgcatcttttggaatgcttgcactgacgatctggctgtacgacaaaggtgcgatgggattcgagggaatcttaacctgcaccatcgcaatgatgggttctttcggaccggtagtagcattatcaagcctttccaataacctgaaccagacactggcaagtggtgagcgtgttctttctcttctggaagagacaccgcttgtggaagaaattccgggtgacgtggaaacttccggtgcagagagcatggaacatgaatttacaggagcagaggcagagcatgtaacatttgcttatgataatgaggttattttagataactattcactgaaattacagccgggtaaaatcacagggattcatggtgcgagcggctccggaaaatctacgctcttaaaactgctgatgcggttctgggatgtgcaggatggaagtgtatcggtagacggtacagatgtccgcaagattccgaccaagcatttgagagatatggaaagttatgtcacacaggaaacgcacctgttccatgattcgattgcaaacaatatcgcaatcgcaaagccgggagcatccagagaagagattatggaagctgcaaagaaagcgtctatccacgatttcataatgacacttccgaaaggatatgatacagaagtcggagaactgggtgatacgctgtccggtggtgaaaaacagagaatcggaattgcaagagcatttctccatgaatgccctctgatcctgctcgatgagcctacatcgaacctcgactctttaaacgagggaatcattttaaaatcattgaaagaatcggccaagaagaaaacggttgtcctggtatcccacagagtatccacaatgaacgtggccgatgtagtatatgaaatggagaacggcagaatttcttaataaattcttagaactgatagggtatctccagaaactgcaaatcatgatgcatgccggatggaacatacaatcagcgaagaatctttccagaagattcaggaactggtgaagaagataaaaaagaagattcatcaaaggaacaaatggaaaaacaatggcaatgccattaagtcagttgttcgaagttttgttcgatagctcagttgttgtcaaatatccgatattttgaactcaaaaagccaaaaacagatatgccaaaaagacagatgctgtccatctgccaaaaagaaggatattcagttgcagaacttaccgatatccaaaatgaattgcgctgattccacggagaggccgttgaaactgccggaacctgtctttcactgcgtggacatatttcatcatcagccggataatatcgatgtgccttccagaatccctgcgcatgaagaactttctggctgtttttaatgctgaagaaaagtcaagttcatagagatacttgttgctgccatcccgtttctttttcaggttttcttctgccgcttcgtttgcgataaaaatgccgaaattgcattggaacaattggtgcctgacacaataaacttgcaataggctgcttttttctgttgagcaagaagtatcttttaattcatatttaggtggtttgtcaatagcaataatatttaatgcataatctgatttaagagtgaatttcaaattttagattttcaataatcatgggataaaaataacagggaggattatagttttcggaataaagccgatatataatattagaaacaataaataataaagaacggattcagagaaggaggacaaaggatatgtcaatgaatgtgaatacaacgggtactgtttatggaagttatcagaatacctacaaggcaggtacagtagataagaaaaaagaaacagcgaaaacaacagaaaatgataaggtcaagaaaaatgtgacagaaagtatagccgaaaaaaatctaagtaaagaggcacaaaaaatgcttaaagatatgcgtggctcaagaacagatatggactttatggttgcagattttgaaaatggtgataatgctaaagatattttagcacaaagtgataaagagtttacggttattttctcaaaggaagaaatggagaagatggcatccgatcccaaatattatgctgaaaagatgcatagtattgaaggtgctttgcgtatgtcggatgaaatcaatgctcagtttggatttgaaagagcatttggtaagacaaacggaatagaaaacagtgcagatactgatacaaaaataacaaagtttggtatttcttttaatagtgatggaactacaacattctttgctcaattagaaaaaacatcagctagtcagaaagaatatcttgaaaaaattcaggaaaagaaagctgcggagaagaaagaggcgaagaaaaaggaacaattaaagcaaattgaagtaaaaaaagctactgttcaagcaaattcaaaagatgaacttttggataaaattaaaaatattgaatggaattctatcaaaccagaggataataaaatcggtggaagatttgatttttcaatttagtatatttagatggggatgattacataaagtatgggggtagattcattatgagaaaacgttttttttctattattgtatgtgttgtcatgctttttacaatgaatgtcacagcttttgcggcagaaactcaggaaaattattcggagacggagaaaacaatgacatttgaaataactccgacagcattaacttctggatcatcacgacattctgttggaatgttaaattccttttttggaacaaatgatacagtggcaacttccgctcttggttcttttacaatcagcagcacatctgttccgtcaggctccacaatcagtaaaatagtggttacatccacaaaaagtagtggaagtagtggaaacatcgaattatttgttgctaaagatgaggataatggagatggcacatttgacagatatacagacagcaaaagttggaatagttctcttacttttgcagattttggcaattataatttaagccctgttggaaattattatgttcaatttgaatctacaaggtattcaacgggaactgttgcagcagcaacattaaaaaatatttatgtcacagtatactatcattaaaattttataatccccattctaaacaagcaaagatgttgttattcagttagcagcatctttgcttttaattgtataattgatatgactattgagttagaatgacattgatagcgatagaaagctatatattacagaagcagactttgataaaaaagcatttgagagattatataaattgaatattatataatcagaggtatatagaacatgcacagagacactatatttcaatatgaaacaatggtgcctgacacaataaaaacgcatagccaaacttcgctcggtataactgcctgattgtgtcgaaattcgtattttatcaattatatctgataaaactggatttgcggtattgaaaatcagttatagccgtggtaccatatagacagtttcagaagggaggctggtctacatgattaaacgagaaatttatatgagccgtatccgtccttttatcggaaatgagctgataaaggttctgacagggattcgccgtagtggaaaatctgtcatgctgagcctgatccaagaggaacttgcccaaaacggggtccaaccagaacagtttatttccctgaattttgagaacatgagcaatgcacacctttgtacggctgttgcattgcatgatgaaatccttcgcagaacaaaagaaatcagcggcaaggtttatctgttcttcgacgaaatccaagaggtggctgattgggaaaaatgtatcaactctttccgggtggagctggattgtgatatatacattaccggttccaacgccaagctgctttccggtgagcttgccacttatcttgccggacggtatgtggagttcgtgatttacccgttttcattcagagagtttatggagctgtatcacaccgtttacgaaggtgcagacgaaagacaatgctttacaaaatatctgacgctgggaggaatgccctatttgagcaaccttcgctacgacgatgccgccagtcgtcagtatttgcgggacttgttcaactccgtagagctgaaagatattatcaagcgaaacaatatccgtgatgtggatatgctggagagaattattgcttatataacttccaacatcggcactaccttttcttccacagccatttccaagtatctgaaaagtgaagggcgctccgtttcaccagaaacggtactgaactacatcaaagcctgcacggacgcattcctgttttatcaggtgaagcgccaagacctccagggaaagaaaatcctgaccgtcaacgagaaatactatgttgcagatcatggtgtccgggaagccgtgtacggtggcaacatgaaggacattaaccttgtccttgaaaatgttgtctacatggagctgctgcgccgtggttattctgtgactgttgggaaagtctctgacaaggagattgacttcgtatgtgaagatcatgggaaaaagctgtatgttcaggtttcctatctacttgcctcggaggaaaccatccagcgtgagtttggggcgtttgccggtgttcgtgacaatttcccgaaatacgttgtaacgatggacgaactggatatgagccgagatggaatcaaacaccgcaatattcgtgacttcctgctggcagaggaatggaactgaaatgttcttctttcaccagaagatatgcagaagttcttccaatgccgagaatgaaaaaacaatggtgcctgacacaataaatattatgatatgtctgtatttaaccgctgtatagaaaccgggaatgttctcttaatactggaatgttggcaggatgtccacccggcgcttgtcagtatcccagtgaaatgggaatacagctcgccgtatggacttttgtatgctctgaatccgccggatgatgttatgcagtttgaaaacaatggtgcctgacacaataaatattgtataaatgtcaatgctgttgtggtacatgttgtattctgcgtaaatggtattcatgttgtgtctcctttaaaccaataaaaatatagaagcatttcaatcagttcacaatgtcacttttattttgtgttatactgttttatataattttcttgcccttgtttttgcccttatcagagttcgtaaacactggtgggacgatataacgcaagggaaacaataagggaaagctcacctgcgataaactttgtgttttcaagggattgagagatatttgataataaaatataacagttattaaatcccttggaatatatgaaatctcaattcaaattttggggagaaagcatgaaatagggcttattatattcataaatgtatatattatgtaattttaaattttatatttaattttagattatccgcataaacactacacttttaaacattttgaggtataggaaatactcattttaccacagatttaccacgattgaatgagccttgatatgatgataaaacgactaagggagatagcacaaataactgtgcatctccctatattttctttgtttattccgttgattacttcatttgatttcaaactttaacgcctttttatatctcgttttttaagtccaatcataatagaacacctacctttttataacttcttctgttatcatattttcaaattccacatcagaataatccaatctttggattgacattgtaaatctgagcgtatcttctgataccgggaattagttgattttcttttgcatgttttacaaatatatctattctaagcaattctgcaatttctagatattttggagtgttcattttatccctttctctttgaaattttctatatcattcagaaattgaaaccacctactcaatacattatatttttcaatgttgagagaatagtatatctctaaacccacttttttagatgttatcaaatttccctctgctaatacttttaagtgatgtgaaatagtagctccagtgagttcaaaatgtttggctatatctccggcacataagcatttactttttaaaaggtaaataatttttcttctagtttcgcaagagagagccttaaaactagaagttagttctttctcattcatttcataaaattctcccagtattctagcactaagtcattaaatttatttttttattacacatttgtcaaaaaatattttttctaatacatcaaagttttgtgggttgttacactcaaaaatgctatgtctgttatctataaaaataattttatcacagaaatttgatactaaatctaaattatgaacagaaaataaaatcatttttccagtatcttttaaatcaaataatatttttttgataatggaagtactttctgggtcaatcgcattaaacggttcgtccaaaataatgttttgagcatttgacatgaaagctcctgcaagatatattttttgtttcattccaagagaataactggaaatagtttgttctaatgaattttccaacttcaattttggtatatagatagcaagcagttcatcaaacttttctttttgattataaagttcactaacaaattgtaaatattcttttccagtcaaatttaaaaacatatcctttgtatctggaacaaaagcatagtgatattttgctgtaaaatcggtagaaggaatatcatctatttttacacttcctttatccaatgtgctaggttggataatcgaatttaaaaaagtcgattttccaataccatttacccctactaaagcatatatacaggaattagttaaagtaatgctctcattttcaaaaattttatttataccataagacttacttaaattatttatttctatcatctgaaagacctcttttcatatacataaccacacctatcaataataaaatcaagatattcatcattgataatccaatagaaaatttaacaaaggaaaattttttccaaaaatacatttctaaaattgttaaagccacaatcatgactaaaacaaatatcttgctcatattcccatgtaataatgtattaggtgtgatttcagttctgggcattttatagtcaaagtacactcccataaaagagcaaagtatattcgtaaatgtaccatacagcaataaagatatatcaaaaaatagcccatttttaccaatactgcaaacaatccatgcacaaatgatgacaatttcattcaaaacagagcttatcaataccttagaaaagaatatcctactgtttttgactggaaataggttataatatgagatatttttatcactggtatatgatgtgctggaaattgtattcatagcacagcataataccattacaagaatttttagtacactttgaatttctatataacttccagatattctttttgaaaaaagatttaccaaaagatacaaagttatcacactttttaaattagagtaaaaaagtaattccttatttcttgaaactcgacaccattcattcaaaatatatggatttttgttaaaatacttagatatatttgcatgaaatctaggtttggtaaaacaatttaaataatggtaacacctaagaaaatatgatgcacttattttgatagtatatatataactcagaaatataatcattataaaaataagaacacttatcaaataattattttcaaaaagatggtatattccatttatcatcagcggtttttcaaatgcaaatataagtaaacgtacaatcccccacattataaaaagaaaaccaccatattgaaaagtaagtaaaatatatccgcaatatttttcactaactgtcgatataacaatagaaattgaaaagataaataaatcaattattatcaatatcaaagcacataatatggtagttaaaattaacggtaaaatattccacttaaaaaaatatatacttgataaaaaacagcagataaatgacaatatttgtattttaaataatcgaattataaccatataaataatatttgtaggattaacaggaaaatagagtaacttttctatctgtgaatttacacatagttgttctggaattcgatacaaagctacaagaacagatatgcaaatcaaactacaaacagccaatactaaagcattttgtattggctgtcctagataatccacattaaaataccaaaacaaaacacctagatacagtccaattaaagttaatgtacatttgacaaaatatgatttttttcttccaaatagaatgatgttaagtgtttttttcattggtcttatcctttactatatcaaagtaatataatatatggtacttccaatgagaagtaatcccatgataatactatttaatgatgataactttttttgcttgataaaagtaaaattcagtaccaaagaaataacaggaacaagccatattcccaaaatactagggataggataataggtatctccattatgcaaaatatttatcttctccggtaagaaaaataacataattgcggaaaccaaaaacataagaataacaataataaaattgattttagcatacttttcattattctcagtaaaattttctcctaagacatcttttaatatttttttaatcatagttcactctcctaatttgtttttttgtgtttgataaaagaataaattgtaggaattccaacccaaataacaagcccaatgaacaaaaccaactctgattgctctgttataaaatataaaatcaacataatgaaaactaatggaaatgtaatatatcctaataatctattcgcaattttccatgtcttttcatctgtcgttgtccaaggtaatcgtaatcccatatacttatttaaaggaagttttgttgaaacatttcctgtaaaaagcataatggtaaccacaaaaataaatgatgttggaatgttgacgaagaaatcattatctattagcggaacaaaatatagtgcaactgccaatattaccgtcaatctattcatacgacgcattgttttcacttttggattatctttagataaatttgtaataactgccattctcgtttgcgcaacacccattaaactaatcaaacctgctcctataaggaaattaacattgcttaaatttttgaaaaaggcgatcagaagtgctgtgatagataacccaaatatacatatatctaaaataaaaattgatttcttcatttctaaatcactccttttttccaaaaatagacataaatccagacaatgcttgttgaagtactgttacattgattgaataaatgacaaagtttccttgcttttctgaactaactaactctgcttctcgtaagatattcagatgttttgttaaagcaggtttcgatatgtcaaaatgttccgctatttctccagcacttaaatctttctcattcaatagtttcaaaatttctcgtctagttgggtcactaatagctttaaaaacacttcccacactcacacccctttcatttaatcaaaaagttaattaaccttacggttaaatactaaactaagaaatgcttcttgtcaataatttttaaaaattattttcataaaaagacttgcatactactatgctcatgcgtccatagataccgcaaaatcagaggttcagcgtctaatcgcataagaagtatttaccacgattttaaccacgcttgatagcgaaaatataagaagatagacctagatatgtgaggtttaccacaaaaggaaaatgcccgtagagccgataaaataaggctttgcggacatttaagaagatataaaaagatagtcaaaaagacatatataattttaattaaataaacgatactgtctctgttaatgcttttctgctgttatgattagggagaggagtagttgttttgtcagcaacaccaagatcaagaagcattaatatttcctcatcttctggtaaattaaaagcttttgccagttcatcaggattaaagaagttaatccagcagctgtcaacaccttcattgcatgcagctaacataagatgagttgcaacgatagttgcatcttctattccagagtttcttttatctcccgggtaagtgaacacattatttttattaaaagcaacaattaggactgtaggtgcgttatatcggcaaggcgttaatttatcaatagtctctaatccactttcagattgtacaacatatatatgctgttcctgaagattctttgctgtaggcgctactcttccggcttccaagatagcatctaatttatcttttcctatttgttcgctgctaaattttttacatgaatatctgtttttaattacatctgaaaattccataaataacccttcctttcagtgaattttatctacgctaattatatcacttatacaataaaatcccgcattgtaattatattaagtaatcatcatctatcatttgtttatattctgaaaagtcaccatcattaaaattatatctgtatctcacatcttcatcgtctaccacgcatcgaagtatcattgtatcatcttctatgtacagataattttccggattcaaataattctgttttaaaattgcctcagataaacgatatgcaattactgttgaaacttcaaaaatctctgaattggctccttctatttctgcttatcattcttaatactgttttatttatcatgtcttattatcctccttaaatctttttcatccagttattcagccattcttctgcgttattaatgtgcatgccaacaataatcacatatccatatttttttgccatatcatgaagatactgtacacaatatttatacaactcctgactcatgcttttgtatgtggtgtgtctgctctgcaaaagcctgaaatgttctattataataacattatatttattatgcccattgtcatctgataaaagttcaacatctctatcatctatagctttaaaatgtatattatcacattgtgacttaaataattttagagcctcatcacatatttcatcaaaacttctttcatcattttctttatcaggtgaaaaaacctgttcatacatatgtgtttctattctttgtaatatattgttatgcacatccttaccaacctgcctatgaaaaatacttataataccattaaagcttctgacataaataatcttttagctaagtcagaaaagaaagaaaatgaacttgtcattcctacttttctgcagtcaagaatgaaaaaatagggggattcccctatttttccattctctaacctgctttaattttcaacatttcccagctctgcccgaaacatcagtcttctcgttcccctgatattctcaaactggatttcatatgtctgtgtaaccttatcgaccttaacaatctcgccagttccaaataccttatgtctgactttatctccaacctcgaatacaacctttggcagcatctgctcagtcacacttctgattaatactctgctgttgttgatacagtcaagaagattagtatcaatgtcacttaaaaatgctgatggtcttgcagcgaaacggccatctttctttctataagtgctgaggtaaagcatattcttagccctcgtcatcgcaacatacaacaatcttctttcctcttcatattcgtcttcattacgaagcctgctgcttggaaactgtccttcaacgagtcctggtacaaatactgtatcaaactcaagtccttttgctgtatgaattgtcattacttttacaacattatactctccgtcctcatcttgcgctgaaaataatgcaaaatggcttaacagatcagccagctcaaccttttcctgattatcttcctccaatgccgtaatagtcctgataagctctgacacattatcaagtctggtctggtcgatatcctgctccaatgcctgacgatatcccatgtcaagacatttgtttactatatcagtacaggtataagcaacatatgtatcatgcaattcactgattgcattgtaatattctatcacatgtttctgtgttatatcgccatcttcaatctgctttccaagtgccttgaaaagactgcagttgttctgtgccgctgcatttttaagcttctcaacagacttcttaccaaagccccttctcggtctggatatagtatacagcaaatccatgtccgtaaggctgtacaccattctcatgtatgaaagcaccgttcttatctcttcgctttcatagaatttcgcaccgcttagtatcttgtaaggaacttttctttttataaatgcttcctctaacgaccttgtctgtgaagcagcccgcaccaatatagtatggtcgctgtacttcatattcttagccacattatcaagaattgtatcagctatccacaaagactcattctcctcggtgtcaggtgcattaaataccggcttattgccatctggtctgttagaaatcatctgcttttcaagcctgttctgattagcagagataagggatttcgctgcatttacaatctgaggagtgcttctgaaattctcagtaagtgaataatcctgcacattttcatgtgttttatcaaaattaatcatgtattcagggtcagaacctcgccatgtatatatgttttggtcgtcatcacctaccacaaacagattctgatacaaaccgcttagaatgtgaagcagcatatcctgtttcatattgacatcctgatactcatcgcacaaaacatattgacatttttcctgccagcgaatccgcacgtcttcatttctgttcaaaatgtataaagtaaaattaataaggtcttcaaagtccagagcataattgtcacactgtctcttaagataattatagaaaacccttttatccacatttttctcgctggaagcccttcttttaagctctgtcttatcaacgcctgccataagctcaacataggatatatcctgcttggttatgtctatatcactcattatcttcttcgcagtattgtccttgagcgatattcccatatcatctgccacatccttaatcatttccagctctgccttcttatcaagaatcgtgaatgttttgggaaatgtcagcctgtgaatctcctctttaagaaacatgttacaatatccgtgaaatgttcctgtaaaacagttggcgttatcaccaacaatattccttaatctgtgcttcatctgcgaagctgccttgtttgtaaatgtaagcgccacaatagatgatggctcaacaaacagttctgttatgagatatgctattctatatgtaagtacaaatgtttttcccgaacctggaactgacgcaacccttatgttgccttctgtctgtgttattgcctctgtctgttccttcgttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacccttatgttgccttctgtctgtgttattgcctctgtctgttccttcgttgctctttctggtatgttcatagtcctctttacctgtaaatatttagtatacctttggtatctctccatcaattccatacatttgtttaaatgtatctatatccgcggcctgcttaatcaacattatctcctctatcttaccggtatggatatcctgaaatcccgcaacctgctcccctgtgcatatgcttgtcttcagtactggtttcttattcattttatcataggattgtgtgtttctttctaaatatactcatgatttataactccaaggcctgcctgcttgtatatatggtggtcactctgatgttaaaagtgaccacttgtgaccacctagtgaacacttaatcataaaagtgaccacatactagtcactctgatgttaaaagtaattactaatttttctatttttttgttttataaagagtattatttctttctcctactttttctatcaaacctgctttcatcattttatctattagctttcttgctccagttctggatttataattacagatttccactactttctgcatagaaatacttccattctccccaatgtaagcaagtatcttatcttcttttggcatagcttttgcagtatctgtttcgctattatccgttgaattccttatatctgctgcccccggaatatataccacctgtccaacttcgagttttaatgttactctgtcattacgctctgaaaaatcaaattccggctttttccagttttgttctgcccatgctgtcataatcttatcgacaccacttccagcacgctcaccaacattaacaaatccaaacatttttaaaatattagggtttcgtggatcactattgccacccgcataaaactcctcttttgttatcctgatagttccgggattggaaatgctaagttcctttccatttttgacaacaatgattccccgtcttccataataatttgcatgtgccagtgcatttgccaatgcctcttccaacgcatcatgcacatccactctgtctacccggtatccatctcttctattggcaaatggaacagctacttcatcgtctattcttgtacgcactttacagaaaaagtcgtatatattaccgctccaatcgccctcattagaatgtgtacggaacagccaacgcacggctttatcatcacattcctcacgataatccagaaaataattaggaaaaacttcagtaatatgataagcttctccaaagaataataatcctgctatcgttggcgataatgttcccatcttattcttcgccgctgctcttaatttcataaggaactcatcattttcaagtgcattccatggatgtccactatgaagttgctcaaatacgattcgatagccctttattgtatcctgattcaaaacatccaatccaaactcatccaatacttccacgtctccagatacatctctctgatctgcaaacatagccctgactgcctcttcagtacagagaaaatctccttcgtaatctcttttataagtgcctttcattggatcagttccaatataaaccggcttatcatgcctatctgctgccggtatatcaattttaagtatctttttatcttccacctctataacctgaacatgatgattcaatagtatattttttgatatcttatttctatcatttagggtgctccagaaatccttctgatatttaataatctgcttatctgtcaatccctcaatcgtaaaggaatcactatgctccctaattccaagcagaatagtgcctccattggtattagcaaaagatgaatatgtctcccatatgctctcaggaagtccaccattagccagcttgcactctcgttcatgatcttcgcaaaggttcaatttatttaatgtttcctgcttcatcttttaccccctaacacaattcaaattgttctaaaactgatatctgctctttattatcccaaacgtgctatcgaacatttatttgtttttattatacactatttttatgtatacacaaacatcaatgtaaataatattacaatatatgtacctattatgggatatataatatttttttacacataattaaaaaacgcaggtttccaagccacaccaaaacatttggtgatgtgctcatcctcctgcgtcatacacattatacatcctttattgtttcccttaacctatctatattatgcgcttttcgcttaagaaaaaacagccatataaaataaaagcccagagaagttttttcttccccgagttcttattttattcagtttaagtcattgataatcattatataaattttgcaacaacctcaagctcttttctcttaggtctttcaggtggctcctgtcccctgtagccaacagcaataacagacacaacattttcactgtctggaatattaagcaattctcttaacgcctcaccatctctaatgcccattaccagagtatcaagccccagttcagcagctttaagaagcagattatcattctgcagaccaaggtcataatagccccagccgtcaccagcctcattaaccggactgcctgtattcttatcaaagccgaccattccctttacaaatgttgtaactatatatgcgcctgctccttccgaattagcctgattaaattccggaagacatttttctctaagttctttcaccgcattttcagataatacacagtaatatcttgatgtctgcagattcttccatgaaggtgcatatgacgcagccttaataagttcctcaagctgttccttagtaaccttacgctcaggattataatttcttatgcttcttcttttctccattactgcctgtaattccatatgtatacctcttttctatgattatagttactaatgtttccgctcaatctacacatcattatctgcttatcataaaatgcctcctctaagtaagttcatattcctttaactgctttctgtatgttctatactccggacagtatttttcaacctccgcccagaattctgccgaatgattcatatgccttctgtgcgaaagctcatgcacgattacataatccatcagctcctgcggcatataatacaactggtagttgaaattcacattgcctttagaactacagcttccccaccttgttttctggttacggatagttattcttccaacgctcacattcattatatcacagtaatactgtactctcttttcaaatgtatcctttatattatcaagttcctgattcgacagacattcaatacccggtgcacctgtaccgcgtctgttatctgatttctgtctgacaaaatccagtttctgcctgatccattcatcatgttcttctataaatcggttaatctctgctgatgacattcgcaatggagttcttactatcactttcccatctgcatgaacctctattcctattgttcttcttctggattttattacctgtatgttcatgattctaccttgtaaatgctttatcttcccacaaccttcttaagatattcatttttcagcttattctgctcttcaagcctcttattttcatcttttaaatgctgtatatattcccgtgtcagtttaacgcctccacgaaccgctatgtcttcatgcttttccatctcatcaagccactggaataatgacttttccctgatttcgttatatgtattatcttctctgttaaacattttccgcctccttgcacacatcaacccagcccttagcccgtgacacgtcttccaactcagcaattgtgagcttcactgcagaatggtcgtcgcctgctgccggatacacaatgtcaaactgtttaaggctttcatcaagatatacatcaatgccctcattaatgccaaatgggcagactccaccaggagcgtgtccgattatattctcaacctcttcaaatggtatcatctttgcttttacatgaaatgtgtctttatattttctgttatctatcttcgcagttccttctgtgattatcaatactgccttgtcgccctgaagaaaagacattgtcttggctatccttcctggctcgactccaagtgcctccgctgccattgcaaccgtggccgttgattcaccaagctgtattacatgctctctgtatcctgctttctccagatatccaagtgctttttctaatgacatataaaccctgccttctttccacatatttttaaacagtttctataataccacacacgcggcttccaatggcatatattcttaaaatttcatatttagcaattgctgattaaataaaaatcccgcgacagtcatacaaccgtcacgggattaaaatcatttattcatatgtgtgtttcttatgcttaccaaaagctgcctgttcctcgacactgtggtctgcaacattcatcttctgatgtactttctttttctttaatggatgctttggattcttatccataacaatcgctccctttctaattcaataataaatgattagtcattagccttcaatagcaatgtacttcttattctcaactgctttagcttctttcttaggaactgaaagtcttaagataccatcttcatacttagccttgatatcttcctgtgtgacaccttcacctacatagaagctacggctcatagcaccagcatatctttccttacggatgtatttacctttcttatccttttcatccttatcaagtcccttagcagcacttattgtaaggtaaccgttatcaagctgtgcattaatttcatccttcttaaatcctggaagatcaatatcaacttcataacctgtatcagtttccttaacatcagtcttcattacattatttgcatgcttaccatataaagccttgtcaacttcaggaaatccgaagtccatccaatcatcattaaataaattctctccaaaaatactaggcatcaacataagtcattcctcctttaacatataccattatcttgttaccttgtttctttggaaccgggatgtttcagtaacctcttgaggtactttcctttactttcgtacctcttttggttcccttcctttgttcttggctatgttatatacctttttattagcactgtcaaggggtgagtgctaattttttttattttccaattataaaatcccgcaaccccagtatttacatgggattgcggaattataaaatatttataaactatattttttcagtcgtttcaaaagaaaattatataattctttattaagttctccgttcttttcctcatcttccatatattcaggaagcggcatatttgtatcacattctccacatatatcaatacctaaaaccttctggtttcttataattatcccaagcatatgctctaatgtcccaagcttcatatgtccctgactccaattggtttcacttatgctttcatcaagaacatccttatcaatagatatgtatacaggaactgataaatcaatctggtttgttttagattccattgcttcggctcttatctcctgtgctgaatatgttataagtttattacttcttaacccaatcgcattaatatctttcttctctggtcccactagaataagctggcaaatatacggattgtctttaatcacctttcctgcccagtctccgcagcttgttaatccttcaatcataggtttttgcatatcggtatggtgatcaaatacaactaaagaaaacggttccttaattctgtcagtcattatcttagtaacataatggtagttacccgaatcaagaaaatgtattccatgaattccaacagaatcaactctttcacctatctgtttttcagcttcgtctgatacatacatatcacatcctgtaatatcagtgcagtctatccatgtaagtgatgttttttccttagcaaattcatcatcatatacacctgtgaaatcaagaataaaattgttgtttttctctctttgcattatacaatcacctcaatgtatgttactttttctcaaattcctcgcttatcttctccacaagattattctttgcaagtccataagcaatcttaactgtattatacactgttttgtccgttgctgctccatgtcccttaacaaccggcttcttaacgcctagaagaattgctccgccttcattgttgtaatcaaactttggctcaagtctgccaataaatgcctctagctgtgccttttgggtatcagatgcacctgctgctgcccttcttatatcatcaaacacaacctttgctgttccctcgattgatttaagaagcacattccctgcaaatccatcacatacaacaacatctgcgttgccgtctaacacttctttgccttcaatattacctgtgaaattaaaaccacatttttctaaaagctcatgagcttccttaataacatcacttccctttccagcttcaatgccattagaaagtgttgcaactgtcggattctcaattccgagtgtcttcatgtaagctacaccgagtcttgcaaaatcgacaaaacggtctgccttgcagtcaatattggcaccgcagtcaactatacagaatggcttgtcattacggccattaagaactactgaaagtgccggtcttgtcgcatttaacttgccaagtataaggatagaacttataagcacaactcctgttgcaccacatgtcacgaatccaccgatatcctcattcatgcggcacattttaagtcccttgattaaggacgaatcagtcttatcgtggtaagcgtcaaccgggtcatcataattagttatctcctgtgtgcagtccactatctcaagctgcgattcatcataagttacattggcaaggaaatcctccagctcggccttccttcccatcagatatacatacaaatctttattctcactgattgccctgattgcacccaaaacaagctctgtctgcggcttgtcagcaccaagcaaatctacaactatctttatcaaatctcatcctccttgttttacgaagtaaaatccgagtccattgacgaggagaggatttagccctccttctgctccctccagaaattatcaagcagattcttatacactgcctctgaaaatggagcttttgacagcttctgctttgtctcctctgacaaatgctttgtcgcagcaaactcttttccagccgcctcatactttgacaaatatctgtcaagtcttgaacttgcacccagttcaattaatgtctttaactgtggacatagaattgctgtaaatccatttttaccacatatgcactcatattccttaagaagcgaatcatagactgactctgactccgaataagcacatcccgatataagaaccaatttctgtcccgtctttggatttcttatgccgtgaaatgactcgccattttcaggtggcttctgtcccctgtaagtacacatcatgcttaaaagtctgtctgtgaaaagcttcatctgccccggcatgccaaaaaaatacaacggataactttcaattataatgtctgcttcttctattcttttcttaactgccggcatgtcatcatttttgataacacactcgccctcagtccttgcccagcatgaaagacagcccatgcatggagtaacatttaagtcggagatattaattatctccgactcgtattcaccaccttcgcatattccctttacaaatgcgttggttaccgccattgtagtgctggcactcttatgtggacttccatttaaaactaatatcttagccacgtccaaataatcctcttctctttcttgcaggagcctgtgatacaccaagtaactgtgctgctccaggaacctctcctactgcctcactgtattcgctgtaacggcctatttttctgtatttctcatatctgtcatcaagaagcttatcaaccggcttcttctctaactgctttatttcttttgaaaggtcatcagcaagctttttcataaaatgtgatgtttctttctcttctgaaaaatcttccggttcttcaacaaccttttctacgatacccattttattgaggtctgatgctgtaagcttgagatgttctgctgcctctggcgctctcttaggatctttgaatagaatacttgcacatgactcaggtgtgattactgaataatatgcattttcaagcatccatacttcatccgcaacagcaagtgcaagtgcgccgccgctcccgccttcaccaatcattactgatataataggtgtcttaacatctgtaagctcatacaggttgttggcgattgcctgtccctgtcctctttcttctgcgcccttaccgcagttagcaccctgtgtatcaacaaaacagataacaggtctgtggaacttttcagcctgctttataagtcttaatgcttttctgtatccttctggaagaacgcagccaaaattccttaaaagtctttcgtttaaatctcttcctttttcaattccgattacagttacaggctttccgttaagtcgtccgatacctccaacaatggcatggtcgtctgcaaagcatctgtcaccgtgaagttctacaaaatcagttattgtagcatttatataatccgatgcggttgctctgccgctctttcttgtacggcagattctgtcataaacacttaaattctcgtttgtcatgattaatctttctccttatattgcaatgcaatactgttatgcacttactgtttctgcatgtattgcaagaatgttagcaagatatgccctctgttcctgtcttggcacgatatcatctataaatccgttctttaactggaactctgcgctctggaaattatccggaagcacttcacctgtaacctgctctactactcgctttcctgcaaatccaatcattgcacccggttcagatatgattatatctccaagcattgcaaagcttgctgtagcaccgcccattgtagggtctgttgtacatacaacatataagagtcctgcgtcactatgtctcttggctgctgctgaaacctttgccatctgcataagtgacagtgcgccctcctgcattcttgcaccacctgaaactgtatatccgataactggaagtctgttctttgtagcatattcaaaaagtgctgtaattctgtccccaacaactgttcccatagaacccatcatgaagttaggctccataatgaatatgcatgtatcattcccaccgatagttcctctgccgcatacaacgccctctgtctcaccgctcttttctctggcagactcatacttttccttgtatgatggaaaatcaataggatctgtaaattcctgatcattaaacattacatcaaacttttctgtaagcatctgaagtctgttctttgccggcatacggtttagcttcccgcataacgggcatatgtagtaattcttctccaaatcctctttattgatttcttctttacatttgttacatttaactgtcattattattctcctgccttgatgttctcaattgcctcattcaacgcatcaactgttgtaactgtgtacatctttgcttctggaagtgtcttcttaacaaatcctgtaagtgtctttcctgctcctacctcgataaatgtgtctattccgtcagcccacatattctttaatgtgtcctcaaaccttacacttgaagaagcctgaagtgctattgtttctataatctgtgctgtatcctgtggataaggctttcctgttctgttggcatatatctctgtctgtggagcattaattgtcattgccttgagtgccttctcaagttcttcacttgcatccttcatataaggagtatggaatgcaccgcttactgcaagcttaactgccctgcctcctttttccttgattgcagcgcagaatgcgtctatctcgtcagcacttcctgcacatgaaatctgtccaggacaattataattaaccggccagatttccttgaattccttacatgtctcttcaacaacttctggagcaagcttaagtgctgctgccattccgcctgcatactttgtagaaagctcacccatcttggttcctctgataactaccagtttaaatgcgtcctctattgataaaactcctgcgtatgcaagtgcaggaatctctccaagtgaaaatcctgctacagcgtcagccttaattccggcatccttaagcgcattggcaaatgcaaggtctgtaaggaaaagtgccggctgtgtattctctgtcttggtaagctcctcgccttctccttcaaagcacaccttaactgttcccggacggagcgactcccccaaatcatataatttctttgcatcagaatctgaatcgtataggtctttgcccattcctacatactgcgcaccctgacctgaaaataatactgctatttttcccattaatttattcctccgttccatatatatccttacggtctactgttgtaaatgtcatgcttccctttgcgtacacattgccatctaccttaactactgcgtcaaatgatgcgagaaccttgttgattcttgtagctgtaactgtaatatcaagtgtatctcctggaattacaggctttacaaacttgaatccgtctactttaagaagcacatataacttgccctcttccctgctctttccaccgtcatcgattacaagtgaacagagctgggcgcagctttcaattataagtacgcccggcattataggtgcgtcaggaaaatgtcccataaaatatggttcattaattgatacatttttaatacctctggcacttacattaggctcaagctctaacaccttctcaatcatctggaaaggtgggcgctgtcctattcttttattaatctcaaatatgttcatcataatgataatcctccatcaagcacgataacctgacctgttacatatgaaaatgcgtctgagcaaagtgatgatacaacatttgcaacatcttctgcctttcctaacttatgcattgggattgcgtctaaatactctttcttcttctcttctggaattgcatccaacatctctgtctctataaatcccggtgctactgcatttacacggattccgtaacctgcaagctccttagccattgtctgtgtcattgaattaacagcaccctttgttgcactgtatacagactgtcccggaagtgcgaatttcgagctgactgatgacatgttgatgatgacaccgctcttctttctgaacattttaagtactgcctgctgtgcgcagtagaagtaacccttaacatttaagtccatgcatgtatcaagtgtatccttgttgagcatgagaaggtactcatctcttacaattcctgcgttgtttacgagtacatctattccgccaagctccttacttacatctttaaccatctgcttaacctgattaaggtctgaaacatctgctttatatgttatggctgttcctcctgctgccacgatttcatcaagaaccttctgtgcctgttcctctgaatggctgtaattgatgactacggcatatccgtcttttgccagacgtatagcacaagcctttccaataccacgggaagctcctgtaactaatgctactttcatatctgtgtgtcctttctttaagaaaatgtcagttctttgtcatgggcatctgcccctgcttcattacttgctgagtacgattgctgtgtatgaaccccctgcaccatatgcagctacaagtacattgtttaacttagaagcttcaacattagtcttagaaacgcttccgtctgctgcaatgctgtatgcttcctgtgaaggtatctttcctgcaaacataagtgctgcatgtgctgctgctgttgtagctgctgctgctcttgactcaccaagaacttcctttaattccacaaccggtttttctgccagtttgtcaccaaatactgctgtcaatcccttgatttctacatcatcgacagccttcattccgtttgcgaaaccaaatactgcatctatatcatcaattgtcattcctgcgtctgctaatgcgttattaactgcatttgtaaggcctgcctctgaacctgtaagtgttccgaacttaacatttgaatgagccattccgtatcctgctgcatggcagtagattcttgcaccacgctccctggctgccttctcgtcctcaataagaactgaagcactgccatcgcttaatacgaatccatcatttcctgcaaatggagctacaactttttcagatgtgacacctaatttaccgaaaagctctgtcattatgtcgctgttctcatcagaacctgtggctaacatagcattttcctgacctgaacggagtacgctcattgcatatgccatgcttgcaagaccagactgtgcaccgttagtaactgttacattgtagcccttgattcctgagcagattgaaagatatccgcctgctgcattgtatacagtgttaggaaatttgaatgcacttcctgaagcattgcccttctctgtaatcatgctctggaaatcacagcatgttccaagtgcaccctctgacgttcccacaattattccaatatctgttgcattatcgtctgttactgcataatcagcatccttaagtgcttccatacctgatactgcctgaagctgactgaaattatcaagttttctatagaatgacatcttaagtccaagtgcatcataatcttccttgccgactgaacttcttaaattagcttctgtcagagcttcgttttttactgcatttgcaacatatgtatctacaccgttgccgcttggtgtaaccacaccaatacctgtgataacaaggggcttcttctcttccttaactgtcacattgccagcctctttgctaaagataatacttgcgttattaccgccaaatgcaaatgagttgttcattacgcttgtaagctctttttcatgtgccttattagggcagaaatctatctttccggctttttcggcaagcttatccatatcctcgtccttaaatccgagtgttggaactactgtattagttgtaagtgccttgattgaaaatactgcttcaattgctcctgctgcaccaaggcagtgtcctgtcatagcctttgttgagcttactgaaagattatcgttctcgccgtcaaatattgtatgtaatgataagaattctgcatcatcgttcttagctgttcctgttccatgtgcattaacatatccaatgtccgatttcttcaatccagaattcttaattgctctgttgatagcttccatctgaccttctccatccggtcttggagctgtgatatgatgtgcgtcactgctgacaccagcacctaatacttcacaatacatttttgcatttcttgccttagcatgctcgtagctttctactactacgacacccgaaccttcaccaagtgtaattcctgtacatctgttgaatggtgagcagccatctgcgtcaagtgcatgaagtgataagaatccggcatatggtactgctgcaaatgtgtctgaaccacctgcaagtactacatctgcctttcctgctctgataagctcgcatgcgtatgcgatactgattgttccggctgcgcatgcatttgcaatattagtaacaacgccgcctgcatgacactgacctgcaacctgaggtgctattgatgagattggcatcttagttacatcacttgctttcttgccatgctcataataatcagaaatgctgactgcaccaccaacacagcttccaattataaccgaagctttagggtctcctgcaaaatcatcaagtcctgcgtccttcattgcctcgcctgctgccttgatacaaagctgtgctgaacggtcagcatcttcgcttccctcaaaatctccaagtgtgtcgcacttaacttctgctgcaaggtctgcgtaacagtctgttgtatcaagtgttgttgttttatgtattcctgaaaccgaattaatggcattattccatgcttcatctactgaattaccgatagcacatatcattccaagacctgtaatgactgcgcggttattattctctgtcataattgctcctttattgttattttcataatttcttataatacttttttggggagtgtgtagttgtctttgttttggactttgtgaggcatgttcttacttgttatgtccaatcttccggctctggtgcgtcggtttggacttttcaagtcctgtttctgcttctaacgtccaatctgctcgctctggtgcgtcggtttggactttccaagtcttgtttctgcccataacatccaatctgtcaatctcgtcacgctgttttggactttcaggaatccaattccaccaaaaagtccaatccatcgactctagcattcccgtttggactttgtaagcaatattccagcctaaaagtccaatccgtcagcaacatccaagcaatcaaccacaacttatatccgtaactaatacgggtgccagaaaagtcatctgacacccgccacattttatatattatgcattttcttcgatatacttagcgattgtctcaatgctgtagaagtgttctttgccaacacctgtcatctgaacaccgaattcatcatcaacataagcaatgatttcaagtgaatcaattgaatcaagtccgatttcaccatctccgaaaagctgtgtatcaaactctaaaacatctgcgtcaattcctaaattctcacataaaaagtcttttaactttggcataatttcgttagtgctcattataatattccatcctttttctttaatcatattgtgcgtccactaaaaaaagcacctacacattatatatttttttgtaaaaatttggcataacaaaacccgtgtagtgttcgaaaacgctacacgggttctataattgtactaatttcggacattttcgttaaagtgtccaaatattatcgtcaaagcattgaattatctacacagttctgcctctcaattccacaacattatcagaacttcctaagatactccaccatcatatcaataaccgcaccgctctctggcataaaaggctcaaacacactgaacgcatgtgtaagctttttattcttaggaaaaactacaagttcatgctctctttctgctcttgtcagtgccttctcaaaatctgttgtatatcttcgtaagaaatcattatggcttgtcacgagccagactggtgcaagtgagttcagcagctccctgttttcaagattaacatactttgcgaatggagttttcttgtaatccctgccatacagatactttggaagaaaaagtccaatcttatcaaatcttgatgtatagaacattccacttatgagcccaagcgcattaatgcgaagtcctgaaggagtgacatttgctgccctcgctatattagtgctattctggatagcattgacatatgtgataaggcatgcgccgccgctgtcacctgccatatacacatgtgacgaatcgccgccatctgctgccagtctctcctttatataatccattgccatgaaaacatcggcaatctggtcatatataagacagtctggaatcagcctgtactctatgctgtatacaagaaatcccttcttgcaaagcagtgcacaaaaatatctgttgaactccttattcccaattataagtcctccaccatgaacattaataattacaggaagaatcttttcctgtgaatcttccggtctgtatatgtcaagcacatgtgctttaattccatcatcagcatatgcaatgtcagtactgcatcttactccttccggaaatgttaatcctacatctcttcctgcgcatgaatcttcaaaatctttcctctgcctataaaactgttttgttaaaatattccccattgatgcactcccgacaattacttcttcatattagatataataaggtcaagctgaccctcaaataatttctcgattctttcaacggtatccttgatttcatcaacagtcttggccttttcttctttaataatccatcttataagcaatccaaatatagcttcttcatagaaactacatataatctcgacatccttaatagaaagtatgtatccttcagacatttttctaatctgcaaaagtgccagataatgaattcgtgtcttaacatatttttccagccactctcttcctcttgcatcaaaaagattagcccatactttcctatgaattatactatattctataaatctcataagaaccttgtccatctcaccattgtactcttcattgaattcatcaatctttgcctggacaacaccatccagtacatcatatatatcggaaaaatgatagtaaaatgtgctcctcgtaataccacattcatcggctatatctttaactgtgattttcttcagtgattttttttcagcaagttcaagtgtacacttcattattgcttttcttgtcaactgcgacatgtaaatctccccgttcacttatatttgcctgcatattgtagcatatttaatgttgaaagtcactttttacttaattatattacttattataaacatttttattaatgaatattttatgacacattttcaacaaggctgttgtatctgattctcttagtaagcataagatatcttttaggtgtcattccgcaatatgtcttaaaatctcttataaactgcggctggtcataatacccaagattaacagctgcttccgtcatattatccacattgccataattaaggaattccagacttctctgaaactgtattatcttgcagaataccttaggggaaaaacccatctgctcaataaaaatcttattaatatatctttctgtatatccaactgtgtcagccatttctgaaattctcatcaagcctcctgaattatatgccagctctttaactgccataagtatctccatcttaccaaatggcttttcctgtctcatctccagtttagtatattcttcaagaaaataattaattctgtctttgaatatcttctttttttccatcccacttacaaatgttcccttattatcaagaagtatatcttccagatagaatctgcagtcaacaagatcccgcaatgtcacattgagtccaaccggcattcttccaggcatgaatcttactccaaaatactctttctttccctgccactctacatctaatgctttaataggactaccaattgcataagcattcattccattttctccatattcgaaaagcatatccacacaactgtcaggaactgtagttatttcctttgttttttcaagtctgaatgtgtagaaatgtgatattccctgattcagatatatttcctgcttaaaatcctgcgtctccaatacaagaaaaggctgggttggtcttaatttgtctgttttatactccatagtgcctcctcttttcccctacatttaagccaacgacaagtttggacttttagcagatatataatgtactagtcaacaaaaagtagacaccactttatatttttatacatcatttaatgagcataatactccctatactgttttgttcatctggtctgacttctgttgaattaacttcacgcaccatctgcatcatataaattttattcatatcaccattatcaggaactaatataagttcgtgtatgctgcttggtaaaacatatagccctttacaattattaaagccagctaattatgagatatcaaaaacaaggaaatacaagaataatattggaaagatagaaaacatggaatacgataaaatatccgatttttatacatgtaagaataacaggaaacttacagtatcacatataagacacaataaaactaaaacaggacatgcagttcagaagatacctaagcaaagggactgcgaatgtactcgcttaaagtactcttttagcaattgcaagaaacataaataaacttcataataagattcagaacgggaagacaggaacacattcatttcctttaaaaagtgcctgaatttagaaatatcaaaataaaaatttttaaaacctatataggtttattaaagtacgccaatttttggaacatcccattcattttaataaatagtaacttaaaaatcgtatttttataggaaaaagaggctggtaccttaacgattttcaatcgttaaagcgacagccccattttttgaatacaggtgactttttcattttttgttataacttaatgtaacttatcaccagtaaacaagcaacttaaagccacttttatctggttcagttttggttcagataaaaaaaaactgtactagtttacaccaatttacattaagtattagtatatacattttttgtcaaaccgcttaaatactgcattctaatttcaagcaattatactattcgtatgattacattctgtcgtggaatgttctagtaataactgttgcaagtggtaataatctgctctttaatatgctgatagcatcttcacttataagtcttgcaccacttgtcgccaccataactggatcaacaactatatttcctgctttatactctgtaagcttatctgctattacctgaatcagttcacctgaagcaaccattcctgtcttgacagcatccggatatatatctgtaaatataccatccagctgctctgctaaaaacttaggagatacctccattatatctgttacacaagtagtgttctgtgcagtcagggctgtgattgcactcatcgcatatacacgattagctgtcattgtctttatatctgcctgtattccggcacctttttagtctttatataatctatgagccccgcctgttcaagctttttcccattatacgtaaatgtctggtcattcaggttaagtatacagccgttatgttctattatattcatactctctgcaaatgaatatgtccgtcttagcattgcctgcaccttagctataagcacattgatatcatctgctattttaacatcatatccccactttaataactgttcacatacattatcagctataatcctgtcatcctcaactattaatattttatacatagactcaccctgcttcaatgtgcttcattattgtattattatttacaagctattacgttaagtatatattcatacattctcttagttgaagatatgcttaagtgttcctcagttgtatgaatatcaaaaatatcaggtcccattgatatgcagtcaagtccttctattttgcctgcaagtataccacattcaacacctgcatgaatagcctcgatagttggctttttaccatacatctgttcaaatatccttaccatgtcatcacgcagcttagaatccttcttatattcccatgctggatattcacctgtaaattcagcatttgccctgaatgcttcactaatgaatttgatctggctcttaagattctttaaagcagcccctacagaacttctaagtgagaatctgagacatatacctgattcatctagtgaaatcacaccaagattaagcgaagtttccacaagattatctatatcctggctcattctcattattccgttaggtaatgcctgtataagtgaaactgcccttgtgctatcttcatatgttactgcctctgtgctgcaaccctctgatatatctacaacacactttaagtctgcatcagatgtagcaaactcttcttttatctcttttgctgcagtctcaatagctgctttaacctctgctgtcttgtctgctgctacaataatctcagccatacattctcttggaatagcgttatcctttcttccaccgttaaacgctgcaagatatacattattgtctgtgataacatcccttaatattcttgacataagaacattcgcattacctctgcctttatctatttcaacacctgaatgacctcctgtcagtcctgataaagtaatactaagctttgttccagtaaccttatttttatcaagctttagtgtaactctgctactgcagccacctgcacagcttgcaagcatgattccttcttcttcactatccatattaagaagctttttgccctttaacatagatacatctatggaagaagcaccttccatgcctacttcctcagatactgtacacacgaactcaagacgtggatgtgcgatactgtcgtcatcaagtattgcaagtgcataggcaacagctattccatcatcaccaccaagcgttgttcccttagcagatatgaaatcaccatttacctcaagatccagtccatcctcatccatattcttatcacaatcaggtgtcttctcgcataccatatccatatgtccctgaagtattataggtgctgcatcctcataaccctttgaggcttcctttattatgattacattgttaagtgaatcctgataatattcaagctttctttccttagcgaaatcaacaagataattgctgattttttcttccttatatgatggatgtgggatattacatatatcctcaaaaaaagaaaatacatttttaggttctaattcagataatactctcataacactgtctcctttaaaatatttataatctacaaatttattttattcatttgtttatctgcttatttatcttgttcatatatacaataaactgattcttatgaagcagctttataaaataacacaatctctcatacagcggctccgctttatctccaaaatgctctttcacaagctgtcctatatcataaatacttcttacaccatctatgctatgccatacaaatgtaccgaaatcatctagttcgatgtaactatatctgggctttcgtgcaataagctgcgctattctgttaaaaatccccttattgtgtactttgacttctacatgaccttttttgttttccctgcattcgaacaacgaattatgctttggaacatagtctaagtaattatccttctgcttagccataaatcaagctttctcctttaatcctagaaaataaaaatctgccggcaaaataaccggcagactcattgtaacatattatttattattttgtcttcttttcttttttgttaataaatgctactaatgttgcaacaagacatgcaaagaatacaagtcctccgatattaccaagattaataatctttgatatattaatagcatcgccaagagtatctgcaccaacaggaataatagcgaataccgctaaaaggataccaaccagtccttcaccggcaataagacctgatgaataaagtattccctgattaaccttagccttacgctcttcttctgtaatacctttcttcttatcaaagtaaagtcttacaagtccaccaaccataataggtgtacttaaatagattggaagataaagtcctactgcaaatggaagcacaggtatctgaagaatctcaactactattgcaattgcaactcctgcaaatacaagtgaccatggaaggctgttacccataacaccttcaacaaccatcttcataagagttgcctgtggtgctggtaattctgttgaaccatagccccatgctgcattaagtaaataaagtactccaccaactgtaatagctgatacagctacaccaataagttcaccagcctgctgcttgtaaggtgttgcacctactatataacctgtctttaaatcctgtgatgtatctcctgctatagcagcaattatacatattacagaaccaatacttatagccgcaaccatacccttcattccaacagtacctgttgccttaagaatcgctgatgaaataagaagtgtcgcaatagccatacctgatacagggttattggaactacctactaatccaaccatacgagatgatactgttgcaaaaaagaaaccaaatatgataatgataattgcactaagaagatttacaggaatagctgggattaaccacataataatagcaagtactccgattcctaatacaacaaacatcataggaatatccttagttaatcttgattctactccatctgccttcttaccatatcccttaagtgcctgcttaaatgtccttacaataagtggtaatgacttaatcaagcttataataccaccagctgcaactgcaccggctccaatataacgtacataattagaccatatctgtgatggattcatctgtgaaactggaataagtgctggtccaatgatattatctccaccgaataatgcgattaatggcataatcataaaccatgcaacagaaccacctgcaagaaggtatgatgataccttaggtccacatatataaccaactcctaaaagtgcaggtaatacatctgcacctaccgctgaacccttatatggtttaattgtaaaatcaacctcacttgggaacaccttaagtccatctgctataaacttataaacagcagcaataccaagacctgcaaatactgtgccagccttagcaccaccttcttcacctgcaactaatacctcagcacatgcctgtccttctggataaggtaacacaccatgctcctggactatcaatgcactacgaagtggaatcatgaataatactccaaggaaaccaccgattaatgcaataagcgctatctcaactaaagaaggcataactgtaccttcctcctgcgcccacataaataatgctggaagtgtaaatatagcacctgctgcaaccgattcaccagcagagccaatagtctggaccatgttattctctaatatggaatctcttcttaatataaagcggataattcccattgagataaccgctgctggtatggatgcagaaactgtcataccaactctaagtcctaaatatgcgttagcaccgccaaataatatagctaataaagcacctataataatagatgtaactgttaactcaggcataaccttatcagctggaatataaggcttgaactctttcttttcgttcatactctttctctctttcttaatattcttatgcaaaaatcacacataatataatattattaaaaaaatataaaaatgtcaaatatctttcagatgtaaattgtaaaccgtaaatagtaaacatagctttattcctatgcaatttctgcaatcagaactttgcaaatatattagtactattcttaagattctgggcaatactcttgttttctatcattttattgctgatattgactatatcctcaacaagatcctgtgtgcttattcttcaaatttcacatcctgaagattatctctttgagctgtaattccatctgcacaccactcataggtatttgtaaatatctctggtgtatgaaccgtttcaaaaagataagttccatctgcatttccataattgccaagaacttcaagtagtttctgaattcctgccccaatactctctctattttcggctttgtcaatttcttttaaaatccgcagaatatctccttctcctgcaaggatattgtagttctgcctattcaatatcctctttccataaatagatgttcatatcaaggctcatcgcatatcccctgtctgtggagaattttgtcgaatgaaaagaatcatccttgtacatctgcaaaaattctcttgtggtttattatccatccgctataataacttactttgccgctaagcaccttcatctctcgatccatcaattctcatcgcgaagcactgactgatatctgtcgggtaatataccggatttttaccagaagaatagaagtcaaatctataagtgacataatttcactggtaaataaaatgaataatgctactgaaattgaatgggatatagataatgaatttcctgattctgaagcaactttaaccagacttatgcttattaacaacagtctaaagtaattactaactatttattttctatataatttcttacaacaacatatattttaattaaacttgtcgcaaaatgttaatttgcatatatcatgtcttcaagccaaatttgatgtcgtgaaaatttaacaactaataaaaaaaataaagtgcagattcagttagaatctgcactccttttttattcagattataaatggtgctttttatatcttgttataacttaatatcgacttttcccagttttcatgcatctttgcagacattatagctggtccagtttttttctcgatttggtccagatttggttcagtttataaatgaaaatatactattttatagtaatttacattaaactgatttttcttcaaatctctcaaacccgcataaacactgtattataaaatctgaaaaaactcaaaaacagcaattacattctatcatggaatgttctgctgataacatccatctgctgttcctttgtaaggtcgatgaacttaacagcatatccagatacacgaattgtgaagttagcgtactctggcttttctggatgctccatagcatcaagaagcttatccttaccaaatacgttaacgttaaggtgatgagcaccctgatcgaagtatccgtccattacgttaacaaggttgttaactctctctgaatcatcatgtccaagagcatctgggttcattgtctgtgtattagagataccatcaagagcccactcatatggaagctttgtaagagagttaagtgaagcaagaagtccgttctgctctgcaccgtagcttgggtttgcacctggagcaagtggtgtaccagccttacgtccatctggcatgttacctgtaaacttaccatatactacattagatgtaattgtaaggatagatgttgttggctcagaatttctgtaagtatgtctcttcttaatcttgtcaaggaatgacttaagaagccatacagcgatatcatcagctctgtcatcatcattaccatacttagggaagtctccctctgtcttaaatgccatagcgatacctgtctcaggatctctctctgatacagtaaccttagcatacttaatagctgaaagtgaatctactacatgtgagaatcctgcaatacctgttgcaaatgttctcttaacatctgtatcgataagagccatctcagcagcttcatagtagtacttatcatgcatataatggataaggttaagtacattaacataaagatctgctaaccaatccatcatcttatcaaacttagcaacaacttcatcatattcaagaacatctgaagtaactggcttataagctggtccaacctgaaccttagacttcatatctacaccaccattgatagcgtaaagtaagcacttagcaaggttagctctagctccgaagaactgcatttccttacctgtctgtgtagcagatacacaacagcagattgaataatcatctccccatgttaccttcataacatcatcgttctcatactggatagaagatgttgtaactgagatatgagcagcatacttcttgaagttctcaggaagtcttgatgaatataatactgtaaggtttggttctggtgaaggtcccatgttctcaagagtatgaaggaatctgtaatcgttcttagtaaccatagaacgtccatcgatacctgtaccaccaacctcaagagtagcccatgtaggatctcctgagaataattcattgtatgatgtaattcttgcaaacttaaccattctgcacttcataacaaaatgatcgataagttcctgtgcctcagcctctgtaatcttaccagcttcaagatccttattgatatagatatcaaggaatgtagaaacacgacctactgacatagcagcaccgttctgtgtcttgatagcagcaaggtaaccaaagtataaccactgaacagcttccttagctgttgtagctggctcagaaatatcatagccatatgcagcagccatagccttcattcccttaagagcattaatctgatctgtaagctcttctcttaactggataacatcgttagtcataactccgcatccacagttagccttatcctcttccttgcacttaataagataatcaataccataaagagcaactcttctgtaatcacctacgatacgtccacgaccatatgtgtctggaagacctgtgatgatatgagatcttcttgcagctctcatctctggtgtataagcatcgaatacaccctggttatgtgtcttatgatattctgtgaaaaccttgtgtaattcaggatctggtgtataaccatagttctcgcaagattcctcagccatcttaataccaccatatggcataaatgctctcttaagtggcttatctgtctgaagacctactacctgctcgagatccttcattgattcatctatatatcctggaccataagctgtaagacctgtaactaccttagtttccatgtctaaaactccgcccttagctctctcttccttctgaagttcctgtaattttccccaaagcttattagttgcttctgttggacctgcaaggaaactctcatctccatcataaggtgtgtaattgttctgaatgaaatctcttacattgatttcttctttccaaagtcttcccttgaatccagcccactgtgtcttctcaaccatttgaattgatcctccttaaatataatatatttcaatgtacattttaagaaaaatgtatttctttttgtacactgtatacaatcttagtcaaaataaaaattgccatgcattataggatacttattgttcctataaatatacattgacaaatccataacaatttgaccatgattactctaacatgcttctgataataaatcaataggtttaacaagagtatttaattttgtacaatttaaggggaatatcgtgaaatattccccctttataaatgcagtattcatcagtacttcaggctgtattaatgttatttaccaataaattccattacctgtccttcacttataaaaccaacactctttgccacacactcaccactcttaaataaaagtaatgtagggattgacataatattatatttctctgcaactgatgattcctcatccacattaatctttacaatctgaacatcatccaccttagctgcaacctgttcaagaactggtcctaacatcttgcatggtccgcaccagtctgcccagaaatccacaagaaccggcttatccgctttaagtacctcattattgaattcacttgcttttacatgtttgatttccatatcttatctcctttatctttaataattattatttcatatttctccgcatatattcaaatttttctcttctcatctccacaagcatctgcttaacattccattttctattagtatctgtcaatactgccttaaatgatacatcaaaacacttctgtctcatttcaaaaagaagcttatccatatgcttatctgtcacatcacaaaatacaataagactctctttattttcttgtggctgatatccctctgcatctgataatgatatgcctcttacatcatctgcaatttctgccaaagtccggtctgtatccgactcattaataaatccgcatataattctcatattagatgctgctttaatgatatgctgagggttcttaacattatataacaatatcttttccaacattaattatccttctttgcctttctgttagcaataatttctttgatttcattaatagattctttatgtacactcgaaacagcattaggatttctcttaataatacttgtaatatggctgtatcttctatcagctctctcagataactgtcttctttcttcagccactgctgccatgaattgttcctttttcttattaaattcttcttctgcaaatgtggccgtaatctccattcttctggcatacatctgaagctgttcattttctttcgtaaatttttcaagtgtcgccttaagatccatagcctcattaattgaaacagcaaaatctgctgccatgtatattgccagaactactgcaataatatctgctattgttcttggaatcataagtactgctgcttcgatgggcttgtgtattacacacacaagcaaaatagagaatgctccccatgcaagtgatataaagaaacatatatgccctttaaaattaagtggaagattgctgtaatcccagtatcttacaccaaaaagcttctccatgcagcagcctgtacagaattcaagtattgtagatgataccattcctagaagaaagaccagtggaacaatatctttcactgcaatcgtactaatcaatattacaattgctcctgaaccatatattggcaggaatggaccatgcaggaaacctctgtttacccacttatgttttctcacagaaacataacagcattcccatatccaacctaaaaaacaatatataaagaaaaaaataagccattgcgatacagcgtaatatctcataagcatacctccatatttaatcaaatgagaatatgctatatatacctacttcagagtttcacagaatttattaataataagtgctcttctgtttctgctgatttcaatatatttgccatttcccacttttgcaagattcttcttaatgttagttatataagatatattaataagcactgactgattaatataatgaaatccttctgtaataagtactctgtagatttctacaagactacaatacaattcaatttcaccagactcgcgtgaatgcatagtaactcttctgccacctcttgcaaaatacattatgtccgcaactctctccttatacacctttcttgaagattggtatacaaaataactttcattatcaatcttaattagttttatctccaagtaaattttctcctctcatatataattcttgcatgcccttctaattatatatgatatacaaaatatttcaatggaataattgcgcatcactatacacaatttggtcgaattttattatctctgataaactatctttcctgaagatatagtataatgtattttacctggtaattcccatccgataaaaggactattagatgcctttgatgcaaaatcttctttccttacggtccatagttctttttctccaaagataactaaatctgctgctgctcctttagtaatacttcccggtatcatacgatagaattcagcaggattcttactcattaattccataagcttcattaaagatatatgtcccggttctaccagtgatttgattccaagtgccagagatgtctccagacctgtaattccactaggtgcattttctaatggtctggccttctcttcatcactatgtggtgcatgatctgtcactatcatatcaatcgtaccatctttaataccttcaattatcttaattctgtcttcttccgttcttaatggcggattcattctggcattagttccatacttaagtaccgcatcttctgtaagagtaaaatgatgtggagttgcttcagcatgcacatcagcaccaagcttcttggcagttctgacaatttccactgaatttcctgagctaatatgctgtatacataccgatgctcctgtatgcaatgcaagaatacaatctcttgcaaccataacatcttctgctgtagcagatgcacctccatattcaagctgttcagcaactttcccctgattaactcctggtcttattataaactctggatcctcttcatgaagactgattggtaaatccaactctgctgccttcttcatggcctctacaagaacatgttcattcataatcggaattccatcatctgtaaatccaacagctcctgcattagcaagtgcttccatatctacaagttcaacaccttttaattccttagttacagacgctgtctgcaaaacatgaattcctgttgtctcaccttttttctgaatatactcaagagtttcaatattatcaaccgctggtttagtattagccatgcagactacacttgtaaaaccaccttttgctgctgctgctgctccagtaataatatcctctttataagtaaatcctggatctctgaaatgtacatgtgtatccataagtcctggtgcaacaataagtccctctgcattaattacttctgcaccttccataacattaagattatatccagtttcctcaattatattattcttaataatgatatccataatctcatctgttttactgacaggatctacaactcttccacctttgattataatcaccgatgtatctttcgcattattatcatcattatcctgtatctccgtactttctaatactcctatatcctctaattttgttccacattcagaacagaataaggcatctgaattattagaaaaaccacacttattgcatctctttttaatttctgtctgctcattttttaccgaaaattgcattgcagactccaatctagaaccacagccaatgcaaaatactgcatcaggtgttgtactacgcattccgcataccggacatatcttatcatctccaccactcacacatcctgtattctgtatatcagtctgcatctgcactggagctgtatacataacaggtggcgcttgatgtgtaaactgtactgtttctggttgctgtgtctgtacaacatgtacctgtggctgcatactctctctgtttactgcgggtacatctatagaatcagcatattcaccaagtatattccatgtcatattctctggctgtttaagcagttcctttaaccttaccataaatgaaacatctgaattcataggtgttcttatcattctgagtatctcatcaagaaaaacattataaaattcaccattattgtaacctgtagctggataatacaaatataaagcctttcccgtagcagattcaattaatacagtatcaagtgaaaccatgacattaccatattccatattatatgctgacatacccgacaacgcattgacactgctcttcataaatacagaaaaagtatgctggtctataaccctgtttttaaaaaactctttagctgtctcatatcccgctgttccatactctgctgtaaatccattattatctgacactatatgaaaagggagaaatccttctacagctgtatttgaaagtaattcagccatattctgattaagctgttcatcttttgtactcttaaccttaacactcacctgattattcttggaaacaacctttacttttcccataaatacatcctctcttcctgttatctgacttattatagatatatttcgtattatacatcacaattgctttatatgtcactcaaaagaaactatctttgcctttctgcttattattccattaatatacacaagaacatgctccttataggttattgaatctcttgcgtacataaatggttcttctctataaagcagacacttatatccctgtttctcatattcattcagatttgctattgcttttgcatgtatcacattatgaatttcctgttcttctcttgaaaaaattctctgtggataacctgatgccgcttccctcaaatctgctattattgcatccacaaacgcagcatgtttcctcattccaaacattgccgccagctgtatacttcttaaccctgaggttttcttcttataagctttaagttttcttcttatcgaattatcttcaactctctcagctatatctataagataatctacagcctcttcataaacacaatctgggtatgaaacataatactggtctggcacagactgaaatctcttaattggaggaaaatccgccagtttcataagcacacgttcagcatcattgcatacctcttctccaagatatctatacttgtctcttatatcagcaagctgatattcaagctggcgtaaatattcatatccttttatccagaaatgccccatgctgccataattaaataaatatgttcttaattccagtctgctgaattttattgtaaatatattcttattcccctgattaactataagcatatatccatcttttaacatctgcacagatggtatctgttcctcatccacatcaatataatttccagtcataactgaatctttaaatacaagaaagctctccactgcatcattcataagataagcaacaacccagtccttctccccttccatatgaacaggacagaatacattaagttcaaatacctgtgaaagcttaacgaacgcatcataatcagaatcacgcacgtcattaagcatatcatttttattatcttctgatacataatccacaattttactcatcaattacacatcccttaacataaagaattgcgtgttactgaaactctgttacatgctttctcatccacactggcataagatttctctgacattcaggattatagcgttgtttaattgctatagtctcaaaaaagattttccacatatctgtatattcatcattcacatcttctgtctttgccagaactgacatatcataatctgtaaaatatcttatatacatctgcccatcagtagtatgaactacagacttttttctgttatcatcaattataagccagttctcagaaggcattctatcagcaaaatgtaaagaaacttcatatataacatcgctttctggttcaagatgacacacatatactttgttaccaattgaattaaaccttgcaaactccataaaatatcttgtctcgtgcaaaaccttcctgcgtatatccttaattctcataacatcagggtcatttctcataaatgttatatctgatccaatcttaaacccttttatcagaaacctatatgctgtatctaatgcatcctgttctgacgataaacatgcataatacacacatgcatatgcctcttcagatatcttatgttttatcgagcgcactactttcttatactcttcttcattatactcaacatatatatattcgtcgaataaagaaatctgttcttctccacgcttttcaagtctaacacatccatggcctactttcaaagccttctcccatgcatgatatatacaacacatcatatcttcaaatgtattctcgcatgtaaatatatacataaacagacctccatataaaaactcttcattacatccatcatatataccaacactttttattcaaaaagtgaaagctgctgatacttttcattctgatgcgtaatctcccagttctccttgtgattatcatcagtcagacattccgttatatatgactcctctattggtattctatacatcattcttccattacatgttataaaataatgtgctctcttaagtactacaccaatcttctttaatatatcaaaatcaagcttcgcatatcttcttgtctccactattcgtctggcagacttaggaccaattccaggaattcttaaaagcatatcatatgatgcattctgtacttcgacaggaaactgtccaagatgtcttattgcccagtcacactttggatcaagctgttcattaaaattaggtctgctctctgacaataattcatctgcctgaaatccatagaacctaagaagccagtctgcctgatataacctgtgttctcttaatagtggaacatctgcatccagctgtggcaatgcagaatcctcattaagcggtatataagcagaataaaatactcttttaagatcataattcttatataaatgttgcgtcgttctgataagtgtaagatcagtttccggtgtcgcacctattatcatctgtgtactctgccctgcaggcgcaaatggacgctttacacacatatctttagaaaccgctggaagcgataacttatctcctgattccaacgctgttctctgtgttcctgataatgctgcttgaccgttatccgtcccgttctggttgaatatgcttcctgtcagatatctgttaatgctgcttctttccattcgtgcatcttttcccaatgccagtctgttagccgcaattgtacctgtaatcttttccataggctcaagaatagtcttaaaactcttattaggagcaagcttagaaagactctgtgctgtaggcagttccagattaatacttaccctgtctgcaagatacccagcccttgaaagcagctcatctggtgctcccggtatagccttaacatgtatataaccattaaatctatacttagtccgtaaaagcatcagtgtttcacatattctttccatagtatatgacggattcttcaaaaccccagagcttaagaataatccttcaatataattacgcttataaaactctataacaagcctgcataattcatcaggtgtaaatgtagcccgcggcacatcattagagcatcggttcatgcagtatttgcaatcatacacacaatgattagtcattaaaacctttagaagcgaaatgcacctgccatcagcaccaaagctatgacatacaccgcatgccacgctgttcccaaggaagcctttctttcccttcctgtctactccacttgatgtacatgcaacatcatacttggcagcatctgccagaatttctaatttctccatagttgtaagatctgaatgtaattcgaacatatgtttattatagaaacatatgttcggtatgtcaagcattttaatcaaaaaaaatagagccataccttatcagtatggctccgtctttttcagaacaaatgcatcaactattttctttactgtggcaatttcttccgaactgcacatcttcaattcatcaattatatctatacttgctctatttccacgcatatttcctaacatcagataatctggcgttacattaagataattacatatatctacaaacaaagttatgctgcaattggttcttccaccttcaatattagaaagatatgtctgcgacacacccagctctttagccatttccgtctgttttatacgcatttcctttcttctctgcttaagtctgggtccaatatttataattcgttctttcataacttcctcacacgaactctttcaaattattgataaaattcattattatttcctgatctttctgagacatgctgtcaaatatataatcaagaagccggcctctgacatcatacagatttaaatacatagatgggacataaccatacaaatcgtaaagtcttataagaaccattgcatccggaagttccttattattctcaattttgctgtatttaaatcttgatattcccagattatctgatataacctgttggtcagttataccattgacatctctaatacattttaacatagaatccttagttgaatccttgtcaatagatttaagcagtctgatatactttacagtatcatctgaaaaatcagctatcttcttctcacacatataaagaatatgctcactcacaacgcctcttacatattccttctttgattcttcaccaaatgtctctatttctgaagaaatcacatacctgcatggcttttcatcgacatcaactaacatcttgtcaatatccgcccctgaatcagaaaattttctgaggtcaatgcctgacaccatgctccttcccgcttccctgttagaatactctggtgtagtcatgccaacccgcacagccattttcgcctgatcgtagtccattaattttctatatatgctcattcttttgcaaaatgctttgtaacgatctgtatactccatagcaacccctgtacattagtatgattactattaaattttagtatacgcacattccgcacatatatagcgtttgttgcgaattagattagtgcaaatgtttatgtgcaattaatgataacatcttgattttatcatatcggaataaatttcttagtgtatagaataatatttgtgacagataataaaaatgttgcataatatcgcaaaaatacatttaagacattcaaaagtacagttgagacataagccatttaaaaatattttatatcaaatataattagtaatatcttaatgaaggaggaaaatgttatgaagaaaacaattaagtctgcattaagcaaaggcgtttctgccatgcttaaccgcactttaacttctggtgctaatgcttcatcaagcttttatttaaatcagcctgttgagccagcatcattaaagaagtttaagaaaacaagataatggtagagaaactttctcgccacataactttatggcttataaaatcaggtatacttgagaatgatgacattgatttatacatatacgcaatacaatatttattattgattattaatccgacaattattttcacagcgtattgtatagccactcataatataacgattggactaatagaaatattttcgtttttgctcataagaaaatattgtggtggttatcattgccagtcttctacggcatgcctgattttttctgccataatacttattgtgatggcatggctttcttctttcattaagccatcattatacatgtttattgcacttataattgctgatatggaattaatcattaaaggaccagtaatatctattaatcactcagtatcagactcagagaaaaaatattatcaccattgccttgtaggtattctggcggtttttaacatcattattatcgcagctactgtcttacacctatatagaacagcaagctgcatatcaattgtaattattttctgctttatttcacatattgcatgcatgacagaaaaaaacaggaagctgtactattaattcacacatacagcttcctgttttctatatcataagcattattgatattgtaaattcattttcatcaaactgttcaatgtggcttccatgatatttattgacaatcttatctatgctcttcattccatatccatgttttctgtcagaatccttcttaattgaaatgaaatttcctcctattattttaggtggaacagcacatgaatttacgcatttgataaatgttgtctcatgctttctcttaacaaccagttcaatatatttttcattaatttcctcacattgcttcgcagcttcatatgcattcgataatatattgccaaacaatgccactatatctgtggcaactatgtcatcaattgttcctggtcgtatatccacaacaaattctatattttctgtataacatttgctgctatattcgcttataagaccgtttagtacattattattagaaaatgtagttctcttcttaatattatactgttccataattgaagtaatataatccttcaaatcactattagtttccatacccagcattgtattaagatgattattcatatcgtgtcttaatatttcaagactttcgttcttctcattctcaagcttataatatcttgcatctgccttttcctgttcaagttgaattttaatgcgttcattttctgcttttctttcattaattcttatactcacccacaacactagtatatccgatgatacaagaataatagaacttgcaaccgcccatactgtttctctcgtatttacattactctcaacaccaatgatataatatgtaataaaaactgtcaaagaagcaataagcgtaaccatcagtaataacattgataaatctccgttatctgacacactgcttttattcttcatcataaccataatctgaattaatataaaatatagtattttacacagacacaaaaccatgacaattatcatggtattttttagttccacatatttaattctcattatgaattgtaatacataaaatatcatttgttctgaaagagccataattgctatgtaaataaccccccagaacacagccgctctcttattaacattataaagaatataaatcaataatatatatgtaagcagattgaccaccgttacaaaatatatattccccgtcagaaacacgacaaacatcacagcatgtcctgccatgataacaaagccggtcacccactgtttatatctatgttcatacatctgcgacatactcatccacaatattatagcttctataatatgtgcaaatgcataactgattataatttccatatccacctactcctgccctgccagatacagaagcattttctgcttgaatgcagttcttttttctcttgataaatctattggttcttcgatgcccttaagttcaatatacttatcagtaaatcgctcaactctgtctatattaacaatgaaggatttattgacaagaaaaaatttatcctcatcaagaacactctgccaataagaaagacttttgagacttatgtacgacttcgtatctgttttgatatatctttttctaaccagtgactctatgcatataatcgaatcctgttcaataattacattatcacccttatattcaatattgattttcttgctctgactcttgctgcataataataatgccttgtgtaaaccgcgcataatcacaggtctttccaatggtttattaatatacctgaaaactccctcgtccattgcatcatcaagatagcccatatacgaagttattatgaataacacaatattcttgttattatttcttaaacatttgccagcttcaattccattaattccgtccatctcaacatcaagaaatgcaatgtcaatcttttcattattcttagctacttcatcaccactgttatattcataaaccttataatccgttatcttatgatcagcaaagaattcatccacatattttcttatcatatcaacataaagcttatcatcatcacatattaatatattcatgcattgtcctcttcacttaactaattaataattttattatatcaaaatgtttaaaaaaacgacagaaatttcttcctgccgtttctcttaacatatatattatcaatctaagaagcctgctcaaactgcgaattataaaggtcagcatagaaaccgtttcttgcaagaagctcatcatgagttccctgctcaacgatatcaccatccttcataacaagtatcacatcagcatctttgatggttgaaagtctgtgtgcaataacaaagcttgttctgcccttcatcagattatccatagccttctggattctctcctctgttcttgtatcaacagaagatgttgcttcatcaagaataaggattggattatctgcaaggattgctcttgcaattgtaagaagctgcttctgtccctgtgaaacattgcttgcgtcctcgttaagctcacagtcataaccacccggaagtgtctcaataaagtgatgtgcattagctgccttggctgctgcaataacttcctcatcagttgcatcaagctttccgtatctgatattctccataattgtacccttatagagccatgtatcctgaagaaccattccaaatgcgtctcttaattctcttctgttgaaatccttaacattatgtccatcaacaagaatagctccatcattaacatcatagaatctcataagcagtttaacaatagtggtcttacctgcacctgtcggtccaacgatagcaaccttctgtccaggcttaacatttacactgaaattcttgatgatagtctggttctcattgtatccgaatcttacatgctcgaaatcaacctcgcccttaattccttctgtagaaacaggattcttaacagtctggtcttcctcttcttcatcaagaaattcaaatactctctcagaagctgctgccatagactgtacctgattgataacctgagcaatctgctggattggctgtgtgaaattcttcacatactggataaatgcctgaatatcaccgattgttataacatttttaatagcaagaagaccgccggttaatgcaacacatgcgtaacctaagttacctacaaacatcatgattggctgcatcattcctgaaaggaactgtgacttccatgctgaaccataaaggacatcattagtcttgttaaatgaatcaaccatatccttttctttattaaatgacttaacaatcatatgtccgccataagtttcctcaatctgtccgttaatatgtccaagatactcctgctgtgttttgaaatatccctgtgacttcttaacaacgaaagaaacaagtcccactgatattggaagtattataaccgcaataagtgtcataagcggtgaaatgcttaacatcataacaagaacaccaatcatagtagttaaagatgtaatgattgttgtaatactctggttgagtcccattccaagtgtatcaacatcgttagtaattcttgataacacctcaccatatgtcctgctctcgaaatacttcataggcatacggttaatcttctcgctgatttcttttcttaatctgtagcagaccttctgtgtaatgcctgtcattatccagccctgtacaaagttaaatactgcacttgcggcatacagacaaagcacgaatataagaattgttccaatctttccaaagtcaattccaccagttccaccgattttctttacaagaccttctgacagagctgtagttgccttaccaagaaccttcggacctacaacagaaaatactgttgagcatacagccataactgcaacaaatattatcgcaatcttatagcttccaatatatcttataagctttcctattgatcctttgaaatccttggctttctcaacaggtgccattcctcttcccggaggtcccattcttcttttcggtggcattttgatatttttattatcttccatactgactaggcctcctttccaagctctttagcagaaagctgtgaacttgcaatctgctgatatgtctcacatgtcttcataagttcttcatgcgttcccttgccaacaatcttaccatcatccataacaagaatctgatctgcatgaaggattgtgctgattcgctgagctacaataataacagtggcatcagacacatttgcagcaagctccttacgaagaattgcgtcagtttttaaatcaagtgctgaaaaactgtcatcaaatataaacactcttgggtgctttgctattgctctggcaatagaaagtctctgcttctgaccgcctgaaacattagtaccgccctgtgctataggactgtcatacttctcagccttattatcaatgaactcagttgcctgtgcaatctgtgctgccttaacgacatcttcatcgcttgcatcaggattaccgaatcttaaattacttgcaatagtaccagagaaaagcattcccttctgaggcacgtaaccaagctcacttcttaagtcatgcatagagatatttcttatatcatgaccatcaatagtaatgcttcctcctgtaacatcatacaatcttggaataagattaacgagcgttgactttccacagcccgtacttcctataattgctgtagtcttacccggctctgctttaaatgtaatatcctcaagtgcgttcgctttagcacccggatacatgaaatttacatgattaaactcaactacaccctttgcagactcaattgtctcaggattctcagagtcttctattgaagaatgtgtattaataacttcatctatacggtcagctgcaaccatcgctcttggaagcattacagacatcattgtaagcataaggaatgacataactatgagcatcgaatatgttataaatgcagtcatagaacctacctgcataactccggcatcaattctgtgtgcggcaacccacacgataagaactgacaaaccattcatgataaacatcatgcttggcatcatgaatgtcattgttctgttagtaaagagcattgtcttagtaagcttcttattagcttcatcaaatctttcctcttccttcttctctcttccaaaggctcttattacagaaagacctgtaagaatctctctggatacaagattgacattatctaccagcttctgcataagcttgaacttaggcatcgcaattaccataagaagcattacaaatgcaatgataaccgcaacagccataactataacccagcccatgccggctcccgttccaacaacctttataattcctccaacaccaagaattggtgcatacagaatcattctcagcataataaccgtaaccatctgaacctgctgtacatcattagttgttcttgtgataagtgatgctgtagagaatttgtccatctcagcattagagaatcccatgacattagaatacagttttcctctcatatctcttgcaacgcctgcaccaactcttgatgcaaggaagcctatacatacagaagtaaccgccataagaagtgccatggcaaccatcttaagaccagctgcccacagatacttagtctggatagaatccatgtccattcctgccttggcatccatgctctttgcataatcaacgcccatagacgaaacaagagtctttcccatggtatcaatagtcttctggaattcgcttcgcatagaaaggatatcgtctttactcatagcccctgcactatacattgccttcactatctgtctcatatccacacatatagtttcaacctcattaccatccgaatcttccatcatctgtgtaaatgtagttagttcaacgcccatagactttccaatatcttctaccgaaacattggcaagctgttcttcacttacatgcatctgctctgccatacggctcttgaatgcactttcagtcactgaagacatctggttgttaattataagtgctgtaaaaagtgtgtcgtctaaatcagtcttattcttagaacctttgacacttaattcatagacattatcatcttcattataagaatacgactgttcccacagctgtgcttcttcctctgtcataaaaagcttcgcagtgtcaaattcttccttagtaatcttttctggcacagtatgctctatgcctccattctgtatacctgtatcaatgatatctgaagtatacgcaggaagcgacaagtcacacactgcctgaacaataagcagtgcaaataccagcactatcgacttccagtatggcagcacatttttaataattctgctcataaacactctcccatctttattgataaatattttcaaaaaatctgctttcaataataaataagcgtttcttatattaacaccgattttcatcatagtaaattaatgtcaaatgtatttttataaataatttataaagaatgtttgaataataacaatatatatgttattatacgcgcgaacgtcatccgtttttcggagatgtatcttaacaagccggaagggctgcatacctttccgcaaaggagacaatatgaatactatcaatgcaactcgaacttctgcaacgaagttcaacactaagtacatggtggagctggcacttatggttgcggtcatactcgttatgtcactgaccccattaggctacatccgtacccctggactttctatcacccttttaactgttcctgtagctgtaggtgctatcatcttaggacctgtcggcggtttaatctgtggtctgacattcggactcacaagcttttatcagtgcttcgttggaggcgcaatgggaactgttcttctcggaattaatccatttggtacatttgtaacaacagtagtaacaagaactcttgaaggcttccttacaggacttatattcaagggacttcacagtattaatggagttaagaaattttcttattatatagcaagtctctgctgtcctttacttaatactttattattcatgagttcacttgttctcttcttctataatacagattatgtacaggccttcgttactgcactcggagctaagaacccacttatattcgtagtattatttgttggtgttcagggacttattgaggcaggaatctgctttattgttgctagtgtggtttcccgtgcattatatgctgcacttaagcttaaccagaattaatcagtcactttgattgaataaatcggacattaatcaacggaggattagttttgtttacagagatttcagttaatgatattaatgattttagattaggtcatgcttccaataaggaagctggcactggtgtaactgttatatattttccagacggagctacagcaggctgtgacattagcggtggcggtccggcatcaagagaaacacctcttactatgcctatgactgctgacaatccgattaatgccatcgtgctgtcaggcggttcagcatacggtcttgccgcatctgacggagttatgacatgtcttgaagaacatggtataggatataacacaggcgtttcacttgttccgcttgtatgccagtcatgcatatttgatcttggatatggaagctctaaagtacgcccagacagtactatgggatatgaggcctgcattcaggcacttatgaaggccggtgttgtcaatactgatgcttccaccgctgccaattcggatagcagcgaaccaattcagggctgtatcggtgccggaacaggtgcgactgtcggcaagattatgggaatgaagcaggctgaaaagtccggacttggaatatattcagtgaagacaggcacatttacaatgacagcaattgttgttgtaaatgcacttggcgatatatcagattatgaaaccggtaaaaagcttgccggacttaagaatgctgacagaacagaatatatcagctgcgaagaaacgctctatcagttcatggcacctcgcgatatgttcactggcaacacaacaatcggtgcgattataaccaacgctgcatttaacaaggctgaacttaacaagattgcatctatggcaagaaatgcgtatgcacgctgcattaatccggtcggcacaatggcagacggagatacaatatatgctgcaagcactgcaaaacgaggcggcaacggtgaagctgtacgtgttgatatcaacttcgcaggaacacttgctgcccgcgttatgtccgctgcaattaagaatgctgtaatgaattctaagatatctgatgaagaatttttaagcatggtaaagtaacacatgaaataatccccgataagctgctgttctggcagtcttaccggggatttttatattatctttattttaacattttaattattcacaaagcttagaaaatgcatccgcaacaaactgtaccttagttcctataataacctgtacagatgtctttccaggtttcataacaccagcaacaccagctgatttaataaccttatcattaacaagtgtaatatcctttacttcaagtctcagtcttgtaatacaattatctatgcttgcaatattctcttttccgccacagccttcaagaattgtctttgcaattgctgtataatcgtcacttgcaagttcaactttcttttctgcttctatatcatcatcttctctgccaggagtctttaaatcccatttcttaatggcaaataagaatacaaaatagaatacgaagaatgctgctataccaagaggaattatcaaccatgtcttctgtgctgccggaagagatgatgagaataacaggtcagtagcacctgctgagaaactaaatcctgctctgaagcctaatgcaactgtaatcattgtaaatataccataaagaagtgcatagataacatagagtccaggagcaaggaacatgaaaccaaattcaaatggttctgtaacaccacagataaatgcacataatgctgcagaagcaacaagtcctatagctacttttttcttagctggctttgcacatttaatcatagctaaagctgcaccaggaacaccaaacatcatacatgggaagaagcctgacatatacattccaagactccatgaaacatcacttgatgtttgtcctgcccagaagtgctgtaaatctccaagtccgatagtatcaaaccagaatacgttgttcaacgcatgatgtaatccggtaggaattaacaatctgttcaagaatgcatagatacctgcaccaacaatatcaagctttacaattgccttaccaacgcttactaatgcgctgaacagtaatggccatacaaataataacacaacagatacaagaattgatactactcctgaaacaattgctacgcatcgttttccactaaagaaagataaccagtttggtaattttgtatctttaaacttgttataacacatagcaccgattataccagcaagaataccaataaatggattctcaatcttgttaaatgcaagagttttagttgcactgtctgctatagaaggtataattactgtaacaaactttgtagaaagaagtgttgtcatcataagccacgaagcaagtgccgcaattcctccggtaccatcatttttatctgacatacctacaccgacaccaattacaaaaaggattgccatgttatcaattaaagctccaccagcttttacaagaaacagaccaatcatatcagctgcgccctgaatatctccaccctgcatagcttctggacacagcatataaccgatacccataaggataccacatataggcagtactgccacaggaagcattaacgcttttcccagtttttgaagaaatttcatacttttctcatcctttaaatcattattaatcggggttatcccaatcacgcgcattgtgaaatcctgagtaattatgatattttcagaacttcatcatcaatagatacctcaccctcctttattagattaattttattataatcgtcggtattgcatataaggactggtgtaatcgtatccaatcctgccgactttattttttcaagatcagcctctaaaagtaaatcacccttttttacctgctgaccacctgaaacatgtgaaataaatggttctcccttgagcgttaccgtatccagcccaatatgtatcagtaattctgttccctgactggttgtcattgtcacagcatgaagagtatcaaacaccattgaaatctcaccatctgccggagcatatatctttccttcagaagggattactgcaaatccatctccaagaaccttttctgaaaatgttggatctgaaacttcagtaattggcaccacttttcctttacatggagaataaataatattatcctttgactttcctttgaaaaaacctagcatattatctcctttccatcaatatatactctcttaatattcaattcctcatcaataagcacgaaatctgcttgttttcctacagaaatacttccgactttatcatatataccaatttcctttgccggattctctgttgcacacataacagctgtttctaatgaaatccctgcttttttaacgacatatcgaagacaatccattaaattagttgctgatccggcaattgttccatcatgtaatgttgccagattaccttttaccactacaggctgtcctccaagagtatattcgccatcctctaatcctgttgctctcatgctgtcactgattagtattatgcgtcccgcacccaacatagcaaatgttgcccgtattactgatggatgaatatgaactccatcacatatcagttctgcatgacattgatatgaatctcttactgcacctataacaccaggctttctatgattcatagggggcattgcattgtataaatgtgttgcatgagttacaccatgttgaattgcctccatcgcagtatcataatccgctgctgtatgagcaatcgacaccacaacattatcttttactttatctatgaaattcatcgcacccggctcttctggtgcaatatcaacaatctttattaaatcatttgcagctttctggagttcacagaaatactcataattacaatgcataatattctctgctgcctgtgcaccctttttttgtggacttataaaaggtccctccatattaattcctaccagatgggctccaccattatatgaatactctccggcattcttcataacttcaacaagttcttccttagctatcgtcatggttgccggacatatactcgtcactccgacagaagcctcataccgcgaaattatatcaagtgcctctttagttccatcacacatatctgcgcctttgcatccatgaaaatgaatgtcaacaagtcctggaatcatcttaagtcctgtagcatctactacttcattgtcaacataatcaggggcttccagcactttggtgaatgtgccgttatctacaacgacatctcccttaacaaatacattatcctgtgtataaacatcagcattctttataatcatatcttcacaactttctattcaccaagttaatatgctttaataaatcttactaagagctgcttcatctgctaccagtgttacatcattatgcagctgcagaactgatgcaggaacatatggtgtaatatgtccaaaaaaggcttctttcacaatctgtgctttatcttctccacttgcaacaaccagaatcttctttgcctgcattattgtcttgattcccattgtgtatgcctgtcttggaacatcttctgctgattcaaaaaacctcttattagcttctattgtagattctgttaaatcaacacaatgaacctgtttttcaaatgaatctgatggttcattaaatccaatgtgtccattatggcctattcctagaagttgtaaatcaatacctccaagagacttaatcagttcagaatatctgttacattctttttccgaatcctgctccattccattaggaatatgagtattctcaactgatatattcacattatcaaataaattcttatgcataaaataataataactctgatcattgtcctgactgagtcccttatactcatcaagattaacagtcttaactgctgaaaaatccaagtcaccttttttataccattctactaactgcttatataacccaactggcgttgaaccagtcgcaagtccaagtacacattccggcttcataataatctgtgctgatataatattagctgcctttctactcatatcagcataatcttttgctttgtatattttcatcacttatcactccatttcacatattctgctacgaacaccaagtaccattgatggcgatacactaagctcatctatacccatcttaataaatctctctgtaagagtggtatctgctccaagttctccgcagattcctacccatttgccatgcttatgtgctccctgtatggtcatctcaatcatcctaagaactgcctcatgatgcggattataaaatctgtccagtctgttattctgcctgtcaattgcaagtgtatactgtgtaaggtcattagtacctatactaaagaaatctacaagctctgcaagttcctcacttagcataactgccgctggtgtctctatcataattccctgctctggaatctcatatggaatattctcattctccagttcctctgccacctcagcaacaatcttcttaatacttacaacttcttccacagaaataatcattggatacattatagataaattaccatatttagcagctcttaataatgctctcaactgtgttttgaatatatccggctgttccagacatattcttatggcacgataacccagcgcaggattatcctccttgccaagaccaagataatctgcttttttatctgctccaatatcaagtgtacgaataactacttttttatcagccatcatctgtaatacctgacgatatgcattaaactgttctgtttcgtccggaagttcatctcttccaagatacagaaactcacttctgaataatcctattccttcagcatcattttctaatacataagcaacatcagatacatttccaatgttcgcataaaggttaatctttctgccactctttgtgactgactctcttcctttataattagcaagcagctttttctgttcctgttccttctgctgggcttccttagcctgcgctatctgattctcatccggattcaggtagaaaattccattctgaccgtctacaattgcattaactccattgggtaaggattctaactcaattggtacaccaattaatgccggaatattcatcattcttgcaagaattgctgtatgggaattagccgaaccatgtacaagcacaaatgctaaaatcttattcttatccatctgtacagtttcactcggtgtcaaatcatctgccacaataattgatggctctgtgttttcccagtcaggctgctcttcaccgctcaaattactcaccagacgattagatatatcctttacatccgctgaacgtgccctcatgtaatcatcatccatattagcaaacatgtcagcaaaattatctcctgttattgacaccgcatattctgcattaacattctcattgcatatcatattatgaatagcatcctgataatcttcatcttcaagcattatctgatgcacttcaaatatctctgcattgactttaccaacctcctttaatgccttatcatacagtctggcaagctgttgaagcgtcttttctttagctttgtccagacgtcttaattcttcatcaacattctcaacatgtacacgcttaatcagactttcacttttctttaggacattaactggtccgatggcagtacctttatataccgattttccaatatatttctccatattctaccctctcagattctaataataaacattcccccagatatacaaatatttattatattaactaaaatgtattgatttccatgtattaaattgtcgttcgctttattatgtttatatattaacaattttttaacaaattgtccagcattatttgtcacattttaataagtcgtgtatttttattaatacattgcagattaaaaggcaataaaaaagactaaccagccagtgtaatttataatacaacgctgattagtccatattagtattcctatctgtccgcattttttaacttatgattaacagccatcgcaaccacaccaagtaacacaatgaaaagagagataaactgcgatgtagagaatattccgacctcacctctgtaatcgtttcttaagaactcaattgcaaatcttccaagtccgtacgttatgcaatataagaatccaatattacctgctgccatatgctttccggcagtttccttaccgtcagccttgcgcttcataacagcagtataagaaaacttagctgctattatcataagaaacgccatattaaggaaatctgcccctgatgatataagctgtgtaggaataagcttaactcctgaaggagcaagagaatcagccgggaaaacaactccccaggctgcatctgtctgtcttccgtaacagcaccctgcaaggaaacagccaattcgaccaaatccctgtgccagcgctatctctggcattaccaggtcaaaatactcaaggaatgataacttcttaatccttacatatataaggttgcacaaaacacctgcaataagtcctccatatacaacgaatcccgatgagccaagcacacccataggatcttttataaaatccttaaagctcactattatatacaacagctttgctccaagaaatcccgaaactcccgcaattatcgcgatatcaataagagcctcctctttcattcccatcttcttagccctatactcgccaacaagcagtgccagcacaaaacctatgccaatcatcagtccataaccatgaattacgaactttcctatatgaaataaatctgtcttcataaaatcaatcttcctttctgtcgcctgcgaaccaatcctacatcagtcccagcttttcctttgccatcgcaagtcttctgtcaaattctgcataaaatgccttatcatcagcacatccggcatatgtcgtcatgtagaacactcttaagttaaatgtattaagaatcttcacattatcctctgaaagtcccggtagtgccgcctgaagctgcttcacatactcatgccatctgacaatataagaatcatactccgcaagtccctcgatgccaagccattttttcagtttaatcttcgatagattatccttattacactcgcccttctgcacaatatatttaaaatgtgtctcatcctcccagtatcttccaagtgggaacattctgcatattcccggtcttatcgtatgtatattgcacagattatcttcacgaagaaaagcacatcttccgtctgatttctgcatttttaaattaggcataataataccatccacaacatttaactcaagctcgttcatcgtaagctgttcaaatgttttgcccaatccggttgtgagcttgtaacagtcatatgggtcaagcacaatcgtacttcccatattctggcagcatacagtctgacagcccttacacgagttagtatcaacacgcacaaggtcattctcagtatacagtctgccatccgatatatcttctaatgaaacatttcttaacattattcaatcctttcaaacgtgtacaaaagattataaatcttcacgcacatatttacttcacatgtaactatagtaaaaaatatgtatcaaatcaagaacattttactcccatttttcgccataatgtgctaaaatacattcttgtatatttattttaggaaatctgatattgagaaaggattaagaaaaatgaaagataagattgttacatttggtgaaattatgcttcgtctctctcctgagaacaacgcaagatttactcagtgcaatgcatttgaggctgtttatggaggtggagaagccaatactgctgtgtcccttgctaactttgatgttgatgctaattatgtaacaaagcttccaaaacatataatcggacaggctgcaatcaactcactccgtcagtacggcgtaggcgtagaccatatcgtgcgtggcggcgaccagattggtatctacttccttgagaagaagacaagccagcgtccaactaacgttatctataacagagcaggttctgcatttgcacttgctactgctgatgattttgactgggatgagatatttgacggtgcaacatggttccatttttcaggaatcacacctgcaatctctgatgagatgactaacatctgtatcacagcctgccagaaggctaaggaaaaaggcatgactgtaagctgtgacttaaactacagaagcaagctctggtcaagtgaaaaggcttgcgaggcaatgtctcgtatctgccagtatgttgatgtatgtatcgctaacgaagatgacgctatcggtatcttctctatgaatcctgccgacgctaatggcgaggagaaaaatgcttacattgccagggaacttatgaagaaattcccattcaagatggttgcttcagtatggagaacagaaacttctatcacaacatttaagctccagtcaatgatttacacagaaggcaaggcttactacagcaaggaatttttcatgcacattcttgactacatcggtgccggagacgcttactgcgctggtcttatctacagccttatcaacaactttgaccctcagaaggccgttgaattctctaatgctgcaagctgcttaaagcatacggtaagtggagattacaacttagttacagttgacgaagttatgaagctcgctttctctgacgctggtaacgaagttcagagataattaatatcacaaaaaacagtaccaccaatcttaattcaaaaaagattagtgatactgtttttttataccattctatcagactttatcttacttgcaaaagaagctgtaagaataccaaccagcccttctaaatcatcatatattcattttctaagacttatccccatacttcttcagcaatttccttgacaagctttaacttagcccactgctcttcctctgtaagcttatttccaatctcgcatgaagcaaatccacactgtgggctcagatacagtctgtcaagaggaacatattttgctgcctcatgaattctgttaataacaagttccttgttttcaagcactggtgtcttagttgtaacaagtccaagaacaaccttcttgtccccggatacctttgctaacggtgcaaatccgcctgaacgctcatcatcatattcaagataataagcattaacattttcctcaccaaaaagcaggtctgcaacactgtcatatgcacctgagctgaagaatgttgaatgataattgcctctgcacacatgtgtattgataagcaggtcttctggtgcagccgcagcaacctcgttgtttaacttaagcattagtttcttataatcttcaagcgcctcgccgcttcttcctgtaagtgcaacagcaagttttggattaaccattccgccccatacgcagtcgtcaaactgaagatttctgcatcctgccgcatatatctctgcaacaaattcgttgtaagccttaattacatcatctgcaaatgcttcctctgttccatatattgcaagtgtatctgaaagaagctctgcacctgtaaagtacgcatagaactgtcccggtgaaggaattgtctgttttgcaacagtgttctcgtcctctaatgccttaacgaatttaaaatgttcaacaaatggatggttctttactgatatttttccaaccatatatgtatcatcaatcattgctgcttctgcgtcaaatgttgtattgccgtcaactgtctttctatgctcaactccgttgaaaccccacatgaaatcaagatgccatgtagatcttctgaactctccatcagttataacatgataaccaagtttcttaacctttgctacaagctctcttatgcagtcatcctcaacagcagtaagctcctcctgcttaatctttccactttcatagtcggctcttgccttctttaatctttccggtcttaaaaagcttcccacataatcatatctgaatggtgtatttaatgtactcatgtgtatcctcctgttataaatcaatcgtgagaataattgtatcagatgtgatttgatatttataatacatttttattgtggttagccatagttttaaactatggctagttttgctttatgaccttatttacaggtgtgttcacatactgaaagaagccgttatggatccatccttctgataagaccataaaataaggcagccccgcatagctgagtctgccttactttctttatttaatgttgatgccactggcatattgctgcagaaactgtttctttccacatggtcttcctaaataatatccctgcagataatcaaccttcatttctttcattttcagaagccattctttttcctcgatgccttctgcgcatatcctgacgttaatactatgtaccatggtgatgatatttttatataattcataatccctgtcactgttcatcgccttggcagtaaaatccctatccattttcacgtaacttggattcatatcacggatacaatgaagattcgaatatcctgttccaaaatcatcgatcacaaagggaatcccgttcttgtccagagttttacggaatttacagaacgaaggtgtcatatccataaatccgctttctgtcatttcaacacataagcattccggctgtaatgaatatttttgaattgcatccagaatatcccgctccacattgccttgcaggatctgaacataggatacatttacattcatccgaaaatcaggaatatatttctgcatttcacagcacattgctgcagcttcgttcaaaatatatcttccagcgggaatgattaatccggtctcttccaataatgggataaactccatcggtgaaacaaactcccgcccttcttccgttatcatggaaaaacgcatcagtgcctctgctccaatgatctgttcggactgacagtccacgatcggctggtagtatacttcaaagccatcataatggttcacaatagcattacgaagtgttgctatgattcttcctttatgtaaaaagacctcatagtcatcctggtcaaaaatatagaatccatttttacccatgctttttgcctgtttcaaggcaaattcaaactttttgcggcattcttcggttccctcacaaaatgttgctgcatctataacaccaatagaaatagaaaatatagcttcataattttcgtctactatgaaattatgaagtttatctgaaatcttttctttcagtgccacagcttcttctgcggaggaagcttccagatccacgatcacatactgatccgctaccagatggtaaattctctgcttgtctgaaaggcattccttcatacagccggctacgcttttcaggatataattaccataatcagctcccctagagctattgatcgctccaaaatcatcaattcctatatgcataaaaaatcccttggtaatgggttctttttgtgcacgcaggtaagcaaggaattccggaccgccaagcagtccggtgacattatcagcccttctcttgttgccggtctcattcagacacccgaccagatactctgcatttccctgctgatcattgacaacgataccacggctgttgatccagaccggcataccttctttatcaagccatctataatgaagattatgtaccttttctcttccttcacatatattcgcaagatgctttgcaagcatctcacggtcttcttcatatactacattcataacttcatttgacatatctgtcaggatattactcggtatattaaatcgttccacagctgactgtgaaatctcaaaggtattattctgcagatcaaatatatacagataatcgtccatacattctgtaatgatctcaaataaaatatcagctgcctgctctccaaataatttaaatatatcattaatcacaacaataaccttccttatgactacttcactctattcctgtcattttctagaataacttaaagatattcacgcggtcatgcatcttggctgctccctctgccagattaatactgatcgcagtattctcttctgaggatgctgcattgccctgtaccacaccggacagctgttcaattccctgaccgatctgttccaaggactcagcctgggagtttgctttctccatggtgttctgtgcaatctctgcaaatgactccatatctgcaatgatctgattgaatgcgtctgctgttgttcttgtaatcgtattgccattttcgatttccactaaggtcttatcgatcagatctcttgtatttacagcagattttgcactgtctgctgccaacttgccgatctgatctgccactactgcaaagccttttcctgcttctcctgctctggcagcttcaatggaagcattcagggataacaggttagtctgggatgcaatatcctcgatatctgtgataatattaccgatctccttggagatttctgtaatgtgctccatttccatcagcagatcgttcattttttctttttcttcgttcgctttatctgcagaggcttttacacgtgcagatgcgctctgtgtttccttcgctgtatctgccgccagatccacgaccgtatcaatggtggcattcaattcctcgattactcctgcctgctctgttgcaccgtccgccagggattttgatgcattttccacctcggatgcattcgatgctacctgttctgccagattgctgatctcggtcagggtactgttaaaccgtttcagaatatacagcagtgataccttcaattccgagaaatcgcctaggaaatctgtaatatcatcaccatttctggtcaggtcaccctgcgctattgcctttacctccacagagatctcgctgacataatctgccagaatacccatggcttctttcagattcttaatggtatcgccaagctcatcctcagactcataggtaagcatttctacattagacagttcgcccttacgcaggctggcaactgctgcatctatctgttctaccggctcagtaatggaattggtaatgatccttccgatcagtgtcgtcactacagcaatcgcaagacccgctgccacaatcacgacaaatatgatgatggtgcatacattggccatggtctttgcctgatctaattctacctggaactcgtcacgtaatatagttaatttttcagtaaaagctttatattcttcatacacctctccggtcatcagctttgctgcttcctgctgtttattctcacggctcaacttcaggatttcatctgaagcagccctgtatttttcccatgcagcgtttgctacttcgtaatcgttctgtccttttttagcatcactgtctgcagacatgattgcatccagattcgcatctgtatcttggatctgactctccagcttccgaatttcctcttcacaggcagtcatatccgatgcatctgattctaccaggtgctgatactgcttgattctgtatttcgcagtcattgtctctaaatcctgcagatattccaatgacggagaccagacctccgtgatcttctctatatttgaacggatcactaatgtcgagatcagtgccaccaacactaaaaataatgtcataacaagtactgtcattcgatatacttttaattttcctgcaacctttaagttagctatacgctttttaatcttttccatgatagttttccctttctttgtaaattattgatcttttatcacatttgtttatccataaactgctataagatatcatactttattggaaaagtctataaaaaaaagtattaaattattttctgctaaatattaatggttctatcgctagaaactggtgaaaatacttctttctgaccatccaatcccaaatcttttgccatttgttccatatccttatatatcttgtctttgtacttatcataaaggaactcaaatccatctttgcgaagaattgatggcgaattatccatgtgaatgcagtctttcataacacagtcatatgcaatatttctgcacataaatagactgtatgtctagacagcttaagctgttgttctgttaactgcaaactgcacttctattattgttcctcctgatgggttaggcctgattgcaatactgccatcgtgtacccgcacaatttcattaacaagcgcaagtccaagaccaacaccaccaagctcacggcttcttgatttatctacgcgaaagaaaggttcaaacacacgttccttaagttcctctggaattccacttcccgtatcctctactgacagataaacctgcttttccttctgatatgcctctactatgacctgtccaccagaatgattatattttatggcattctcaacaagattatatacaagcctatatataagtatatcacttccaaccatatttacatccttacattttccaataagctttatattcttttcctgtgcaagtggctccagatccgccaatacctcatcagatggcaaacaaggcagatgtggcaatggtgagggatatagcttggatgataatgattacagacctgacggatgtctggaacttccaagcacactcagcattgcctgtcggtcagttgcaaaaagaaggggctgaaaagcctgctcttatatatacatatatctgtctcctattttttaactccagctcatacggatatcatacatcagccttgtaagtgcaatactgtctttagctgtatatacatcactgctgcaatatccaagttttacgcatctgcttacttccctgatttcatattcaaagccatttatatcaaccggactctcgattgtttccggttcttttccttccacctcaagtatcatggtctcggcgtgttggaaatccggtaaaaatatacttccctttgttccctcaattctggcattacgttttaattcctgcccaattgtctggactgattctgccgtacatccatcattatatgtcagtttgagacagctgtaatcatctgttccatactcattaatatgtactttttgagtttctacattctgcggctcatttcctgtaacaatacgcagaaatcccagattgtaaattcctatgtccaacaaagcacctccaccaagtgcagggttaaatttacgctcttttctggcacctgttgcaacaaacccatactgacatgaaatatgttttatttctccaattactccttgctgtaagatactgcgtaaacgatcatacaatggaagaaaccatatccagagtccctccatgataaaaagatgcctatcccttgccagtctgtacagttcctgtgcctgtttatcatttatcgtaaacggcttttcgcacaatacatgctttccatgttcaagacataacctgcaattctcataatgcaaagtatttggtgttgctacataaacagcctcaacatcctgatctttaaccagtgcttcatacgaatcataatatcttgggatatcatgctcattagcaaaggcttttgcactttcaatgttacgtgaaccaactgctactaactgttcattttctttactcatctgatttatggttgatgcaaatttttttgcaatattacctgtagccaaaattccccacttcatcttatctctcccatcgattctataaatttatatgtaatatatcctcatttaacaattattaaaggaaacacatctattataccttatatcatcatcttcgcatatccattttatatcatattttataatacaaaaggtcagacccgccaagcccaatggttactgacgaatctgaccttttacaattactaaaaattttatatattatccttcaatctctttaataagattaaccatctcaatagcaccttcagcgcactcaaatcccttattgcctgcctttgttccggcacgctcaattgcctgctcgattgtatctgtagtaagcactccaaacataacaggaatatcacttgctaaagaaacatttgcaatgcctttggaaacctcgctgcacacataatcgtagtggcttgtagcacctcttataactgcaccaagacatataactgcgtcatatttgccgctttttgccatctttgaagctatcaatggtatctcaaatgcgcccggcacccatgcaaggtcaatattttcttctgaaacatcatgtcttacaagcccgtctttagctcccgcaacaagcttagacacaataaattcattaaaccttgccgctacaatacctaccttaattccactgtcaactaacttaccttctaaaactctcattatcaattcctccttataaataatccatatttttacactacatttaaaatgtgtcccatctttgtctgctttgtcttaagatagaacctgtcaaagctggtcgcatctatctcaataggcactctctcactgatttcgattccaaaatctgcaagctggtataccttatcgggattgttagtaagaagccttaagctcttagcgcctaagtctttcaatatctgtgctcctatgtagtactcgcgtgcgtctcccggcagaccaagtgccagattagcctcaagtgtatccattccctgatcctgaagtgcatatgccttaagcttgttgacaagcccgattcctctgccctcctgtctcatataaagaagtactcccctgccttcattgttaatctgtgtcatcgctgacgctagctgctgaccgcagtcacatttcattgagccaaatgcgtctccagtcaggcactctgaatgtaccctgcacaaaagattgctgccatcaccaatgtctccctttaccaatgcaacatgatgctcgccatttaacttattaacataacagtgtgccatgaattccccatactttgtcggcattcttgtaactgccacacactcaaccaagttgtcatgtctctttctgtattcctgaattgctttaattgttatgaatttgagattgaatttttcggacatttctatgaggtcttcttttctcatcattgttccgtccgctttcattatttcacagcacagaccacattctttaagtcctgctattctcataaggtctactgttgcctctgtatgtccgtttctttcaagaactccattaggttttgaacgtagtggaaacatatgtcccggtcttctgaaatcctcaggctttgcttcatctgacacacatgctcttgcagtaaagcctctctcctctgccgatattcctgttgtcgtcttaacatggtctattgacactgtaaatgcagtttcatggttgtcagtattgtcagcaaccatctgtgtaagtcccagcttcctgcacaaatctccactcataggcatgcatataagtccttttccatatgtcgccatgaaattcacattttcagtagttgcaaattcagcggcacatatcaggtcgccctcattctctctgctttcatcatctgagacaagtatcagctttccatcctgtaaatccttaactgcctcttctactgtgttatactcaaacatttcctttgcccatcctttctatttaatagttattctagaatccattctttagcaggaactctttcgttatcccgcttttcggcttttccttttcaaatgtgatgaatttctctatgtacttaccgacaatatcattttcaagattaactacatcaccgactttcctaagtgacagcgttgtcgcacctgccgtatgcggtattattgatactgaaaagctctggctgtccgtcttggcaaccgtaagacttattccatctatggcaaccgaacctttttcaacgatatattttaatattccgctgtctgtcttaatctgataccatatcgcgttatcatccttggttatcgctgcaacttttcctgttccatcaatatgtcctgaaactatatgccctccgaaccttccatctgctgccattgccctttcaagattaacagcactgccactcaccagcttgccaagtgatgagcggttcaatgtctcatgcatcacatccgcagtaaatgtattatcatatatccctgtcactgtaaggcacacaccattgacagcaatgctgtctcctatatgtgtaccctcaaggactttttctgcctgtattgtaagaattgctgacgccgttcctttttttacattatttacatgtccgatttcttcaataattcctgtaaacattacaactctccttcaatcagaatatcgtcaccaagaagacgaacggttttgtttctcaactgatatgcttcatctacatttgcaataccctgaccttcaactgccgtcttactgtctgccccgccaaatatcttaggtgcaatgtaagtctgaacccgtttcacaattccagcctgcaatgccgagaagttaagtgttccacctccctcaagaattatactgtcgatacctttttctccaagtatgtgcataagctctttaaggtcaacatgctgctctgattcttttgtaattatcacttcacaacctgcattttcatataaagatttcctgtctctgtcggtactgcatgtagcaattattgttggtatctgccctgcactttttacaattctgctgtccaacggagttctcaatctgctgtcgcatatgattcgcacaggattgtgtgggttgcttatggctgtacttctacagtcaagcattggattatcagcaatcacagtgccgacgccaaccataattgccgcatatctgtgacggtctgcatgcacattttctcttgcctgctcacccgtaatccacttggaaagtcccttatatgtggcaatttttccatcaagtgtctgtgctgttttcatcacaacatatggctctttattccttatgtaatgaaagaatacataattcatcgccagacattcttcattgcatacacaaccttcaactttaatcccgtgttcttccaaatatttaacaccttttccacttaccaggggattaggatccatcgaacctatcacaaccctgcttattcctgcctgcacaagtgcttcagtgcaaggcggctgtttcccatgatggcagcacggctcaagtgtcacatatatggttgctccactggtatcctccatacatcttgaaagtgcatctctttccgcatgaagctcaccatatttcctgtgccagccttcacctataattctatcatcctttacaattacagctcccaccagcggattaggattaacccagcctgttcctctcttcgccagttcaatcgcccgcttcatgtagaattcatcttcttttgaaaaattgttatttatttcctgctgcatatctgcaccttctttctgttccttcctgtccagcttttctctgttctgcttttttctgtcctgattttctctatccttatttcccttgtctgctgtatcttaatttcattcttaatgtgcttgctgctttcttgattttaccggctcaaagtcgtgatacctataagtagtcgcattttcaatggtttagtaggtcttttttcatcttgtctataatattaaacgcatttttattcctcaaaaacctataaattcattgtttatagctcatttagtaggtaaatccatatgttttctttggttttcctccaaaataaacctaccaaattcttaaaaagcttacatttataggtttttaccaaatttacctgctgccattctgctctgaattgctataatatgccgccagattgctcagaattgaattgccgtaatatgctgcagccacaattgccagttccaacatttcagaccagactccgcctcaataatacagacatcctagcacaaccaaaatccagcccagacataaaaaaggcttccaaagcagtttcatttcaccacttcagaagccatacgccaaaatatcgaatttctataatcaaattcttactctgacaatcaaaaaactctgagataataattcatctcagagccagtatccacattcaagccagccattcattctactatgattacattatgaataactaactttaatatcacttcttccatccagactttactgtcggcttcggaattacaccgaatcatgctctggcttacgcctcggctcgtgggctttaccaccggtagggaatcacaccctgccctgaagttccatatgtattaaattatttatagtatacacctgatttttaaaaaatcaagtacttgacatatttattaattttatgatactataccacggcacaattaaatatggttatattggaaacgagacatcccccggatgataacgaacaacacatgttttgcttaggttattatttaaggaggatttttttatgccaaaaaacaagtttcaggatgttgttttcacaattattatggcaacaattatggtatatggaatggtcgtatataatgttgccctcaacacaggtactgtaaatggtactactttcttagctgcaacacatgaattgccaatcatggttccaattgcattcgtactcgaattcttcgttgtaggaaagattgctaaaatgcttgcgttcacagttatgcgtcctacagacagacctcagttcatcacatatgcaatatcaatatgtatatgctgcattatgtgtccggttatgagtctcgttgcaacatttcttttcaaagaaccatcctttggcatgtgggttaaaacatgggcaatgaattttcctatggcaatctgctatcagatgttctattgcggaccatttgtaaggcttatattcagggcaatatttgttagaaaaaatgctgatgcaacagaagctgtaacggctgcagaggcagaataatattaatcactaaggggctgtcacttgacagccccttaaaaaaatcaattatttataatattacattttcaaacaaaaataccattaccggcatggttactatagcactaagcgttgtaatcacatttatggcactggcatattttgaatcattgccatatacctgacacatctgcgtaactgttgatgctgaaggtgtaataactgccaagaaaacaataagcataattttaggtgcatcctgagaaataccagcaagatggcttaattttatcaaaagaagtgctataagcggtacaacaaccattctcaacaaagaaacaaaatacagccttctgttagcaaaaattttctttaaatccatccctgcaaaaagcattcctgtaactatcatgctggcaggtcctatcatattgccaacagagcctatcgtatcattaattattaaaggcagtctaattcttgtaaagaaaagtattacaccaaccacaatcgagatcatatttatatttaacacaatcttcttccagtcatatgaactttcacggctgattatttttttacagtgagtccacaaaaagataagctgcacactcatgaaaacacatccgtaaagcacccactcctgacctagaataaatgtcacaattggaacaataagattacctgaatttgaataataaacagatgctatctccacctcattcaggtgaaacaatctcccaataactgatataactccaagcaatacaatctgtaatgtcactgatgccgccaaagcaagcaacaacccatttactgtctttgatgtataatccacctgaaaagcctttataatgacacatggtataatcaggtataaaacaattttggataaaactttactgtcctcatcttttacgatacctgcttttacaataataaagcccataagaatcataatgaatagctctactatctgttccataagaagtatgctaatatgcataaaaatcatctcctattgttatgatacgcccaacgcattatatacatcttttgcaattatcattcatccaccaggcataacattcttttaagcaaaagcctcctcttttatataaaaactcaatatataagcaggggaaacttttccccccacctatattacatatgttctttgcaaatatcaagatgcaagactaatgccataggtcgtatgtctgattgaataatagctcctgtcccatacgccgcaaattcatatgggaaaatcattcttgctatttgtattgtttaagaaatatttatcggaaagtggcatagataatgaccatatcattgagattgctttagatggcattgaaaatgatgagttgagagatccaaagaagtgttaccagtatattaaagatgcaatgaaagatgaccagaagtattatctacttttagacgaagtacagtttatgccacgatttgaggaagttctgaacagcctgcttcatatcggcaatattgatatatatgtgactggcagtaattctaagtttctatccagtgatattgtaactgaatttagaggcagaggagatgagataagaatatatccgttgtcttttgcagagttctatgcagctttcggcggagattatgatgatgcttgggaagaatatatgatatatggtggtttaccacaggtggtacagttctctatggaacgccaaaaggctgagtatctaaaaaacattttcacaaatgtttatattaaggatgttgtagaaagaaacaagcttcgaaatgttgatgagattgatacattagtagatattctcgcttcttcgataggggctccaactaatccaacaaaaatatcaaatacttataaaagtgagcgtggtataaattacagcaataagaccatatccaaccatatagattatcttgtggaggcatttttgatttctaaagctgacagatatgatattaaaggcagaaaatatgtgggggcaaatctgaaatactattttacagatgtgggacttagaaatgccagattgaattttagacagcaggaatctactcatatcatggaaaatattgtttacaatgagctacttatcagaggctataatgtagatgttggtattgtagacgtatatacgaaaaatgatgaaggaaaaacaactcgaaagcagtttgaagttgattttgtggtcaatcagggtagtcagagatattatattcaggtagcttacgatatgacttcagaggaaaagcagaagcaggaacttaattcatttagaaatattccagattcatttaaaaagattgtgatagtaaacggaacaaaaaaaccttggagaaatgaagaaggctttgtaatcatgggaatgaagtattttttgcttaatgcggatagtttggagttatagtatgcttggacttgacagaattttttagaatgcgggaagcttcttgcatattaattactagtcctcattagaaattccatatggtaacacatattcttcatcaggcagttctgatatttcacctgcattaatgtttttactattttcatacacaacctccagcaatttaataaaaaagaccagcaaaatgctggtcctaaattatgtatatatccagacatacaatcaccaacatgtggtcaaaacatctggaacactccatttgtcaaaaatttctaatattacattataatgggtaagaacttaagtcaatacctgtattttatctaatgttatttatgctgcacgatgtatatctttttagtttaagcatagctttcttccatatcactgatatcttcaagaacctcccttattccataaagcatttgctcttcagttaatttatgtatcacttcccgcttagagatctgattctcaattattggaatcaaaagatttcttgcaaatttcttcctatcattacttgcaaacatatctttaagagtttttccatctaatttatcctttaatctgtctacggacttttctgcttccttattgctaagaagatattccgatgccatttcagtaaacacatcctgaattatttccaccattttatccgcatcatcttcaataaagcttccaaccacagcatttgttactttacctgctgcagaaccagcaaccatagaaccaactaagccacccacaattgtacctattcctggaattgcggaaccgattgctgcgccggcaacccagcctcctgttccagcccctaccgttgcagctgtatttgccatatttttaaacaactgttttcctgatattctccctctgaatatgttggcaacatcaaaggaagacagtacaacaaatgtgatgcctgctgtaattgtattgctccttaaaagcttggctgctgctttcattgccgctgcgccataaataggctttgaacctacacgaaatgcattaattaaaactgcagatgctttcggtcccatcatagcaactatagcttcggaacttccaacaagcgcactattaagcccggcttttgataattgagctgcaagtatcgaagtaataaatgctgttccacctactttaagacctgaatatgtcgcaatctttatagcatcttcaaaatcttctccattccacattgatgttgcaaatgttatcattgcagtaacaccaaatgcagatgatgctattattgttccgtttaccgcatcatatgtaagagattcaacagtacccgctttggcaatatttttagcctgtgcataggtaaagtgtcctttcttaacaatattctttgcttcattaggatcagacacaccctttacctgtccgtttttaattttctcttccattgcccttacagcttcatcatacttatcagacggaacttctatcttcattggttttccatccgtcatatatctgaatgtaccttttccatcattttcaaagcattcatttatacatctttttcctgtagcgcaatacttcgactgtatatttacgccatcaacaactctgtcagcaccatttttagcgttatcatctccaacaatctttgcatcatgtcctgtcagtttatcaaataggttattagctctttccgcggcaaaaccatgtccctgtcttgaatgaaatttctcttcttcaaactgattattaacagtcctaaatgctcctatccctcgacctgctgattcagctccgaaattattcttcttttcattttcaattttcttcttctccgcctttttgttagcctcaaagtttttcatttcatttaggaaattttttaatggagtcttgtttataaaagaaccttctatataaaatgtgcttccgtctaaaaaatctattgccaattcacgattacaatcttttttgctactcttcaatatcctcaattgttttatatcatcataccaaagctttttaggcttctccattgtttccacataatacatcttatcatcagtaaaaatataaccatttttaccacttccaaatacagttgtatcaagaaaacctagcattgtagttctatccatcccctgtgcaaatgtttgtaatgcattatcaattttcttaataggaatatttcctttgacatgataatttccagcagccgtcatatctgccaaatactttctcattatctcaatcttttcttcatgttcccccataaaactaattctccttattctctgtcactacatttcctaataattcaacatatctgtgcataagctcctgcaaataaaacccattcagcctttttgaaactggaagactatcaaatttgctgcctgcataatctaaggcctcattccacaacttatttaattccaacttttcaggatacatttccgcaaacgcttcttttattgtatcttctatatatatcttcttatcttcaacaattcttttcttcttatcttcacctgcaagaaatggaaaatccatatgcattgtttcattcaataatctgtttatcacatcacagtcaccattcatgtagcttctccttgaacccatcttattctttctttaccttttaatcatacttttgccatcagcaagaaatatatttctgtttttcacgcatataaactgaatatattataactctttgatgacttgacagcaagatttgttatttttcatagcatctaaccgactgcaatgatttcgcacttccatttattaatatattataaagcagcttgttatcagaatatatgagatatataattataaaatagaaataaaaagcacaataaggagcaagcagatatatgttttattttatattggaacccataatgatgtataactggatattaatattagcggcagttatccctgcggtattccttatgattaaagtatacagagcagacagaatggaaaaggaaagcggctaccttttaagacagctagttattgcgggaattctatccaccattattgccctaattgaggaaaaaataggggaatggattttatcatgctttgttcccggaaataaattgctgtatcagataattctttattttgttattgttgccatagccgaagaaagctcaaagtatttcttcttaaaaaaacggacatggaataatccagaatttaactgtcagtatgacggtgttgtatatgcagtatttgtttctctcggatttgccctttgggaaaatatcaactatgttttatcatatggtttttcaactgctattgtaagagcaataacagcaattccaggacatgcctgttttggtgtgtttatgggtgtattctatggtctcgcaagaaaacagtataatcggggaaaaatgtttagctccaagatattcagaatattcagcattgtggtaccagttcttttacacggttcatacgattttatagcgtccatggaaaatacaatgggcagtctatatttcgtggccttcattattatactttttgctctgtcttttggactggtaaacatctcatcaaagaatgataaatacatatgatataggaaacactccgactttctttattgttactacatcttcatcggcaagcacttcaccttccaatgtataaattgctgtagctgttatatcataaatcgtagctgcatcaggttctgtcacatctgcagtataagtagcaacatatttataagccagattattggcaggaagatatgcatctccgtcccattcaatggagtttattttatatattgataatcttttatttttttcgcataatccgtatatttccaccagaatatgttaatatatgaatagcaatccacagattggagaattaccatgaaagcatatgaaagattattaaaatatgtcactttccgtacaccaagtgatgaaaacagcgagaacacgccctcatctgcatgccagtttgagttagccagatttcttaaaaatgagatggaaggattgaacttatcggacattgtacttgacgatatgtgttacctgtatggtaaacttccggcaaccaaaggttatgaaaatgtgcctgctatcggatttattgcacatatggataccgtgtccgattattgcaatcacgatattacaccagtaataacagaaaactttaatggtgtatcactcacacttcctgcgggaataaccttgtctgtgcatgattttcctcatcttggcactcttaagggtcgtacacttatcacatcagacggaagcactatacttggtgctgatgacaaagcaggtattgctgaaatccttactatgatagaacatttgcagaaaggcaatatacctcatggaacaatatgtattgcattcacacctgatgaagaaatcggcatgggagctgaacattttaacatagaacagttcggtgccaaatacgcctacacaattgacggcgacacagaaggcgagattcagtacgaaaacttcaacgcatgcaaagcggattttcatattaaaggcttcaatgtacacccaggttctgccaaagacaccatgattaatgccagtcttgttgcaatggagattaacaatgcacttcctgctatggaaacccctcgcggcacagaagattacgagggcttctaccatcttgtcagcatgtctggcgatgtcagtgaggcttcgcttaattatatagtaagagaccatgataagaatttatttgaagcaaagaaaaagactctgcgattaatcgaaaagaatatgaatgaaaaatggggtaagggaactgttacgctcaccattaaagaccagtataagaatatgtccgaaatcattgcgggctgcatgaatcttattgaaaatgcaaagaaagcctgtgaactggctgatataacaccgcttattcttcctatccgagggggaacagacggctgtcagttaagcttcaaaggacttccatgccctaaccttggaactggaggacacgcataccacggtccttatgaacatattactgttgaaggcatggatatgaccgttgcaatgcttgttaaattggttggaacatttactgaataacaactatatttcataacacaaaacaggagttaagctattgacctactcctgttttgtattatcagttgctattcagtttttattactttcgctttgaaacaacatacataactgctgctgcaatacatccagctaacgcaataattgctattacaagccataatttcccatgatttctgtccccagtgttgattgatgatgcatttgtttcattttcatcaaatgtatactggcttgttgtttctgattctatctgactgatggtctctgtttctgtttcagattctttagtactctccatctctgtttttgtcgccttgctgctctctgaatcagattctttgatactttctgtttctttactactttcagtctccttgatgtcctcagtttcagattctgttttcctgctgctttctgtcactgtttctgtctctggttctgttcctggttctgtcactgcttccgtctctggttttgtctccggttttgtctctggttccgtctccggttttgtctctggttttatctccggttctgtctctggttctgtctcaggttctttaacagtaaaatgcgcactcgctgttccactcgatgaagcaatacctataacatgctctcccgtcgataatttttttattaaatctggattaagtgttacaataatacttcctgcttttaccatataatccttgtcttttacaagctctctgccatcaagttctacttttacaaaatctgaaaatgctgcattagacttaaatgtaattgccttatcggaattcttatcaattatacatttatcaccagcaattatttctggtgccagtttcgatgtaacaacactatctttgtctatctgctttgatgcatttgaatctgcaaagtattttaaacataaatagcagtaataatattcaatattaccttcctgagtcactgtagctgctttagcttctacatgctgtaacttatgattatccttatttaattcaccatattcctcatgacatacttcacacactgcacgattgatgcatgttgccactccaccactatgaatatgctctggaatgccaccctttatttcaaatgtgagtatattattctcgattgaattgacactgatataaatatctccgtaaatccatatatcttcacctattcctaatgctgcatctgcctttgtgttatactgtccaccaataacttcataattccatttaggtgatgaaaaatacatattacttggaaacttagtgtcactgtctataagataacataccagcccagattttaatggaattttatccactctgtttccattaatcttgaacatctgcttatattgagaatcatatttgttaccattatcctcaaagtttctgtactcaagatacaatgtcttacccttttccggaatatccatcttatatcctgtaatattatccgtacctgaagttcctaatgctttaagactatattctccttcggacaaaatcgtcttaatatcattctcatcagcccagcctaatacttctttctccttaagagacataaactgtggaactggagatatatgctttgccataactgacatgaaatacaccggtgacgcattctttgagttatataaatccttcagccccataatatgtcccatttcatgtactgctgttgcaattgatacaaatacctggtcatccccatccttaaataaatatccgttagtatcaccatcaggcttacaatacgaattggttatctggacatatttgtaactattaatagtttttttgccggtattaacagaaatattattaacataatctgtataattccacaatggtgaagaccagcttactgatatattacctgactcattattcttataaataattgtaattgaatcaattgttccattgttatctttatcaagcacaccataatcatagtatacagtatcattataatcagaaattttattacccgatgatatggcattattaacagcttctgaccactcctgcctaagctcatacattctgtttgcacgctccgaagcatctttataaccaatagtattaatatcgctgtactctgcataatacccacgaggatgtgaaagtacaattgagccgccattatcatataaatatacacttctcattcttaatttgttatctgatacacatctgtaataatcgcctacactatatgaacctgcattatatgaattatctgttatttttctgacagaactgccttcatatacatcatttataaattcggtttcacctgcaaatctggcaaataccactaaattagtaaaattactgtcatcatcatctgcctgtatcctgtctttatcacctgttaataacaaaattgacagaaaaacagcgcaaaataacagtattagtttgatttttctcataaaaattcctttccatgtataaacaagctaactattatattatccggtttctctgtcaaaatcttaccatattattaaatttaattcaattcaaataactattttacggcttgcacacaccacaagactcataccccatatcaataatatcctgcctgcttcctgtataaatctttttattggaagcatccatgctctttgcactgttgcaggattctttgtggaacttcttagtattcgtattaagtacatatgtctgcacatttgcttcggctgcagttgttgactttgaagcatctgcaactattgaatcgtcctgatggctgtcacctgttgcataatcaatagcaattcccggctgtgcattaaaacaatacacattgaaaagaattccatcgccattatcctcaactgactcagcctccatctgcacaccgctggcaacaagattatcgccagaaaatacaggtgttacgcggtacaaaacatgattattagtttcctttatgtaatccgccaccatattttcaaaaggcagcataccatcaacattaagatatcttgttcctgtaatcagattcttttcattggcattctcaccagtaagctgatatccaatcagatgacatctgttatacagatatttgccatcaacactatcgtatttcgctgtctgccatcccgtaggttttacttcaccaattgcaccacgtttctcagtaggcataatgtctttacctatattagcaaatgcagtcgtacatcttccaagttcatccagttctccgtaactctcaaatgatatagtcgtgaagtcagcatcattaaacgctgggttattatcattaattacaacatacggttcaccctgatatactaaagatgccatatcatctgcaacagccgtactctgaacctcagcactccccacagtaccagcctgattatccttcttagaagagcatccgcttaacccaaatccgcttcctgcaataaagaacaccagtaaaaatgcggttactctccttagcacttctaaccttatattacgcatgtatttttccttatttctttcttacatatctttcttcagtaattttctcatgagaattaccctcaaaatcagtagaaccctccagcttaaactcattaagcatgtccttaggaaacttcacatcagaaggatacttcctgttccacttatacagataaacctcatccaccatatcctcataagaaacaatctcagagtcctcaacaaaacagaaatcatcccttccggcaaaaccaaactcctgattaacctcaagattctcataatcacaaaaaagctgcttgctatataaagaaagccataacttcccgccatcaagcatcttaataatatgctcattaagaacactgtccttagaaactcgtctgttattaaacataattccataatcatcatcaacaatagatataaccttcataatgtcctccttcttttatgtccagcaaggtgtgactgggttggataaaggactttcttaaaggtggaacgtgtcattaagacgctgtacggattttatccgcgttacagtcaccgtccgcaaccggcgcatactcgccatccatggctcgaatgcgcctttttctcacatcgtgtgcgaaaattgctacacattttataaaatcctacagcctctaaactccacttgaaccttcaagaaagtcctttatccaacccagtcacatcctccccatcacaaacacagttgctctacacgaccatagctcaatcccgccaccacaccagcaagggagcaatgcgaccaacgctgaaccacgcatctcaccccccaccacaaaagcgagggagccaaagcgaccaacgctgacaggtaaaaactccccgggtggtgggctgggtgtggttgtgtggtttaattggaaaccgtgtgaagacgccggtacttagtgcgtggggagagccgccgcaaggcggcaaatccccacaaacttagtacccgctgcgtcttcgcccgagcgggagcgcgttttcaattaaaccatacagccatccccagccccctctccggggagccatttcttacctacttcttaaagggaaacctccccgattccagcctcttcttaagcatcaccccacctatcgtctgaggctgcttagccggactattttcagcttctctttcctccgcttctgcaattctgcggcgaatctcttccatcttgttatccattgcagcaatctgatctgcacatgaagacaattctgcagccagctgttctgcttcagaatctggaatattcttcttataacgaaccttatgctccacgctcgcccagaaatccatggcaattgtacggaactgaacctcaaccttcatcatcttcttttcattctgaaggaatatcggtatctcaattataaggtgaagacttctgtaaccgcttggcttaggattcttgatataatcctttctctcgacaagcactacatcgtcctgctttaacaggcagtcggcaagcatatagatatcttccgggaaagagcatattactcttacccccgcaatatctcttataccttcctcaatgccttccattgttataggaatatttttcttcttcgccttcttaaatatgccatccatagacttaattctgctcttgatactctcaataggatttctgtcatactgtaatgagaactcctcattaagcaccttgaacttagtctcaacctccataatggcgcatctgtaataagccatcagtgtgttaaacggcataatattttcttttaataactcaatcatttcatcagaaaggagattctctttaatgaatctttcctgttcctgcttgagtatctcttctaataacatagtaaccccttttacctttgatgcatcttaaagtgccttcttaatagcagctaaaagctcatcatatgtatcaaatgcctctaattcaggattatcagccttaatctgctctgtactcttaaagaggaagcctgccttgcttgccttaatcattcctaagtcattgtggctgtctcctgatgcaatagtatcataaccaatagactgtaaagccttaactgttgtaagctttgactgctcacaacgcatcttgaaacctgtaatctcaccattgtcagcgacctcaagtgaattacagaaaatagttggccagcccagcttcttcataagcggagtagcaaactgtgtaaatgtatctgaaataatgataacctgtgttatacttcttaattcatcaaggaattcctttgctcccggaattgggtcaatcttagcaatagtatcctgaatttctttaagtccaagaccatgctccttaagaataccaagtctccagttcataagcttatcataatctggttcgtctcttgttgttctcttaagctctgggattccgcttgcctctgcaaatgcaatccatatctctggtacaagaacgccctcaaggtctaaacatacaatattcatatcattatctcctcgcttattattcttagatacactcgtatctcatgtgttatttcacttatattattgtaacccactacctgtcaaaactcaatatgccatttctaagtctttcaagcccatccattaaagttgtcttaggacatgcaacattcagtcttaagaaatgttttccatctccgccaaagccttctcccgctgacaggaaaagtcctgtattctttcttatatatgccgcaagccttgttgaattgtctgtgatatcagacacatcaagccaacaaagataagttgcatgtgattccaccattgacactctcggaatattgtcttttatgaacttttcggtaatctgtttattctcgtagatatattctcttaactgctcaagccattcctcaccctttgtaaatgcagctatagccgcatcaactgcgaaaacatttggctcagctacctcatcggtattgattgcacgccaaaccttgtgacggagtcgctcatccggcacacatattgctgctgtctgtaagcctgccatgttaaatgttttcgtaggtgctatgcatgttacagatatattcttacacacctccgaaacacttgcaaatggcacataatcaatgcccgggtctgtaagctcgcagtgaatctcatcagatataacaacgactccatacttgtaagcaagctctccgatacgtgcaagttcttcctttctccatacatttccacccggattctgtgggttgcacagaataagaagtgttgtctgtgggttcttgagcttaacttcaaggtcttcaaaatctattacatacctgccattctcatatgcaagctggctctgtaacacatttctgccattattaagaatactgttaaagaaaatgttgtatacaggtgtcatgattacaacattctctgctggtgtcgtaagctttcttacagagcttgatattgcaggtataacgcctgttacgaacataagccagtcgtcttccatcctgaaattgtggcgtctttcccaccagcctgtgtatgcgtcataccagtcctttgatatctcagtataaccgtatacaccgaggtctgcctttgccttaatagcctcagttatctcaggtgctgtcttaaaatccatgtcagcaacccacataggaagctcattctctgccacgttccattttaaagaatccgtattacggcggttcactactgtatcaaaatcatatttcattctcggatttcccttcttaattctacttattaattcctgcatactatcttagtaagcgaaggatcaaccttatccttctcaattataagcttatctatactgtctgctgttatcgttccggaagttggatttaacacgctgtcaaccctgcttgtgatatcagcatctacagttgaatactcgaaagcaagtgttgtattaataagcttgcagttcttcataacaagattatcaatgtaacacaatccctgaaggctctctattgtacagttaataaacgtaagattctttgaattccagccaaggtactcacctgaaatgtatgaatcatacactgttatattttcagcattccagaaagcatccttgctcataagtcttgaatttcttatctcaagattcttacttccgtcaaatggataattgccaacaagcttaagaccatcaatcttcatatcgttgctgttcattgcaaaataattaccctttgccactacatttgtcatagtaacattatcacagctccagagagtttcctctgcattgacaaattccacattcttaagacctagtctgttacatcttctgaaattcttaggtgcttcaataattgtatcctcaacattaatatcgttagtgtaccatactcctgctcttcccatctcaaagaaataacagtcctttacattgacattgttgcagtaccagagtggatatttccacttaaagctgctgtttacaagctctatattactgctctcctttaatggagactcaccatcatcaaatatagaatcttcaatacgaaggtctttgcttgcaaaaagagcacgttctcctgtaagaagctgctgcttaactaatttcttttccatatttactccattcttatctacaaacattaaaacccaatcaccatattataagtgattgggttacattctaaacattcttaaggttctctaccatctcttccattgtgtgccagccaagtactgcacatttaactcttgctggcatatgagagatatctcttaatgctccggcttcatcaagctcatcaatctcttcctcagttgcctcatccttaatcatcttaaggaaaagttctgaaagatgtactgcctcatctataggctttccaatgataagctcaagcattatatctgctgatgcctgcgatattgcacagccatctcctgtaaatgccccatcaacaatagttttcttagcatcatcaaacttaagctttaagattatgtcgtctccacagcttggattaacaccctcaagctctaagtctgcattgtctatatcatgcttatgatatggatgcatgttatggtccgtaagaacctcattataaaaagttttagtctccatatcccataagccccctgatcttagatagttcttctataaaatgctgtacttcttcttctgtgttatagaaagcaaagcttgctctcgttgttgaattaaccttaaggaaatccattaatggctgtgcgcagtgatgtcctgctcttactgcaatatgctgtgaatcaagtatagaagcaacatcatgtgggtgtactccgtcaattgtaaatgtgactataccctcatggtcttctgccttcgaagaacctattaagttgactcccttcatgtcattaatggcatcaacagcaatcttagtaagctttctctcctgtgccatgattgtgttaaatccaacattgttaatataatcaattgccgcatgaagtccgactgcaccgccagtattaacagttcctgcctcaaacttatgtggaacctctgcatatttaactctgtcccagtgaacaatctcaatcatctcaccaccgcttaagaatggtggcatcttgtcaagaagctctttcttgccatataatgctccgattcccataggtgctaacatcttatgtccagaaaatacaaggaagtcaacatcaaggtctgttacattaaccggcatatgaggaacactctgtgctccgtcagccacaataaccgcaccatgtgcatgtgcaacctctgcaatatgctttatatcattaactcttcctaatacattagaaacctgggtaactgctacaagcctagtcttatctgtgataacctctaaagacttgtctgtaatctctccattctcatcaggtgtaagctgctttaataccgctccacatttttctgcaacctgcttccatggaaggaaattgctgtggtgttccataacactaacaacaatctcatcaccctctttaatgaaattcattccataactgtatgcaattaagttaagactctctgtagcatttcttgtaaatactatctggcttgcatctttagcaccaataaactgagctactgcctttcttgcattctcataactttctgtagcaatctcacttaattcgtatacacctctgaacggattggcattcatctcctgataatacttattaactgcatcaagaacagcctgtggcttctgtgtagtcgctgcattatcaagatatgcaatattgcttcccgaaataagtgggaaatcttttcttatagactcaatcgtcttacttaactcactcattaataaacctctttaatgtagtcatgtatctcgttcctgataccatcatcagggattttgccgcatacggctaaaagcttagctgctgccagcatattataacattcttgtgctggtattcctcttgattcaagatagaataatagttcctcatcaggctttcctatagttgcaccgtgattaccgacaacatcttcttctgcacatagaataataggaatagtctggttgacacatttttcatcaataagaagaacttcttccttctcattaccaacagaacctgctgaacccttaatgaaatcaatagttcctctgaacagcttaaatgctgtatctctcaatgcacctgccgcattgattgcacattctgtcttcttgccggtatgtcttacgcagtagttcatatcaagtctttctttacctgctgcaacatatccaatctctgcagacatagagcttccatcacctgcaagcttaatctcacagccttcgtatctgttctttccgcttaaataaagctgcacaagttcaattcttgcaccatcttcacagtaaccaccgatatcattaataaatgttgtctcactgcctaccctctgaatctggataagacggataaccgaatccttggcggcatataatcttgtctgtactgctgcgaagccttctccatctttatctccattaaaatccatgtaaacatcaatgctggcattctctttagtttcaataccaacaacattgatgtctgcattactctttccataattgaagtcgagtcttacaaaacctgcattcttcttatctgttatataatatacaggttcagtctgtgacttcttagctgcctctgtaatctcctgaccacatccaccaatgatattgtcaagctcaccattgttaagctttccatcatcaatgagacttacatcattaacagaagcatttaactcacctgtacggttaattacaacctctccaaccttgctctggttcatatgaagatgattccatgtcttggctgggatacggtttattatcatgtccttttcttcgatacctatcatatcatattcctcactctgattaacttaaccaatgctgcccttcatctcaagcttaataagattattcatctccattgcatactcaagcggaagctccttagatacattatcagcaaatcctgaaacaatcattgctctcgcatcatcttccggaattcctcttgacataagataaaatacagcatcatcactgattcgtccaattgttgcctcatgtcctacatccgcatcattaacacggatatccatagccggaattgtatcagatcttgaaatatcatctatcataagtgactgacatgaaactgatgatttactcttcttagccttggtagtcattgttaccgcacttctgaaagtactgattccgccacccttagatattgacttagtacttacaactgatgttgtagctggtgcgttatgaactaccttcatacctgtatcaaggttctgtcctgctcctgcaaatgtaattcctgtgaattcacagcttgagcgttctccattaaggatactcataggatacagatatgatacatgcgaaccaaatgagcctgaaacccattcaatcttaccaccttcagcaacagttgctctcttagtgttaagattatacatattcttgctccagttctcaattgttgagtaacgaagctttgcattcttagccacaaaaagctcaaccgcacctgcatgaagattggcaacattatatttaggtgctgaacatccttcaataaagtgaagacttgcaccctcatcaacaataataagtgtatgctcaaactgacctgctcctgcagcattaagtctgaaatatgactgcagaggaatctcaagattaactccctttggtacatacacaaatgaaccaccagaccatacagctccgtgaagtgctgcgaacttatgatcctgtggtgtaataagcttcataaaatgctcgtgtaccatatctgcatattcacctgtaagtgcactttccatatcagtgtatacaacaccctgatcagcaacctccttacggacattatggtatacaagctctgagtcgtactgtgctccaactccggctaatgactctctctccgccttaggaatacctaatctgtcaaatgtatccttaatctcttctggtacatccttccagtcacccttcatattcgtattggcacgaacataagtagcaatattatccatattgagtccatcaatagacggaccccagtcaggcacctgcatattattatatatctctaatgacttaagtctgaactctctcatccaagcaggatcatgcttctcttctgatatcttctcaacgatttctggagtaagtccctgctttattctataagaatcgttctcttcgttcttaatatcataaacacttctgtttatgtcatctacaaatgtcttttcttccattacaagcctccgagccttaattacttgatgaatctttcgaaaccattctcattgatatcatcaatcatagcactgtcgcctgttgcaacaacattaccattgacaagaacatgagtataatccaccttaagtgcctctaagatacgggtgctgtgagtgataataagaagtgctccgttctgagtcttctgatattcttcaacacctagcgatactgtcttaacagcatctacatcaagtcctgagtcagtctcatcaagaatagcaagagaaggctcaagcataagaagctgtaatatctcagctttcttcttctcaccacctgagaaaccaacattaaggtctctgtccatatatgatggatccatctgaaggaattccatcttctcctgaaggagcttcttgaacttgaagtatgtcatcttctttccacgctgctccatagaacttcttataaaattaccaagtgtgataccaggaacctcaataggattctggaaagacagaaaaagacctgcctgtgatctctcagcaacattcttagaaagtaaatcttctccgttaaatgtaaccttaccacctaatatctcatatcttgggttacccatgagagcataaccaagagtagacttacctgctccgttaggtcccataagtacatgagtctctcccttattaagagaaagatcaaccccatgaagtatttctttatcttcaacaccaaccttaagctggctcacatttaatatttcctgtgccataatgcctccttagctgtacattcttttagcaacacacataatatcattgaaagaaaaggttgtaaagttattcataataacaattgttactattgtttaacatagttacttctcttttgcggcttgaacccacaattccatctcccgtttctttgcatcattaatattgcttactatttcccttgcgaatatatcgtctgtttctttttctctatttcggaaaccatcgtatcttcatatatatatcttacctccctgagataatatataaatacaggtatctcatcactgtaatccttgctctttgacacaaccaactccatccacttatactcaccatcaagaagccgtctgaatatcaatctcaatgattttttattgtttctgaaatgctcaagcaccctgtctggattggcaaaatctctatatgtcccggcatcctcagggtgaactactcccatatcaatatatttgtcaatatattccttaatactgcctgataatccggcatctcttattatgtcctcctgggttgactttataggttcatatctgtcatgcagaaaatcagccctgagtatcttaataaatgtattatatataatatccattgcatcttctcttgcacctgcctgataatcagcttctttccatgtgaaaagcactctcctgttatcctcagaataatttgttggcttagtaacctcaaatacataccatttatatgttccatccatattatatcttatctggtatgttcctctttctttcccctcatcaagctgtttcttaattctgccaagattaatagcttccttgtaaagtgaaacatcatccgggtagataacaccatacttaatatatctgtctgcatattctgcaatagtcttaggtcttggtgtcataacataatcaggctcatctgtccttcttataaagtgatatgctcccgtatcaagatcaacatctgcaatcttccagaagtaatcagttatctccttaagataagacttatcattctttcttgtttttaaaataataagcttatcagctacgttgtccttatcatcaacaagcttctcataatcacttataggcataggtctgtaataatagtatccctgtgcatattcacagcccaggatttcaagcagcttaagctgttcatcagtctcaataccctcagcaatagccggaatatcgagctgtcttgccatatcaagaactgcagttataatgcttacacctttatcattattttccggattaaggtctagaaatttcatatccagtttcagaacatctgcatcaatatccttaagcatgttaagtgatgaatatccgcttccaaaatcatcaataagaatcttaaagcccgcattcttaaatgccttctccgtatccttaattaccgagccattctccacatatgcactctctgtaatctctatttcaatatactctgttgaaatattatatttttcaatcatgcctttaagtattcttacaacatccatagagtatatatctgctctcgaaacatttattgatattggcagtactgttcttccctcatcaagccatcttcttatagtctgacatactttatcccatatatacacatcaagtttatttatgaatccattcttttcaagcagcggtataaactgtcctggtgaaataaatcctttctcaggacttatccatctcacaagtgcctcagaaccaataatcttacctgtctgtaatatacatttgggttgaagataaaatgtaaattctccattatccattgcactgcatatctctggcataagctttgcttctgcttcctgttcccttgccatactatcatcataccagaagatatccttatcagggcgctgttttgctatctctagcgcaccatacgcatagtcacacatctcacctgtagttatatccttatctgcagtcttatatgcaccataatatgcccttgtaatatcatgccccctgtatccgttaacaatacctgatattctttttctgattagattaatcacatcatcgttctcttcaaatataacacagaaattatctccacccatatatccggaaattgttccatacccggcatctatactcttaagagcttctccaatctctataagaagctcatcaccagtttcacgaccataccacttattaataaggtgaaaattctctatatctatcgccagtatgcaatatgttttgttatcaaaaagtactgttttatcagctattctccagaaagttcttcttaatggaagattcgtagccagatcgtaattatatctatcaggattgattcttaacttattatacctgctcatgtctaccatagctgcctcctttgtaccctcaatatattataagcccacgtcgcccaaaataccttttccattttatcattaatacattgataaaacaataatttaaatataaaataactatcaactggatatgtttaataaaattatataaaggagactttaatatggcaaaatacataatggctcttgatgccggaacaacaagcaaccgctgtattcttttcaacagaagtggtgagatgtgcagtgttgcacagaaagaatttacacaatattttccaaaacccggctgggtcgaacatgatgcagatgaaatctggtcaacaattctggaagttgccaggcaggctcttgcaaatgtaggtgccaatgcgtcagatattgcctcaataggaataaccaaccagcgtgaaacaacagttgtatgggacagacattctggtgaacccgtatacaatgctattgtgtggcagtgcagaagaacttcagaatacgcagattctcttaaagagaaagggcttaccgaaacaatccgtaataaaaccggtcttgttattgatgcatatttttctggaaccaagttaaaatggattcttgataatgttaaaggtgtccgtgagcgtgccgaaaaaggagatctgctttttggaacaattgaaacatggttaatctggaagcttactaaaggtcaggttcacgccacagattattccaatgcatcaagaacaatgcttttcaatattaatacacttgaatgggatgaggacatcttaaaagagcttgatattccaaaatgcatgcttccaaaggcagtcccgtcaagcagcatattcggtgagacctccgctgaattcttcggctgtcctatcccaatcggaggagctgccggcgaccagcaggctgcactttttggacagacctgttttgatgccggagaggccaagaatacatatggaacaggctgcttccttcttatgaatacaggagaaaagcctattttctcaaagaacggtcttgttactactattgcatggggacttgacggtaaagtgaactatgctcttgaaggctcaatatatgtagccggagctgctattcagtggcttcgtgatgaaatgcattttatagattcttcacaggattcagaatacatggcaagaaaagttcctgatactaacggatgctatgttgttcccgcatttacaggacttggtgcgccatactgggaccagtacgcaagaggtactatcttaggaataacccgtggtgtcaacaaataccacattatacgcgccacacttgaatcaatcgcttatcaggtaaacgatgttcttactgcaatgaaagcagattcaggcatagaactttcttctcttaaggtcgatggtggagctagtgctaacaatcttcttatgcagatgcaggcggatatatccggtgctcctgtaaacagacctgtatgtgttgaaacaactgccatgggtgcggcttaccttgctggactttcagttggttactggaaaagtaccgatgacataagaaagaactggtctgtagacagaacatttgaccctgaaatcacccagaatgagcgtgattccaaagtcagaatgtggaaaaaagctgtttcttattcatttaactgggataaataattccgtcggatgattcttctaacatataaaagcgatattgtataaaagtaaattcatacaatatcgcttaatcttttattaccttacaacactcttctggtttttgtgcattgcacgaaatttagtaatgttattttacctattatccaccttctccggatacatatcatgatttgccatacggttgaatgccacatcttcccacttagttcctggctttccataattgcagtatggatcaatggaaattccaccacgtggtgtgaatttgccccacacttcaatatactttggctccatcagcttaatcaaatccttcataatcacgttcacgcagtcctcgtgaaaatccccatgattacggaatgaaaacaggtacagctttaagctcttgctttccaccattctctcgcctgggacatacgaaataataatgtttgcgaaatcaggctgccctgtaattggacagagacttgtgaattccgggcagttaaacttcacgaaataatcattttctggatgtttgtttacaaatgtttcaagcaggccagggttgtaatctgtctcgtaattgttctgctggttgcctaataatgttaaattctctttttctctcatagctttctccaatttttattttattgcagggtcacttaccccatttgctgcaaatgcagccgctctgtcgatacaggttccacatttgccgcaaggcacatcctttccttcatagcaggaccatgtaagctcgtatggtgcgttaagctctaagcccatcttcaccacctccgccttagtcatattcacaaatggcgcctccacctttaactgatgtcctgagccctcaaaaatcgcctgattcatagcatcattaaacatcggtgaacagtctggataggcaaaaccggctgaatcatctgcatgtgcgccataaagaatcacgctacagtccttgcttagtgcaatgcttgccgccgatgaaagaaacagtccatttcgaaatggcacataggtgcttacaggcttttcgccctccgtcttttcaatctgcctggcatagctctcctctggaatttcctctgtagactgctgcaataaagagcagttgctatattgaaaaatcttactcagatccaggaataactgctccactccgtaaaatgcagaaacagcctttgccgcctgaatttctttatcgtgcttctgtccataagaaactgacagagcaattacattgtcctttccatatcggctcactgccaatgccagtgccgtagtggaatccacgccaccgcttgataatactaatgctttcataactcatctctcctatcttagatacatttgtaatgctgcatcgtccttaaagcttcctcttaactctacagtcattgttctcgtgttgtttttcttaattcctcttgccgacacacagctgtgatatccttcaagcaccaccgcaacatcctcgcttcctgttatctctgtcataatgtccgcaatatcctgaccgattctttcctgtaactgcagtcttcttccaaccatatcgcatattcttgcaatctttgataagcctataaccttcccattaggaatgtacgcaactgtcgccttcatatcatacataagcgccatatggtgctcgcagtaagaaaacaggtcgatgtccttcataactacaaccttagaagtatcaagttcctcaattccatcctcaaatgtcttatcaaacatctgcgcaatttcgtgattggagtaattcatcccaagaaagacctcctcgtacatcttcgcaactcgctttggtgtatcctttaagccctccctctccgggtcgtcgcccaatgcaacaagaatccctctaatatgctcctcaattgctttcgtatctatcatcataatctccattcttgcttcaccccgcaaactttgggctgaaagcacaaatttgcatgtgaaaaatctttgatattaggatttttcacattatacgcccctttcctctgggttccagattaccttgtgcatctgaatctgaagacgcacatcattcatccttttactggtcatgaaattcacgatttccactggctcaattgaaccaaacactgagcttatgaatacctggcatctttctgtcagatgaaatttttcaattattttctctgcacattccaaatcattaatgctgcccgaaacgaacttgactgtgtcctgctttcttaaagcctccatattggagagaagcattttctcctcacagccgctggatggcagcttgtaatccatagtaaggctaagtttttcttttgaaaatgcattggcaaggggagcaatatcaaccgctccattagtttcaatctctactcgaatgtccgatttgttcaataatttttctaccagactcctgatatccttctgtaataaaggctctccccctgtcagcgtcacatttttaatgcctgtctcactgacatattcacaaatcttatctggtgacagctcctcgtaatcacaagctggctcattggcccactttgtatcacagtaggagcaattcaggttacaacccttgaatctgataaacaccgccaattctccggctcttcttccctctccattaatacttataaatttctcaacaactttcatattagtttctttcctttattgttcgtatgctgctacattattaggtgtctcgtatacttccactctgtggattggaaagccttttacactcatcagctcatagaaatattttgaaaaatgctccgcagtaggtctgaagccaacttcaatcatacgaaactcctccgcctgtaatgcagcaattgtcgcacattttagagaacctttttcataaatcaagctgtggtcaaaatcatcacagatatccttcaaagcattttttaaatcagaaaaatccacaagcattcctcttgtctgaccctcatcctttaactggtctgctgctatttcaacaacaactctccagcggtgaccatgaagattcctgcattttccggcataccccttcagaaaatgtgcagaatcaaagctgttctcggtttttaaataatacattttagtttctcctctaatttattgtggaataaaaacagaattgcttagaaaagaacgtgccccactgtgagcacatatagaaagccctgtaaatgtatacacacctacagggctaaattacataaaaagtcttcttagcagccctggttttatttaacgacaggatggtacaaacgaactgtcgcgcatttttatgcgatatgtctattataaatatttttctggatatgtcaatgtaaattttcccccagcagctgcacctttatcacgttcattatgcgtgccgagtatgtttcctgaatttctcctgcaaatgttattgaaaccatatcatttactaccaggtcagacagcgcaatctctgtttcctccttcgtccatgaagttttatatttgaccctattaaaccaatcctaaaccgattaatcttttaatatatcttatcaacctcatcttcatacactgattcagtatgagtatcaaatagcacccattccaccagatcaaaacaatctggattatcctgcaagaaccggtttactgtatgtaccgcaatctttgccgccaactcaacaggaaaactatatactcccgttgatatggaaggaaatgcaatagacctgattccattatccattgccagcttcatagaattaaaatagcagttagcaagaagctcctcttctctatctctgcctccattccatatcggtcctacagtatgaataacataatcgcatggtaaattataggcttttgttatctttgcttctccagtcacgcatccgtgaagtgtcctacactcagccagaagttccggtcctgcggctctatgaatcgcaccatctacaccgcctccgccaagaagagagttatttgctgcattaacaattgcctgcacatctgttacttttgttatatctccttttactgtcttaatcaaatacatctttcttacctgcctgtttattatattacctctgccccaaatggcatcagagacaatttagcaattttgaaaaactgctttccgaaaggaattccaataattgttatacaacatatcagacctgccaaaacccacgacagtccactcaacaatccaccacatataaaccaaagtatatttcctaatatgctcatatcaatattccttctctatctctccatctattccatacattttcttgaatgcatcaaggtctgcctgatttttaatcagcataacctcctctatcttacctgtatgaatgtccttaaagcctgcaacctgctcaccattacatatgcttgccttgattaccggtttcttattttctttatcatatgtcttcataactatctttttcttaaagaatcccactctgagcaccttcttttgactttgccatcagtataacaactgcctataccattcatccttcgtcatatcatcaccacaaatcgtatggtttcatggtttctgaatttcgatattcatgtttctcataatatcctatcagcttactctcatctctgagtgccaccatgtaaacatctttattctgtttctcattatgaaaagtataaacgatattatggctttcatctgctgcaaaccagtccacgacctgctgtattttattcctagattccggactatgacaatctaacaaacttcttccaataagtttatctccgcctcgcttcgcatagctggtaacagctgcagtattcatgtagataatctcatgtttgagattgcatataacaacggatgccctgtcctgatcaacaatactcttataaaagctgacataggatttaaacttaattaccttttcattatccagcctcttttgaagttgtggtttctttcttcgataataatcgtatatctcttcatcaggtatccagatttgtgcctcatttatcttatcaagtacagcttcaacaatctgttcatctgccagtaaatcaggtactttatcatgctctgttacatactttttgtattcttcatacacccatcctgtaatcttatccttctgcttcatctttagattactaaattgtttgttcatctgtaaaatctgaccatcaatctttttatgtattttagttttcttactttttgccatcttcagctatcctttaaaacttcactatttccggttcatgggtaaatgatgagaatgtggctgttgcattcttgaaatagaatacctcggtatttccatcatctgctgagtacatattctgtaaagatggataagcatcaagcatagactgtcttgcttctcttctgtcatcttctacaagttctccggctacacgaaaccactcgccatttttaaatgcacaaatttctaccttcgggtttgcgtgaatctgctttgaaacatcctttaccttgccagtctgaatatacagctttccttcaaaaatgtgtgctgttccaaaaggtcttacccttggctggtcgccttctactgttgccaaataatatgtctctgcttcttttaaaaatttagctactcgttccatgatgtaatcctcctgaattgattaatatcgtttcatatttacaagcagtttcattctattagttataaaggtatatcttcaataaatctgttgttgctttgtcatttatgacggcccgtcctattgttatgccattgctgatgataatatattctccgttttcatatctggcatttaccaaatcatcttccccttttaagtctatacatatacttgatataattccgcaaatctcctcttgtgagcttccgctttttatctcataagcataatccgcatctcctatctcattcagatcagttaccaaacaatactccgctccattcatcagcatttcttcattcaaagttggtaattgagccgtcttatactcattaaataaaaagataactacaagcgcaatgaatgccggaaaaaagataccgccaaaccgctgtgcataattttgttcttcccaccgcttgctatgacgaccaaacagcggtattttcatctgcaccaaacctgctcctatacttacaagcaaaaaataaaatataacttttatcaaagactcatcccccatttaatcattaataaaaatatcgttcctaaaacgacgcctactaaccatataaagcgaaacaccttgttatatctcgaactattagaacaaggaacaagccaatattcctgtggaaactccaaaatgtattcttttaattcctgcttcaattccatgactatactccacattaatccaaatagcacaatgcacaccgttccataatatgtaattgatgcatttgtaaccacagcaaagaaataatgtgccatcttaagaaggaagatacaccacgcaatacagcatgaaattgtaaacgcccttttcattttccacttcaaaccaaatataacctctggaacgaatacagtcaatgcccccatcggcaatcctcctgttcgtccatgtgtgaaatcgctctccgactccaaagaccaaattcctatcaatactattactgctggtattagtatggtgcagaacaagttatatgcaataatcaaaacattttcattgtcgtcgttcataacttagcccccaatcagttcatcaagcctgatagccactcttcctgataatgaataatacaatgctgttagctttgccttgtcgtacaaatttgcatacacattataataacatagcgatattgacataccgaagccaaatatttttaagggtatagacgttacatcaagttcttagtatatgaaatttgcaaattattcttggatttggctcaaatcaaatgcaccgttctcaatcaacttcaaaattgtgtctaccaagttgttttttacagtttcactttcattttcaacgccagaatactctacgtaaatagtgttctctcccatatcaaaggttgcataatatattacggttttgataccttgactatttgactttgttacgaaatatcctgcatcgatatcaacgccgtctacacttgaagtgattgtatttccatcaatgatagtatctaatagatttacaccctgtttagatactaccattcttgtatcactaatttttccctcaaaacccagaatattatgattgtcagcatcaaagtaagcatctgcggtaacaggcaggtctgcaaaaagcatttcaatctcagcattgctcaaaggtcttgttgttacatttaagttaattgaagattgtgataagtcatttttaacaaaagtaattgtttctccaccatccagcgtggcaatatcgttttttgtaccaaacagattgctttgaaaaactcccactccaatcacaacaacgagtacgaagcaagcagcaacagacacccatttttgccgattagtaattttacttgtttttttcataggttcagcctccttaatatactgattatcgacatttcccaatgcccttaaaagtttcttttctttcatacagagataccttctttctctaataattttttaagttcgttccttgaacgaaataatgacatcttgattttgctctcactcataccatattccgttgcaatttctttaatgggcgataaataccaatatcttctcataaagatttttcgctgttctaatgacagggaagaaagaaagcggttgagaatatccgttagagcaatttcttcaacaatgttttctgtactatccaacgatggtatgcactcttgtatttcatcaaaaatcaatgacatttgcccgccattacgtttctttgcattgagcagttcgtacctgtccaaagataagttgcgagtaatcttccccaaaaaagtttttaggacagatggacggttaggcggtatgctgttccaagctcttaaataagtatcatttacacattcctcgctatcttcgtcattgtgaagaatattagaggctatatatctgcaatactttccgtatttttttgaagtttcggatatagcagcttcggagcgctcccaatataaatctaatatctgcttatcatccataagcttctcctccttccccttgtattaaggtctttcaccctaatagacgagaaaaatgtgtcaagcgtcacttaaattcaaaaaatatttattcaaagattagctttcattttttgaaagaatataataaaacagcaaaagacgtacaccaacaagtctcttaatattcaatgcggaaaaagttatttcaaatgggggtttaattttgccccctccagggtattatactggttccaccaaaggcggggtttcgcaacaccataattacttgttgcttcctaaaggaagctcattacttccttccatcttcttacttatcgttttcttcctgttcctgtatgtattttcttaccgtttcttcattcacatttcctactgtcgatacgtaatatcctctcgcccaaaaatgtctatctccccacttgctcctatattccggatgtcggtcaaacaacatcaatgtgctttttcccttcagatatgacataaactctgaaacacatagtttcggtggaattgcaatgtacatatgtacatgatcaatacatacttttccatctgttagtgttacctatttcatctcacacaattttttgattgtttctactaaatctctctttgtttcaccatacattatttttcttctaaactttggaataaaaacaatgtgatatgtgcaattccagcgtgtgtgtgttatactttgattatccatttggatacctcctgtgttttgatatggtctgcgaaactaatatcattataacacgcaaggttttattttctagcactctaggtaacgctacggctttgcctcggcccccatttcaaatgggggattaacaaaacttttcatttacggttcatccgggagctgtactacctctacaattgcttcaattgtttcaaccggagcatcactccatggatatgccgcatcatcacagcctgcctgctcaagtaattcttttgcatcaggacctaataatttctgatatgcatcatacacagatgcaagcttattcgaaaattccacctgttcagagtttcctttatcagaaaaccatgatactgtctcttttttaatctcatctgtggtcatactggttccaacccccccagttaagcaaatgtgctgcagttttaatagaattcattccatttccggctgttcctggctgaatatccgaatcaatttcatctaatacacctctgaattctttatatgacggcttcacatcctgtaattgattttgtttcttcgtctctgtttgctccatattattatcttctgctgttgccagctcactattatcttcgctcgtaacgacctgctctatactgtttccagtattagtcatagtttcggtttcctgctgcccacatgcggtcaatgaacataccataactaccataatcatcaaaaataacttattcttcataattttttctcctgtcattctacattattattcgttccatgatgtataactgcccatctttatattctgcggtaatgtcacctcccattctttcagtctctactctcatgaaaacactcctaaaacatctgtataattctcgcaatctccataactacaatctttagcatcactccaccggacatcacataaaaccatatctcacgcatatgctgtgactttgcaattggtgttgctattgctgcaataattatgattgcagctccgacacatccaacgatgttcgggacgctcacaagtgaaaatattccaggattacagcttccatctatcgtatactgaattgttttatccagtccgtctcttgcagctgcaaagcagcatataacaagactatatgccaaaataaacaggctccttctgccccagaaattaatgttgcttctgttactgattgagtatccaacaaacccaaccagcgatacaatcataagtgtagtaactgttgttaccatattcccaaaatagagtttcatccttgacctcccataatataaatgacgcagtgcaaaactgtaatattacaatctgcactgcgtcttagcgtctggcttcctttactataaatttttctgcatcaatcaggctttcttttttacactttggacaaaacaaaggaaaatttgttaataccgtatccttccttgccagtgtactgtttgtcggggcaggcatcacggaacatgaccagcattgcccctgtaccacagccacagtccagtacgtcctgacagggttctttcaaaagctcctccaacaagtcggggtaatccttgcggcacaggttgtacacgctggggtcactgtcatcaaatttctccgccgcagcgtcaaactcccgcagagtgagatttttgtatttttggtttgtcataatagcacctctgcatattcatttgccatttagttagtttatactaatcgaatattatcatatttctacatagttttcaacatcctatctgtgtctgtagtctatcagcaacttgaccctttctatttttataaaaagcttagatttttgtcttgacaactgagccactatagagtaacgatatatgaaaaagatgtgagaggaaaatcatgaaggttgaaacattatcagaaaaagatatcaatgcgatcgggcatgcattcggttattatgaatatgctcagggcgaaaaggggcttgtttccgcatacagcagcaaagacgcagtcgtcagttatatcaacggctatgtggaaatggtactgcaggcaggtatgctttatacaaccggtccgcagcaggaagcatttattgcctataagcgctgtgatgaaaaagtgggactgaaggcaggtcaaaagctgataaaagggatgtttgcaggatcatcctttggtgaagtggtacggatgctcagcattctcggaagcggtggatcatcttccattgaaaagaaactgaaaaagaaaaaacaaaaatacctgtttgtcggattggtatgtgtgcgggaagaataccaggggcaaggctatatgaggaaagcgctggagcttgcgtttgccgagggcaacagactgggactcccggtcgtactggataccgatgccaaactgaaaagtgataaatacagacaccttggcatggaactggcaggcgtccgtacctgcaaaaacggcagtaaattatacgaactgatcaaatatcctgattccacggtctaatgaaattaaaaatcatacactgtctaatgaaattggaatttaataattagttttttcgcaatcaagactccaacaggagctaaaccgccatccaccaaattcactttgacaactgtaaagccataatccgtaataaactcacaaaaattttccttcttccattctttgtatgctttaaatcctgtaatagacatcaatcgctttcgtaaaccacttgattttttctctgcccataagaaggttggtgcgtacaaaatgccgtctttttttaatactctacgaatttcctgcattgctttttcaggctctggcataatgtgcagtgcatttgaaattactacacaatcaaaattttcattctcatatgaaagtgccgttgcatcggctacgcaaaaactaagtttttctgttgtacctctccttttcgcttgcttaatcatattttccgaaaaatcggttgccgtccagctattagtacaatcagacaatgggaaagatagctgccctgttccacaagctaattctaatacattcatatcagatttgagataatctctaatatatccgcagattgcattataaaatttcttatctgactccatcaaaggtgcatatatttttgcaagtcgttgccaataacccttgtttgccttgtctttcatatcaaaatctccattttattcaataatacaacttctgagttatagtgctatttttttccattttctaatcttagttctaaatgttccgaatggagcaactgtgttaacatgtatgaacttgtatacttcccagacagctgtcttagttgcttcgccagcccattttctcatatgtggtttaaataattcttcctcacttagcgaatcgatcattgcataaatagaattaatattatcattcaacatatctttcaactcctgcagtgacagatacgcatatgtatctgtgaaccattgatataattcaccaagctgattccatttaaaatcatctgaaggagttttgacatgaagaccttttctttcatctgcttcccatttaaggacgagcgttgtccatccaacttggtaagcgagattttctgccggagttcggtcaacttcatcaaccctcttatcctttaaagattctggaatatcattaaattcaaaaatatactttgcaaagcttttatttatctcttttttaagttcgtctttattctcgtatgttctcaatagtctatttctccaaacttgaatttggaacgtgctttataaattttttccgatcccctcaagttcgttcatggagtagataaaaccacataactgaaagatgaatttacacacaaatttggacttgactcattcacgcctcctatacggctctaaaaacctactcaacactcacatctcactcacttagtaggtcttcacattccagctcgctccagcccactctaatcccagcaaaaaagacctactcaagccatctttcaagcttaatagtaggtcttcaacgccatagcaaataatatagtaaataatataataaaactaataattacaataatctctacctgttagtcttaattatatcaagaacaaacttaagtgcttccttcgtagactgacaccttatcgtatgcctgtcaccagataaatcacattctttaacatgtgtctcacctttatagcaacatccgatatacacaagccctacaggcttatcatcctctcttgaaggacctgctacacctgttacagaaacactgacatctgctttggatattcttaatgcgccctctgccatctctgcagcagtttcagcactcacagccttatattcttcaagagttgcatgtttaactccaagaatacgctctttggcttcattactgtatgtaatatatccttctttaaaaatgtctgaagcaccgcttatattaactatagacgaagcaaccatgccgcctgtgcatgactcagctgtagttatagtcagggatttgttctttaatgtctcaacaagagccttatcaagacagctgagataatcaaccattattatttacccgaaccttccagaaaaactttataattctttgcaatataatcaataagagaaatcactgtcaatcctaatgatatatatatgagaacagtattaataatattcataaatggtacattaagattaagaacaagcataataattgtaatcatctgaaatgctgtcttgaactttccccaatagcttgcagctataacaacaccattatctgatgcaacaagtctgaatccgctaataataaattctcttgcaattataataataacaatccatgctgcaattctgttaaggtcaacaagtgcaataagtgcagagcatactaaaagcttatctgcaagtggatccataaattttccgaagttagtaacaagattatactttcttgcaatcttaccatctaaaaggtctgttaagcttgcaagaataaatattcctactgcaatatatttgccacatccaatgttaagatacagacatatcagaaacaaaggaatcataataactcttgcaattgtaagtttgttaggtaaattcatttaaacattttcctccattattcccattaaatcatattcagttgaaccggtaatctttacagatacgaaatctcctgacataagttccctgtcacattcaaagaacaccattccatcaacattaggtgcatccttgtacgaacgtccaacataagtattgtcctctgcaatatagccttcaaccataacatcaatagtctttccaaccatttgtgctgacttgtcaatagatatttcctgctgcagagccataagctcgtctctccatgtatccattatatcctggtcaatctggtccggcattgttgcagccagggtatcctcttcccttgaataagtgaatactccaagtctgtcgaactcaacttcatcaataaattccataacctcttcatgatcagcctgtgtctctcccgggaagccggcaataagagttgttcttaatgcaatgtccggaatctcttttctcagcttcgcaacaatatcaagaagctcctgcttatctgtctttcttcccatacgctttaatacattatcacttgcatgctggattggcatatcaagataatgacagactttaggctcattcttaatagcctcgataagctcatcattaatctcttccggataacagtactgaattcttatccatttgaggtcttcaatcttggcaagctcatgtataagcattggaagtgatttctttccgtaaaggtctgttccataaagagttgtctcctgtgctacaagtataagctcttttgctccattgtgtacaaggtgctttgcctgctccacaagatactcaacaggataacttctgaaattgccacgaaccttaggaattatacagtatgtacaatgcttatcgcatccttccgctatcttaaggtactcaaaatatcccggcgtagtaataattctcttttctttaacaataggaagtctgttggcatcatcaacgacattaaagcccttaccttcaagcactgaagtaacaacctccgcaatcttgtcataagaagttgttcctaaaaatgcatcaacctccggaatctctttgataatctcatccttatatctgtgagcaaggcatcctgtaacaataagtgccttacacacagcatcttccttgtgctgtgccatctcaagtatcgtgttgatactctcctgcttggcatcaccaataaaacagcatgtattgacaacaataacatctgcctgtgtttcatcatctgtaaacccaaaacccttgtcattaaggattccaagcatattctctgtatctacaaggttcttatcacaacctaaagatgcaaacataatcttcatatactgcattacctcctgcatagtactcctcattgtaacacattttttgcaaatgtaaacatatcccttacataatctgaccatataaaacattatcaaattggcacttttaataagacctgaattgtactattctttgttgcaaatatgaatcaaaggagaaaaagataattatgaaagacaaaaaaacaggtttaatccagacattaattggtgctattattcttgttatcggtatcgtgttatgtgtcaacacatacatagtaaaaggtaataaagcatacgcattttcacttcttgtaacaatccttggcattgttattcttatcgccggattatacagaacattttcaaagaaagagagaaagcctgtagacgcaaaggttattgcacaagctgctttgtgtgccgcactctgctatgttggtgcaacatttataaaaatagacattcctgttggaacagaaagaaccatgttccactttggtaatgtattctgcgttcttgcagctttacttatcggtggcgaatggggtggtcttgccggagcaatcggcatgacaataagtgatttgtcaacagcctatgtaacaagcgctcctaagacatttattcttaagttatgtatcggtcttatcgttggttttgtagcacataagctcttccacctttctaaggaacattctgcaaaatatgttactgttgctactgttgtatcaagcatatgcggtatggcattcaatattgttgctgaccctgtagtcggatatttctataagacataccttcttggtgtgcctcaggaccttgccaaaacacttgccaaaataggtgcgataaccacatctgttaatgcagttatcgctgttatagttgcttcaatcatatatcttgcattaagaccagctatgaaaaagctgaatatgttgagagatttataaaaatgtttttcgccgctttgtcatcatgcagggcggcggtttttattccagcatcatcattatattcagtttaaatgtatcatcagccggctcaatatttattccgccgtaatatttttcagcaatacgttttatgttcttaagcccatatccatgtgcctgtgcattatccttatccgttgccggaagttttcccggctcaacagttatcctgcccgcacatgaattagtaatctctataatataggcattcttttttctaaaagccttaaggcttacatatccatgcggagttttctgtgctgcttcacaggcattctgcaaggcattaaataaaactatgctcatatcaaatgcgtcaacaacacctttttcaggataatgaaaatcataagtaaaatctattccggttttgatacatttgtccttatattctcctataacaatatcagttacaggattaccgctcttaacatcagactgtgtctgaataatcatttcattaagctttgatgaatattcctctgcagcctcatttctgccactctcaataagttcattaagcaccatcagatgattagccatatcgtggcgcatagcccttatttccgcatatgatttcattgcagtatcaatatgattcttaaggttaccaatctgtgcctcaagaatctcctgctccttattattctcctgcattttcttaagttcctgatacagcataagaaatacaagaatagcaccatatgatatcagataaaatgcaagaagtgtgtagttaaactcataaaccggttcgattactcccgccttcatcgccttatcatataaatcataataattaatcacgctctgatagcctacaacctgcgccagcatcggcagtacaagcattataaattctttgacagtcagttcttcacaggcatttttatagactttaagaaacatttttactgaaaatcctataaaaagcatgcacagaactacctcaagaatctctgttgcaacaaacattgcaattattgcaggaatgtttgtcataaatatctctatattattcattaatgtagtcgtcatctggttaatcagcatcataagctgtgacacgcttcctactgcaagccatcttaatgcaaaaaatgttatgcacagaaatgccttcagccttattttcttaaaatctcccacaataagaacaatataaaccgctgccattgcgattacatatgcagccagattaggcagtatctgtggaatataataaagcaccgtaagcactgccagatacagtactgccgatgcaaatgctctttttttattaacaaaatcacttaaaagtctgtacaggaaaaatgcagctgcaagccttacaccattaatcatgcactgtgagactatttcataaaataaatctattttcattatctactctccgattcccctcatcgaatatttcatgtaactttcgacaaaacatttgtaattctgctttgccatagttacctgtcccttttcaagataaatgtgtgaagaatcatatcgttccacatatttcatattgataagatatgccctgtggggacggaaaaagctttctccagccatatcctgcaattcagacattttgccatagtattcaatgtcatctgtagtcgtatgaataacgattttgcggttaaatacctcagcatatacgatatcatcaaggtacactcttgtatgtactttcccattggtaacagtaatgcttgcccgtccggcgttgtctgcttgaagttcctggattctttcttccgcttttcttaacacagcttccagtttttcatcatcaaccggctttacaagataattaagcgcatctacatcaaatgcgtcataaacatattcctctgccccagtcacgaatattatctggacttgagaatcattttttcttaactgccttgccgcctgcatgccgtccatgcccggcatctggatatcaaggagtaaaatatccagacgcatcgaacacagaagaaggttgtcacagcttgaaaatttaacaattcttgcctgtggcattaaccttcttactttgttttcaaggatatcccgaattctgctctcatcatcgcatatacctacaatcattttcctgctcccataactatttctaaatatatcggcataaccctgaagtaattaaatgagcatattaaaatgtttatagttctgctcattttctatatcagtatctgtcaaactctgcttaacggaattgatatccccgcctgcctgaattgtgtcagacatttcatcagcagactccgctgtcttttcagcagattctgccatcttttctgcagactcgtcagtcttttcactaagatcatccataatctcagacagttcacccttatcttcatcttttcctgctgcctcatcaagcgcatcttttcttctctcttccggagtctttggcttgttcttctctgcagccttggcaatcttttctgctctctcctgtgcctcatctaatacatgaagcatttgtgagctgttgtattcctgcttggcagctttaatctcatcctcataagaatgaaacatttccagcttcttggcaatttcttcaacagtctgtgcctctgtattcttgagattctgcttctgtttctcatagaattcgattttaccgtcacgctgtgcctgtctgtccaaccggtcttttgtactctttagcattccctgattttgcaagccaaacatcgttttccctaataaacttaacgaataattcatgtcaaatctccttcctggctatacatacatgtcaatcaaacttctttatcaatcttgcctgaggcgattgacgctgctgtctttgagtaatatgtacctttacttgtgtatgaacttcctgctccgtttgaagcatttgatatagctgacgccttccttgatacatttcctgcaaatgaattgtacccgttaaatattgattttaatgtgcttttatcagccttttttaatgtgtcttcatctaattccagcttattaccttttgcgattgtaatgcctgccttagataacagttttgcatttttgccagtcattcctgtaagccatgcggcatttcttaatacagatttattattagattctcctgattcactcacaacatcattgtaactttcgataaatgatttaacagctttaacaattgtgtcatcatctttatcaaaaagctccgaatcattaagcttatctgctgccacctttaatgaatccgcacttgaacccataagagttgatttctgtacagtatcctgttttgtagttgacttttcagtatcctgctttgcataatatgccttcatcagtttcttatagcttccatttctgattgaagcataatctgataaataattagctgttcccactgatgaattagatgctgttccaaataacgctgaataatcaatattactattatatttacttgaataatcactaaaactattaattcctgacataaatttatccccctataatcttatatcaatctttttataaatgttctggctatcaggttcactactgtcctgtgtgccgtcttcttttactttttcactgtcatgttcagtctttttgccgtctgcggacctgtctgtttcattatcagactctcctgctttgctgattgattcctttgcatctgcaagtgaagacatctgtgcctgtgctgcctgctgtgcctttccctgtaaatcagcaagttcctgttctttcttctcagtacttgagcctcttcctttgtccattgctatttctgactcaagaactccggcttttccatttatctgtgtggcaacacttccctgcacctgtgcctgtttcattgctgaatctgctgaaatcatagcagacattttgccctgtgatattccacccacctgtcgctttgagcccttatttttttctgtatcatcataatcagcgccagtcagctcatcaacagaattactgctcttattctgctgttgttttctaagttcaatctgatgctgtcttaactgctgtgtcaggctgctgatttcctgctgaatctcctgccttttcttcatcttctcttctaatgaaagttcctgattagaagatagttcctgtaattttttctgtgcatttgcaatctgattctttaaatttctgctaatagaatccatctgcatatttccaccaatactgtccgaccttttgcaatccgttgcatttccgacaccattaactgtcatagtcattatcctccttgatatattttctttataaaaatgtcggaataatactttttcttatatattcagatgttgtgaattgaccttttttcgttgtgaagcgactgagaaaatcaaaatgccctgctgctggtttttgccagttgcagagcacttttatttcaccatatttcaattttatctttattttctaatattgactttcattaacagctatagtattatcctttcataaaggaaatgggtttttgtctggtaagcgattaatcgccgagagagttgctcgtttctttttttatgtctataacatcatatagatacatcctccatcatttgaatgccttattagcacagaggtatgaaatatattatacctttccactttaccattatcatcatatacaggaagagcaaattttgaatcatatctataccaaccatttttgccatctcttctatgtttatcttcattattctctctaaaatgctttcccacagcaatttcaataagttcaggaatacctgttgcagcatttgcctttgctttagcatttgttcctttaatactatttgtatattttgagccagtatattctttaggtaagtctgaaccaatataaaccacatcaccggttgatacaatagtatatatttcaccaacatatttctttatctggcagcaaaagtaatctatcaattaccggatgaataattgcggtttctgtaatctgattaattgcacatagcttcttccctgcatctttactggatgctccgcagtgataaaccaattctgtcttctcaccataatcaagtacaattaacctgtcatgacaatcgggattaggcttgattcgaagcgatggatattgattttgaaaatctgtcactaaagattttgtaagaaatccttttccaccttttccattttctgtgaacaaaacagcctccacaccatcagccttttgagaaagatgttgtaatgactttgcattcatataatcatccacaacatagattgatttctttgcttgttgatagatttctatgtaagcaatatcagcctcgaacttctgacctttataaatcacaaaattcttcttgtctttatcagtaataaaattatctgctaagatagccacatctttttgaattgaatccatcttattctccattcgattctgcctctccgttatcgttccaaccttcgctgttaaaagattcatttcatttctagtaacaaactgctgattctgcctaatatagtgacgcatctccctaaaagtacgcataataaatatgctctgttgttccgctaattttccacgaagaactgttgcaagcatataaattccttgctctgtaaatgcgtacggtaaatatctgcgtccgccttcctgaccagcaaaaaaattctttttccgtgaggtcacaatttgtgacctcacggaatcaatttcactattagatagttgaaacataaaatcttccggaaatctttctatatttcttttctttctttggctgatacacgcccgaaagagaaagcagactttccgatttgtagtccttgccctcgcatttcagataagtggcataggacagtaaatcaatggcggcttcaaataaatgcacggtatccgtcggctctcttgccagaagtcggaacgaataccgcttgtcgctgcccgatgcgtcctgcttgaaagtgctgccgagagtgcttcgcagggcggcatatttcggtgttccgctttcgtctttgccgataaaaacagcattgtgataatcggcactctcatagagcgtaccgtctgaaatacactcctgtatgagttgatagtcaataccacgccagaaaagatactgtatcactctgttacaatccttattttttggcggcaggagcaggactttcggttcatctttcttgggagcagggggcggcttccagtccgccatcgcctgccccatgagaatttccactgcttctacgaagtcatattccttgaccttgatgagataatcgagggcagaatagccgcccctcctcgaccaccaataccatttgccgttggaaatctttaaactgtcgtgttctgcggtacagtacacattacttgtgcctttgaccttaacgagattgctcggctcaaactcacgcagataggataacaggtcaatctggcgtacccgttcaagcacatcagggtcaatctgcacatagggtcggttagttctcaatggataaaatcacctccagaaatagaaaaagccaaggggctttcgctaaatgaaaacctctcggctatgtaaaaacattctattttgtcaacttcatttcattctcatatatctcattaaatacatgtattccgttccatatatattcagacaacttattttctttatccattaccactaaagattttataaattccattttatcttcctgtgttcttgctatggtatcgctatttaaatttaagattataggcaaattttgattaaatgatttcgtcacatcatatttgtctttatttaattgcaactggctaattatttcaatcgtagtaacaatgttattttcttcaaatcccaacagccgagctacatctattattcctgcatcatacttcttcaacttagaagaaagttcatctacttctcttttcaaagtatgtaccgacaaaaccatagttgacattattctttctattcgctttacaaatgacctccatatatcaatcgtaacattttgcggttgaattgtgttgaatttgggttttgtactgctgtcaatagaaaaagccccaaacgctgtctgggttttgctaccgtctatatgatacaaatatagttcaaatagcaaagaacgaacatcgtgaaaacactcattaggagatttgcaaattcttactctatacgaaatcgtcttccagaaatcaaacacaacatacctatatccgtcaacatcatcatactgaaaaaaagcatttgttcctatttcagataatttatccattacaaaataataattcccatcaattatgacatcaacaaaatccccgtctttattgcctaagatataatctactatttcacagtattcttccttaaattcctctatgttattaacatagcaataccactcgtatgccatttttgccatactatgaattgcataaaaacccaaaaaactatctgcttcaatggttttatgcacaataacatcacttatatcaactgttgatgctttccctttgcttattttctctattctttccattggagccattaaaattttgtttccattatcatcagttcctgcaacaacatctttaggtgcatacaaagactctctattactgatttttacattatgtagctctgttccatcaactgatatatctgccttatactgaattggttttccatcacgagtcgtaagacctaaatgatttctgaaaaaatccaaatcagctacaaattttttctcataattatcatttgtaaatgcattatgtgttttacaaacaaatgatttggttagctttgctcctgtaattgcataagttataatgtcagatgatgttagttctgcttctgaattacaataaatacatttcatcgtttattttctccattcatcattttatctcacattgtccttataaggctcacatcaagctttatttagataactttatcaaaaaattatccaaagtatcattccatttatccaatcttgaaacgcacttttttaagttatctctgtaattcacttcatctatacctaatacttcaaacattattcttcgatataataagctcattttcaaagcatataaaaccgattccgccccattaaaatacacacccttctgttcacgcttaatatgcattattcgaactctactattgactaacgctgataaaaacttttcatagtcatttgacaattccctttcgaaaatatctacaccatatttcgtaatcaatgcatccaaacagtttttaagagatgtcccacgagcccctggtgttaatgaagcataaaaattagtatgcttttttacgatttcaacaagtggctctgctaattcaatcaaaaatgcacacttaatatctaccgtcattccactattacttaaagaatagagatacatttgatgcaccacatctaattcatcaagcaaattttcccatttacaatacaaatccgctgtaatgatagagtcaaatccaagcattttctctatactgtagttacaaaaatcagcagacatgaaataagataaacgccccttcataaaatgttcttcacatgaatgtaaaatcttttcatcaacagtatcagacttagataattgaatttctgataaagaaataaaagccccatcaaacagcattaacaatctttcaatgcgtgaaaataatgcatataaatcaaatacagaaacatccacatctgaagttattgaaatttttctgattccacattgttctacatcaatatgaaaagccttgtctttttctatatcaaagccaaccgcatgtggaccatctaacatttttttatcatctctgaaaatagctactaaagatttacattttgcaacttgctccataatatttctccctcgtactttgatttactactttgattataccattccattattaaaaaagctattatggcaaactatatcatgcccctatacctttatttattttatgtaaaagcggcatcagctcaacgccaatgctgcccattctcggttataaaattcctgcctttttgagatacccaatgctgtcatagcaccctctgaaatagattgcttcctgctgcatatcgctgagtttgttccgaagctccaaaacttctatcaaagccttacactcctgctcggataaatcgctcggtttctccgtatccagagcctccatcacttttggatactccttgtagagttcctctatcctttcctctgtggaacggtattctggattttctttgggcagctttgcgataacggagcttagatattcagcaaagatgttgctattcacatcaacaaaggtttcaaatctgaaattatcaagcacacctttcacctccgacatttactaatctacacctattatacttcccagaaatcagcaatacaaatatgcaaaccacattatctctcccgacttgcacattttctttcgggctgttcttctgcctgctctggctcggtatccataacggaagtatctttttcattcagattcagctcaatgttaagagcgttcagccgttctgttttttctttcagctcatcttcaaaggcaaaaggcttcttgatttcctcctttgcgatttcaagctgtgcaatagtttccgcctttttggtcttggcagcttccagtctggcagggagctttgacagctcattttcaattcaagtcagatttccgagagcatcggagcctaaatccaccttatgctttgcctttccacaaaggttcatacaataatgggcgttgacggtatcataataaatctctattcggaaacctcgatagctgccgatttcggtagctgcggacatcggatagtccttgcagattgcaaggagcatttcgcctgcagctgccttttcggtataggtcacgccttttagggtcatcgggcaaaacttatcctcaccctgcggcttgtgctgctcggcaagagctgcatcattttcatagcccgcaatgcgtttctcatactccttaatggtctggggatagtatttcagcactctgtcctcaaggtagtaatgctcggaaaggtaactctgctttaacactcggagcttggaaacctgtatatccaaatccatcttttccttaaaacgggcatcgcctgtggcaagcattttaacctccgcaaaggacagggcaacctcgtccacatcttcggcagaacggacagggcttttgctcgtcattatctggctgataaatttctgtttgctctccaccaactgatagaggtaggcatcaaaagtctgctcggtcacatagcggtaaacctccacctctgggaacatgttgccctgccgttcaatacgtccatgcctttgttcaaggtcagtcggtcattttttgcggacagttcaatacatgcctgtctgtttcgctccctgctcctgcgtttcgtttccgttccttgaacctttcttatcctttttctgcactctgggcaatactttgatattgcagagcggggaacatattcaacaccgcacaccgtacaattcttaggctttaacgccgtccaccgcttggttggcgtgatatgtaattcaccgacaaagccgatgaatttataataaatcttgatttcctgtcttaccgttccgtctgtaagtttctcacgttccgaaacaagtatcttgtctatgagtgcgtttatgatggttgcgtccagttcctttaagccttggtaattacggattagggagaggaaatcacggacaccctgcgacttctcatagctgtcgttgagcgtttccgttacctccctcaatcttgcttcgatttcaagctgttctttctggtacttccccgacatcatctcaaaattccgctccgtaatacgctccatcaccttatcttcatagagtgaggaaaacagcctgtccagttctgcaaggcgtttgtttagctttctctgctccttttccagtgcccttgccctgctctggtctgtttccgtgagccgcttttcaatcgcccttaccgccttttcatcattgaccgccatatccgcaaatcggttgatgtcggcaaggacagcgttgaataaatccctcgcttcaatgctatgtgcggtacacataacattgccatatctgccataattattgcaggtatattgtacgcagtcgatgatgtcggggcgtttcctcctgttggcactcgccgcccgcattgcatagccgcagtccgcacatttgataacgcccgaaaagatattctcaaatccccctgcgttctgctcccgcctgcggctcgtcataagctgctgtacggtatcaaattcttcctgcgtgactatcccctcatgggtatcgggtatcacttcccattcttcgggcagcttagaggggcgtttcttgcttttcatgttggcggcaatccgcttgtagcctgcaaggtttcccgcatatatcgggcttcttaaaattccccttatgctgttctcgctccaaatataacggttctcctcgttatcttcaaagtgccgctcatagcctatcgccccctgtgtgaccgcataagcggcagggcgtaggatatgctgtttgttgatgtgcttacggattttggcgattccgttgcccgctaacgcaaggtcgaatatctcccttaccacatgggcaaccttgtcatctatcaacagatggttgtggtcggcagggtctttgacatagccataaggggctgttgttcccatgaatttcccctgctgaaacctcgcacggtacgccgattttatcttgaccgacacatcggcagaatacatttcgtttaggatgttgcggaaaggcgtgatgtccatcgccgatttattgagcgtgtccacgccgtcattgaccgctatatacctcacgttatgctctgggaagaaaacttccagatataacccacaatcaagatagtttctccccagacgggataaatctttcgtaatcacgcaatttatcagaccgctttcaatgtcttttatcatattctggaaacttggtctttggaaatttgtaccagagtaaccatcgtccacatacgtttttgctaagtgccatccctgctttttcacataatccgcaaggatggatttctgtgtcgcaatgctcgcactctcgttatccgtaccatcgtctttagataagcggcaataaatgccgactaaatagattttcttttcttctttgattcctgccatactgtaaaacctccgtatctgtcctatctgttttcatgtcccattgcgtacattctaagcggacagcccctcattgtcgaaggtgtcgccctcggcaatcttcttccgaatatcctcggagataatcgggataaacgcttctgtgactgtctgtgtgccgacatattcacggctgattatcatctgcactggtgctttcggcacgatacgctttctctttttatctgctttcttatcctcgcccatacttaaatcttcctttccagacagggcaggagaacgtctggaaacgccccgccctgtcaatcagataccatcaatccccgctgttcaattctttctgtaatgcttcaaggagtgccgccgcttcatcagcgttcaacgtgatgcctttcccgcacttctcacggttcggggaaaagctgcggatgtcatatttcggctctctcccgttccatgagataagattgatttcctttgtgtatccgctgtcactcgcagacaatacggcgatttcctttacaatctcatactggatttctctcattccttacctcattttccttaaaattctgtctttctcctgttccaaattcctgtatttacctcccgaaaagagaagattagcggctgtcacggttacgtttcctctgcaactcacgttccaaaagtttgatgatggtttcctccatctgctttggcgttgtgttcttcggaaaatactttttcagcttgcttgtgttgattttcaaggtttctttctggtttcccttttcctccgtcataatcgcaaatatcgtatccatgtcaagccgcccgctctggctcatgcttttcatccgatgtgcctgtgagagtgagggcgttgcttcttcgctctccatcgtggcaaagaggttttcctgctcgtctttctttaaaaaggacagttccaccgcaggcgtaagggcgattttcccctcgtccaccatctgcaaaatcggcggtatcagttccgtcaagcgtataaaacgctgcacggtcatcctgcccacgccgaagccctgtgccaccttgtcgtccgtccgcaacttcgtcacaacttgtgacgaggttaagtctgtgcggaaaccctgccttttcatggcttcggatttcatcttgtaggcaaacgcccgctcactcggcaggatattttcacgctgtaaattactgtctacaagggtaatgatggctcggtcacggtctaagggcaggacaaacgcaggcacggtatttatccctgcaagctcggacgcacggacacgccgctgtcccgcaatcacttcataaccgttcccgtcctctttcgggcgtgtgattatcggcgtgacaatgccaaattccttaatgctttccgctaactctgacagcgtttcatcctccactacatgaaacggattgtcgggaaacgggtataaatctttggtctttaacaccttaaaatcctgtttcttcattcactttttacctttctcttgatttgtttctgcctgttctttgtaattcttccaacacttcgggcggtatctttgagagcagccgccccatctgctcgttggttctctgcaactcaaatatcttctgatttgctttctgtacctttagttcctgctcgtacttttcatcacgcatacgccccgcatagtccgattcctgcccgatttgctcctttaggctgtcgatataggcactctgcttactgatttcctttgagaatttctccacgtctgggagccatgccgctatcagttccagagccttgtcacgcttcttccctgcgttaaaggcgttgatgtcggacagggcagacacgatttccccatactgtttatcaagcctgccgcccaatttatagagccatgtggggacgtgtttccgcttggtttccattgaggactgacctctttcaagctgattccaccgtgaggacatccgctcatggtaggcggtctgccactcggataatgatttctggttgcctaaaatggttttcgctgacagcttgttgtctggtgtaatcggcacaaaacagaggtgcatatgcggcgttctctcgtccatgtggacgactgcggagaggatatttttctccccgacacgctctgaaatgaaatccagagccatcgtaaaatacgctttctgttcttcgggcggtaactggttcataaattctggcgaagccgtgataagcgtttccaccatcatcacgctgtctttcctcgtcctgcaccccgcttcggctaccatgcggttaatctctttcttgtaggtgtagcgtggcggttttacaaggtggtagttatttttagagcgttccatatctatatctggattgcttttgtaggcttctttcttccgctcgttgtggcgttcacaagccgcaacgccgcccgctttgcgtttctggaaacgcaggattgcgtatggcataatccatcatcttcctttcttcggcgggtaactgccctttgggtgacagcggtgacagtggtgacagcgatattgggatacccccctcgcatgagccgtcaccgtcaccccgacattcttttatccgaagccgcaaggcgtaggatagcagggcgacagccctgctttaagggagtccagagggaacgtctggcacacgactttgcagggcaaagtgtagtgtgttacaccctgtaaacgcagtcggaaaaatcggagagatttttctgaccgcaggggtggttttacacgcccgaaaagggtgggtgaatcccacgcctgcattttgcgtttgcggggtgttctcccgtagggatgacagcggcggggtatcctaaaatcactgtcaccaccgtcaccactgtcacccacagggcagaaccgttattcttacatggctttaagcgtcaatgacagtaacagagggtatcccaataccgctgtcaccaccgtcaccgctgtcacccgccctccttgcaagggcaatctgcctgccgtctttcctgcggctgtactggtagcagatacggttctcgcttaaaaatgtggtgcggtattcattcagccatttcgtaatcaccgtgggtacggtttccgtttcccccatagcggctaacagttccgttgccgtgcctgcccattcttccttatccctcataaaatccaccaaccgaaaaaggacgtctggtatcgtttctttcgcaagctgctcctgtgttttcctctccaccagttcccaactgcaatcacggaaacgcagcgtgtattcctgatagggcgtgtccctgcccgtcacatacagcttggcggtgtcagacgcacgtttctccttttccagaacaaaggtagcgtccgcactccctgttaagcctgtcgtcccagacaccttgttgaacacgtcgctgtcgttctgctttcggatgtggtgtacgacaatgaccgccagagagtgcctgtcggcaaaatctttgattagggaaatgtccccatagtcgcttgcataggcgttatctttagatgcggttcggactttctgcaaggtatcaatcacaatgagcctactgtctggatagtctttcaaataatcttccaactgcacgataagaccgtctgacagcttgcagcttgccacggcaaagtgaagccgcccgctcgcttcgtccgtcaagcggaataacctgtcctgtatgcggcagaacgtgtcctcaaggcagaggtaaagcacgtcgccctccattgtcggcatgtcccataaagggattccctgcgacacgcataagcatagcttcagcatgagccagctcttgcctatcttctgtgagccgcagaacagcgacaagcctgttgggataaggctgtccaccacaaaggacggcttctcaagcggctcataaaggagcgtttcggcgttgactgtctgtaacttctgcatggctttcctcctttcgggcggtgtctttgttttcgttgcacataggcgttgacctccttaaaaatagatttactcccatgaaaaaaatgagagtatgtaatgccgccaatcccacacaaataaaaaacagatttctttttcgggcggtgtcggtcacggttggagatacttcctcatttccgcctttactttctcctttgcaatcgcaacagatttctgtattgctgaagcggtgcaatgctccatagcggcgatttggtaaaaattgaactcatactcgtagtagagcaggaaacgccgcctttgtatctctggcaggctcccaaccgccttacagagcgtttcattccgttcttcttcaatcatgcgttcatcaaggctcttaggcacacgcaacgcccgtctgtaaagggtttcgtcccatacctcattaaactccctgtgccgctcgtcccattggagaagattcctgttcctgcgctccatctgccgaaactccataaagaactgttccgacacttccaactcgtgggatttgccttgcccgtccttaaagctgataaaataccttgtgccgctttctgcggattcctcccgaagcgtgtacgccttagcctgatatgccatcccgttctcctcctgccaaaaaataagcggggagattccactccccacccagtagcccgcaggataatgggatgtattagacgtttataaaattttccgaagcttcttccgcagatggtctaacctcgcatagatagcaccagtcgtcaaatgcacaagcggggcaatctcctttgtggaatatccctgcattttcagcagaacgattttcaaggtacgcccgtccaccgtgactaatacttgatagagattttcgctctcaatctcgtccagtaactcctcaaccgtacccacttctgcctgccgctccctgtctgccatgtcctcaaggtattccgcaacgtcattcgtccatcggtaaaaccgcctgttggaattgaagtctgccctgtccgctattcgtatctgctcaatggtcgtttcatcaacgccatactcacgcagcaacttttcctccgcttctttccagatacgccatttcctgtcctcccgtccgtggttgtatgccattcttatttcctccaatcagaattgattgagagggcagagaaaagccccctcattttcccaaaggaaaaaacaagggggctgaacgccttaaattttaattttctattatctttcttagttttattaggattctggctttgcgtttgttcacaacgctctgggtcaatcctaaccgcaatccaacctcacgctcggtaagaccgtcaaagaagatggcatgaatcaatgcctgttcactctccgacaacaaatgcagggcggctttcagcctgtccaccataaccgcattgacaacggtttccgcaatgtccgccgcttcatcagcgatgaagtccagaggattgccctcgctgtctataaatccatccagagaaagcaggctgttcttcgcatctaatttttgcagataacgccaccgttctttatcacggtagaagtccgtatattgctccctcacaacttcaagcaaacagccctgtacagggataaacagcttgtccatgtaggtctggtcggcgttcctgcggcggcagaaatctgtataggacagttccacatagccgccgctttctttgatatatacctttcttggtgcgtatttcaccgtattgtcctccaatctgaatttttgaaatgtaaaaaatccagatggagaggcggagaacgacaccgcatatcagaaacagccctacggcactttccaacaaaaatcgacaaaagaaaaaccgcaaaggctctgtgacctttacggttataagaaatacaaattctgttgtatggagattgtacttctactttcaaggtgagaagtaccgctgcactggcagaaatttttttaactggtttcctgccattctctgatatgctatgtattgataaattttacttcgtatgagcagatgaataaccgcccgaaaaaagaacataaaaaaatccctccaaatttaaaaacaaattcagagggtaatttagggtataacaaaataacccacccgaatatcgttttttttatttggtgagtttgttctttcaaatacgaaacaaaaagagccgatgattcgtgaattgttccacaatttcatcggctctgcgtcttaagcgtctggctctttgatgacagttatcttcaagttgtcaactttaatcaagctttcttgtctgcattttggacaataaaggggataattctccaaaacagtgtccttcctaattttattacgggttttgctcccacaaacaggacacaatatccattcgcatttcatcataattagtctctaatcctttcaaatctcattttatatgacttttgcaagctgttaagctaacttgtggaacatatgccgaaccttatctatacggctattcgggcggcggggttggcaaataaatttaccaatagctggctggtatccttttaactctgtcaagcagactccctgcccatttgtgaaataagttaaatcgttcctgtattcttgaatacatctggcagggatttctcctttcagaatgacctcgtcattctttatctgagtacttacaatatctgcacaataccttggagcatcatgatacgcccgtgagagatattcctgcggtgcataaatttcaaagtggagatatggctctaatagttctgtccctgctttttttaaagcctgctccaatacgataggggaaagcagccgaaagtctgcgggggtacttacaggactataatacaatccatattcaaaacagattttacagtctgtcactttccatccatacagcccctgctcgcagccataaagaaccccctccataaccgcattttggaacgattggtttaaatatccaagtgaaactctgctttcatactgcactccgcttccaatagggagcggctctatggacaacccgacagaagcccagaaaggatttggcgggacttctatgtggatggtatattctgcttttctaagcggtctttccatatatataacagtaggctcttttatttctgcctccacatgatatttttcctcaagaatggcacaaatgacttccatctgcacattccccaaaaaagaaagtataatctcatgcgttgtagtatccacataatattttaaaagagggtcgccatctgaaatttctgtaagtgccccaagcaatatttcccgctgttcaggtttctttactgcaatcgttgtttggagcatagggagaggattttcaataaattttctctgcggcaacagcatttcgttccccaaaatactgtttagctgcaaaacatcatttggtaaaattacaatatcaccagagcaggctgtatcggatggatataattcaccgtttgtcggaacacacatctctgtgatttttattttctctttttcagatattctaataacatccctcaaatgcaatgttccgctatatatacgcacataaacaaaacgccgccttttctctgaatattcaatcttaaaaacctgcccgcataattcagattgaccttcaggcgttgatgaataaaatttactggcaatcacttctataagctgccgaatccccagattgtttttagcgcttccgtgataaacgggaaataacgttccgttttggaatctcctgttttcttcctgttccagttctgacattttaaacggtttccctgacatatatttctctaatagttcatcgtttcccataattaccgcatcccactgttccatatcgtcattgtccgttacatttatatggggatgctgcccaaccttttgcttcactataatttccgaagaaagctttgctttcatttcccgatataccattggcaaatcaatcccctcttggtcaattttattgatgaaaaagattgtcggaatcttcattgtctgtagtgcatgaaacagtatacgggtctgtgcctgtatgccatcctttgcagaaactaataatactgctccgtctaaaacggataaagaacggtatacttccgccaaaaaatccatatggcctggcgtatctataatgttgacttttacatcctcccactgaaaagatgtcactgctgtctggatagtgattcccctttgacgctccaaattcattgtatctgtccttgttgtgccttcatctacgctccctagttctgcaattgcaccactggtatataataaactttccgttaatgttgtctttcctgcgtcaacgtgagccagaatgcctaagttaattattttcatgtgattttcctcctatcaacacccaaaaaagggcataaaaatacccagtgataaatactcctatcactgggtaaataactccaatagccccaaaacacttatatgttttcgggcatataaaattacatgataaaagtattcttaaactgggtacaaaaaactaagccccatattaaaagtgaaacgggactgctactttttgttcccactatcaaattgacagtttatttaagaataccttgccgcatatttattaactccttgtataaaactgaatctaattatattccttaaccctttatttgtcaagctgacaaactaaagcagaaaaagcggcaggatttcaccctgccactaatcatctgtttatgcaaaaataatttccttttccacaatctccctcgcacaagcccttatgttattgaggcatcctgtccattctaaggcgttttctgcctttagctgttccgttatgccctgtgcctgtttcataccctctatgagcctttcaaagcgttcctgtgcctgtctgtcaatgtcggcaaggtaagcgttaagtctgccgcttgtaagaagattggtgtatgtaactttacagtgatgcttcagataatccaaattccgctgtccccagatgcctatcggctgttcttcttcggcgggtacagtcaaacaaggtattaagtaatcgccttgcctttcgtatttgccgcccatttcctcaaaaattgtctttgccattgtctgttacctccacattcttttttattttgaatgtccgcaaaatccgtcctacatcggaaggacgccacggacaatcaaggttatggattgctatgagcctgtcctgcacataggcaatgagctttgcaatgctgctgaccgttggtacattgtttctctttgccgtaatgcggacagaaccactgatagctacagtggagctgattgtcagcttatttccagactttgacacgctcacggctcattgcattgattagccttacctcaaagcccgacagctcaatgtttgacggaagcaggtcaacgccctctctgtggtggataatcccctgtgaaacatcaagcgttttatcgtctatgatattctgcatcacagtagagagcgttatgggaatatcgtctggtctgttataacctagagccatcgtgagatttgcctgtgcatcagcgtcaatcagcaggactttttaccctgctgcaccagacttacgcccagattgaccgctgtggttgtttttccgacaccgcctttctggttagtcagagcaatcactttgtaatttaacatagatgtgtcctcctttcacatagatttagccactttgtcaaggtggctatgtaaacagtaccagagaacgcaaaaaagccgcctactcttaaaatcaataagaataagcggctttgtaatttgtcttagacatattcaatttttattctcttggtcggtgcatttatgaccttaaaaacaaactcgtcaacacaatccgtatatctgccttgctgaatgagctgattttttaactctacaaggctatgtattaaaagttttctttcgtggctatccaaatatagatgattaaatttcgctctcataagcacacctccacatctttagcttcattataagtttcggaaaaataatatacaaatctataactgggagactttgataaaaactcattcctatcataaatttcttccatctaaatactggattgcggttgaaattaaagacaggcaacgtttataaaaatattcataatgccttttatcctgaatatccgtttttgttgtttcatggtgtcgaattctaaaattattgccaagtatggtaagctcatgaaattccttttcaaataattctaaaaacggctgttgattattacccatatccattataatcttattaaccgatttcttcttatctacagtcgatgagcagtaatatgtctttagtctctcaaatgcatcccaaagtttctccactgcaatttgcaaattgttttcatcataatattttgaagcctcttgtaataactctttcagtcctacttcttgaacagacactaatgaatttttatttatctgagtataaaatgtattcattagcttccccttggaaagctgaaatggtatctcattcagttttaatatagcattaatctgtggttcaaagtcatctgagatactatgtttcgcaaaaaactctattgcgtccaacacacaaaatggagaattagaaagtatgaatgcttgcaaatcagcagtttcaacatattcttttttatcattataacacattggcacataaaattgccttatttcattaaaaacatcctcagctactgttgtattataattccatcccgtttcgtcagtcgcttgatatacgatattatatcgctccagaaactgataaatttgatttctcgctttccgctttatggacaatactatattttttgcttttatgtcctttgcatttcgttgagaatatggaataaacaacgtattatcttcttgctgatatattctccatccataaacatcacgattggatattttttcagcagggtaaatctcataaccgtcattttgtaatagcttgttaattgccactaaaaattctttccagtatcccttatcatatcgaacagcagggtgaaatacttcacaaagaaattttaaatatacttcatcgctaccatcttgtaaattgaatcttttgtcttcaaaaacccaacagtatggataatcatcattattcactgtatgttgccaaatatcctgttctgcatttgcaaatcttgaatcaaaacttggcattctctccaaatcatataatcttttaagaaaatctatttcttcaaggcgaccataataattataagtaacggttcgggtttgaaaaaattcgtctatctctaatccattctgaaataaatctaaaatatctcgctttgttatttctgtaatacggttcactccattttcctcctttcaagcatgttcaacacttatatattgcttcccaaatattttaaagaaaaagcgtaccactatttttaatgatacgctcatcattattaaatcacttcaaaatacttcaatgcatcctttatcgcttccactttctccgctgtcggatgcttcctcggctgtttcaattcttctaccgcattaggagcatcatacattggtaagcctaaatctctctttacctctgcgatatatgcgatatgtaccttgaagccgtattttgcttctatgtactcctttatcattttgtaggtcactcgttccctgggcttgtattcttcggctcttttagcgatattatcaagcggtacttttccctcaccttcgccaaactcaacttttacgttgatatgtccgtttggctttttgtaggaaagcagtaccaccgtctccacatgctccgtatgcgggaacaaatcaaatggctgacatgccgtaaccttatatccacccttaaccagcaccttaatatcccttgcctgtgtatcaggtccgcatgaaatgtacacaatcctgtctggcttaatcttaagaagagaattaagaaattccggtgtgcttccacttcttggcggatccatgataacaacatctgcctttgcatttttcgcatactcaacaaggaaatctcctgcgtcagcattaacaaatgtgacattctttatattgttaattgaagcatttatcttagcatctgatacagcttctgaattaagctcaactcctataactttgccagccttttttgatgcgactattccaatagtaccaattccgcaatatgcatcaattacagtgtcattttttgatatatcagcaagctgtattgcctttttgtacagcttttcagtctgctggtggttaatctgataaaatgatgtcgggcttattctgaatctgcagccacacaacacatcctcgatataaccttttcccttaagaacaatatttctctttccaagcaccatgcttgtgcgcctgtcattaatattctgcacaattgtagtaatttccggatgcttctcacataatgccttaagaaaattgttctttgatggaaatgcgactcctgctgtaacaataacaagcataatctcctttgtcgaaaatccttttcttaaaagaatgtgtcgaatcattccctttcccgcatcttcatcatatggctgatatttaaatgaaactattagttctttaatatccttaataatgtctgtacactgtgaatcttcaatcatacagtccgatgtatcaactattctgtggctgttttcctcgtaggttcctgctattacatttctggactcatcaagtcccacaactgcatgaactttattgcggtaatatattggtctgtacattccaacaatatcatcaacttttacatattcgccaaaaagttcttcaatgtacttctgcttaactgcaagttcattgtcatatttcatccctgcataatcacagccaccgcatttttctgaaaatgcacagtgaatccgtctttctttctcatcatatctattcgtcataaaatttcaaactcctcattttttctcgtagctcatactccagaacttcgttctgtcgttgtcgcggtgctcctcgaatgcaagcgataatcacacaatacatgcaagcatgattgtgtgattcccgcttgtattctcatcactactcgcacaaaagggcaaccgcccatacaagcagttgcccttaacatcagtctttgttaattataatgaagtattctcgtctgtacttccaagaatcttaaccttaccttcgtagaattctttaactgcgattgataatggcttgtctttctctgaacatcttacaagaggagttccaacctgaagctttctctcatcttccttagagattctcttctcctcaatcttatccttgtccttttctttctctttttccttgttgcttgcttcaattcttgccttggcaatcttctcctcaacgcttcttgcatcgatgatttccttagctctgttagcagttgccttaacaattgaatatctgctctgtactaaaggctgctcgccctcttcaacctcactgttaattacagccattaattcagtatacgatggatgtatcattatattattctcctttcgaataaacctttaattcttctttaatattattaatcagtccaagattatacttagctttcatcttctcagataacacaatatcatgaatacggccgacacataaatcgacttcatcattgataactatgtaatcataatcctcaacaccttctgcttcctctgctgctcttgaaagacgggctttaattgtcgcctcatcttctgttcctctgccacggagtctcttttcaagttctgctgctgacggtggtgttataaacataagcactgcatccgggaacattctcttgatattcatggcaccctgtatctcaatctcaagaataacattgttgcccttatcaagctgttcttcaacatatgccttaggtgttccgtaataattgccaacatactgtgcatgctctattaaagcatcttcagcaatcatcttctcgaattcttctacagtcttaaagaaatattctcttccatcagcttcgccttctcttggctttcttgttgtagctgatatagaaagtgaatactcatcatgaagctctaaaagtcgcttcataacagttccttttcctgcaccagaaaatcctgaaataactaataatagtcctttgctcatataattacctcattctgcacataaagtgcacaagttattatacctaacaagcccgaaacaatcaagtaaatttaatcaaaaccaattaaaaatatattgaaagcctactcaatgttctgaatctgctctcttaccttctcaatctcagtctttaagtcaatagctgcattagatatctcaatgtcattagccttagatagagttgtgttagcctctctgttcatctcctgtgcaatgaaatccatctttcttccaatgccgccatcctcgttaagacattttcttgcatgctcgatatggcttcttaatcttacagtttcttcgtcaacacatatcttgtctgcgtatataataacctctgttgcgattctgctctcatcaatagttgtatcgccaagaagttctttaaccttactctctaacttgctgcggtattccttcataatttcaggacttctcttttcaacaaatgcaacaagctcctccatgtggtctaactttcctaaaagatctttcttaagattctcaccttcaagaattcttgtattaacaaactgttctaaggctgccttcatggcttcctctataaaatgccacagctcctcttcgtcttcctgcacttcatccattgtgataacctctggaaatctggcaagacctccaacagtcatatcatttttaagattgtatttttcggacatattattaaatatagccatatattcatcagctatattctggttgaacttaagattaacctgactttctgaatcatcctcataattaataaatatatcaatcttgcctcttgttgcatacttcttaagtaagtctctcattctgctctcgaatacattaagcttcttaggcatcttgatacctgcttcaagatatctgtgattaactgacttaatctcaactgaaatttttctgttacctttaactatttcactccggccaaagcctgtcatacttttaatcattgtttctatccttccattcgcatataatgcttaggaaagtataccaatttttatgaaagataacaagacttacaacaataagtatgttaatataatgcaataagaatgaatattattaactaaaggagacattatggcattcgatggaattacaatatccagtattgttaatgaattaaacaacacaattaacggcggaagactttacaagatatcacagcctgaagccgatgaaataatgcttacaataaagacacaatctggtcagtacagacttgttttatctgcaaatgcatcgcttcctcttgcatatcttacagacgataacaagccatcccctgctactgcaccgaatttctgcatgcttcttagaaaacatttgaacaacggaagaataatatctataacacagccaaaatttgagcgtgtaattgatattgaggcagaacatttaaacgaactcggtgacctgtgcagaaagcacataatcgcagaattcatgggcaagcacagcaatataatattatgtgacgacaataatactatattagacagtatcaagcatatatcagcacagacaagctcagtcagggaagttttacctggaagaccttatttcattcctaatacttctgacaagattaatccgcttgaagctgacagaaagcattttgacgaaacagtatttacaaagcctgtacctgttgtcaaggcactgctttcaagctatacaggaataagcacatgtatagcagaagagcttgcataccgtgccggagttgatggcgggcatcctgccaactgtcttgatgagcctatgaaagatgcattatacaacgtatttgacgcacttatgtctgatgtaagaaatggtatctaccaccccgatatggtaaccgacaacggtgtgcctgcagaatttgccgctgtgaagctttctatgtatgacaaccacacagaatatgattcgataagcagactgattatcgattattacagacagaaagagattgcaacacgaatccaccagaagtctgttgatataagaagaattgtaacaacacatcttgaaagagcatacaagaagcttgacattcaggaaaagcagataaaggacactgagaaaaaagacaaataccgtatctgcggtgaacttcttacaacctacgcttacagtattcctgcaggttctaaggaatatgaagcacttaattactacgataatactacaattaagattccgcttgataacactctcacaccaattgagaatgccaacaaatattttgcaagatataacaagcttaaaagaacctatgaagccggaatccgtcttattcaggagatcactgaagaaataagttaccttgaatctattatcaatgcaattgagatttcagtaacagaagctgatcttgctaacattaaggaagagcttattgaaactggatatattagaagaactgttaaaggaaagcacaaaatcacagccaacaagccgatgcattttgtatcaagtgatggatttgacatatatgttggaaagaataacatgcagaatgacgaacttacattcaaaacaggcaacggtaatgactggtggtttcacgccaagcagatgccaggttctcatgtacttctcaaaacagatggaaaggaagttcctgacaggacatttgaagaagcagcaagccttgccgcctattactctaaaggccgtgagcaggaaaaagttgaagtcgattatgtattaaagaaagaagttaaaaagcctgccggtgccaaaccaggattcgttgtgtactacactaactactcaatgattgcagacacggacatcagcaaaataaaacagttataaaaaattggctgaatcagaatctgaggtgtcacctcatctgactcagccattatttttatttattcactggttttaatgcaatacttacaactgccagtataactgacgcacaatctgccactatccacggcatatactggattgcaagtgaagatttgcccgaaacaataatcataagaattacacttataacaacatttataacaaatatacctgccagctttctcatatccagaatcccgcttatcacaagatatatcagtatgtatgcagccgtcatgcacacgcagaaagttacaagatacatgtaaaatgcgttatcagtcatatcacataacgatatatccaacgtaagatatccaaacagtgcaggcgggttaaatgcatatattacagatggcattatcgttacaagtgccggaataccgatacctgccaacattcctgccctgccgcttaatcccttgataacgcctgattgtataattatacaaataatggttgctagtaaaagcattatcatccatgaccagttaaagaatattttattaccaatataatatgccgtaagatattcattaattgtcattctttgtgaatcaccatttcttataatcacagacaatatatcctgtcttataaaaccagcccacgcataaattataagcgccggaacaaggtaatttacagcatttgttttcttattcttagcgaacatctttatgcgcataattccagaacttttcaccattaataattcaagaattccaagaactattaaaaggatatacagaacaggaactttatcaagtaactgggttgtctcaatctgttctttcactactccgtcaagatacactgaatcaatcattgcatgcatggatactgatgactcccatattcttgcaaacaacagcagcatacctgtcaataaattcaatattgcagatacaaatgcaacaactcctgtattaccgattcttaaaaggattcctgacacagacattgccgtaaaaagaattgtaagtgaaaagaacaactgataaacaacattaaagcctgtataataatacagattatatactgaattctggctttccggaatgttgagtgcattattattcattttactgattatctgagcaaattcattacttcctataggaacaagaagaataaacagactcagagccataagaacggcgaggcttaaaagcctcacccttgtaatctcatcttttttcataatccttccttttcagggaaacaattaattaacagatactttaacgaaagatttcttacccttcttaacaactactccgtctccttcaaacatactcttagggaacttagctgctatatctgctaccttctctccatctacagaaacaccaccctgctggatagttcttctggcctctgacttagttgttgccagtcctgctccaaacacaagattaattgcatcaatttcatcatctgtaaagctgtctgcttcaagctttgctgtaggcatgttagctgcatccccaccagtaaagattgcctttgctgtagcttctgctttcttagcttcttcctcaccatgaacaagctttgtaagctcataagcaagaatctccttagccttgttaagctgagcaccttcccagctatccatcttgtcaatctcttcaagcggaaggaatgtgagcatacggatgcatttaagaacatctgcatcatcaacatttctccagtactggtagaaatcgtaaggacttgtcttatccggatcaagccatacagcacctgaagctgtcttacccatcttcttaccctctgagttaagaagaagtgtgattgtcatagctgaagcatccttatcaagctttcttctgataagctctgttccacctaacatgttgctccactggtcattaccaccaaactgtaaattacagccgtatttctggtataacatatagaaatcgtatgactgcataatcatgtagttaaactcaaggaagcttaatcccttttccattctctgcttgtagcattcagctcttaacatgttattaactgagaagcatgctccaacctctcttaaaagttctacatagttaagattaagaagccagtcagcattattaacaagtaatgccttgtcatctgagaaatcaatgaatcttgccatctgcttcttgaagcagtcaacattgtgctgaatctgctctggtgtaagcatttttctcatatctgtacgtcctgatggatcaccaatcatagctgttccaccaccaataagtgcgattggcttatttcctgccatctggagtctcttcataaggcagagtgccataaagtgtcctacatgaaggctgtctgctgttggatcaaatccaatgtaaaatgtagcctttccattgttaataaggtctttgataagtgcttcatctgttacctgtgcaataagacctcttgcaactaattcgtcataaagtgtcatttttgtttcctctcttttcatttttctcattactgcttgcgcaactttgtaagccaagtctctccgcagctttgctgctcccgagccttgataattcacaacttccgcactccgtgctccgttgttcattatctgcattcgccatataagacagaatctgtgcaagcacattctgtcttgcatggctcattgcttacaaaaaaggcttccgcccttctttaaaaggacgaaagcctgaacttacgtgttaccacctttattcatgacagactcgcatctgccacctcattaagtccaccagcatggacttatgcactataacgtgtgctactccggctgcccctacttacaaatatgctttcagttcgccactccggaatgtattcagttacccttacccttgcgcctctcatcaaccggctgctttctgtaagttcagtaataacctacttgtttccatcaacgctttgtaatattaattgtgtattacttataacataatagaatattaaaatcaagcctcattccgaaacaaatgtatcaaattaacactagattgtaactactctcattgtgttagtaagtcctctcttagatgaaggatcagaagatgtagcgataccagcagaaacaattactgtatctccttcttctacgaatccagcatgttcagaaactactaatgcatgctcaataatcttatctgtagaagcttctgttgctgtcttaagaggtctaacaccccagtaaatctgcatctttctaaggacattatcgtatggagagcatccgataatctcagcttctggctttaacttagatgtaagtcttgctgtaaatcctgaaattgtaggacagataatagccttagctccaaggttatctgctgtctgaactgcagcattacatacagcgcttgaaatgcttctcttgctgtgaagattagaatattctactgaatgtcctttaatctcccgctctgttctttctgcaatcttaaccatcatcttaacagcctctaatgggtactttccattagcagtctcaccactaagcataacaacatctgttccgtcgtagatagcgttagcaacatcagtaacctcagctcttgtaggtcttggatttctgatcatagaatcaagcatctgtgtagctgtgataactggcttatacttagcattacacttcttgatgatttccttctgaacatgtggaacttcctcagcaggaatctcaacgcccatatctccacgggccaccatgataccatcagcaactctgatgatatcatctatattagcaataccttcggcattctcaatcttagcaataactgggatatctgaaccatgctcccaaagaaggtgcttaatttcctcgatacatgctgcatttcttacaaatgaagctgcgataaaatcaaatccctgctcaacaccaaagatgatatcttccttatctttctctgtgatgcctggaagtctgatgcttacgttaggaacattaacacccttcttagaaccaagctcaccaccattaattactgtacattcaatctctgtaccttcaaccttatcaaccttaagctcgataagaccatcatcgataagaataatattacctgtagtaacatcttctggaagacctgcataagttaccatattaatcttatcatctgctggcacctgtcttgttgttaatgtatatttctgtccctcaacaagtgtaaccttcttgtcatccttaacagcacctgttctaatctcaggtcccttagtatcaagaagagttgcaatagggatattaagttcttctcttacacttttaattaaggcaaatcttcctgcctgctcctcatggtcaccatgagaaaaattaaatcttgcaatatccattcctgctaacgcaagatccttaataaggtttctgtcattagtattaggacccattgtgcaaataatcttagtctttttcattgtttcctccaaaataattaaaatcttttcaaacacatacctacaatataataacatatttgcgtgtcaaatcaactaagttttttatttaacaagctttaccttatttatcaccagttacatggatgtgggtatataagtggtcggaacagtattcgtagttgccggcgcattttgagcagaatctgaatgtgaggttttcgtcgtcaagttctgtccttccgcatactgcacatctgtgcttcggcacgccgcgcttcacgtgttgtgcctgactttgttgtgttctgttatctgatgatgctgtcccatatgtgccaccattgccctgagtgttaccactattctgctgccaatagtcttttctggcgttctgctgtgctttctttgctgttctcattgctttgtcgaagtttctctgtgtactgctctttgccgggcctttcttgtacaggaagaagaatattataaaattcagcattgacacaagcgccgccgttgcgttggcataacacataattgctgatggcgcaaggaaacctgctgcatacaggctgtaccatacatttcttggaagaaaaggcacaagatatccgaatactatagtaattccgaatattacagcatcaagtattgccatccatttaatcttgattgggataatgaagaataataaaacctccatatccggctgctccatagcgaatgccatgaacaacgcaagattaatataattcgtacttaatttaaagcttaatccccatataagatagataataagtgatgcaagtatattaaggataactcctgtaaagaagtatacattaaatctgaacgagccccatattctttcaagtaccgaaccaatcagatagtagaaatacagcacaaataccacaaatattatgctgttagaaggaggttgtaatataaatgtgacgagtctccatacctgtcctttgaaaatcatagcaaaatcaagtgaaaaatatgcgtcatataatccattaaaaaatgtattcatcacaaatcctattgcataaaggacaatgatataaaacataagattcttaatcgcatacttagagaatttcttctcaaatttagcaaaccagttcataaaatgttcctttcagtcttacacatgttacagactaataattcataatcatatacaagaaattataataaactaaacaatattatgtcaattaaacttactcttaagttcttaaattttaataaaaatatccgtcataaattattaaagctattttattatttcctattaatattgaaatttattccaatttactctataatgcataagttgcatagaaaatgacatattctgcgttttttcaccaaagtcactatgcaatgggtaacttttgtatatttattttaaggaggacagctgcagctgtattaggttatgaataaattcaaattaggtattgatattggatcaacaactgtaaaaatcgctgttttagatgataataataatattttattttctgattatgaaaggcattttgcgaatatccaggaaacactccagtcacttcttgaaaaggcagtggcagaacttggtgagtttgaagtatatcctgttatcacaggttcaggcggacttactcttgccaagcatttagaagtaccattcacacaggaggtagtagccgtgtctactgcccttcaggattatgctccacagtgtgatgttgcaatcgagcttggtggtgaggatgccaagattatctactttactaacggtattgaccagagaatgaacggaatatgtgccggcggtacaggttctttcatcgaccagatggcaactctgttacagacagacgcaatgggacttaacgaatatgccaagaactataagtcaatataccctattgctgcaagatgtggtgtatttgccaagactgatatccagcctcttatcaatgaaggtgcaactaaggaagacctttctgcatctatatttcaggctgttgtaaaccagacaatcagtggtcttgcatgtggtaaaccaatccgtggcaatgttgcattcttaggcggaccacttcatttcttatcagagttaagacaggcatttatccgtacattaagcttaggtccggatgaaattattgctcctgaccattcacacttatttgctgctgttggttcagcaatgaattacagtgaagatgtatgtgttcctgtagaagacattatcgcaagacttaaaggaaagattaagcttgaatttgaggttgaacgtatggaacctctttttgagaaccagtttgcatatgatgaattcacaaagcgtcacagctctcatcatgttaagactgctgatatcgcatcttacaagggcaactgctatctcggaattgatgcaggttcaacaacaaccaaggttgctttagttgatgaagacggtaatcttctttactcattctactcaagcaataacggttcaccacttgctacaacaattaaagctattaaagaaatatatacactgcttccaccagaagccaagattgtacagtcatgttcaacaggttatggcgaggcacttatcaagtcagctcttatgttagatgagggagaagttgagacagtgtcacatttctacgctgctgctttctttgaccctgaagtagactgtatcatcgatatcggtggacaggatatgaaatgtatcaagattaagaaccagactgtagattcagtccagcttaacgaagcatgttcatcaggatgtggttcattcatagaaacatttgcaaaatccctcaacttcacagttcaggactttgccaaggctgctttatttgctaaccaccctattgatttgggaacacgttgtacagtattcatgaattccaaggttaagcaggctcagaaggaaggcgctgaagttgcagatatctctgccggacttgcttattctgttattaaaaatgctttatacaaggttatcaagatttctgaccctgatgatttaggtaagcatatcgttgttcagggtggtacattctacaatgacgcagttcttagaagttttgagaagattacaggtgttcaggcaatcagacctgatatcgccggtataatgggagcttttggtgctgcccttattgcaagagaaagatatgacggtatatcagagtcatctatgctttctatagataagattaactctcttacatatgaaacaaagcttacaagatgtaagggatgtactaacagctgtcaccttacaatcaataaattctctggcggcagacagtttatcacaggtaacagatgtgaacgtggacttggtaaagagaagaacaaagaaaagcttcctaaccttttcgattataagttccacagactctttgactatgagcctctctctgaagaaaaggctacaagaggtactgtaggtattccaagagttcttaatatgtatgaaaactatccgttctggtatacatttttcacaaagctcggatacagagttgtactctcaccgcagtcaagccacaagctttacgaattaggtattgaatcaattccatctgagtcagagtgttatcctgcaaagcttgcacatggtcatatcatgtggcttattaagcagggagttaaatttatcttctatccatgtgtaccttatgagcataacgaatatgaaggcactaacaaccattataactgccctatcgttacttcttatgccgagaacatcaagaataatgtagaagaacttaaaacagagaatatagatttcagaaatcctttcatgtcatttgaaagtgaggagaagatatcaaaaagactcgttgaggaattctcatcatacattcctgccgcagagattaagtctgctgtcaaagccggatgggatgaaatgatggcttgcagacaggatgtcagaaataaaggtgaagaagtaattgcttaccttaacgaaaccggaaagcgcggtattgtacttgccggccgtccttaccatgttgaccctgaagtaaaccacggtattcctgaacttattaattcatacggacttgcagtacttacagaggacagtgttgcacatttaggaacagttgaaagacctcttatcattcttgaccagtggatgtaccattcaagactttacgctgctgctaactatgtaaagactgtagataatctcgaccttatccagctcaattcatttggatgcggtcttgatgccgttactactgacgctgtcaacgatatacttactaagtctggaaaaatatatacagtacttaagattgatgaggttaataaccttggtgctgcaagaatcagagtacgttcactaatcgctgctttaagagtacgtgaacagaagaattaccagagaaagattcagtcatctgcctaccacagagtacagtttactgaagatatgagaaagaattacacaattctctgccctcagatgtcaccaatacattttgacatattaggtcctgcccttaattcatgtggctacaatattgaagtccttgagaacgacaacaagtcatcagtagatgtaggtcttaaatatgttaataacgacgcatgctacccttcacttatggtagtcggacagattatgaatgcacttctgtcaggcaaatatgacctttcaagaactgctgttattatgtcacagacaggtggcggatgccgtgcttccaactatatcggcttcatcagaagagcacttataaaggctggtattccagatgttcctgtaatctcacttagtgcacagggacttgaatctaatccaggcttcagctatgatataccaatgcttaagaaagctatgatggctgttgaatatggtgatatcttcatgaatgttgtataccgtacaagaccttacgaggcagttcctggttcagttaatgcacttcatgaaaaatggaagaaggtctgcattgaacagcttactaaaaataaggttcatatgaaagagttcaataagaacctccgtgctattgttaaggattttgataatattccgcttaaggatatcaagaagcctagagttggtgttgttggagagattcttgttaagttcatgcctgctgctaacaaccacattattgagttacttgaggcagaaggtgctgaggctgttatgcctgaccttatgggattccttctctactgtatgcagaattcaacatataagcatgaattattaaagacacctaagaaaggggctattctttcaagtacacttataaagatacttgaaaccttcagaaaggctggaaccaaggcacttgcagaaagcaagagattcgatgctccatctaagattagtgagacagccaattacgctaaagacttcgtatcacttggcaaccagactggtgaaggctggcttcttaccggtgaaatgattgagcttatccatcatggtgtaggcaatatcgtatgctgtcagccatttgcatgtctgcctaaccacattgtaggaaagggagttatcaaagagcttcgtgcagcatatcctgaagctaacataattgctgtagattatgatcctggtgcttccgaagttaaccagttaaacagaatcaagcttatgctttcaactgctaacaaaaaccttgctaaagaagaaaaagaatctaaaaaagacgcttaattgcttgtacatattataaaaccgatatataatggatataataaatatgttcgaagaggtgtaatgttatgagttttatgttattcatcggaccaattataggtgttgcagttgctattattgctgctgtagttatcatatcagttatagctgctgctgtctcacagaaagatattaacgacgaagattaacaaaaagttcctgcagtttccattgtgccagaagcactggatactgcaggaacttattttttactgcttattgcttttcttatctttctttggttgtatttttccttctgctatctctataatctcgtctgataagaattccagttcatcagcatcatgacatgcaataataatgagtgcccctctttgcttatgtttcataagaatctgccttacctgctcagttcctgaatcatcaagcgcattaatcggttcatcaagaataataatatctggatcttccattatcgcagccgctataccgagtctttgtttcatacctaatgaatactttttaaatgttctcttatcatccggttcaagcccaacctcagtaagtgtctgtcttatcttgttatcatcaattctttctctgattgaagcaagagtctttagattctcaaacccagtataattacttataaatgacggattctctataagaatacctatgcttggcggaaacatttcatcttttcctaatatcttcccatcaatatcaactgttcctgtaaccttgataagacctgctattgcgcgcataagcattgtcttaccgcttccattctttcccctgaaaccatatatctttccagattccattctaaggctgacatcatcaagaatatcaatgcctttaattttcttagatacatttttcaattcaatatacatacttactcctcctacagaaaatctctttttcttgaatatataattccagcagccataatccccacatctatccccagcattaataacgctccaagataccatctgtcataaacatgcgggattctgtacatcatcatataattatagaaaccaaaccacttcatataacatatgctgaatatgaataacaacagattaataataaatccaaatatagagttaaacacatatgaaaccagcagaattataatacatgcagtaattaagctaagcgtacacagaaccataagtaaaacaacattggtctggcagcttatatcttcactcccaagtatgagttttatgttctctctggcggtaaaatgcatcctcagactgaacttatttcctagaactgcaaagccactgactgcaaatgttacaattatcacaaccatatatacaagtgcagctaatactgcgataatatatttactgacccaccagtacactggtgaacgcgaggcaatcattatgctcctgcttaacgcactcctgtccgaattaatataatacgcaacaataaaaagcaaaaataaaaggacaaatatctcaagcaccggaatatccatcgccagatttctttcgggatagaactctttagctcctttaaagaaatccataaggctgtcgcctaacgacaccgctgctatcctccccttattgattgatttgttcatattagcaaagaatattaaagcctgcattaaagaatacactgcaaatgctatgtataatttccatgcaatattccagaaccttttcaggtctgccttaaatacattaataaaacatctcattagttcttaagcatgtcctttctataaaacctgaatgtcagataacttactgctgcacacaccgcccagataataacaggcagtactatattgttaaatacagatattccatatatgtacatgtccgtctgatacatcacaaatctgtcaaacagccctgttttacctatacttaaaaataatacattaaaatatattatgataaaactccacacagccgatcttgtaatccagtaaagcagacataaaagcacataaacaatctgaagtcttaagatatccagtaataacatgaggactattaccgcaaatgtattctcatatgccagttcatgataaggtatccatgttttagctaaacttcctgtaatattccagttgcatccaaaaactgccccttctcttaaccctgtcagcattataatcagacaattaaccactggaataagcaaagttattaatatgcctcttttaatgcagtctctccacatttttcccattaactggtaaagaacaattctattcgaagtcatatttcttttaataattacaatagatacaaaagatacatatatcatctcgaataatcccatgaaagaaatcgtcttccaatcaaatacggcaagataataatctgacatgcatgcgttcacattccagaacactttatacattttagaaagcgtactaatgaatataataaccggtatcaaatatatcagtgcaaaacacagctttttccacgttctgtttcccataaattcacctcttatcaaatacaagctttcttctatatggatagaacgaatatacaagcgtcattgttgatgattcaatcttatcaaaattttcgtatttaagcattgatgttgaaagcatgctttttaataccagctgtctttcttcacccggcaaaacattaatactctgctgtgatggattgtcattattaattattggaaatgcaccattacttgcacacagttcttcaattaccatgacaaaagatggactataactaataatgtcatcagttgtatttcttactgataatgtaaatacaacaacccgcttcttatctttattctctcttttaagatacctgtcatactccgaagatatctccgaaaattcatctaatgtatataccgagtaatctattggcttaacttccagaccattaatatcaaccggattatctttggtataacttataacctctgcattaggatacagcacatttattcttataatcatcaccgcacatattactattgcaatagagcttatacataaaactattaatttacaatgcttcattatctgctcctttcacaaaaaatatgataccgcttataacagttataattattggttctaatatatatgcagcaagctgcttatcagataacatattagaagccagtaatctcatcggattaaagctgtccattccaaacatattccttaacatattggaaacaacacccaaaccataaaatgtaacgaatggcataagcatcaccagaaaagaattattaaatatatatgacgaagcaagggcaattacacaaaatgctcctccatatataaagaattgcacaatatatataaacgtatatatgaacgtatgtttcacaaataatacattcataaaagaagaaccgtttcccataaaaagaccattttcaattggctttaacgcaggaacaaacatcattgttgctatcaggttaacaagtaatggaattacgacaatcaatcctccaactacgaaagttgttatgaactttgcaatatgtaatctgttctttgatattctgctgtaatactgcaatatatactgactgttattatcttttacaaatgttgagcaatatggcaatgctgcaagtaatatacatacatataaataaacagtcgcccatatatcataccctattccgattcccatccatgaagtgaatactgaatgaggataacttgccacgcttccatcatatcccccaagtacatctatatgaggtacaacagtctggataaatgcacctgctgccaatgccagacctataacaatacttgcggcaaacaatttattcttaaatgctcttctaaattctatctttaataaaatatttaattcatgcataattatcccctatcttctatgtccagttctataagatatccagtataaccggtaggctggaatatatatccaaatgaaccttcaagataatacgtccagctattcacaacaggagcttcaaatccaatccacatatcatactcatcttctggattaatgtccatacagtatgctatagaattatctttgctgctcgtaaaacgttcctctctgtctacaaataactgcactccaaaaggatataattttccatcatctttcttaacaacaaaacctgaacacatattaacattttttgaagtatttccattatatttcatatgtatcttaatccacactgtgcgattgtcatcttcctttaaattaccatcgacatcatacgcaatctgtttcttaaaatatttcataacttcatctatatatttatcatcaataatttctttcgcataattataatttcgtgtagccaccgcttcttttaccgtaaactcacaatcataatattcaaatgtttcattcatctttatgaacttcatcatgcttgttttattgctcaatggtccctgttgatactcttctacctgctcattctcatcataggttggcttttcattgtatatcttagttactgcctcccctgctgaatcagtttcatactcatatctgtatgcatatgattttgtctcttctattgctttagcatcctctatggactgcgttgtacatccgcacaacgcagccataaggaaaaagcatggtaatgttttatatatcttcatactaattctccctgtacatgttctctataattatagtatcgctcatgcttccccatttcaacaccaatgtcgtgaacgacagcaactttgtcgtgaacgaccatggtgactataagtatagttacaaaaagccggaacagaaagattaatccaactgttccggctctatcaccatcttatttcacaacagaacatattaccttcttcatgataatcacatgttccattattcttctttacaagcttcttaataatctgagttccaagaccatgtgatttcttgtcctgcttacttgtatgaagctctttattatcatttaatactgactttgatatataattctctacagttataatcatatcattaccattccacacggaacggatttctatttccctgttacatatatcttctttaagttcagcctctattgcattgtccagcacatttcccataatcgtgtacaggtcattgccatgcataggctttaatgtcttatgaagacctgtcgttattatgatatcttcactcttggcatattcaattttattattaataacagtattgaatatcggattatctgtatgaatatattccttggttttctcaagacttatactgtactgcttaagaaaatccttagcttcctcatatctttcctgtgaaagcagaccatatataacctgaagctgattattcatatcatgccttacggttcttacctgcttatccattgcctgaacatttttaagataatcctcacctgactctattatatttcttaaatgttcagcctcttgtcccttgtaattctcctgatagagccttacaagcgttctgtagaatataattgcaagcaccagacttaacactataatgttcataatcagcatgacatcatggccgccatcagaaattcctaatctgattaacagatatatattaaaacataataccaaaacatatgctgctatattaattatatccttcctagtaaaactgccatgtctgattgttttaaatgtatttacaagtgcaatcaatatcatatatataactataacagtgaactcatatattcccgttttatatacaataagattaacatttacaatatatatcacgccataagtaatagctgctatagcaatgacaaccagtgccgatactgcatacgctgctttagcaatatagccgttcagtaccagatatatctctcttacaagtattactcctatacatatcattattgccattctgatattaacaatatttaacaatatatcattcatatgtctgtctgttgtgcctgtactgcatatactccttcataaatgtatctttatagcttcttccaagcttgagagtttcaccatcaatcataagaatctcattagtactctgattaattcttgatatatacttgtaattaatcatatattttttatgagcccttattatatccgtacctgttatatcctgtccaaattccatcatattcttcctgattacataggaattcccatcagccatatgtactgtaagataatggtcctcactgtgaacatatgttatatcacctgaattaatattgataattccatctttatcatcaataacaatcgtcttttcataaccatcaatggcgattagcttcttaacgactctctgtacataagtctcatatcttgactttctgataaaatagaacggagtataatcaaatgtatcatatacaacatcttcatgcgaagtaacgaatataatcttagtcctgtatcctgattttccaatagcctcagccacagcaaatccatccatcggttccatgttgatgtccaagagtactgctttatacattttattctttagagcttccagtaactgcacgcctgtgtcatagtaatctatgattacatcattcctgcctgctttcatgaactcattcttcaatgaagctgtcagcttgtctgccatagccttatcatcatcacatatcgcgattgtatatcccatatataaagcaccttctctatagttatttgctcatgtttcttacttcttcgaacttatccataacttccttagatggctttccggttgcaagacttacaacaataataactaatgttgcgaagataaatgctggcaacaattcatatacagcaaatattcctccaagcttggcaataccgaatttccatatgaatatcattgctccacctgcaatcattcctgatacaattccgtacttattagctctcttccagaaaagtgaacagagaaccacaggaccgaatgccgcaccaaaaccagcccatgcaaatgaaacaatcttaaatactgaacttgttggatcaagtgcaaagaatattgatataactgatataacaacaactgtaagtctggcaacaagcattgatgtcttcttagacatattaatatgtaacacctcaactgcaaggttctgtgatattgctgatgaagctgcaagaagctgtgaatctgctgttgacatggttgctgcaagaatacctgcaaggataattcctgctatgaatgctgctacagggttaaatgttgaaagataatgtgatatcttaacaataattgtctctgattctgaacctgtaagtgtatcaataataccattctttgaaagtgtaagtcctattacaccgattccagttgcaacaataagtgatatgaatacccatacagtagcaattcttcttgaaatctttaacttgttctcatcttcaatagccatgaatcttaaaaggatatgtggcataccgaagtatccgagtccccatgcaagtgttgaaacaatcttaaagaatccataatcacctgatgtattagtctctgcaatatgtgtgtggaacatatcaagatatcctggaagtgccttggcattatcaagtacagctcccattcctccagcctgcacaattccgaatattacaacgacagcaagtgcgaatgtcataataatactctgtacaagatctgatgtacttgctgcaaggaatcctcccattgtacagtaaagtacaataacaacagcacttacaatcattgctgcatgataatcaaaacctaaaagactgttaaacagctttccgcaggcagcaaagcctgatgctgtgtatggtataaagaatattacaataagtgctgctgatattaatgtaattacatgcttgtcatccccgaatctcttagaaaaataatcaggaagtgttattgcctgataaccatgtgaatataatcttatcttcttggcaacaataagccagttaaggtatgtaccaagtgcaagaccaattgctgtccatgttgcgtcagcaagacctgtaaggtatgccagtcccggaacacccataagcaggtaactgctcatgtctgacgcttctgcactcattgcagtaacaacaggtcctaactttcttccaccaagatagaagtctcctacatcactgttcttcttagaacagattacacctatccatactaccattcccaggtaaagtataattgctgctaaaataataatgtttgacataaaataatcccttttcctttcataaatacacgaatgtacctattatagcatacattcggctttataaaaagcgaaaagggattaattgttattataaatgtgttgttaaattactctgacacggtcttgtcatacggcttctgtgcctctgatgactgggcagtagtctcctgctgactgacagttgtcggctgtgtctctcgagaatcatttttctgtgtctgtgcctcagtctcctgaggtctgtcatcattcgtgacagcttctgtttcaacctgtgtctgattgtattgtgaaacattattattctgtatattactgctgccattcacattatctgtcgggtctctatatgcatcatcagctatccggcttatgccttcaattttaatatctgaactgatatcaaaatcttcaactatctctacggttgtcttcgcaccgcaattctcatatatccacttggcattggcacatgtcataagtattgaaccttccgacacattctgacctatggcattgtatgactttggattaagattattatcactctggctgtaatatgttgcggtacttagatactcagcattatcaagtcttgaagagtatctgacataatatatatctgtaatcttacgccataaagatttctctgatatagccgtcttggcaggagcaactttaggtcctagagccactttaaaagccttaacaggaatagagaattctttattgtcatcaagctgataaacaaccagcgtatgcttcgctatgcttattctgatataatacgactggttctttgcaattgtctgtgtctgtgtatccgtctctgatgaatcagtttcaccagtggtctcttcctgtgatacattatcagcattcttattgctgttatgcatactgataacagttcttaacacaaacagcagtcctagaaccattacaacaagtataacaaggtatacgattgaattagttcccttaaaccatctcttaatatcaaacttcttcgttctcttatagccattaaaatccataacttaccaaccgtgtatatattaaaagtgaattaaatatctttgccaatgttcttctcttttaattcaataaacttaagtatcatatcaattgcaccatctattcctacaagtccactgtctatacagagattgtagctcttagcttctccccacttcttgcttgagtagtaattgtaatagcttgctcttctcttatccgtcttctggataagatctgcagccttagaatcattaagttcatagattctcttaattctctgtactctctcatcaagacttgccttgataaatacacttactgcatatggattatcttccaatgcataatcagcacatcttcctacaataacacatgattctctctctgcaagtttcttgatagcatcaaactgtgcaaggaaaaccttgtgattaataggcatatccacatatgaattagtatatcccagtgaatatgtatccattacaagagaataaaggaaactgttagtaggcttctcgtcctgagatgcgaaaagttcttcacaaagtccactctccttagctgcaagttcaagcaattccttgtcgtagcactttatccccagcttctctgccaatttcatgcctatctcatgtccaccgcttccaaattctcgtccgatagtaataactgttctctcatccatagttcctacctcctggtttcaattgtatacgaaatactttagatatattatacattatttctgtggtaaaatctacatattaagcataattaaattaatctttaataattattatttattcttcataatggtctatatgcaagagtatctctgtaagaaattctgctatcttagttccagccttattagatatcacactgtatctactcggggtaacacaagccagtctgatattagaaaaacctcttgcaccaaacatataattcttactataattcttagatttaagtgccttctcaacatcaggaagcacctggtttcttgtgattattataaatgatatatgtgtatacatatgattcttagccggcagctttccgtcacctcttacaaaatgcggttcaatcttattgacagcaaaatcatataaatcatcaagctctttcatgccaagcgtatcacaattaatgaaaaacagatgctcatagcattttgagtcccataacttggcatcatctgttgtagaaaatctgtctttcttattatagctgtaagcatatataacaaactttctaccttcaaaccagtaattatggtatatatcaaatgtatctgaaataccgttcaatatcatatctataaattccctgcgtctcaattgctacctccatttcttaaatccttaagcagcttctcaaaatattcgggcaatggtgctttgaactccatatattcgcctgttgacggatgtataaatccaagaacacccgcatgtagtgtctgtccctgcagcttatatccactcctggcatgacaatacacatcatctccaagtatcggatgtcctatacttgccatatgtactcttatctgatgagttctgcctgtctctaactgacattctataaaactgtatttgtcaaaattctcaagtacacggtaatgtgtgacagcacgtttcccattctttctgtcaatcgccatcatcttgcggtcctttggattacggcctataggtgcattcaccgtgccttcttcctctttaaagcggttatgtacaatgcaataatactttcttgttattgaatggacagcaagttgtgcagcaatatcattatgtgccttgtcattcttacatgcaacaataacacccgtggtattcatatctattctgtgtactattccaggacgcataacgccgttaattcctgacagattatccctgcagtgatacataagtgcattgacaactgttcctgtataatgtcctgcagccggatgtacaaccattcccttcggtttatctatcagtattacatcatcatcttcatatattatattcagaggtatgttttccggaagtatctgtggcacaataagttcaggaattgttattgtgatatgttctgttccattaagcttatagttggacttgacacatttgtcatcaaccgtaatatctccatcatctaacagcttctgtatacgtgaccttgacacatcttctaactcctgcgacagatatttatctattcttgtccccttatcctctggttcagcaattaaattctgcactgaatcactcattattatcacccttcttcgataactttaagaattcgaaatcatcttctttatagacaaaaagaataagaattataagcagcgcaactgaaacagtaacatagcagtcggccacattgaataccggaaaattaataagcttgaaatatataaaatcccttacgtatccgaatcttaccctgtcaataaagtttcctactgcaccagatacaagtaatgtacatgttataagaagtggcatatactttcttgttgcaggaagattaataattacataagttactataagcataactataactgtaaacacaagaaacagattaatcttaccgcttaacatgccccatgctgcacctgaatttctaagataagagaatacgaaagcatctcctattatcttaaaatccggtttttctaaaagcttcgcttctgcaagtgctttggtaatctggtctaattcagtcagaacaacaattcctataatataaaataacaaattgaatattttctttttattattcactttcggcctccgttattaaacatttatcttattacaccttcaagtgctcttctcatctggtcatcagttatatctctgtcaatataagcatctccgactgacttaagaagaatgaacttaaccttgccggcatccatcttcttgtcattcttggataccgcaacaacatcatcaatcttaattcctgtgacatggtcagggaattcatataatgcaaatgtattaagcgcatcatctctttcctctgcagttatagttccaagctcgacacatatattgagtgcagctatcattccaagcacaacacattccccatgataaagcgagaaattcatctctttctctatagcatgtcctaatgtatgtccgaaattaagcagtgctctttctcccttttccttaggatcattctcaacaacctctctcttgatgttacaactcacatatatcatatgctcaagtgcatctgtatctagtgccttaattctgtctgcattgtccttaagccagttgtaatattccttgtctttaataagaccatgcttaataatctcaccaaatccagaattaaaaagtctcttactgagtgacttaagcactgacatattcatatatacaagctttggctgatggaatgctccaaccatattcttatatgccctgaaatcaacgcctgtcttgccgccaatacttgagtcaacctgcgcaagaagtgatgtaggaacctgtatgaatttaatccctctaagatatgttgccgcagaaaatcctgtaaggtcgccaacaactcctccgccaagtgctacaaggcagtcatttctgtcaaaatgattctctataagatattcatatacatcctgtactgtgtcaagagtcttattctcttctcctgctgcaaatgtatacacatatactgcattgcctgttttttcaagctcattctttacctgttctgcatataaaggacctacattgctgtctgtcacaatacataactttctccctgttatttcaagcttattaaaggcttctgaaagtcccccgaatccactttcaatcacaatatcgtatgctggtttaccttcgcactttacattaatacacttcataacattctcccttatccttatacttaaacagccacccattatatgtgggtggctgtgaagatcaattaaaatctgttttcattcttgttaaatgatgaaagatcaattcctcctgttactatctcaggaatatcacccgaaatatctacattaggtggagtcaccaggaaaatataattagttatcttctgaaggttaccccttattgcatatgtagaaccagcagaataatctattattctctgtgctatctcaacatggattccttcaaggttaagcacaactgccttacctgtaagaagtgtatcagttatctccttagcatcttccatagattctggtcttattacaacaacttcaagtcctcttggagactgtgtcttcataggaacaaccttagacttggaagcaaatcttggcttctctgctgtatatgaaacatcttcgtctgctactgtatctttcttggtattccttccaaaaagattctttctttctgatggtttctcatcatcgtagtcatcaccgaaatcatcatcgtaatcttcgtaatcgtcatcaaaatcatcatcgtcatgcatcttaaacatattagttaaaccgtctaacattcccattataaacactctcctatatctaataatctgactttctttagtatccccaaaacatattaatgtgaatagtccctggctccaaatatcgctgttccaacccttacatgagttgccccttcttctacagcaacagtataatcgttagtcatccccatggacaaaacattcatgtatacattatctatgtttttgttattgatgtcaaccagtaattgctttaattctctaaaatacttcctgttatcttcaggattttcaacaaatggtgcacttgtcatgaatcctcttatcttaattcccggaagcactcctattttcttcacaaattcttccgcttcttcacatgttacaccgaacttgttctcttctcctgcaacattaacttcaataagaatatcctgtataaggcctttctttactgcttcatcacttattgcaacggcaagtctttctgaatcaactgaatgaatcaatgcagctcgtcctacaacatattttaccttgtttctctgcagatgtcctatcatatgccatgttatatccttaggaagtgtatctgccttgtccaccatctcctgaacataattctctccaaactgtcttattccacagtcatatacttccataagcatatccttgggcttggtcttgcttactgcaacaagacacacatcttctggatttcttcctgatttctcacatgctttcttaatatgctcttctacttcaataagattatcctttaacataatgcctcctgaatgtcattaatctgatataccaaagctttaatatatcatctcattctctgaatacttgtctgcatctagaattattctgtcatatattgacacaccatgactaagcgactgttttaatatgtagtattcattattgccatctattacttctacaagcttaaatactgtatatcctgtattaacacaatacacacctctaagcttttcaaccggtcctacaacgaacctgtcacttgaatccatcctgattattccagtgccggctgccagttctgtcttcttaatatacacagcctcatcatttgacttatatatatcaacagccttaaatacctgattcagcttaccatctgaatcgctctgttctacaaggaatccataatcacccttttcaccattagttatgaggtattctttaggtatcttatagaattcgttctcggttaccgccgataccggaaccttgattcctgactttcctgacacaattatctcaatatcaaggaatctctctgtagcatatcttatcatatattttgataatgttatctcaccatatgagttcttaccatcattaactatcttgaatggaaatgtgcctgtaatattatccttggtaaacttaattgataatgtatccttagatgaaagagaatacttgtctatatctgactgtgtaactggaaacataagtgtccagttctcacttgtaataagcttatatgcaggatctgaggctgtaataagcttttctgacttaagactctgcttatcatatgattttttcttaaagtcaacactgccaattgtttcctcggtaattccttcataaccatcaaccgaataaacaactatacccggtttatctgactttgcagtcttaaaaaggtcctgacttcctgtgcttgctacaattgaatcaagattggccataatattctcattaatagactgtagtacagttgcattaagatctgacttgagatcataaactgcactgaatccactgtctgcatactcagtcttgtaattagtaagtgtattcttaatgactgtaagattctcatctgaaagtgcattaccatctcctgatgtatactgtgcaagtatatctgaaactcttcctgtctcatcaaccgtatacactgtatcaccggtcataactcttgttccctctcgctgataatagttaatatcaccagaatatgaggaattatagacttcttcctgtcttaaggcaactgctgtaaatgaagcattattcattaatgatcccacttcaacttcatatgtctgtacctttgcttttgaaacatatataactataaagcacacaatatataccagcactattccaaatataattgctgctgctttcggctttcttctgtatctgactactttctttcccgccatgataaacctcattatttccgcactttatctgtgctgattcacaaacactgtaattgtagcattttagacagtatgatacaaggtttaaagtcgtcaagtttacactttttctcaacaaaatccatattttaccagtatgatttatcttacattttccatactaatttcaaaaccaaatccgcaatttttaaggaggcattttatgaattctaaacctatagactacattgctcttacaattgccattgtaggaacgcttaactggggacttatcggtttcctcaactttaatcttgtgcattttatattcagatcagttatggttgaccgtataatctacgcacttgtaggtctttctggcttatatcttttaagtacttacggaagaatcaaggcacttggcgaagatatgtagcaaaacaggctgccagttaaccggcagcctgtttttattattattgtcttgctttcattattctgtcaagaagtgcgtcagcaacctcttccttactcatcataggaagctcctcgactgcgtctttagtaataacagtaaccacattggtatctgttccaaatccggctcctgccactttgacattattagccactatcatatcaagattcttctttgtaagcttcaccttggaattgtcaagcatatgctctgtttccattgagaatccgcacagaaacaatccatctcttttattgcttccaagtgtgcctattatgtctttagtccgctcaagaggaattgacatatcaccatcttttttcttaatcttttcttcacttacatcagaaggtctgtaatctgcaactgctgctgccttgattattatatctgcgtctttagcactcttaattactgcattatacatatcctctgctgaaacaatatccaccatcttaacaaatggcaccggctcaaggcttacttttcctgatataagtgttacatccgctccacgaagcattgccatcttagcaattgcatatcccatttttccagtggaattattagataagaatcttacagggtctaacttttctcttgtaggtcctgcagtaactgtaagcttaattccggccatatctttatctttagctattgtccttaagatgtaattaagaagaacctgctccgatggcatctttcccgcacctgtatctccacatgcaagataaccgctgtcaggctggataatttcatatccataatgctctaatttcttaagattatcctgtactataggattagtaaacatattagtgttcatcgcaggtgatataagctttggacatttgcatgccataattgttgtagtcagcatatcgtctgctatcccatttgcaatctttcctattacatctgccgaagcaggtgctacaaggaatatatcagccagctttgcaatgctgacatgctcaacattaaactggaagtttctgtcaaatgtatcaactaagcacttgtttcctgtaagtgtctcaaatgttatcggattaataaaattgcatgcattctcagtcattataacatgcacattggcatgcttctttacaagcatacttgcaagattagcaatcttatatgctgctatactgcctgttactccaagaacaactgtctttcccttaagcatattatctcctcccgcctattcagccactttctagacatttttatcataaatgtatttcaaacctcttataagaagtgcagggtctgtctcaattctgtttctgcagaatggaattataaccttactaagcccccctgttgccacaagctttgcagcaggctttccgttctttccaaacccgcagcaatctattattctgtctataattccgtctatacttcctgcatgtccgtatataagaccgctcttcatacagtcaaccgtattctttccaaccggtccttttggtgcatcaaagctgattcttggaagctgcgcagttcttgatgaaagtgaattcattgaaacacctgctcccggaagaattgcaccacctatataattaccattctcatcaactgcgcttatagtagttgcagtgcctatatcaactataataacaggtgcgccataatcatgtgtcgctgcaactgcatcaactattaagtcacttcccacctgcttcggctggtccataagaatgttaagccccgtctttactccaggtcctacaaccagaggctctatatctacaaccttttcaacagcagctttaattacattaacaagctgtggaacaactgacgatataattgcaccattaatatcctctgattttatattatagatttcaagaacatttttaaagctgatggcatactccagctctgtctttgaaaggtctgtactcagcctttcctcaaatattactttatcatcatcaacacaaccaataactatattagtattgcccatatctatagctaatattgttcctttagtattctttcttgacattaattatacctcgctaatatagtaaccccgtcacagataagcttatcagccatacattcatatatatcattaacaggattatccttaaactcatcagcggctattgccactcttatatagttctttgtatatcctgtataatatgacctgccatctatttctgtcaattcttctataagaacttcgagcctttttccgatatacatctttctgtattcaagtgactgcgccttctctaacgcaagcagtactgcacttctttctgatttcacagtgtctgctacctgctccttcatcttatcagcaacagttccctttcttcttgaatatttgaatatatgcatttcgtaaaaatgtactttctcaaggaacttgcgtgtctcaaggaaatcttcctctgtctcgcccggaaatcccacgattacatcagtagttattgccggattatcaaacacttctcttaactttacgcatccctcataatactcttctgtattatattttctgttcattgcctttaatgtcttgtcgcatccactctgtaatgataagtgaaaatgtggacatatcttttctaagccggcaatcctttttgcaaattcttctgtaattattcttggttcaagtgaacctaaacgtattcttttaattccttcaatctcatggattgcctctataagttctataagacttatattctcaaggtctgttccataagatgatatatgaattcctgtaagaacaacctccttaacacctgtagctgcaagcgtcttaacctcatttactatatcttcaggcttacggcttcttaccctgcctcttacatatggtattatgcagtaagaacagaactggttgcatccgtcctgaatcttgatatacgctcttgtgtgttcccctgtctggttaatcttaagcgattcatactcctgatacttgtcattaatatcaacaagatagctggttttatccgaaccgccaaaataatcatttaatgcttcaacaatacttatcttcatattattgccaagaacgatatcaacacattcatcctttttaactccgtcagggtctgcctgcacataacagccagcagcaacaacaactgcctccggattcatcttctttgccttatgcagcatctgtcttgattttctgtcagcaatattagttactgaacatgtattaattatatatatatcagcctgaacatcttcactgaaaggcactatctcatacccctcatccctaagcattatctccattgattctgcctcataggaattaaccttacagcccagactgtgtatagcaacttttttcaatttaatcctcatttcctgttaatttttgttacatttctttattgacataggtttaacaaatagatattatagtttatagaaaaacatttaaggaggtattctaatgaaaactgtaaagatttcattaaattcaatcgacaaagtaaaatcttttgtcaacgatatcactaaattcgatgttgactttgatcttgtttctggcagatatgtaattgatgccaagtctataatgggtatattcagtcttgatctttctaagccaattgacctgaacattcatgcagacaatgatattgatacaatccttgccgtattaaagccatacatcgttgagtaatgatgtgtaagcacatataaaccgctttatctgtaacagataaagcggttttattttattcaattacgattttttctgttgtctcaattgctgtcttgtaaagctcctcaataactccgtcaaggttagtctcatgctgcttgataacattaagattaggcttggttacagggtgctttgcaacgaatattgtacagcagtcttcaaatggctgtattgatgtctcatatgagccaatcttttctgatatatcaatgatctcctgcttgtcaaaaccgataaccggtctgaatacaggcattgtacacacttcgttagtacagtaaagacttgccattgtctggcttgcaacctgtccgatactctctcctgtaacaagtccctgacatccgcttgattttcctaaatcttcagcaatcttcatcatatatcttctcataatgattgtaagctcatcatgtggacatttctcatatatagccatctgtatatctgtgaaattaacaacattaagtgtaatagggcctgaatacttagatacaatctttgcaaggtcaattaccttctgctttgctctttcacttgtatatggaggagcatggaagtatgttgcttcaatctgtacacctcttttggcaaccatatatcctgcaacagggctgtcaataccgcctgataataaaagcatagcctttcctgctgttccgattggcattccgccaggacccggaacctcgatagagtaaatattgattacatctcctctgatttctacctgtaaaagaacctcaggcttatgcacgtcaaccttcatctctgggaatgcatccagaattcttccaccaagctccatgttaatctccattgagttcattggataattctttcttgttcttcttgcattaaccttgaatgtaagattcttattcttatatgccttatcaagataattgataacctgattagcaaggtcatcaaatccgttatcttcaatctgaactacaggacagattccaactataccaaatactcttgtaagactatcaatcacctcatcataatcatagtccgaaagtgcattaacatagattcttccatctgctcttcttacatcaaattctccctcaacatccttaagtgagaacttaatctgtcttacaagggcgtcctcaaagatgaatctgttctttcctttaacgcctatttctccatactttatcaaaaatgctttatacatcgttttccgcctttcctttgcatatcaagatttgtgcaaagcacaaatcttgtgtgtgaaaatctattttcacacaattatcgtcttgtgtacttcctaagcattggaagcagctgtttaagtgtttctattgtgtattcaagttcttcctttgttgtctcatagcagaagctgaaccgaagtgtagaatcaagcagctccttatcaagtccgattgcaacaagtgtattgctcagtcccggcttgttagatgagcatgctgaacctgatgatacatagattcctttatcttcaagtgaatgaagaagcacttctgcccttactcccttaaagcttgcacttacaatctgtggtgccgaatccgtacccttcttgctgtttacctgcacatcaggaagcttttcaagctcatctatgaagtaatcctttaactcatacaaatgtgctatcttgctttcaaagtcattattatatataagctttacggcagttgcaagtcctgctatagccggaacattttcagttcctgaacgcatgcccttctgctgtcctccaccatatataataggcttgattcttgtcttatcattaatgaataagaatccgctccccttaggtccgtgaatcttatgtccactgactgataacagatcaattccaagcttcttaggatatatcttatatttaccataagcctgaatcgcatcaacatgatatacaatatcaggattataatctttaattatatgtccgatttcttcaatcggttcaactgcaccaatttcattattaacatacattactgaaacaagtattgtctcatcatcaagtgcatcctttagagcctctatatcaactattccatctttatcaactggaagatatgttattctgaagccttctttttcaaggaaattgaatggctctttaactgatgaatgttctacagatgatactatgcagtgcattccttttcttttattagccattgctgttccgattattgccatgttattagattctgttccaccagaagtaaagagtatctccttatcctgacacttaagagtctttgctattacctctttagcttcacggatatatttctctgcatcaacgcccttcatatgctttgatgatggattaccataatcttctgacataacctttactgctgtttctactacctctgctgcacatttcgttgtagcagaattatcaagatatgcttccatatttcctcttttccgcttattcttccatattatacataagcactgacaacagcatcattcccgctgtctcagttcttaatattctcttacctagtgtgattatctcacagcctgcatttacagcttcgtcaagctctgacctgtcgaatccgccctcagggcctatgaatataccaacagattctccatgtccgatttcttcaatcacttttctggtcttttccatgccttctgcgcactcatatggcagtaaaagcttatctagctttcctgcatattcaagtgcctgcttaaatgtcataacttctgtcacttcaggctggatacttctcttgctttgcttggctgcacttaatgcaataccattccagcgttcaaccttagctttagctttcttcgcatctagttttacaacacttcttttcattgctacaggaacaacactgtatgctccgagttctacagccttctgtattataaattccattttgtcagccttaggcagtccctgaaacaggattattcttgaaggcagttctttcccctgctcgtccttgcttagtatatctgcccttatatattcatccgacatagaagcaatactgcattcataatcaacattatctccgctgcttataagaagcttgtcgccttctttgaatcttaatacattcttaatgtgattaacatcacttccaactatatctatatatgaatcatggatattctcatgctctgcaaaaaaatgatacatacactacttccttcttgctgtgatattaacccactcgccatcatggttaatctcaactatctctaactcaggattcttcttaaatgcctctgctacctcattttccttagtatctataataccggaagtaataaagtaagcgccgtgcttcatatgctcatgtatgcatgttgaaagcggctctaatacgtctgcaaggatattggcacacacaatgtcgtagcactcatagccgcaggcatctttaacagccttgtcatcaatgatattaccctcaataacctcaagctgcttcttatctatattgttctgctctgcattttcctctgatgcaataattgcattagggtcgaggtctgtaccaaatgcatgctttgcaccatattttaatgcaactactgaaagtataccgcttccacagccgacatctaacacctcatcaccatctttaacatacttctgaagctgctttataaccattcttgtagtctcatgtgaacctgttccgaaagctgttcccgggtcaatgctaagtacagcatgccccttcatctcctctgtctccggctcccatgtaggcttaatgaataagtctcctattgtaaatgtatgccagtactgcttccagttattaatccaatccttatcctctgtctctgattctgtgattgtaccctcaccaatatcaataaacattcttaaatcttccagttctgccttaaccttttcaagcattgagccatcatcttcttcactgtcaatgtagaaattaaccttagctctgccatcatcaggtggaaggtcaggtataaaatctacaaacattgacttagcctcttccttagtaagctgtacattatcctcaatttcgataccttcaattcctatatcattaagcgcgctgcttatcatatcaactgcatctgtagttgtctggattgaatatttattccacttcatattattgtcctttcgttaacacaaacattttacatctgtaaaaatgcttcatacccctttaatgtctcatataggtcagccttgcttattacctcgtatggtgcatgcatattctgtacagcaattccactgtcgattacattcatatcaagattagccaagatatatgcaattgttccgccaccgcctgcatctacctttccaagctctgccatctggaaatacacatctgcatcatccataacttttcttaactttccaatgaattcagcagaagcatcattagaaccactctttcctcttgaaccagtatacttgttaaacaccataccttttccaaagaatgctgaattcttcttttcaaatactgatgcataattagggtcatatgctgcacttacatctgatgataacatataagaattagcaagtgctcttcttaacttaagctctgaataatcaccgcatctgtccataacctctgcgaccatattttcaaagaatcttgaatgcatacctgttgcaccgacacttccaatctcctctttatctacaagtatgcaaacgccagttcttgtaacctgtggtgtattaagaagtgcaataagcgacggataagcacatactctgtcatcatgtccatatcccataatcatgcttctgtccagaccataatctcttgcaggtcctgccggaacagcctcaagctctgctgataagaaatcctcctcttcaatcccatatttttctttaagaattgcaagaatattcttcttaactgcttccttttcttccttattctcatctgtattatcactgtctgatgctgccggcatgcttcctataaggatatctaggtcctcaccctcaactaccgagtttcctttcttttccatctgtttggcagccagatgtataagaaggtctgatactccgacaaccgcatcgcaagcgtcttctccgattactacttcaacacattcaccattctttaatgcaacaacaccatgaagtgcaagaggaattgctacccactggtatttcttgattcctccataataatgtgtatcaagaagtaccaggtctgaatcttcatacattggattctgcttgatatcaagtcttggtgaatcaatatgtgccccaagtatattcataccagtgcttatcggttcacttccaatattaaaaagcactattgccttcttcatattaacggcatataccttatcgcctgctttaagtgtttcattggctgctattatcttctgtaaatctctgtatccggctttctctgccagttctacagccttttttacacattctctttctgtcttacactcagatataaaagacttatattcatctgcaaatgttaatacattgttcttatcttcgtctgaatatttcttccatgcattctttctttccataatgtcaacttcctttctatattcctaatgttatctgaccatcagaatcttcctgattatctgcatcaaagctttcgcttgcaagctctaactctgcctcttccttatattgttcaaccatatcttcactgattgttggaagctcgtctatcgactgtactccaaatgaccttaagaaatcctctgttgttccaaaaagcattggtcttcccggtgcatcaagtcttccaacttccttcacaagaccgagctcaacaagcttgctaactgctctgtctgaattaacacctctgatattctctatctctattttagttacaggctgcttatatgctattatcgacaatgtctctaatgccgcgtctgtcagtgtatatcttcttggctggctgcacactcttattagggcatcataatattcctgcttggtacacagctggaagctgttctcaagctcaatgattcttattcccctgttctctgattcatatttatccataagattgtgtactatcttaacagttgtatccacatcctgttctatggcatctgcaagcttacctgcttccacagaatcacccatagtaaaaagcacagcctcaattatgccttccatctgttctaaactcatcattctactcctctgttatatcttcaataagctcaggatccctgaccacccttatgaatatatcatcctccggacattcctgcttaacctcaacaaatccagtcttaataagctctaacacaactaaaaatgttactataacagcaacctttgacggattattccacaaaagctccctgaaactaaaatcttcatgctccatcataaatgctttaatatccacaagcttttcactcatggtaacttcttctttctcaatctttccaaacttgcttcgtacaggatctatcttatcttccttacgtttacaaacatcagcaaatattctgttaagacgcataagtgttgtatcgccaataacctctgtaagatcaaccggcggtgtatatgcagcaaccgcctctggaatactctgcttcttataataagttctctctgcatctgtatgcttgtcctttaattcctgtgccatagccttatacagcttgtactctaacagcttttcaacaagctctgctcttggatcttcctcattgccttcctcatccacttccttaggaagtaacattctcgacttaatatcaagaagagttgccgccattacaaggaactcacttaccacattaagatcttccttctttagctgctcaacatattccatatactgttctgtaatcattgcaatcggaatatcatatatattaactttattcttatctatcaaatgtaaaagaagatctaaaggtccttcaaacacctgaagcttaacacttattcccatatctgcctcgctatatttactgtgcataattacacgtatcacattttacataaaataactgctgtttgcaagtaattgctaaattctataaaataacatataatatcttgaaaacattcaattaaggattaaggtataagaatgctcaatttaatattattaatcaaaagaattgtcactaaaatatctgaagaccgcatcggcgactacgcatcctcagcatgttactatctcatgctgagctttttcccgttttttattggtcttttaagccttataaagttcctgccagtttccaaggcagaccttctaaaaatcatatacggcgttcttccaactcagctgcaacctattgtcaaggcaatgttcactgatatatatgacaattcaacaactgcattaaccctcattactgcaattgctatcatatgggctgccggtaaaggtttcatggctattgtccgtggattaaaacagatatacagaaaagataaccagaagaactggcttttccagagaataagagcaagtatctatgcccttatatttatgattcttattattgccagccttatacttatggtatttggtaacaatattatgaacttcactatgaaatatataccacagcttactaatgtagtcgtgatattcagaggaatatttaacagtaaacattttctctttccaagtatattcacactcttctttactatagcattctcacttgtatcaagaagaggaaaaaagttctataaagagattcctggagctttcttttctgctttgggatggtatctttttacagcactgtattctctttatgttggccactcaccgaacttttcatacatgtacggtagtcttgctactattatcatagcacttatatggatgtatgcctgtatgattataatattcataggtgcagagattaactacttcattaatgatgaaaaaatattcaaacattatcttgggaagaaatcaaagtaagcgtagtccctctgtagaagaattccagaatctgcgcgtaagtcatggattctgccattttattggcagcattctgactcatgccgattccatgtccgtagccacctcctgttatcttaaatcctgtaagcttctttccctccgtcaccttctcaaacacacagaatgtacttggcagattagcatatcttgtcgttcctgacttagtgttcatatccacatttgcattgccaaatgctgccctaatcgctgattcactgtctatcactgtctcgcctttatcacctgtaaccttaacttttactgccgctcctccattaacacgctcaagtacttcaatatcttttatgtttcctacattcttccctgtagaacgtgcaaatccttcacttatctctttaacagattcctccatgctccatctgtacaaggtgcagtcgtaatcataatcagcctcattttcaccttttataaatgtattaaactccgattctactgtcagtgtaagtcctctgtccactccacccacacactccgcaacaaaatacggatagttttctgttgtattgccccagagtgtaacgtctgttgtgcttccacatgaggttgaatagtaatatgtcttaacaacttctccgttatatgatagcacctgtcccgctgtctcacctactgcagtatctgttgattctgcccgcggtgagttattatatacctgaaactgtattgagtcatcaatatgcgctccataagcactataatagttattagaaagttccgtataagcatagcttcttgcacatacagcctgacatttcagtgcttcaagattaaaccctgacggcatctcgctaggaacaacttttttaagataatcttctatccccacttcatttacaacaacaattccctcatcatacagtgaaacttcaagagttccgccatatgaaggtgttcctatgcctctgtttactgactggaactgtatctcacctgatttaggaattagttttattctgccctcattaaagtcttctgtatccgtattaaacacaaccgtctccccgggtgccgtctcataagattcttcaccagtctcaactatcattcctgaatcagcacaaaaagctgcttcattaaaaaatatatctctgaatccgcttgtcttgataattactcttatattgtcagcctgcaaaggtttattcttaatagcaccacagacttctccatctgccacaataaaatcctgtaatgcataaccgacaattatactgctgtaattacttatcaatgagttttctttttcatacataataaagtcctcatccagcttaacagaaccataaccttcaatttcaacgctgtcttgtgaaactgacagcacctttccacttacaacatccgtcttggtattaactccaacaatctttccatcctcaacggtaatatcacataaacacccggttacatcttctgctatctttccactattgaatttctttatattaccatacatattggcagttatcgtgttgtcttctatattagttacatatacatttttataaatattgatttctgacgatgtgtcctgatatcttgatttaatcatatgtgacatatatatacatgctgatgacataaaaatcaccagtgcagaataggctaagaatattatttttgttctctgtttcatatactattctccatactaaattaagtgtccttgttcagacaagctcttgatagtatatgctgagaattgaagttttagaactaggtatgctcatcgcttttcgcgcaaaaagcttatatgccagaactaagttctggcattgtcgcgttgctcctcgaatataaaatcataaaaagcgacgcatgcaagcatggccgcttttataattttatattctcatcgcttttcgcgcaaaaaacaggctgtcgcttatgtgacagcctgttaataatatcccaaaacgccgctccccacgctttcgactcctagcgaagctaggtgggcaaccgcatccagaccgctgccttccactgactaaggaggcttgacattggaatggagatataggaatcccgtcgatgaaatgtaggatcaaaataatgtggttttgcgaacgtcccaggaaatattcaattgatacgtaatctgtaccgatgtattgattatacatcttctttactgattacacaatattatatgtcaaaaaaattcaaatatacctgcgaatgaattcaattcagacgcaggtatataatcataattcaaactctgtaatgattgaaaattaaagctgtggaccagcagcaactaaagccttaccagcttcgttacctgtgtacttaacaaagttcttattgaatcttgcagcaagatccttagccttagtctcccactcagaagcatcagcatatgtatctcttggatcaaggattgctggatctactcctggaagctctgtaggaacttcaaagttgaacataggaatcttctttgttggagctgtattaatagcacctgaaaggatagcatcaatgataccacgagtatccttaatagagattctcttacctgttccattccatcctgtgttaactaagtaagccttagctccactcttttccatcttcttaacaagctctgctgcatactttgtaggatgaagctcaaggaatgcctgtccgaagcaagctgagaatgtaggtgtaggctctgtgattcctctctctgtaccagcaagcttagcagtaaatcctgaaaggaagtagtactgtgtctgctctggtgtaagaatagatactggaggaagtactccgaaagcatctgctgaaaggaagattacattcttagctgctggagctgaagaaattggtcttactatattctcaatatgattgattgggtaagatacacgagtattctctgttacgctcttatctgcgaaatcaatctttccattctcatcaagtgtaacgttctcaagaagagcgtttctcttaattgcattgtagatatctggctctgattccttatcaaggttgataaccttagcgtagcatccaccttcgaagttgaatactccattgtcatcccaaccatgctcatcatcaccgataaggagtctcttaggatctgttgaaagtgttgtcttacctgttcctgaaagaccaaagaagattgctgtattctctccgttcttatctgtgttagctgagcagtgcattgaagcaataccctttaatggaaggtagtagttcatcatagagaacatacccttcttcatctctccaccataccatgtattaatgattacctgctcatggcttgtaatgttgaatgcaacacatgtctctgagttaaggcctaattcagcatagttctcaaccttagccttagaagcattatatacaacgaaatctggctcgaagttctcaagttcttctgctgttggcttaatgaacatattagttacaaaatgtgcctgccaagcaacttcaacgatgaaacgaactgccattcttgtgtccttgttagctccacaaaatgcatcaactacgaaaagtttcttattagaaagctctgccttagcgatgtccttaaccttagcccatacatcttctgacattgggtggttatcgttcttatactcatctgatgtccaccatacagtgtccttagagttctcatcaacaacaatgtacttgtctttaggagaacgacctgtatagatacctgtcataacatcaacagctccaagttcgctttccttaccaacttcataaccttcgttagtagacttagtctcttcctcgaataataattcataagaaggattgtagacgatctctgtagcacctgtgatgccatacttgcttaaatcgatttttgccatcttacataaacctcttttcttataatttcttgtaaattattacaaaattctttttaattctataccatgccctaattaaaatcaataaaaaattgttaaatttttctcgaaatcgtgtatatattaattttattaatcagttattctttaggaaccgtcttttcgtacttgatatcttcaattgtttcacttgaaagcctgatagcctcaagtaccacattttctgcaactcccatgttctttgctacttcttccaccgtaggttttcttcctaattcttctttaagtcttattccccagtcatttacaagattgactttattgagaatttttcccgaaaccatattaacatccgtctgttcatctataagcatattaagactgccttcaataagctccttaactgcttcgtcaattcctttaagcacattaagaaggtcttcctgtccaccttctttaatcttatccttccactcataattattaagccattcctgctgtcctatatatgctgtcatagccagattggcctcctgtacaaggtcacatgcaagaactccctttcctctgaatggttctatccatgacgcaatcttttcaagataactttctgtaagcagttttagtgattctttatcattatcctcaactatgttcataagaagatatgatcttgtaacatctgtcataggctgtattcctgatatatcctgaagatatattttcagatacttctcatcctcttcataatcaagatgacttacaatatcatccgcaaccttcttatcttcctgttcttccttagaaatatgttgtcctgactcatcaatattatcatctgaggcactttccatcagcttcaggaattcattatctacgctgtcttcaccctgtatcttaattccattagccatcagatatcctgaaatcatctggaatttggcatcatctaatgccatatctttaaaaaagctgtgtacatcctctcttgtaacaatattgccattaaccttggcatattctttaatgcttccgacagcctccataaatgctgcctgggaatctttattttcagccatattatctaacctctttcaacttaattcgttctgtataatataacacataagtacgcatttggtaaatgtattatttcagtatacacatttgacaaaagcagacccacagcttatagtttatatagaatataagaaaagaggagatttcataatgagaatcgcattaattaatgaaaacagccaggctgcaaagaacgagatgatttatgcatcacttaagaaggttgcagaaagcaagggacatacagttgataattatggtatgtactcagctgatgataaagcacagcttacatacgtacagaacggtatccttgctgctattcttttaaacagcggtgctgctgactttgtggtaacaggttgcggtactggtgaaggtgctatgttagcacttaactctttccctggagttctctgtggacatgttgttgatccttcagacgcttatatgttcatgcagattaacgatggtaacgctattgctcttccatttgcaaagggcttcggatggggtgcagaacttaacctcacatacatctttgaaaagcttttcgagggtgaaccaggtggcggatatcctaaagaaagagttgttcctgaacagagaaacaagaagattcttgatggcgtaagagctgttactcttaagcaggatctcgtagaagttcttaaggagcttgatcaggatctcgttaagggtgctgttgcaggtgagaagtttgaagagcttttctttgctaactgcaaggatgagaagattgctgagtatgttaagactctcagataattaattctgcattgtactcaaaaggggctgtcgctttaacgattgaaaatcgttaaggtaccagcctctttttcctataaaaatacgatttttaagttactatttattaaaatgaatgcttctgaatcgtgcaagtgttgcatggtcaggtgcagaatgcccttctagaagaaacatgaaattgatatctcttttacagtttaattccatagaacgggatgaataatcaccattcatgtaagagtataaaacaatcttcaaaagtgttcttggcgataaagaatttattctatcataagtagaatatagatcagtcaaatccatctcctcgtatactatatccatcttaactaataattccaatactcttaatccactttggtttgtcgtaagatgcatgtttaacgacgtaagttacatattttattagtatagttgcggaaatatatcttcttaaagttgtaagactaatctatttcagtcaattcatttagttcaattaaataaccgttgtaactgtcattatcattgtaattctgaaaatttccttttacataataagtgttttctgttgaaaaaagagaaagattataaaagaaccacatttcatattcttcattaggttctagataaatattatcgcttttatttatattaaatgatttgtctataaacattaaatgaccagacgaaaatatttgattatcaggatgtttgctaaataatacagaataaatatccatattaacaggtttttgtccagaatatttcatatgaactttaacacaaacaaaacgagaagtatcacgaatatgttttcctgtttcttttgaaatatatcgtcttttagaaatttcagttgataatattgtatgatatttttcattaactaaggtataaaagtaatttgaatttgaagttacaattgcatctgtaattgaacattcacaattcccaaatgaatatttttcattcatttttatgtaggtaatagagtttttatttctgaaattaacagttgcttttacaacatctctggattcattctgattaacggatggcttctcttcgtgataagctgtacttaattcaccatcaggctcagtttcataatcataactatataagtaagtttttgtttctaacatatcatcagtattattggaagtctgtgttgtgcagccgcacaacacagttaataacactaaaaagataattgttttttttgctttcaattataaagcctcctagatatctggataccagtaaccgcctataggtgctgagttaaccccgacaattaatatcattgctgtaaatataacagcatttttaataaaatgtttgtgaaccatttcttattctcctgttaaattatttataagtacttatctctttaaaacagaataacagccccgtacttaaagtacaagactgttattctgcggtttgtcgtaagatgcatgtttaacgacgtaagttacatattttattagtatagctgtggtaacaagcagaaaaatgcattttaccatcgtatttcacagtgaaattcattctctgtttcgtaataatcacatgttccataattccttttagcaagtgattttacaatgttagttccgagaccatgggagttcttatcctctttggttgtagcaagaccagagttcctgtcgagaactgtttcattaatgtaattgcttacatggaataccatttcttcatcgtcccagtatgcctgaatatgaagctggcgcagagactcttcctcgtgaagctctgcttctattgcgttatctatcacatttccaataatagaacacaggtcattgccggtcataggtttgatgtctttagtaatatcaattgctgttattatattttcgcttttggcatatgcaattttgctgttaattaatgtattgatgaccggattattggtgttaatataatcaattgttttttcaagaccgataccgtactgttttaaaaaatctgatgcttcattaaattgtccgttattaataagcccgcttaacacctgaagctgattgttcatgtcatgttttattgagcgtatctgacggtcaagcatgcttacatttttgatgtaatcttctcccgatgttaattgctcctgaagtttatccgcatattttttattgctgtttgccatatatagtgacaaagccagttcgtatataagaaatatcagtatgcacaataaaagaagaatcagcagactgcccgatgtaagctgcattttcatagtcactgtaaatacggcacatacggtaatcaaagtcaatgcaagaattatgatatcacgaatattaaacatgccgtttcttattgacgcgaatgatttaaggacaataattaacagaacatatattataagtgagaatatgacatatggcattactggatatgaatatatcgaaagcattttctgtgcctgatatgtaagcagcggtactgcaatcgttacaataagctggattatatatggatatactctcttctttttgccgattatattaagcgaattattgtaaaatattattgcaacagccagtaaaagaatgtattgcgaataattaaatgaaatgtatggaaacatagtatgttatcttacattgtacggcggtattgtacaaagcctttcttaaatgtatctttataggagcgtccgacttttatcctgaagccgtctttcataataacttctgaactgacagcatcgaatcttcttacatgcatgtagttaatcaggcagcttttatgtactcttatgaaattatatccggcgagttcattttcaaggtccgaaagctttttcctaagttgataatttccagaggttgtatatatattgagcatatgatcctgactgaccgcgtacttgatacttacagagtcaatgcttgtgattgaaccgtttttttcaagatgaaccgaagtggtgagcaggtctgtatgtgtaagtttgtttacaagcttcttcacaccgttttcataatatttctttctgataaagtagaatggtgtatattcaaatgtatcaaatacaagttcttcatgtgaagttacgaaaactattcttgtatctgatgaaatggaacatatagattgtgctgtgtcaaatccgttaagcggagtcatgtctatatcaagcaaggcgagattataatgcttttcttttgcagcctcaattaatacatcccctgatgaatagtaatcaattgtggcttcaagattatgcgcatgaagttcattattaaatgcctccattatcttactggcaattttttcgtcatcgtcacataatgctactttgtactccatatataccccctgatgtatgtactaaatgtactaatagaatacatttttaaaatgtgtttttcaagtaaatatacatttataagttaatatatttttcactagataattcgttatattcgtgttacaatgataataatatatcgggatggagacgtgaactatgattatatcagagaatcattttggaaaagagaattgtgttgcatattgtgatgttttaatcagaagaaattatgaagttattaatgcggatgaacatttctatcattttgtagaaaaacttgttggtattaattttcttgatattgttcatcaggataatcttaaggattttaagatggcttttgagacgattaaaccaggtgagaattgtagaatgctgattctgttaagaaatggaattggtgaatattactggacagatatggtgatttctaataatgggaagattctgtcaggtgagaatgtaattgaagtcagatgttattttctttcagcagttgagagcaggtatcttttggctttggacaatgtcaataagtacaggacaatactttctacatacagaaattatttgtttgattataattcttacacggatatgtttacaatatatctgtatcgtggtaatcagtgcaatgcacctattaagggaactttggaacagttcagggaaagaatgttaagaatattgcggtctgattcagagcgtaaggagtttgctacattttataattatttaaagaatggttctaacatgttcagctgtatggtttacctgccgcttgacgagcataacgatgaactgtacaagttcaaagtgaatggcgacagcctgttttcaataaataaaacgtctgttgttgcaggttatcttgagactgttgatggatgtgtttcggatgttattccttattatgcaacaagtgaagctgttgattctgccactggacttcttaataaacgtgcatgcatggaatatactaaatcggtaattgcatccaaagatgataagattcattatatgattatgtttgatgttgataatttcaagagcattaatgatacatatggtcatctttttggtgatgaagtattaagtaagatagcaggcattattaatgctaaccttaacggacgaggaattgctggaagatttggtggagatgaattctatatattcactaataatattaaagacgaagaggctttgaggattcttctcacaactatgcgtaaggaattacaatatgcatttgacagcagaattgaagattttggagttactctttctgttggtgtaagtctgtttcctaaagatggaacggattacgaggaacttttcagaaaagctgataaatgcctgtaccttgcaaaagaaaaaggacgaaacagatttattatatataatgaaagcaaacatggttcacttgagaataatagcaggcatattcataaaattcttgatttgtctgatcattcagaatatatgtcaggcgtggtatctgacataattcttgaacttgtatccagaggaaaagatgcaattgatgatgttgccaataatattttagagcagtttgagattgatggactgagaatatataatgataattccgagcttatatattcttgtggtgaatataagagaatgccggatatgacgaatattcttaatgataaggcatttttatctagatataataagaataattctatgtcaatcggtattgtttcatctgtggaggcatggcataaggaattatataatgagttatcagacagtaatataatggcattcatcagtgcatggtttgaatttaaatatagaagatattatttcttctacgatgtgtttaatcataaaagccgctggaatgattctgataggaactttgttcttattataagtaaaatcattgccagcgtgctataatattagatataattatactgttattatgtttggcagctttgcaaagctgccaatttttttgtctgtaataatagttgcttcgttaatacttccaaatgttactgcacttgtttctccgaatttggaactgtctgtaagaatatatttgaaatgacaatgtgcaaatgctgtttctttaacaagtgcttcattaatatcaggagttgtgaagcctgatttttcagttattccattagttccaaagaatcctttattaaaattcattctgtctatagtaataattgcctgattaccaacgacagcttcagttattcctttaagttctccgccaataagtattactttaaagcctgcaattgcaagttttcttgcatgtgtaacagcattagttacataagttgcggttttctcttcaagataatcaataagatattctgtggtagttccagcatcgatatatatgaaatcattaggtactacaagtcttgcagcatacattgcaatttttttcttttcttctgtgtttacatcagctttttgtgaaacggataattcggtagtagatacaccattgatcttttcaacagctcctccaaatacctttgtaagccgaccctgttcatcaagtgtattaagatcacgtcttattgttgattcagaagtattaagaatgtcttttagttcagttacggtaatgcttcctttttcagatagcagattaagaattatttcgtgtctttgttctgtaagcatattgttataactccttttccataaaatcttttatatcagtaatgtttttataatgtgcaagcgaccacatgagtttcattgtaaggttttcaattgtcatggattttccatttatgacattttcctttgtaagattacgaccgacttcatatatctcccaattaacaccttcatagagacattgtgttgtaacaacaacacatataccattaactgtaagtctgtgaatgtgttctgtaatattatctggcattcctccgatgccaaaaccctcaataattacgcctctgcacgatgaattaagataatcaaaaatattataattcattccaggaaaaagtctgataactgctatatcagtacacatatcagttttgatatgaaagccattgtctgatgtcataatattttgaattgtattaatgttatatttaacgatattgtttctgattgctgcaatatatggaaaattaatactttcaaatgcatcaaaacttttcgtcttgattttcttagcacatgttccttttataagtttttcagaaaatgcaagaaatactccagaaatgtcttcacatgaataaataaatgcatttgttaaattcatgactgcatcagttttttccacatcaatgggtaactgtgaaccggtaagaatgacaggctttgaaagatttataagctgataagataaagcagctgcagtgtaagcacatgtatctgttccatgtgttataacaaatccatcatagtcattgtaattgttcataatgcattctgaaatggaactaatgtgagatgtatccatattactactatcgatattcattaatgatattccggtaacatggcacttttgcctgattaccggaatatagtcaagtaaaacattaacatcaattgatggcgtaagaccattgccattatcttttgaagcaattgtgccgccagtagctatcagtaaaatattcttcattttaccttcttaccttctccattaaaataatcttttaaaagttgtacaacggtgtttgaaagcaggaatactgctattagattaggaatcaccataagtccgttaaaagtttcagcaatgctccacatcagacctaaattcattgttgcaccaactacagcaacaagtgagtaagcagccatgaatggtttagttgctttaggacccaaaagaaattctatgcatctttgtccatagagtccccatcctataactgttgaaaaggcgaaacagcacattgcaacagctgtaaatattgatacccaccctccatatgtagatgtaaaacctgatattgtaagttctgcaccagcagcctgaccatatcctaccggaacaccactacataatataacaagagcagtcagtgtacatattacaattgtatctacaaatacttcaaatattccgaaaaagccctgctttacgggtttacttgtatcagcacatgcatgtgcaatagacccggtaccaagaccggcttcattagaaaagatgccccttgatactccttttttcatactcataaagaagcttccaactgcaccaccagtaactgatgcaggagaaaatgcaccttgaaatattgatttaaatacagcaggaacattattaatattaacaagtacaactccgatggcaagaattatatataacacggccataaatggtatgagtttttctgtaactctgccaattctttttattcctccaatcattataagtgcaataagaatcataattattatcccaattataagattaatcatatgagttgaatcggcagatataatattataattaattaatgctgagtctagagcggctgttattgtatttacctgtgttgcattacctgtcccaaatacggtgagaacaccgagtgctgagaataaataagcaagccagtgccagtgcttcttaagaccatttttaatatagtacatcggaccgccaacaagctcaccattattattagtttctctgaaatgtacagcaagaaccacctcggaaaatttagtacacattccaagtattgcggatatccacatccagaatacagcccctggacctccaattgcaattgctccagcaactccggctatattaccggtacctacagttgctgctaaagctgtacagacagcttgaaatggcgtaagggcgccgtcagaagctttacgcttcttaagcatgcgcccgatagttattttcattgcataaggaaatttccttatctggataaatctggtttttacacttaagacaattcctacgccgataatacatatcattgcaggaagtccccagataaagttattgattacgctgtttattgattcaattgttgaaagcattaattagtccatcctgttatatagttgtcattatatgttatttttttcttgacccaaagaatttagatagcagccctttttcttttgtatcagaagatttatcagatacctcatctatagtagtatctgtttcatcagtataattaaatgttaatcctgttaatttactgaattcataaaggacagaatcatatgctgatttggctgaatcataatcagctttattataatcacttcttgttgcttcataatttaatttatagaatactttagaaagctggttacatatgctgttgctttgggtatatgtataattggctttttcatattctgttttagcgttgtcatatgcaagctttaatgattcagaagtacgtcctttttcattagaattagcctgggctttaccaagtttttcttcagcttcatgtagtttaaagcgtatctgattgatgttttcttttgtctggttgattttcttgtggatattcatctcatctgcaagagcatcttccattgcttttttcttagcttcttcatcagcaatacatttgtcaagttcatccttaacctgaggcatatttgctgcagcattctgttgtgcagcaatgacttcatcgtattgtgctttagcgttctcatattcaagctttgcattattaagaacagaagctgaatcctcatctaatgcttcaagtttttttatatgatctttggcattgtcaatatcattaagaattttatctacactttttctggcattttcatattctatattaattgaagaggttgtagaagttactctgttatattcttctaataatgcatcagctttctgtttatactgttcatagatttcatatgcagcagcaacggctttggctgtttcgtcatattcagttttagagcgatttaccatagcacgctgtgtattaaaattcatttttattgattcagcattctttacagctttttcgtattctgtcttaagaccaggaactactgcttttcgtgtctctaaagtcgcagctgcattatcggtggttgtttttgctttgttataggcaatttctgcattattaatatcatcctgaatagatttcaggcttagctgataaagatctgttccatttaaaaaatccttttcagtaaagaatggtttcttaataatatgcgacatatctgatatgtcgcattcacatatatcaattctgttatcagaattttttttgcattcacatgaataattagttttatcagagatcccattttttgtgaaacttaccggtatataggcaagtccagataatcccttaagattaacaatccattctccaaatgatatgtctttgtaatcatgtactgtcagattataaagaatcaggtgcttgcaataatcctgaatatctggattattaattgtaaaatcagttattaatgaaatgctcttttcttcagctctaagattatcaagcacagcatcatagtcattattgtgagaatctctgccaatatctacctgcgagttatattttttttctttagcagcttcatcattgacagcattgtcatatgcagtatgtgcttcttctaataattttgcagcatcttcatattcttcttttgcatatttctctgcgttaacagcttcatcatacgccggcttaaggcggttttgtgcctctattgtacggtcatatgcaacttttttaattgtttcaattgaatgaatctgttcatagtcttttttcttatcagcttcttcagcctctgctttttcaagcatcgtctttctgcctgatattaatgaagaattacgattgtattcttcctgtaaatcctgaatagaagctacagccttattatatttatcttccaattctttaagcagggcttttgcttcgtctatcttatcctgtgatttatcagccgcatcaatatactcatcatatacggctttttttgcattgagattctcttctactttgctgatactgtctttaaaagtatcagctttcttttttatattatagaatctgtctcccatttcaattgtcttctgtttagccgcagaatgaacttctgatgcttttttagaagcttctttagcattattaatctcatcattaagtgacaaaagggatgcctctgctttattcaattcaacttttataagatcaaccgaaagtatatattcatgaataccagaattatctgatgatactgtgttgatattatcatcataatctttctttgcatcttcaagcttagctttactatcgttaatcttctgtttaaggacagataaatgtgcttttgctttagcaacgtcctgttcagcttttgttataacagcgaaattgttcataaaaacaccctctttaactatattgttatttcattatcataatgaagaaatacttatttaagtgcatcagcaagctggtctaatgcaggaatatcagtttctttaagaactgatttaattgtgacaacaggttcaacaattgttatatttttcattgtttcaagtatgtttcgcattgtttttgcagctgtaggtgcccatgagccattctcaataagtcctactgttctgttctggaatgcttttgcctgaaggtgatgaaggaaatcctgcataattgggaatacacctgcatcataacttgcggcagccagaaccattctgtcatatctgaatgcatcttctactgcctcagcaatatcacatcttgaaaggtcagtaataacaacattatcaacgcctttgttgcgaagcatttctgcaaattgttcggcagcatatgcagtattgccatgaattgaagcataggctataaatacacctttgctttctggctgataactgctccatgtgttatataagtcaaggtaatatccgaggttatctgataatacaggaccatgtaatggacatatagtcttaatatcaagtgccgaagcttttttaagtaaggtctggacaggagcaccatatttaccaactatgttaaaataatatcttcttgcttcacatgcccagtccgcattctcagtaagcgacagagccccaaattttccaaacccatcagctgagaacagaaccttctcactgctttcataagttaccataacctcaggccagtgaaccattggcgccatgacaaaagtaagagtgtgggaaccaagattaagagtatctccttctttaacagtaagagaattcttaatgttaatattctcaaagaactggttaatcattacaaatgtcttggcattacctactacagtgatttcagggaaaagttcaataagtctggcaaggcttccagcatggtcaggttccatatgctgtataattacataatcagcattccttccatccagagcattaagaagattgttttcccagtctttcattccacgcttgtcgacagtatccataatggctgttttgtcatcaagaattacatatgagttatatgaaacaccatctggaacagcatactggctttcaaaaagatctaatgttgtatcatcaactccgatgtattttattttatctgatatattcataattagtacctcactttctgattctgaaattattaaattgtataaaatcaattgttataagtataacatttatctgacagaagttaaatggtaattgtttataagaaatcatgattttattatgcttttttaataaaatcaacttgttattattttgtcatagtggtaaaatatagtcaacttttaaaagtgaacaattttatatttatggaggcgtttttatggcacagagatttattttgaacggaacttcttatcatggagcaggtgcaattcaggagattgcaacagaagttaagtcaagagggtttaagaaagcatttgtatgttctgatcctgatcttgttaagtttggtgtgacagcaaaggttcttaaggttcttgatgataatggtttttcttatgaattatattctaacatcaagcctaatccaacaattgagaatgtacagacaggtgtagaagcattcaagaatgcgggaacagattacttaatcgctattggtggtggttcttctatggatacagccaaggcaatcggtattataatcaacaatcctgagtttgctgatgtaagaagtcttgagggtgttgctgatacaaagaatccggcagttcctattattgcagttcctactacagctggtacagccgcagaagttaccattaattatgttattactgatgcagagaagaatcgtaagatggtatgtgtagatcctcatgatattcctgttgttgctgttgtagatcctgatatgatgtcaagcatgcctaagggtcttactgctgctaccggtatggatgctcttacacatgctattgagggttatattactgctggtgcatgggaattgtctgatatgttccatctaaaggcaattgagattattgccaagagtttaagaggtgcagttgataatactcctgaaggaagagaaggaatggctttaggtcagtacatagctggtatgggattttctaatgtaggtcttggtattgttcattctatggctcatccacttggagcactttatgatacaccacatggtgtagctaatgctattattcttccaacaggcatggagtataatgcacctgctactggtgaaaaatatcgtgatattgccaaggcaatgggtgttgaaggcacagaaaagatgactcaggatgaatacagaaaagctgctattgatgctgttaagaagcttgctgctgatgttggaattcctgctgatcttaaggatattgttaagccagaggatattccattccttgcacagtcagcatatgatgatgcatgccgtccaggtaatccaagagaaacaagcgtagaagagattacaaagctttatgagagtcttatctaagtaatatatgtatatgtaaataataaaccgcggtatagtaaattgctatatcgcggtttatgtatattattaattttctgtcatattaataaacattacatttaattctggtaaagatctttttaatgatacaggacagcctgatgtatcaaggaagcagtgttcactttcgccagtacatcttacttctccagtcttttcatcaatcacagtatattcaagcgtaatctttacaccattgtatttaataaccttgacattaataataacagtatcatagtaatgagtcatagacttatatctggcattaactgataatacaggacttattattcctgattcttccattttcttatagccaaagccattttcttcaagaagaaatgaccttgcttcctcaaaccatcttatgtaattagaatgatgaactattcccatctggtctgtttcataatactgaaccagatgtttgtatggtttatatatcataatatccctcctgacatgtttctgtataatccacagttatgaattttattcattgtgtaattatagttattcagatacatttttgtcaattttagaaaggttgatattaattacattataattagcagctacatttattacattgtcagctattattttatcatatctgttcatccattttcctgttactccagtgtatgaagcaacttcatctttagatgctcctcccattagcatatagcttatagctgcatgacgaagtgtctgcatggtataatgctttcgtaattttttggctttcacaagtttatctgtgtatgaagcaagaagacgttctgtatcgcgcattttaatacggttttttcgtatatttgtaaataatgcgccgctctgtatattttcagccacaatatatgtatcaagaattgtaccaaggtcatcaggtataataagaaatctgcttatatgattctttggtggcatattaatacataggtgccctgtctgatttcggcatatatattctttgttcagattacatatttcctgattggtaagccccatcttaattacaagtgaaaatattaaaaatgctttattgtcattggcatctaatgccgcactcagaagattatcaatttctttagtatcaggtattgcatcttttggcaatattttatcctgttctggaagagacatactttcaaaataattaacatatcgtttgccatgattaatagtataagtttctataaatgtgcatacagatttcataactgaaagacgcattactgcagtattatatgacaatctgccagagttaactttctctataaggctgttgtaataattcattgcatcttttcttgttaatttaagtgggtcgtgtcctgttaatttatcaaagctccttataacattccaatattcttttcgtgttcttgcacgtaaatttgtctggaaatatatccatatctcatcttcgaattttgctgaaatcatatgttatcctttctcaaaagcagtggtgtggtatagtttggttatatatgacgacatatgtataaatcacatacaaataatatcatccctccaccaaaaaatcaaaataaaataaaacaaaaaccaaaataattaagaaaagcttcctgactgaactcagttcacatttgctttttatgtcgaaagtccgtataatgtatttatatttatattgaaggagttaatatggaacagtattctaggcgatttatagaagagcttgccaagcatatcaacccaacgattctagaatttttcaataaaaagaaaaatctgatgaactttcctactgataatgctgcagagcttatagacgaaacattgatggagtatcttgaaggtaaaacgagccgtgaagatttaatgcctattattaacaagattaaaaagtcgcgtcttcagaaacgcgccagatggtataaggcatacaacaatgacattgataatatgaatcttgatgatcccaaacatcctctcgccagttttatttctctggccagatcattaagacctgacgagtatgccaagctttatggagataaagaacttgatgatattatcaaagataaaaaagaagctgctaataaatggaagaacgattccggaagtcttctgattgattttccaggactctactctttcactaataattcaatatataattctcttaagaatgatctaattataagtgcatggaagtatatagaaagtgaacttgctggtaacattgattcctacctaagaatgtatcctgttgaccttgttgataaaccattattcagcccatcttcttttactctgatgatggaaacagcttccaataatttgttaaaggaaattatcacagatgatgatggagatgaactgttagaggtcactgttgataatggtaagctgacaccaccaaagtctatggatactgatgaccttaagctggttaatgcatttatctctaatattaacatgcaggagttctctaaggagaaatctgttattgttgatcttaatactctgggtaaagaggttgtagattatcatgtaggtaagaacgttcttaacaagataagtaattcctgccgtaaacttgtagagtataacttctcttatgaagctgaaggcagtaagatatatttcaacctgttcgataatattgttattaaagaagatgctgaacgcccatatgccatagcacaatttggagaaattctaagcaacgcaattattcagaagaagcttatctccattacttctgcttcttatgatgttcttgataataatctttcaaagattatatgctatgcgataaagcgtgaacagattgctaatcaggaaacaagagttaatgaatacagttatacatacttccagaagattgtaagattcaagttgaagaacaaaaagaagaatctgcagcttatccaggaaagtcttcaggagtttgttgataaccatattgcaatagaaaagtttgaattaaagaatggtgtatttatcataactttcctgccgttgtctgatgctgaaatagaagatcttaattctgacaatgataagaatgacaaaggactgttgattgacacccttggataaatgtctacattttcgtatttaaaaaattgatgtagaatactgaaggataattgattaatttcaattatcctttttttatttgcctcaaccatgcgatttattcacattttgtcgtttatttttattttttagtatagaaaatgtgctttactcccctatttaaggcattttaataaaaataaacgagataattgatattcccgtgtaacctgcttctaaaaaatgtagataaatttggagtaaatcagtaatacatcactatcagaatgtagatatttttggagtaatttaatgaaatgtagatatttttggagtaatttaattcatttttataaaaaaatcgccccaaaactatgcttaatgatatattaacactacacaaagaagtgtttttctacatttttttttcaaaaaatcattgtcaatgtctacatttttggcttaaatactagatattcgggatttattgtctttatatataaatcaataacacccaaatgtagataaatttggagtaaaacatacaaaatatgtaatttgaagtctacaaaaaaaaatcacaagaaatttcgtagataaaaacggagtaaaacaagtatctttttaaaaaatgtagataaattcagagtaaaataatatgaaaataaatataatgtggacaaaaatggagtaaaaaggcaaatttgattttagccccaaatactgttaaattatgggctaaaagggggtgaaatgtttggataattttgcgaatattggcaaagcagctataatccagtctttaggtattcagaagaattacacagaagtaattgaaactactgtagatgccattgattatagtattacagcttgttcaacatgtaaatacaaagctatcatcaatacatttgatgaaaatagcaagccttatgctgatgcctgtgcttcctgtgcaagttgtccacataagacattaatccagaagaacgtgtataaaaaaatctaccataatgaaaaaaaccgttatggttacagacctatgcttaaggctaatgccattaaactgtttttgttattgcatttttatcaccctgataataacggaattgtatataatctggaagcatgtgaacttgcgtctgttatcgggtgtaatgtaagaactgtatggaataatcttaaggtacttgaagaatatacatatatctcatattcaaagaatgagtatgggcttattaatgttatcctcaatgattatgaaaattattaccttcctgccaataaaggtgggcgaggttttcttgtcatgtcaaaggagttgctaacaaaacttaattcaacagattccctggtatcactccgtatctttataagagaacttttaagtcttgattctcctgaattaaaaggtgttgcaagtgttgattacaagaacatacgcgatatacgtaatacgcttccatcttactgcaagccttcggttattaaagcaaagcttacgaaaaactccgatatattcaatgttacattcaaagatgatgttgtccggttcgagatcgataaagcatatatcccaaagaaccagaaagcttatgtacatgaggaatatgtaggaatcctgcagaattttatatgggaatttaatcagaatgttgcttatgttaattccggtgaaactgtttctgcaaaattcagctcattttttaatattaaaacttcagttgcttcttataaacttatgaagctcactgatattgaaattgatgatattgcaagtctttccttacactattcttatgaaattgtgatgaatgctctctctgtcgtttataaagaatattatatgtacgaaaagactataaataatcttgcaggtcttatgtcgacaataattcgagctcaatttaataatcttaaaaaggctgcctgaaaacagtcttttttctgtgtctttttatcaaaactcttcataaattatctaaagattctttctcaccccttacctgattttcgtttcttaagttaaatatatgtcatttattaaaaattatgataaaagttattataaaaagtggcaataatgactaatatattaataatttatggaaaaaaaacgacgataaatgacttaaaaaagactaaatacttaaaataaaaacctttttctgaaataaaaattcttataaaaatacaaaaagacttttttaaaaaaaattatatgtttgatttaaataaaaattcatcatttctgaaaaacatatacgtcttaattatcctcaaaatcagtaatcatctgtctttccagatttctcatttatcaatatatgttaatttgttaataatatatatatacatttatataaaaaaaacggatattaatgcataaatagtatttcatgcataatatccgtcaaaaattgactttgtaatttgaccaaacaacgatttttatgatgtcataatacaaatatgtatctatatcataaaaattcatatatggtcatattaaaggttgtcaattaaatcaacaattctgtcctttaaaatttcaacacgtatttttaattccgcatcgttttttatgattgatttattattttttagtacatcaaaattattttctaataaactaagtgactgttccagttttgcaattgaattaattcttttaagttcagaatcggagattgaagtctgacgttgttccttttccttctgctgctgcttaagtttttcaacctgagcttccatctttgctttttctcgttctgctttttcttttgcttgcattgcaaatttaaccatctcgtccttatcaggtcctttttctgtagagttactattgctttgaaaatcatttattctttgttccagtaattcaattgtatgtttcttatcttctatttcttttgtagcagaatcaagctgctttttatactgtctcgcttcatctgctctttcttcagaaagtttcttaatagattggaattcagcattttcaattgtaccgtttttctgaataattgaaagtattgtcttctgagcatcttcatcaagtttaccaaatttatcagcctgattaagatcaatgccattagaattaagaagttcagataattctggaatcagtttttctgctgttgtgtattttcttgcctgtcgttcagatatgttaagctggctggctatttcagcatgaatattcttaatttcacctttaagtttcttggcttcataaagctctaatagtctgcttacttcccatcgcttcacttccatgcttgattctcttacatcatgatttgcagagataagcataatctcttcgtcaatatctgatatatcggatttctctactttacaaggaattcctgcaggaaaattatcacgatattctttgtctgtcatctggcatatagcatggtatcttcgttcaccagatataagacgatattgatctgtttctgcatcatataaaactgaaaggttatgacggaggccattaacaagaatactttctttaagtgcttctattccgtcttgtgtatactgttcattcttaggattaggaataatcttatcttttggaatatatttaaaattgtattgtgtcttagcttggatttctctgagtttttctccaccatcattattaagtacaccagattttgttgatccagcactaaaatttttcttagccatattacttctctcctttcagatatcttgcaagcttgcggtaatgagctgtgtccataagtccaagatagtttacaagttcaacgtaatcaagagatgcaggacactttttatcgtatgataataatggttcaaatgtcgtatttgattcattaacagctatacagtttctgatagatattggaagaaatctatcaccgaacatattttcataactctcatacatctgtctgaaaagagttgttcttcctgccacccttgtcataaagataccggcaaattcaatacttaaagcatatttatcgtttagttcttctatagtatcgaaaagtgacataagaccatcatacgagaaattatctacacaaattggagtaataatcttatcactggcacacattgcacatgatgttagatatgatttgaacggagaattatctataattatgtaatcaaactcgtccttaattaaattcaagttatagcgtaaatataattcaacattaatctctttcattttgtcatatattttgtaaataagactgttaagttctcgtgatgctgtaagtatagaaatgtttttatattcagtttcagttatgtagctcattacttcatttttatttttttgtttttcacaaaacagacgttcgtaatctatatctggattagcttctgcctgaccatacattttggttgtattcatctgtggatcaaggtcaataagcaatactttgtattctgagatagcaagaatctgtgctattgtaattgctgatgttgatttgcctactccacccttttcattaatcaaactaattacttctgtcatagtttttcctttcgcatattaatataagtttattatacaacattttgtcttcttttcaattgcttttagaaatgtttttgagaaatatttgaactgagttcattttttgacataattatactttttataataactttgcactaagttcaataattaatatatgaattaatttttaagatagacatattatatcctgaaatttatgcctcaattaataattatataataaagatttattaaataaagaatcatataagacaagataagtaagaacacaaaagatattattaaaaaattctgaactgagttcaaattatatttataataaaaaagtgctaaagtattattaatcaataaactttgaactcagttcaaaatataactaaatactggtatattaaaaaattatataaaaaatgaactgagttcaaattttataataaacacaagcaagccaaaagaacataagttctgcatgtttcatgtgaaacattattactatatatagtgtttgaggggatctgtaaccacaattctttattacatctcttgagttattgtaattgtgactgtataattaataaaaatattgaatattaaaaaacaaattaatgaggttattatggtatttaatcatacatacagaattggacttgaagattgcggaaaagaaaatgaagctactaacaaagcaattcttacaattcttgaggatattgcaggcttacattcagcaacagtaggacttgggctcaatgaaattaataaaacaggctgtgcgtgggtgattttgaaatggcaggtacagattatcaagcgtccagaatataatgatgaattaaatgtttttacatggtcaacaactgcaaataagctttttgctgatagagattttaaagtgcttgatagtaatggtcagacagttattattgcaacttcacgatggatatatatggatattaacaaaagaagaccagtcagaataaccgctgaaattatggataggtatgaatctgagccagaaagacgtgtgttttcagaagaaattactaaaaatgagattcccgatacagaatataaagagatttcgtataatattttaagaagagatgtcgattatcttggacatatgcataatataagttatcttgatgcggcatatgagattatgccagaagaatactttaatggtccacaatttaactatataagtatcgattattgtaaagaattattgaaaaatgacgaagtaaaagcacatttttaccgaattgacaacggatgtataatatcattaaatacggaaaagataaattcagtaattacactgaaatattagcgaaagacagttatataaaactgctggaatccaatatatattagttatattggggattagctgctttgaaaggagtatttttatgagtttgattaataaagaaaaggttttaaatggtgtaggaaaggctgtagatgttactaacaaagcagcagataaggcttcttcctttgtcaaagaaaaggaaattgacaagaaagctatgaaggctgcgaaaactgccgaaaaaggtatcaaaatagcaggaaataagattggagaggttgctggagaaatcgtggcaggttataaaagtaaggcgggaggtacttcttcaacaggcagcacagcaccagatatcattgtagatgccaaagatattaaagaacatgtaagtgatgaggaatagtaatgcaaagtgatttttcacagggaaaagtctggaaaaatgttattaatcaggcaattccgcttatggtcgcacagcttatacagattctgtacaatgttgttgaccggatatacattgggcatcttcctgttattggaagcaatgctttaacaggaataggactggtttttcctattacaacacttgttgcggcatttactaatctgttttcaacaggtggtgtgccgctcttttctatggcaagaggagcaaaagaagaaaagaaagcggaacttatactaggacaggttgtatcactgctttttattacatcgctggcacttatggcgttatgctatatatttaaaagacctgtactgttccttttcggagcaagtgaagaaacttatgtgtatgctgaccagtatcttaaaatatatcttctgggaacgatattttcagtgttttcaaccggacttaacggatttattaatgcacagggatatcctaaaaagggcatgatgacagttatgcttggtgcaattattaatctcattcttgatccagtgttcatatatgggcttcatatgggagtttatggtgcagcaatagccacagtaataagccagggcgtgtcttttatgtgggttttaagcttttttatgggaaagaaaacattttaccatataaaaaaagaaaatctgattcttaaagcagggatggttggaaagattacatctcttggaatatcaggatttgttatgcagggaactaactgcctcgtacaggttgtatgtaataaaatgctgtttatgtatggcggggatatgtatgtaggaattatgactgtaattaattcagtcagggagattctttctgttcccggtagtacgcttggaagtggtgcacagcctgttcttggctacaattatggtgcaaagcagtatgaaagagtcagaaaagcaattagattcacggcggcaattggatttttatacatgctcattgcatggcttgctgtaattatatttccgaaagagattctgtcggtattcacgactgataaggctatgataggtttaggagaacatgcgttaaagctgtatttttttggattcttttttatgtcattccagtttgtgggacagtcgacatttacagcacttggctgtgcaaagagggcggtatttttctcgatattcaggaaagtaattatagttgttccgcttacaattattcttcctatgcttggacttggagttgaaggagtgtttattgccgagccggtatctaatgcaataggcggtctggcaagctttacaacaatgtattttacactttacaaaaaactgccggaatagtattctaaagacaatgatagcaaaggtgccatcgcttctgtatagggagcggtggctttttttaaaatcttggaaagaaggataatttatggatatatttgacataataggacctgtgatggttggtccgtcaagctcacatacagcaggtgctgtcagaattggttatattgcaggaaaacttatgggagagctaattgcaaaagcagaaatccttttatatggttcgtttctggcaacaggaaaaggacatggaacaagaaaggcgctcgttgccggacttcttggaatgaaaccggatgatatgagaattccggacagttttgagattgctaaggagcatggcatagaggttgctttcggagaatcagcattaagagatgcacatccgaatacagcccagattttcctgacatctgtaactgataagaagcttgaagttgttggtgaatcacttggaggatcacgaattaatattgctcagattgacggaatatctacgaatttttcaggtgattatccgacacttgttgtgcataacatggatcagcctggacatgttgcagaagttacatcaatgcttgcacacaaatcagttaatattgctgccatgcagttgtacagggctggcagaggcggcaattcagttatggtgcttgagtgtgaccaggaagtgccagaggagggaattaactggttaagacatgcagaaggtgttgtcaaggtgacttatcttggcttggaataatcataatgcagaatttgattagcataattattggtgaaaaatggaggatttatggcagaatatcattcaatcagtgaccttgtgaaattaagtattaataataagcaggaattatggcaggttgttcttacgggacaggcacatgacaagcttatgtctgaaagagatgtatttgcacagatgaaaaagatgtatcaggctatgaagagcgcagatgagcaatatgaccagcagttgaggtcaccaagtaaaatggctggtggtgatggatataaaatgcgcatttataatgagtctggcagaaatatatgtggtgattttattggtgtggttatggaaaaagcattaaagatgggggaatcgaatgcatgcatgaagagaattgtagcagctcctacagcaggttcatgcggtgttattccagctgtattactgtcttatgaaaaatgttttggtgttacagaagatgaatgtgtaaaagcgttattaattgcggcaggaataggtgcggtaattgctgaaaatgcatctattgcaggagcagcaggtggctgtcaggcagagattggttcggcaagtgcaatggcagcggcgggactggcttatatgcagggagcagatagtgaaggatgtgcaaatgccctggcacttgctttaaagagtatgctggggctgacatgtgatccggtttgcggattagttgaggttccatgtataaagagaaatgtttctggggcagtcaacgcaattacggcggcacagatgacaatggcaggtataaagagcgtaattcctgcagacgaggttatagattccatgagaagaatcggtaatgatatgccggtatgtcttaaagaaacaggtgaagggggactggcaataacaccaactgcaaaagtgtataagcaaaagttaaataatattgacaactaatgtcacaaaagttgacgaaaaactgacaaaaaatactgttttttttaaaaaaatggcaaaaaatctgttgattgacaaaaataatatgctataatatagatgattgtaaaagagattgaatttgtttgaatgaatttgaatgattttacaattaacattacacacagatataaggataactccataattccttatatttgactatatttctatcccctctactcatccccggttcccccagaaccggggaagttttttatgcgcggatagcgaggagaatataaaaatgcgctgtaatcatgcttgcatgaattgaaacttttttacatgtgggcatcagtatatgctataattaaacaatatgtttacattcagacaataccggctatgagtaaataaataatcagaggatggagttagttatgacacgaaaagaacttaatgaaattaaatcacaatatacattagaggattgtggaatattaaggttatgcggatgctatgttgatggtgagcgaaataagataacacagtttaatgagaattttcttaatcttccggaagaggagaagcataaatattttgatatatttaagaagactctttcaggaacaccaggaaagaatctggttgatatgaagtttaatgttgatgcgtatgctgatgagggcgcaagaacatttttaatgaacttaagagacagcggacttaaggatgacagacttcttaacgaattctatgacaggattatcaataattacagctatgttggtaattatctgattcttctaattaatcaggtatatgatattcctgcggttactactgataatatagagatggatgatgcatctgatgaggtttacagctacattttatgcagtatatgtcatgtgaatctttctaagccggggcttgggtatgatgaggaggacaataatttccacgataagaagcagaatcatatggtagatgtaccggatgtgggatttctgttcccggcatttaataagagaagtgcagatgaggatatgacacttttctatactaaagatgtcagtgagtttgaggacgggcttatcgactgcctgcttgactgtgcggttccgcttcctgcaaagcagcagaaggaaacatttacatcacttgttaatgaggcacttggtgaagaggctgaccttgagattgtgaagaatattcatgaaaatcttgagcagattatagaagagaagaagcaggaaagtccggcaccggttatgcttgataaaactgagatgaaggatctgttggaaaaaagtggtgttaaagaagaaaagcttgagaatttcgaggaacactttgagatggctgccggtgaacatggaaagcttgttgcatcaaatgtttcatctggtaagaaatttgaagtgaaaacgccggatgttgtcataaagattaattcagataagacagatattgtgagtacacaggtaattgatggaagacagtgccttgtaattcagattgacgagagacttgaggttaatgggatttcagttaatcctgatacaggtgaggttatagacagaaccgctgagggatatgtagaagaatgataatggaggatgagtctgtatgacattgaagaagttgctgcataatttcaatgggcatctgcacacggttaattcccacagaaggctggtgagaaaatactgttttaagcttggattatacaggcagggaatgatgcatgatttgtcaaaatattcgccatcggagttcataccaggggttaagtactatcaggatggacacagaagccctaataatgcccagcgtgaagatgaaggtgtttcaaaggcatggctgcatcataagggtaggaacaaacatcattttgaatactggatagattacgatgtcgaaggtaacagcactattcttgcaggaatgaaaatgcctgtgaaatatgttgctgagatgttttgcgacagagttgcagcgagcaggatatataataaagacaagtacaaagattcagatccattggattactatattaaggggcttgggcattatattatgcacccggaaacagatgaacttcttcacaatcttttgaagatgcttgctgataaaggggaagagtatacatttgcatatataaaagcaaatgtgcttaagaaatagaaaaaaggcggattttagcaattttttggtgaaactttaatattttgacaagaaaaaggtttctaaaataggtgtaatagtgtataatttaaagaacaatatgaacaagaaaatgttctggtgaataatttaataagaggaaagggaggtcttataatggggataatgcatactaaggccgaaagaactgaaaaagttgaagagattaaggctgagaataggaagaaggtaaaagagatcagggcaaagaagaaagagcttgatgctgaggttaagaagaaagccagacaggttgccgctgatagaaagaagagaagagcgggtattacattcagactgtttatgcttgctattgtaccggtaattgttatggtactggggcttattacaactacagtattcagtcttaagtcaggactggaagaagaggccatggatggactagaactgttaagtggggcagtacagagttcttatgaggatattaaaggcaactatgaatataagaacggtagattattcaagggtggcgaagaattgactattaaaccggctgcacttgatatatatgtcaagaactccaagaatgatgtccaggttacacttacatatggaaccaagagagttcttacaacgcttactgataataagggagcaagattaacgggaacagatatatcaagtgaagtgtgggatgtagttaagacgggaaagacatatagagatactaattataaggtagatggaaagagatactgtgcagtatatgtgccactaaaggataataaccaggttgtaggatgtgtatttgcaggacagcctacatcagatattacaaactatataatgcagaaggttggaacaatgcttatagtttctgcagtagtacttatattagtaggaattgtggcaacatttatagcacagagtatttcaaagtcgattaagagagcaagtgtatctgtaacgaaagttgccggaggagatcttacagtagaggttgataagactgtacttaagagacaggatgaaatcggagacatgggcagagcccttgaaactcttataattaagttaagagaaattgttggaagtcttgcgaagtctgcaacagatcttggtgagtcaggtaattcaattgactctatggcttcacagtcaagtgttgctgcaggagaaatcagtacagcagtagaagagatatctaagggtgcagtatcacaggcagaagatattgagacagcaactaatgaaattatgacaatgggtgaacagattactcagatagttaataatattgctgaccttacaaagacatctaagaacatggaagaagccgaaagtgcttcacaggatacaatgattgaattaagtgatgcagtccagagaactactgatgcagttgcaagaattgcaaaacagatagagacaactaatgaatcggtagataagattggcaatgctgcttcacttattgcagatattgcaagccagacaagcctgttatcactgaatgcttctattgaatctgcaagagcaggagaagcaggaaaaggatttgcagttgttgcatcagagattcagaagctttcatcacaatctgacagcacagcaagtaagattcaggagattattacagatctccagaatgattcgaaagaaacacttgaggttatgagaagtacagaagttcttgtaagagagcagtatgaaaagcttgcagcaactaaggaaagatttaaggaagttggtaatggcattaatgtttcaaagcatggaacagatgttatcaagggaaatgcacaagtatgcgacagttcaagagttaccgttgttgatgtaatatctaatctttctgctatatcagaagagaatgctgcttcaacacagcagacaacatcttctatgcaggagcttaatgcaactattaatattcttgcagaaacagcagctaaggttaaggaagtatcagaccagcttaatgaagatatgaagtattttaagatgtaatcagaataaaaattaccggttaagtttgtatatattaagaacttaaccggtatttttttatgctttttctagtacatttattaattctttgagttgtgcccggattttcttacgattgatatccgaataaccaatttcgttggcaatcttgtaaagatattcctgaaagttctgtacaatctgtgggtgattgaaatcaaaaaccatgcttggcagggctgtacggataagcattgcctcagatccttcattaacaattatacatacgttatcatctggatcgtattgtatcggaacaaagaaatagtcaggatgtgtatccataattcttataatattctgcagatgctttgcataagaacggggcgtgtaatatacagctgtctgttgtcttacaacagggaaaataaccggaacatggccagctataacttcttcagcagttgccagtggacatatatcaacattgcgtaaatcatcaaatacagtggataactggtaagaggtacgcagatttacgccaaggctgtcaggattattattaagaaactctgttatcagttcttccggcatggctgctggaggaagactcaatcccttctggatatggtttacatgggtgtttaagatacgatggaaacactcagaaacctcctctgctgattcatatatattcatggttggcctgcagtaggataaaaatgttttgaattcgttctctttaatagaaacaactgcaggttcggttgtcataacagtaaatgaattatcacttaccgttgaaagacagtcagagtaaactgcaacatgcggaggataaattatgcttatttttgaaaacagattatcacgcatgcgaggatagtagtaagatttcacccgtccggtaatatatgccggaacccagtagaaaaactcttcaaaaaactgggtggtattgacaggagaaggggaaatctggcatatagtatatccataatctatcaatctgagcagaagctcctgtatagaattaagaatttccttattatcaaatatactgtaaacatcatcatcaatccatacatatactgtaccatggtcttcaagggtaagaagatggttgataaaactgataacagcctgtttttttccttcggacttataaagaatactggtggcattgggaattacgtcaatggattttattcccataatattattagtgcctgatgaagagatattttcattaagaatgccgtcaaccagtgtattggtctgaggaagctcatccgccagccactggtaaagcatgtctgaatattcaggcaaaggtctggaatgattgaatctgctataatcagatgcaagagccaaagcctttctttgatagctgagtttaattgaagaggcaaaatagtccgacattcgtcttaaaatttctttattacgaggacattttctcttaccactgcgatacaggcttacagcagaattatcgatgccaacagcaccagccagagttgtgttattagtgtttgttatatccatcagaaacttaaatttgtcattaaaagtcataagctctccttatgcaaatgcgtgaacgccagaaataataagcgttgtaagtgtgcgtgccatttcatcaagagtaataccgtcaggatcggttatccattcataatacgcggaaaccattccgccagcgacaaagctagaaatcagaggatattgttcagaaggaacattcatcttaatatccctgcttaccagctctttgagaagagtttcctgcaatgctttctggagcctgttaaaaagcaggcttccgttgtccgaagcaaaaaggtctcttgcaatatctgcatcagacataattgtattaagaaatgcaaataaagtctgaggtgagaacatattataatcctcagacatagcacacaaaagatctttaagagatgttataagttcattaatcccttcatcaagaacatcattgacagttgaataatatgtgtaaaatgtttttctgttaatgtcagcctgtgcagcaagctcagtaactgttattgaatttagctttttcttctgcataagctcaacaagtgcttcgtaaatcgcttttttagtttttagaattctgcggtcagctttaatttcatgtgcagaagtaaaactgatttcttcagattttgccataataaactcctattaatcagattataaaatatatataaaattgttatgaaaatactatgaaaaatgtattttgcagttaactatattgtacaacatttgcaaatgatagtaaacaaaatacgacaaaatgttacataagtgccaaaaagaaattaattgacctttgaaaatatttgttaataaatatacaatgctgattggaaacatattgtatgatattggaacatttgtgtattaacttgtgattaaatattaatacgcggataaatgatttgacagcaagaggtatcaaatgagaaagaaaaatgcatttattaatgtaacagccagtatggggagaggtcttttatacgcttacctgtatattatgttcagacctaagatatgttatcagagcagaaaagctaaagaggaaattgaaaaaggcggagtcatatttattggcaatcatgtgggacataatgacggacagatgttttatatgctgtttaagaacagtgtccttataatagccaaagactgggctgataagaagattctaaagtggcttacaagcggtggtaagtttatttctgtagaccgctttggaacagatattacatggataagaggagcatcggagcatcttcgtgcaggagataatatgataattttcccagaaggacatacttctaagacaggggttatggatgaattcaagccgggctttgcaatgttggcagttatgtcaggtgcaaaaattgttccggtatataatgacggagaatatcataagctgtttgggaagagacttaagctgtatgttggcgagccgatggaacttactaaagagggaaaggggcttaatgcggagtatctcgcaggtgagtgtgcgaggttccgggaggctgtggagcagctcggaaggtagtgacaggacggacggggctgcggccggctgggaagcgtgcggactgcgggggtatggcgttttgaaacgcgctcccgctcggtctcggacgcagcggtactaggctcatctgtgtagggagtgcgggctgttgaaagcaagctttcaccgcccttcctacacacggattcgccaagtgccggcgtcctcaaacggtttcagaacgccataccccctcagtccttcgttcccacccggctcgcagcccctgtggtgcggtctggatgccggaggcgggcagcagtagtggggtgaatgacagacgaacgggcagccagcctccggctggcgaccacgcatttagttaataaaattcgggaaggtgtcagtcgtaggttcatggtttatgggtttgtgtggaaaaaaccgtctgaggacgccggcacttagcgaatacgaggtgcgaggacgaagtcctcgcaccgaagcaggagcttagtgaccgctgcgtccgaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcgaggacgaagtcctcgcaccgaagcaggagcttagtgaccgctgcgtccgaagccgagcgggagcgtgtttttagagcataaacccataaaccgtaaaccgtccgtcgtctgcacaccccacccaccggatttcataaaataaatcaaaaggagacaaaacatgaataattatttttataacatggtagaccctgatgaaatggcgactctggaatatattccaactattccaaagtttcttgaatttattaagaagcaatattctgattatccagccataagtgacaaggttactacatatacatatgaggagcttgtttcaagagttgcaaagagagttacatttattaattcattagggcttgagaagggctctaacatagctgtacttgcaaagaacgatcttgatgcaatggagcttttccttgcaattccggcggccggacatgtacttattatgcttcctaatgcacttaacgataaggcacttgcaggaatcagcatgaagtttgaccttgccggtatgttcgttggtaaggaatttacagaggttacagctaatcttccttgtaagacatggtcaagcacttctattggtgagactgaaagcacatttgcagatgttgaaaaggatactacagcagcaattttctttacaggtggaactacaggagcacctaagggtgcagttcacagccacggttctattatgagaggctcatttaacggagtatttggtccaggaagtattctccataagagatatatagctatgcttcctctttcacacatatttggggcaattatgggatatatggctaagctctacacaggctcactaacatacacatgtactgatatgagagccggtattggtgatattcctgttgtaagacctacaactcttgtacttgttcctggtcttgttgagattattcttaacattgccaagcttaagggaagagcattcttaggagatcttgagcttatcatgtgcggagctgcacctgttcctccaagacagatggaggaatgcagagagttaggaattacattatgtgcaggttatggacttacagagtgtgctaacctgacatcaggcaattgcgatacagataagaagcctgagtctatgggacatatttatccagaacagcaggttaaggttgttgacggagaactctggattaagggtgacaatgtaatgaaggaatattacaaagatcctgagcatacagcagaagtattagaagacggatggtttaagacaggtgaccttgttgagtttgatgataatgactggatatacataacaggtcgtatcaagaaccttattattcttcctaatggtgaaaatgtatcgccagaagagattgaggaattattctataagcagccacttgtaaaggattgtcttgtacaggagatggaaatgaatggaaacactgttatcggtgttgagattattccatatatgcctgaattagatggtgcatctgaggaagaaatccagaacagattgcaggaaactgttaatgaggttaataaggaacttcctccattcaagagagtgcttaagatgaaggtgagaacagaggattttaagagatctggagcgatgaagatattgagaaatcaggtgtagtgacagacggacgggcagccagcctccggctggcgatcccgcatttagttaataaaatccgggaaggtgtcagtcgtaggttcacggtttatgggtttgtgtggaaaaaccgtctgaggacgccggcacttagcaaatgcgaggtgagaggacgaagtcctcgcaccgaagcaggagcttagtgaccgctgcgtccgaagccgagcgggagcgtgtttttggagcataaacccataaaccgtgaactgtccgtcgtctgcacaccccacccaccggatttcataaaataaatcaaaaggagattttatcatggtatttgagaaattaaaggaaatttttggaagggttatgccacagtgcgacccggcaactattaaaatggacagtgttcttgcaacagatttaggagttgattctcttaatatgatgttacttgctattactgttgaggatgagtttaagatcagattcaattctgatgccaagcttgaaactgttaaagatattgttgattatgtagaagctaacgctaaataagaggcgcttatgagcaaagtaaagacagggcttgtactggaaggcggggctatgagaggtattttctcagccggagttcttgattacatgcttaagaaggacatttattatgactatgttataggtgtgtctgcgggggcaggtaatgcggtaaactatgtttccagacaggaaggaagaacgaaaaagataattacccatgaaaatgctgaaagctattatggagtcggacagcttttcgagaataagaagattcttaatcttgaaatgctggtagccgaatatgcgcttaaagatattccttatgattttgatacatttttcgcatctaaaacagagtgtgagagtgttgttgttaattgcgagactggaaaggctgagtataaaggaaattttaagacgaaagatgaatttctgaagtgtcagatggcaagctgctctgtgccatttatatgcgaacctgttgaaattgacggttatcattatctggatggaagcattattgattcaataccggttgagagagcagttgagaaagggtgcgataagattgttgttgtacttaccaagccagagggttctaagcctacggattattctaagataaagaagcttatcgagtggagttacaagaaatacccagagctttgtgaggttatggcacacagaaggcaggcttatgacaggcaggataagttcatgaaaaagcttgtggaggaggggaaagtctttgttatccgtccggaggagcagatgataagacactttgagaataataatgaaaaacttcttcaatgttatcagtatggatatgacacgatgagaaaacagtttaaagcatttgagaagtttatggaggacaaatcctctcctcgctagagagactcggattttcctgcggaaaacaaggaggattaataatgaaggttttaatagtaaacggaagccctaaaggacctaagagtaatactatgcagatgacaaatgcagttcttaagggacttaaggagactaatccagaagcagagattgagcttcttacagttaaagatatggatattaagccatgtatgggatgtatgagctgttggggaaagacagcaggtcagtgtgttatcaatgacgttatgcaggatgttcatgtcaagttcatgaacgctgacgttattatatacagcttcccattgtatttctttggcatgccgggtccaatgaaaacatttgttgacagaatcatgccacttatggagacttacaagggcaaggtaagagatatcggagataatgcgttccacgaattccgttatgatgtaagcggcaagaagttctatgttatatcatcatgtggatacggaaggactcaggagatatatgacgcacttatcaaggaatttaattttatctatggcaagggcagatatcaggcacttctttgtccacagagtgaaatgtttgcaattccaccaatggtaaaccagattaatgaatatcttaagagatatacagaaattggtaaggttatgggaaaaggtgaggatatccctcaggatatgattgactacgcttcgcagccaatgattccacagagagcattagagaagcttatgaacaattactgggatgcagttacaccagagaatcctcttccggctcctaatttaagataagaggcagcttatgaaaacatactacatgtttggtgactcacttatgcgaggagttatgccggatgaagcatggaattatcacagttcagatgcaattggatttgaggcaatgcaggcacaatataatatgaagtttttaaattttgcgatgccgacattcacatcagagagagtaaaaatgtggcttacacagataatgtcaaatcatccggtacctgatgtggcatttcttgaatgcggcggtaacgactgcgactataactggaagtcaatatgtgagggcagatgtgattatgaacataggcacagagttgccccacaggattttaagaagaattatgagaatatgatacatttgttacaggaaaagggagtagcagtaacagcagtaattgcaccaccgattgctattgaagtgtatctgtcatatctgcttaaaagtggagtagacaaagatattatgtcagaatatgtgaactcagttcagcagatgcaggatgaatatgccggatacggtgacataatgagagacacagctaaagaaaacggctgtgaaatattaagtcttcgtgagagctttcttgcacttggcgacatgaaggcatattatagtaaggatgggatgcatcctaatgaggcaggatatgcacttattcgtggtgatttcgaaaaatattttgcatctgcagcaggtattatatagaaagatgaggaattataatgtttaatctgcgtttcaaatgtactgttatatcaagctggcacatggtgcttcatgctgtacctaaggctaataaaatgattgccaacaagaaccgttattcagaaactgaacggtttgtgtatgccaagtggattattaattacatgagaaagcatgccagaacaagaaccagggtgtatggcagagaaaatattccgacggacagcaattacataatgtatcctaatcatcagggcaaatatgatgcactgggaattattcttgcacaggaaaagccgtgtggtgtcctctgggggaagaagcaggctgaaagacttatgagccgtcaggtatgtggtcttattgatgcagtcgttattgatcttgacaataaccgtgacaaggtaagggctattatggatgttaccagacaggtcaagttaggaaggaatttccttatatttcctgagggaggttacactgacaataagaatgaacttcaggaatttcaggctggctgcttttcgtgcagcttacagactaagacacctatcgttcctatagcactttttgattcgtataaatccatgaacagcaatacatttgaaagagtagatacacaggtacatttcttaaagccaattctttattcagagtatggcgagcttaagaaaaaagaggtcgctaagctggttaagagcaggattgaggaaagaatggctcagattaaggctgggaaaattaatgaaagctatgaattaattggataataaaaacacaggctcagggaaataatatgttccctgagttttttgaccaaattctaaaatattcgtttcaatggttgacatgttctaagtacattgataaaatatttaaggtttacttaataataagatagtataaggaatagtatgttgtttggtaataataagaaaaatgcagagtatatcgttgatgtacattgtcatataatgccagggatagatgatggttcaagagatataacagaaactcttgagatgcttaagatagcacaatcagagggaattacacacatgattgctactccacattttaaaagtgggcatcgtaatgcttcaccgcagaaggttaaggaacttattcaatctgttggaaaggaagcagccgcacagggaacagatattaagctttaccagggcaatgagattctgtttcatgatgagatgtgtgaggaacttgataatggaaggataagcagaataaacggaactgattatgttcttgttgaattcatgccatctgatccatatcagtatataagaaattctcttgatgagattatgagtgagggatatcagcctgttatagcacatgttgaaagatatggatgtatggttgatgacattgagaatgtcaggcgactcagccgcatgggggtagagattcaggttaatgcatcaagcattaccggagatacaggtaaagaaattaagaagtttgtacataagctattaaaagaacagcttgttgattatgtaggaacagatgcccatcgttgcgatggcagcagaacacctatgatgaaagagtgcagcaggatgctttataaaaaatatgatgaggggtatgttgacagtatattatatggcaatgcatttgatagactgttagcagatacgaataattaaaggagaattaatgatggaaactaataagagtacagatgagattgaaatcaatcttggagaaatatttgcgttattgcttcataaggtgtggattataatactggcagctgttgtatgcggtgcagtaggatttctttacagctattttcttataacacctcagtatcagtctacaactaaggtttacatccttaataagcagaacagtacatcagttacttatagtgatgtacagctttcaacaactctttctaaggattatgaacagcttgttacaagccgttatgttatagaaggtgttattaaacagcttaatctggatgaaacttatgaaagccttgtggaaaaggtttctgcaactaatacagatgatacacgaataattgctattacagtaataaatccggatcctgagcaggctcagaaggttgctaatgcggtaagagatcttgcagcacagcatattacacaggttatggatattgaggctgttaatgtggttgattcagctaatcttccaacaagccctgtttcaccatcagttcctaagtggacactgattggagctgttattggtattataattgcggttgccgttgttgttatacagcatttgcttgatgattctattaagagttctgaagatatcgaaaaatatttaggtatcagtacacttgcacttattcctatgaatcaggctgaggaagaaactgccagcagaaggaggtctccccggaaaggtaaagagaaagtagtacttggcactgatgatgagaaggcaagaagttttaaatcatctgatattaataagaacactaataacaagaacagtaaaagaaatgctgatggcatagagtttatggaggactagagatgcaggagttttcagtaaaacagagcaaccttgatttcaggaccagagaagcttataagatgttaagaactaacatagaattctctggtgataataataaggtaatatttataacaagcagtacaccaagtgagggaaagagtacagtatcttttgagcttgctatgtcttttgcacagaatggtatgaagacactgcttattgatgcagatacaagaaagtcagttatgaagaacagaggtaagaagggtaagattaaatatgggcttactcattatctttcaggaaagaatgaacttaaggatgttatatgcgtaagtgatgttcctaatttctgcatgatatttgcaggacctgtaccacctaacccaagtgagcttgtcggtaacgacagatttgtcaagatggtagaagaagcaagagctacatttgacatgattatcattgatacaccaccaataggaagtgttatcgatgctgctgttatttctaaagtatgtgatggcggaattcttgtaatcggagcaggtgatataagctataagtttgcaagaaagtctaaggaacagcttgagatgacagggtgcaagcttcttggctgtgtacttaataaagttgatatgacaggaaattcttattatggtaaatattacggtaaatattatggcaagtactatggacatgaggataataattagttatggatatgaaggcggcacataagtaagatgtgccgtcctttttagattcaaggaagaaaggatgtgtgtatgaagaagatattaaaatatactggactgttaataagtattattatgcttacagtatctgtggtgtttatagctcttttaataaatgtcagggttgttccagttaaatattgcatcattgctgcagtggtgcttgttatactaacggcagtaacagcatttacacaaaagtggtttgttccaggaattattacgaagataattgccattattatgattgttgtgcttattatgggaagcatttaccttaatcagacaagacatatgataaacaagattacaacaactcaggaagaaaaaattgttatgggtgtgtatgtacttaacgacggcggatatgacagcgtagatatgcttaataataaatccattggtataggaacagctgtggatcgtgaaagtactgatgagcttattaaaaagatgggtgcaggtggatttatggcggagtatccagagtattctaatataatggagctggcagatgctttgctgcagggacagattgatgctgccattatgaaaacaagcagtattgaaatgattgatgagatgggagatttcaccgggtttgcgtcagatgtgaagcttatatatagtggtgaatttacaattaaagtggcaacgacagaagagaatgttacagataattatctttcaagtgatgatgttataaatgtatatatatcaggaattgattcaagaggcggtattaatgaggtgagccgtagtgatgtcaatattattatgtctattaataagaagacacacaatattcttatgattaatacgccaagagattattatgttccactttctatatccaatggtgtcagggataagcttacacatgcaggtgtttatggaattgagtgttccagaaatactctggagatgctttatggtatccagattgattattatgtaaaagttaatttcagtggatttgagaaaataattgattcactcggaggtgttgatgtgacacttgattattcagcaactcttagtcaggctggaaatctcacagtacataatggtgttaatcattttaatggtgagcaggcacttgcatttgcaagagaaagatacgcatattcagatggggacagacagagaggccgtaaccagatgatgataatggaggcagcaattaaaaaagcttgttctccagcaattatatcaaattatacatctgtattatcagaagtgtctaaaaatgtaattacagatatgagttatgactttattgcagatcttgcacagacacagcttaatgatatggcagcatggaatattacacagataagtgttacgggagttggaagttattcatcaacaacatattcaatgccagggtggtcgttatacataatggtacctgatgaggaaagtgtggagaatgcaagggagcagataagagataattataattaatattttaacgaaaaacatagaaacttatatgaaggtatgatattattttattatgaaacatacgtgttaattgaatagagaaaggaattgactatatgagaattaaaaggttatcagcgttattattaagtgcacttcttattacaagtcctattggatatatgactgtaaatggagacacaattgacgcaaaagattattcgcagcaggtacagtctgtggattctgcgtatataggaagttacataccaagtagtcttgatagtgatgctccggtatatgtatcggatattgcagcatatgcacagagaaatgtaccatcggcatacccagaggatgtttcttcatataagaaggaacacccatcaagaaatcagaatccttatggaacatgttgggcattctcgtctataggacttgaagaatttgaccttatagctaagggtcagagagattctagtgttgacctgagtgaattgcagcttatacattttacatttaactcagttattgatccgctcggtggaaccaaaggggattattctaagtattataataataataccaacatgtcatatctggaaaagggtggtaactacgagtatgcagtaaagagactcagccagtgggtaggagctgtcaatgaatcagatgttccatatgctgatgcccaggcagtatataataatggtcttgataacaaatatgcttatgattatgatgtggcacatttacagaatgcatacaggattaatgttaaggagcagccagatgttgttaagcagcagattatggagcatggtgctgttggtgcaagctatactcattattatgcaggagagaaccaccttaataattcatattatgatatgcagggaattgtaagctcaggtggtggacatgcagttatgattgtgggttgggacgatgattattccaaggataattttgcgacaactacaaagccttcaaataatggtgcatggcttataagaaacagctggggtgattattttgattatttctggatgtcgtatgaaacttattcgcttgcagatactgtttgggtatttgatatgtcagcagaggatgggctggataataattatcagcttgatggcgggctgcatacagcaacagtaggatattatacaggtgcagctaatgtattttatgtatcagaaaaagaaggtgttgcatctgaaactcttaagtcagtatctttatcttttacacagacagcagatgttggatatacaattgatatatatactgaccttaaagatgccagcaacccgataagcgggactaagcatgctgaggcgagtacaagcggaagaacaacttttgcaggaatacacactattcctctggaggaagaagtgattctcaatcctggaacttattatgcagttgttgttaatattgataagaaagcatttgaagttgaatattcgtattcagagagcactaatccggggaaaactgatgataagatggtctgggaaaatgtagtaagctatgattctgactgtgaaggaagttattattataatggttatggcagatatggaaaatattattataacttctgtataaaagcatttacatcaaataatgttgatttgggtgatgtattagaaggatatacattaagcatggacggaaagattgatatgaatttctacatgaatcttcctgataaactggttaaggacagcagcacgtacatggaatttactatgcctgatggaaatgtgtcaaaggttatgttagccgatgcaagaaagacaaccgatggtttgtatgtgttctcttgcggaatagcagcaaagcagatggctgataaggtaaatgccagaatcgtaagtaatggcgttaagggtgaagttcatacatactcagtaacagattatgctgaatctgtaattaatgctgcaagtggagtttattctgataaagctgtaaatgcagttaaagcaatgcttaattatggaacagctgcacagcaatattttggatataacacagataatcctgccaattctataatgacggatgatgataagaatatggatatggttggattcaatacatatacaggaaagctggttaatgcagacagtgtttcaggaataagctattatggaagttctcttgttcttgaatcagatacaatattaaggaattattttgagttgtcagacggatatagtattgataattatacattttatgtgaaggataaagatggaaacaaaaatatcattgttccacaaaagacagatgcttcattatattatatagatatcagtaatgtgaaagcgtatgagcttgctgataatgttaatatatacgttcagaagaatggagatagtgaagataaaataatgatgcttgagtatggtgcatatgtttacgccagatatgtcgataaatatttagataatacagcactaaagaatcttatgacggcaatgtatcattattgcaatgctgctacagaatatgcaaatatatattgatatttttaatatgtgactatataataattagcaaggctcattttgaaatatgagctgattagcgtatttcagttggggaaagtatattttaatatgaagtattaatacacgacttgttatgaaaagttaaaaaatagcggggagggtaagaccaattaacgtatggttaatgtaaacaaaaccaaagagagtattcagaatgttttaatatttattacagatgcaatagcgcttataatgtcttattacatgtctggttttatatggctgatggaaataagaaataatacattttcatatgtaatgaaagtgcttaatggcaatatagtcacaattattatagctgtattaatagctgctttattctgtaacattaaaggcgatgtacttaatcgtggcaaatttgaagaacttgcttctgttatgaagaaaagtcttatttcatcagctgttatagctgtttatgaacttttgagtaaaactgcacagggtgttccaagaagtgtgtatgtaattacattttttatgggaacagtgcttatgtttttattaaggatgcttgtcaaggtatatatgaagcatcgtaatggaggaaagcgtaccaacagtatacttgttatcactattaaaaacagggcggaagatacactttccaaagctgcggcaaggaatgactggatgcgtcgtatagatggtattgtaattactgatgaagatatgacaggtcagtcaatagagggatttcctgtagttgctaatgtacattcaatgatgcgttatattaagaacgagattgttgacgaagtgtttattgatgtggattacaagacccgcgaaagtatcaagcctatggttatggaacttgaggatatgggagtaattgttaatcttaagcttgagattcttgacagctataaggattttgacagtaagctgggttacataggagcagttcctgtcattacatttgctaacagaatatatgactggaagggaatgcttgttaagagatgcatagatattctcggagcaattgtaggacttatagttatgtttattgcaatgatttttgtaggtcctgctattatgatagaatcgccaggtccaatctttttcaaacagaaacgtgttggaaagaatggccgttattttgagatatataagttccgttctatgtatatggatgctgaagaacgaaagaaagatcttatggcacagaatgagatgagtggtcttatgtttaagatgaaagatgaccctcgtataactaaggttggcaagttcataagaaagacaagtattgatgagcttccgcagttcattaatgttcttaagggagatatgagtcttgttggtacaagaccaccaacggtagcagagtttaagcaatatcaaggacatcataagagaaggctttctatgaaaccaggcatcacaggaatgtggcaggcttatggaagaaagacggttagcgattttgaagaaattgttaagatggatctgaattatattgataactggagcattatgcttgatattaagattttgtttaagacagttcagtcagtattaactactggtggacagtagaataattacccccctgtagtatcatcagatactgcagggggtaattgttttatctagacattatgtacattaatactggataattatagcagaattgcacaaaattcgttggcaatatagaaaatatacataaaaattaaccataatgcttattgacgcaaatcggcggttgggttaaaatgatagtaacttttggtataggggacatgctgtagtgcaacatgtcgaaaagaacatgttatatgctgttagtaacaggaactttactatgcctacaatataataaggaggattttatgaaaaagggtaaaagaattttagccgcttttttagcagtgctgatggttgttgctattatgccatttacttcatttagtggtatattcacaagcaaggcaaaggctgcagagagtggcaagaagtacacttttgagggtactgaacttgaagcagcagcggcaggaaagtatacagatggtcaggctgttactgcaggaactgatggatattttactttttatatgagtgcaaaaactaaaatcgactcaagtgataaaacatgggaagatggttacgcttgtaaacagagagtaaactttggtggtaaagcagatgttgctaatatgaagaatctggtttctttcaagacatctaatgctgcaaaagtaaaagtatattgggtagaaggtggaacagacaatcgtcagatggcaatctttggttctacaggagatgtagtaactaagacagaagtaacggcagcaaagaatgatccagtagtttctacattagaattagcagatgcaggaacatattaccttgggggtcttgagaataacaattatattttcaagattgaagttgaggagacagcagcagttgaagagccagttgttaaggaatacgaacttgatggtgctaagcttgagacggcagcagcaggaaagtttacagatggacagactgttgcagcaggaacagataatgcatttacactttacatgagtgcaaagactaagattgactcaagcagcaagacttgggatgacggatttgctggaacacagagaattaactttggcggtaaggctgatattgctaatatgaagaactttgtttctttcaagacagaaggaacagctaaggttaagatttactgggtagaaggtggaacagacaatcgtcagatggcaatctttaattctacaggagatgtagtaactaagacagaagtaacggcagcaaagaatgacccagtagtttctacattagaattagcagatgcaggaacatattatcttggaggacttgaaaataacaattatatcttcaaggtagttgttacagatacagttggtggtgatgcaccagttgttacaagaaaaaattggtcagaagttgctgcaccagtaattggagaagtggctcaggacggagcaaatgtaactgttccatttacaatggttcttggtaatgatggtgcagataaagtaagcgttgttatgacagatgcttcaggtaatacagaaacaaagggatatgcacttgaaggtgaaggcggaaaggtttcattctctccagcttcttcaggtgagtatacatttacaatcacagcttctagagagaatgaacaggataagactggtaatacagttaagcttaactttgcttatccactctcagcaccatctatcagcagtgcaacaagcatgggtaatggtacagtaagtcttgtatggcagtcagttaaggaagctacatcatacaatgtttatgttggcggaacaaaggttggttcaacatctgctacatcttatgatgttacaggattaactgttggtacaaagtatgattttgcagttgaagcagttagagagacaccagctgctgtatctgataagtcaacaatatctgcaacagcaacagctgaagctaagcaggtatggggatatatcgtatatggtaacggtgcaagcgagtctaattcagcatatgaaggaaacattaatgaaactggttcagttacattaagatctggagcagtagatgctaatggagttcttaatggaagcggtaataacggaaaattagttccagcatcatttgatggtcttaatttctattatacagcagtacctacatcacttaactttacattaagagctaaagtaactgtagatcagtggaatttatcaaacggccaggaaggctttggtcttatggcagcagacagacttggtggttctggatggaacaattcttatatggctgtagtttctaagacagaatattactggaatgaagaagctggtaaagttactaatgatacaacagcacttaaggtatctcagaagatcggtattgcttcacaggagaagaaggggcttactaaggataacattgcagcaatagaggctaatgatactgaaacagtaaaacagttccagagtgctatgtatcctcttgagcagagatatgcacagaatgtcaatgttattggtaatgctgttaagccagttgatgcaacaatagagaatcctgttactgagatgtatcttacaattcagaagaataacacaggatattttgtgtcatacgaatcagtagatggaacatattcaacaactaagaagtattatgacactgaaacattatcacagcttgattctgataatgtatatgtaggtttcttcacaagtagatatgcacaggcaacattctcagatgtaacatttacaacaattaatccatctgatgatgctccagcagaagagaagccaattgaagaattagtaactaatgcagcatttaattctaagactgcaacaggttcaagtgattatgaattcagattcacagctaactgtgatggtgttctttctatctgggatagtgaagataacgcaattgctacagatgtagctgttgcagctaatacagttgttaagcctgcaacaacaacacttaatgtaggtaagaattcatttagatatgtatttacaccagatgctggctatattccagaaaaggatatggttatgtcatcatatgagccaattgaaggcacatttactgtaacatacagaacatatggcgttgaaggacagtcaatttatgtagcaccaggtaagtatggtgttggtactaaggaagatccaatgagcatctatgatgctgttaagtatgtacagccaggacagactatcgttgttatggaaggtacatattaccttgagaagacagttaaggttgagagaggtgttaatggtacagcagataagcctattcagatggtagctgatacagaagcttcttcaagaccagtatttgatttccagggattatgtgcaggtatggtacttgcaggtgattactggtacttccagggatttgatgtaactaattcagctaatgcacagaagggtattcagctttctggtaagtataatacaatggataacattatgacttaccacaatggtaatacaggtcttcaggttagcagatatcttacaacagatgaatttgatatgtggccagcatataacttaattcttaactgtacatcatatggtaacgccgatgcaggttatgaagatgctgatggttttgcagctaagttaacagttggtgatggtaatgtatttgatggttgtatctcatacaacaacgctgatgatggatgggatctttttgctaaggttcagtcaggttcaattggcgctgtaacaattaagaattcagttgcttatggcaatggttaccttgaagatggtacaaatgctggtaacggtaatggatttaagcttggtggcgacagcatgtcaggcaagcatgttcttgagaactgcgtagcatttgataacaaggctaagggtattgattctaactcttgtccagatattaatgtaattaactgtacaacattcaataatgagtcttataatattgctctttatacaaattcagctaagaatacagatttctcagcaacaggtgtactttcatacagaacatatatgaaagataatgttgagcagtttaaattacttggaacacaggacaagacaaaggttgataacgatactaactacttctggaattatgaaggaacagctaagaattcagctaaaactgtaacagatgactggtttgaatcagttgatacagcaatggatcatgcaacacatgtatatgcatcacataaggtaacaagaaatgctgataacacaatcaacatgaatggtcttcttgtacttacagacaaggcagcagctaatacaggtgcaagaatgacaggtactccatcagctaagattgaagttcctgagggaattaagggacataagacaatatctataacaggtaaagatgttgttaaaggtaatacaacagatgttgcagttattcagggaacatctacagatattgtgtggacaattgatgcagatgcatctacatttgattatattatggttgatgatgtagttcttgatgcttctaagtacacagtagtagctaatggtaacacaacagttgttacattcaaggcttcttacattaagagcttaaaagcagcagagcatacattcagagcatgctttacagatggttatattgcagagactaagcttgaggttcttcctaagacaggtgatttctctagaaatatgatagctgtatatgcaggaattatgcttatggcattacttgcagcagccgtagttcttttcgaaaagaagagaaagagagtttagtgtaagcaaatagtataataaaacatatgaatgaggtctggttatccagacctcatttttgtatatagatatatgataattattgtacaattattacaaagtaatatctagttttaacgactttcagaaaaacatttactaaaagtgttattgactatttgttctattagatggtactcttattacagatttatgaaaaggaaaaggaggcttttttcatgagaaaaagaactaaaagaatgttgtctgttcttatggcagctttaatggttgttagtattatgccggttaccggctctaataacattgttgctaaagcatcgacagcaagtgcagagtcttctgttgtgacatggtcagcagcagatattcttgcagcacaagaaggagactcaggattagtgttatgtggctcaggctgggctaataataatgctacagatgacaagacatttgaagacggttttagtgcattaggagacaatgccaaggcaggatctacaaaggcacagacagatggaaagacagcagcaggaacagtaccagataatggatgctatgtaaaatatacagcacctgttaatggtgaattagctattaatactaagataggaaagaacaagactttctatgtaatagcagaagatggaactaaggtagcagaagtaaaaaatggaacttctggaagtacatataatactgttaaggcagaagtagaagcaggaaagacatactatgcataccttggaggagcaacagctcagatttggcaggtatactttacacctgcagaagcagagtggttagctgcagatatattggcttcaacaacatataataatggtttaacattatgtggaacaggctgggctaataataatgccacagatgacaagacatttgatgatgggttcagtgcattaggagataatgctaaggcaggatcagcaaaggcacagactaatggaaagaattcagcaggaacagtaccagatagtggttgttatataaagtatacagcagcagctaatggagagttagcaattgatactaagataggaaagggcaagactttctatatagtagcggaagatggaactaaggcagcagaggtgaaaaattccacagatgcaagtacatataatactgttaaagcaaaggtagaagctggcaagacatattatgcataccttggaggagcaacagctcagatctggaaagtatattattcacagttaaataagaagactgtagttgactgggaatcagtagcaaagccagttatcagtaaagtagaagcaggctcagatggttttactgttactgttgaaggaattgtggatgagtataatggggctgaagatattgtggtaacaatgcttcataatgatggacaggctggagaagctgttataaagagatcagaaggaacagcaacagttaattttacagctcatgaaagtggtgattatacatttgtagcaacagcacagagattaggttgtgcagataaagcttcagatgtttatgaagtaaaagatttcatactcggtgttaagatgccaactattacatgggctgaaaacaagggtaatggagaagtatatcttgactgggttaatataagcgatgcaaaggattataccttaacatataaggttaaaggttctgatgaaagcacagcagttaagattgatggaatcacagaaggtgattatacagttaagaatttaacagttggaagtacatatgaattcagtgttgttgcaaatagagcagatggatattgttcagctgtttcagaaaaagagttatcagtaactgcagacacacagaagaactggtatgtgtcaactgttggttcagctcaggagactaaggcaactatcacagaggctgatggtaatgcacaggttataaatattgctaatggtgatacagcatctaagaaagttgctacagttgaagcaaaagatattactaatacaacaggaagtatggaaattcaggctaaggcttcaggaaagatttctgatgatgaagatggattctcatattactacactaaggttaatccagagaaagagaactttgaattaactgcaacatttacagtaacagatgcatctcttacccctgataatcagacaggttttggtgttgtagttgcagatacattaggtgttaataactggggtacaccaagttatgtacacaaatattttaactacttctcatcaatgatgtacagctctaagattaatgcaccaacaatgcgttatatcacaggttatacatcagcagatacatcaaacaaagatggtgtagacagagttaataataatgttaagtttaaccagttaacaggaacaaatatgttcaaggttggagctgagtatacatttacagtaagaaagactaatgatggatacgaagcagttgcaacaacagagaatggaacacagacacagaagcttacagctaatgattttacatcagtacaggaagatggaacagtagttgtaggtgttatggtagcaagaaagattggtgttaagattactgatatcaagtttactacatcagaaagtaagggacttgcaacatctgaggccgtagaagacaaggtaacaccatcaatcagagtatattcttctaacacatgtggagcaggtgagtatgaatacacggtagttcctaattgtgcaggaactttaaaggtaacaggaagtgctgacggtaaggctatttctaaggaagtaacagctgatgaggttgtaagaattccagttgcagttaatgttggaagcaatactattaaggcagaatttgaaccagcagcggcagctaatattacatcaactaagacagtagcaagcgaaacaaatgttactcgtaaggtatatggtgaggctggacagacaattattgtaactccagatggtaagacaactggtgacggaactgaagaaagtccattagatattaatacagcagtttcatatgcacagccaggacagactattcttatgaagaatggtgtatatgataaatggattacaattaacagaagtgtatgcggaacagcagataagccaattaatcttgttgcagaatcaatctcaacagatggaactgatggtgttgtattgtcaggcgcaggtcttacaataatcggaagttattggcatgtatatggtttatatgtaaaggattcatcaggggtaggtattcaggtaagcggtaactataatacaatagatatgtgtacagtaaatcatgcggcaaacagcggtattcagataagcagaaatggtggagctgataactatgcaggaattcagggtaagttatggccaacaggaaatcttatcaagaactgtgagtcatttgataactgtgatgcaggaagaaatgatgcagatggatttgcagcaaaattaacatgtggtgaaggcaacagattctatggttgtatatcacataacaatattgatgatggctgggatctctatgctaagtcagtatctggtacaattggttcagttacaattgaaaactgtgtagcatacaacaatggatggcttacaacagatgatgtaactgcagcaggttataactatggtgaaggtaatggatttaagttaggtggtggataccttaagggtggacataagcttattaactgtgtttcatttggaaatcatgcaaagggaataacaagtaacagctgtcctgatatctctattacaagatgtacagcttataacaatggtaatgcagattcatatagcataggtcttaatacaatggattctatgcttaaggagtggaaggttagcggccttatatctatgtctaaggcagatttaactgctaaggcagaccttattccattctcacagcacggagatgataactacatttataatggttcagaatcatacaataatcttggtcagaaggctacagatgagtggttcgaaagtgtagatacaacaattagaccatcaagaaatgcagatggaacaattgatatgcataatctcttagttattaagagcggtgtattaagcgataatgttggtgcaagacttgatacaacaagtgaagaagcaataagcgttaagccacaggctggcgaagttgtatctcatgtatttgagtggacaacaactaaggaagcaacatgtacagaaaagggtgaaaagcatggaatatgtacagtatgtggacatgaagaaacaagagaaatcgaagcccttggacatgaatttgccaacgagttcacagtagataaggaagctactactacagaagaaggctctaagtcacagcactgcttacatgcaggttgtacagagaagactaatgtaacagttattcctaagcttacagcaggcagcgaagaggttaatccaacaccttcaacacctgataataaggatgatgcaaatgttccatcaacaggaacagattcatcagagaaagcacctgcagcacagacaggagatacaatgcatgcagtaccatttgtattggcaatgattatctctgcaggagtagttgttattgagatttctagaaagaagaaagcagtaagataataacagttaaacagataataataatggctggtgatatgagtgaatcatatcaccagccagtttttatataagcatttttatctgtaattctgcagagtaggtgttgaattaactccaagaggagttgtgacaccagcagcggttgttactttgtaagtaattgtaatgttcgcaccaggagcaattgagttgccaaacatatatgcaacatcaaggttgtggtaagtacctgtatacattcttccgccattgctagtttttatatctgagattgttccaccagcaggagcaaatatatggatataaccagtgattgttccgccgtagcttccaagtatataatttccagcattaactttgtcagtattgcttaatacattgctataagtagctgttacatcatatgttcttgtgccatcatcattaacaaccggttcaccgatttcagtatcaatatctaagaaccagccaagcttacaaggatcagaaatgctaaagtaaacaccggtttccggattttccggctcttcgttaagtccaccggagcagcctgcatttttaacaagttcctgttcttcctcatcttccatccacatcatgactgtacggtttttagcaccgtctgagaataccttataataatcaccagccttcttgacgtcaaaatcagatacaagctttgacatagtagctttggctgtttctgcaaataaatcatcaacataatctccagcagtagcagaagcatttgcattaagatacttgtaataaaggtcatactgcagaacctttgtagcattttcacttgttaattctgtgccatctgaaagtgttacattacctatatattcaagcattccctgaataatagctggtgtgagagaaacaacaccattaacgtgttcggaatttttctgttcgtatgcgagtgcccatatatatgcaactctttcaaaatcagggtcaaaacatgcatctcttgggccgttcatccatgagccgaaaagctctttttcttctgctgttatattagcagcggaaggtgtataggaagcgagaaccttgtatacactgctgaaatcaccaattgtaagtaccccatcacgaatgcggattgtacctatagaaccagggaaaccgccagaagcacggatttctgatgaattctgtgcagcaagcagatatgttctgtcagagccgtctcctataaatgttttgaatagaggaaggaactctttgagattatcatatgaacctgtcattgaagcaatctgtacagaatagtctgaaatcatgctgttgagtcccattgggagatcaacctgattcattgctgtaactatatggtctatcttaggctctatatcttcaagaagtgaaagatatgcgttgatagtggttatgctgaagccatcatcaactttaagtcctgaaagcggatagtcattaagtacagcaactgttggacgtgcaatatctgaggaagcttcctgaacgagatcaagaagttctttgacagaatcaatatatcctttgaatttagggattttgtaagctgtcttccatatttttttgtcaaatgttttattaatatcttcaattgctacatcaagctggtcacatgcagtttctgtggcaacagggtcctgtgctttaagtccagccataacatttttaaggtcagccttaagagtgtaagcctgttgtttaacatcagcgacctcgcgtttagcaatcttgtagccataagcaccgccaacaccaatggcaatcagcagacatgcgacaatgctcaaagtaattataagtatgcgttttctgcgcttgcgttgcttagagtgtctatgtgaaccatgatgatgtgaactgtggtgtgattcatcagagtggtgatgcgaactgtgatgttctccatcagaatggtgatgtgaatgatgtgaaccagattctttagaatcagaatataaaatttcgaaatcttctgacatggaatcctccttttgtttggattattttgtaaatatgtgtatacaaacacaactccacattttaacagatgtttaaggtatttacaataatagccataatatcttataatattttaataaatttattaaagaaaaggatatcagatatgagtttacttacagtaactggacttacacacggatttggcgacagagcgatatttaacaatgtgtctttccagcttaacaggcttgataagattggattagtgggagccaacggcgaaggtaaatccacatttatgaatataataacaggcaagcttatgcctgacgagggaaaggttgagtgggcaaagaatgtcagagttggatatctcgaccagcatgctgtgcttgagaagggcatgacaatccagtcagtgcttgcatcagcatttgactttctgtatgacatggagaatcagatgaatgagatatatgccgggcttggcgacgcatcaccagaagaaatggacaagctgatggcggaagcgggaactattcaggaccttcttacaatgcatgatttctatatgatagatgcgaaggttgaggaagttgcaagagcattgggactatcggaacttggacttgataaagatgtaactgagctttcaggcggacagagaactaaggtactgcttggaaagctgcttcttgaaaaaccggacatccttcttcttgatgagcctactaactatcttgataaggagcatattgagtggcttaagagatatctgcaggactatgagaacgcatttatactgatatcgcacgatattccattccttaacagtgttataaatgttatttatcatatggataatcaggaactgaaccgttatacgggtgattatgataatttccagaaggtgtatgctgtgaagaaggcgcagcttgaggcagcttacaataagcagcagcaggagattgcggagcttaaggatttcgttgcaagaaataaagcgcgagttgccacaagaaatatggcgatgtcaagacagaagaagcttgataatatggatattattgagctggcagcagagaagccaaagccagagtttaatttcaagacagcgagaacacctggaagatatattttccagacacacgaccttgtaattggttatgatgagccgctttcaagtccgcttaacttagagatggagcgaggccagaagattgtgcttacaggtgctaacggtatcggtaaatctacattgctaaagagcatattaggacttattaagcctctgtcaggtgatgttgagcagggagattatcttgagataggatatttcgagcaggagactccggctggaattgaaactacatgtcttgaggagatatggcaggaatttccaggatatacacagtatgaggttcgttcagcccttgccaaatgtggtcttacaaccaagcatatcgagagcaaggttaaggttctttctggtggagagcaggcaaaggtgcgtctgtgcaagctgattaaccgggagagtaacattcttgtacttgatgagcctactaaccaccttgatgtggatgccaaggatgaattaaaaagagcccttatggcatataagggcagcatacttatggtctgccacgaaccagagttctacgatggtcttgcgactgatgtgtgggactgcggaaagtggacaacacgtatttaatcattaaagtactcagggaacattttcctgattgcatcaatattttcagaatatctgctcatatgtctctgtgatatatgggcagctttttctttatctttcttctcgatggcggctacaagttctccatggtctttcaggattctacctgtttctttgcatctgaaacttaatattgtagttctgtcaaaatgtggtgccatgctttctacaaggttgtaccatacagttttgccacacattttatacagacttccgtgaaattctttatcaagtgtgaaaatcttttcttcatcaccgcgtttgatatacatttcccataaagctacattttcatataatgaatcaagctggttctttgtcagtatatcgcatgcttcaactgcaagctgtgcctcaagtacacagcgtaagtcgcggagctgttctacaatatctgaattaacatatgatacaaatgctccaattttaggctttatctctatcagttttgactgtgcaagttctaattctgcttcgcgtaaaggattattgctgacattcataagtgagcagagttcaggtgcctcaagcttctgacctggcagcaggttagtgtggacaatgttgtaaataagctgtctgagtacataatctttagctgcttcaccttctgatttttctgtaatatttaacataaatacctccaaaaaaatgttaatgatatatattttatagcacatttttattaaactgtcgattttttaacatttgacattttgtaatatgtcagttgttaaggctacacttatattttcaattgcaacatatcttgatgtaattcttaatcctttgatgtgttttattacagacagtttttacagaactaagcttggaaggaagtttggacgaagaagattctttatacttacaggtattccgcttatgcttcttcatcggaatgcttggcaaggattcaccactgccattcttctatacaggtgtaagattgtcattgacgagcttgacagagtccatgcaggtggtagaaaagaggacgtttctgaggaaacaagaaatgtaattgagaaattaacaggtatttcatatgacaaatgttttggtaacaataatattggttataaggaatgagaaattgaataataattgataggaaagcccatagaagcagattctatgggcttttgtgttaaaaaatcatatcagcatcataatcagatataatctgacacatacggaattctatggaaaagtatgtcatccagatgttcaacagcttcatctgatgcctgtatcttgtccatgacgtgaagcttttcagcagtcttgtaaccaagcattaatgtagttaatgtgccgattgacatggatacttcgtaatcaggctgctgttcggtttcaatacattttccattatcaaaaaggtatgtaaagtaaccgttgttccatgcaaggaggtcatcttcaatgtagaagcgtatacatacagaaggctcgtccgggtcgcatgcatatttggcaaagaattgtctgatatcaataattcgacccattgtgtatgggcggattgtctctttaatatcgctgtcatcaagttcaaatgcgattggctcactgtagtagttgtttccacggacctcgtcaatcattgaatcgtgggcatgtatgaattcccacaagccaagctgtgcctcgcggttaagataaatcatttctttaacatgcatgacatcagaacttatcatgtataccatatatccgtaaggaacatcgtccttagaataatagatggcaacagaagtgtcgtcctcgtcccagcgccagtattcttcccatgcaaggttgtttctatatagacagccatgtgtcttttcagcaaatttggtatgaagctctttaaattctttgtcgtcccatgaaactcgtctgacataaccaggctcattaagctttcttggaatctgtgtatccttgattgtataagtcatcttgttagagataatttcccagccaagaccacggtataatggaattgaatatggatacagcaaagcaaatgatttgtgagcatctctcattcgtataaggctctgaatcatcagtcttttcataattccatgtcctgtgtattcaggataagtacatacgcttgtaacaaagcctacgctgtatttaacaccgtaaatgttcatatcaagtggatacaccgcaaactgtgcaatcagatcattaccattgaagcagccaagtacatcagctctttgaagaactgggaatttggactgggtaatctcatcatccttccagcctgtctcagcaagctcctgttcagttacctgaaaggcatatcttaaaagtgcattgtattcttcagcgtcatctatagtgagaggacgcagtgtataattgttttcatcatttctgctcattgcgtttgttccttttctgtatgcgcgttttttgtacataatatagcactgggggcggttgtggtcaaatacggatgaatactatacttaataaaatatttatatatgatatattgaatatgatataaaataatgataatatacatatacaattacatgagataattttgaaatagattgacaccgtatatgacaccatatataatatagatagggggtatttgtaatgtccaaatgggataaattattaatgagaatatctaatttatcaaaggatattcgttttgatgaattaagaaaagtaatggaaagctatggttataaaatgaatgcgccgaggagtggaagcagtcattatacatttaggaaaccaggctgtcagctaattacaatacccagacacgaaccaattaaaaaagtatatgtagagatggtaaaagagattgttgaaagtgaggcaatgaataatgaaaacgcttaacgattatatggcaatgaattatcgtatggaaattatagaggatagagaagaaggcggatatgtagtttcgtatccagaacttccgggatgtcttacatgtggtgaaactattgagtcagcagtagcaaatgctattgatgccaaaaaggcatggttagaggcagctttggaagaaggaatagagatacatgaaccggatagcttagacgaatattcagggcagtttaaacttagaatacctcgaagtctgcatcgttctcttgtagaacattctaagaaagaaggaataagtatgaatcaatattgtgtatatcttctttctagaaatgatgcattatattctaagtaaaaaggaggcacacatgtcaataaaatcagaagcaaagctcaccacatttgaagcaataagcatgattgtaggaaacagcattggaacgggaataatagcagttccgtatcttgcaacgaagaacagtatgattgatgttatctggatggtaggagcagcttacatcattaatgtaattctacatcttataattgcggaactttcgtataacaacggtggtgtacagcttgtaaaaagctttgagggcgagctgttccgcggagttatgaagaaggtattcagctggattgtttttgtggtgtatgggcttgcgattatgataggagtgagcggcaatattaacggtggggcacagatatttgtgaactggttcggactgccgttatggctggcacaggttatatattatgtgattgccggaattgttgtattcatgggaatgaaggcggtaggaattgcacagaaatacgctgtaatacttcttatgggaatagttgcagttatgacagtaggaacatttacacatccagttaatggattctatacagcatctttccattggaataatctgcttgcgctgtatagtatggttgtatttgcgacatcagctaatcaggcggttattcaggttgttaaagggcttgacggcaatccgggtaagataagaaaatcaatattcataggatttggtctgtcgtcagcgttcgtgcttgttgtgacactgactgttcttcttggaactaagggaacaatagataaggaacttgcttatatgcagcttggagaaagcatcggaaaatgggcagttattcttgcaggtatcttttcgctttttgcactacttacaacattctggagtaacacacttgctttaagagatgtcgtgcatgagcaggttggaatcggcaaccgtgtaagctggcttatagcgacagttccatgtatattatttgcaatattcggagtaagcagctttataatacttacaagaattatgagtggtgtagttgtactggtgagcataatgctcgttctgacatatggtaaatcaagaaagaaagcaggagccagtcctatatgcggagtgataggaacgctgccatttcagatccttatggtagtatcgacgatagtttcggctataggagcattaataccgctcagctaaacatataactggtattaattttagtgccggaaagaaaggcgtgaaagtatgtataaatcggacaatttaaagcagacagacaatgaaacatttacatatataatagataaacataaagattttaagatattgcagcttacagaccttcatctgggatttggttttatatcaagaaagaaggataagctggcgctaaatgcagtaacaaagattattcataaagcaaagcctgatatgatagtgctaactggggattctatatttccatttctgccaaaggcggggacgcttaataacagaaagcaggcgtacaagctgatgaaattcatggacagttttgcaattccgtatacacttgtatttggtaatcacgattgcgagatgggttcgacttgcaataaagaagagcttgcacagatttataagaaagggaaatactgcatatttacagaaggtaggaaagagcttacaggtgtaggaaacttctttattaatcttaccagctcagatgaaaatgttttattgccacttgttatgcttgattctaatatgtatggtgaaggaggctggttttacagcggatttgaccggatacatgatgatcaggtggagtggtgcatgaacaggcttaatgacttgaaaaaatgtaatccggatattaaggcgatggcgttttttcacatgccgcctgcggaatttaaggaagcataccgtaagatgaagcttggtgataaaagcgttttatatcagcacggcagtattgctgagaagaatgagcattttggaatttcaaagtttgaaggaacattttttaacaaagcagtggagaatggtgttattaaatggatgttttgcggacatgaccatctgaatacactttcacttatatataagggaatccagatgacatatggaatgtcgatagattatcttggatataaagatattgataagagttatatacagagaggtggtacactgattacgcgaaaagctgatggtcaggtgactgtaaatatggttcctttaggagctgtagtatctacaagggtaagaggtgtaaatacaccccaaaatgacgagaaataaaaaaggcctacccaaggaagagggtaagccctgcaatgatttgagcaaaaaccatttacatgtctaatataacacacggattataacaaaacaagcaatactttgattgtattagaactttacaattctactaaaaaggtcacaaagtcagtgtttatcagctattcagatagttggacactggctttgttgtgattgtgctttttgaagtacaattttaatgattaagtaaaaagcattaaatattagaattaagtgctacataatcttcattcatatcaataacgatatccttgccgctgttaatcatgaacagcttaacatagttggtaacaaatgcatatccaacggaagtgatgaaactatagtcattatcgaagccctgctcgttagcagcatactgtttgtggttagttatgagataatctaacattctgtcagcagacacaccgcgaccattattagatatcagaggtttgttaatatcgttcttgttttctcttatataattcatgaacttaatttcatataacacatgctcagacatcggttctggataccatgagttatgtggaaatgtaaagtaatcttctatgtaatgtaaggcatagcctaaagacaaaaaagaaaaacagttcattctgccatgtctttcaagacgctgcagccttcttgaaactttattgtaggaagaatcccatgtatgtcccttaatatatgtatgcagaagaatatccggcataatacttccaagtcttaaagcaaaatcatgtcttttcttaagcttaggggtaagtcttttggttacggttacatgtccgtacttgttcattaattttcctttcataaatgctttatatccgaataataaatacgaatataaatagtcctttagtcctataagaaagtaacaccttttaatacatttgtctagcacattatggaaaagaatgcatgaaatttatgtaaatttattttgatagtcaggtaaataaaaaatcttacgaacatattacaatcagcagcacttgtttatgtatatagattttggcacagtttagttctgatttttacaatttataatataaatgaggtcgtacaattcaaagcatacaattgttaaggcaaaggcgcccagtacagcggaatccgctggctgggcgcttttcctgtatatcggacagattgcgggcagccagaaagagatgtagaaaggatggtagttatgggagcaagaattgaagaacatccaatattgggaaaacaagaaaaaggaaggcttgtaacattttattttgatggaaaagaactgacaggctatgagggagaaccaattgcagcggctcttaaagcacagggagttatgatacacagatatacaaagaaagagcataagccaagaggaatattctgtgcgataggaagatgtacagactgtgtaatggttgttaatggaaaaccaaatatcaggacttgtgttactcctttagaggagggtatgaaggtccagacacagtatggagtgagtgacaaaccatttgaagagcagtagatgaaaggaagtgtggatatgaagcgatttgatcttattatagttggtgcaggtccgtcggggttatcagcagcaatagaggcagctaagagaggacttgaagtagttgtatttgatgaaaatgaaaaaccgggaggacagctttttaagcagatacataaattttttggttctaaggagcataaggctaaaataaggggttttaagataggtgaagatttattaaaggaagcagatgaagcaggagttaaggttgttcttaatgcaacagtctgtggaatgtatcaggacaaagagattacagtaagaattggcgatgagatacatcattttaaaggagattcaataataattgctacaggcgcagcagaaaatatggttacatttccgggctggacattgccgggggttattggtgcaggagcagcacagacaatgatgaatcttcatggagttaaaccgggaagcagaattcttatgcttggctcaggaaatgtaggacttgttgtaagttatcagcttatacagtgtggctgtgaggttgtggcacttgttgatgctgcaccaagaattggcggatatggagtgcatgcagcaaaggtagcacgtacaggagttccattttatctgtcacatacgatagtaaaagcagaaggagatgaccatgttaccggagtaacaatagcagaggttgattcatctttcaaattcataccaggtacagaaaaacattttgatgtagacacaatatgtctggccgttggactttcacctatgtcacagcttcttaaaatgtcaggctgtaagatggaggataatccaaagcgtggaggacaggttcctatatgtgatgaatatggaagaacttctattccgggggtattcgttgcgggagatgtttcaggaattgaagaggcaagttcagctatgattgagggacgtatggcaggaatcgcagcagctgagtatctgggatacatagataaaacagaattagatgagaatttaaagaatcttgatgtagcacttgatggtttaagacagggaatgtttgcaccaaagaacagaggtaagcttatagaaaaaacagaggaaggaatcgatatttctacaacacttcttactaaaggatatgttgcagatgatgagattgagagatttccaggtgtgacaagaaagccgggagttcatccggtaatggaatgtacccagaatataccttgtaatccatgtcaggatgcatgtcctaagaaatgtatcaagataggagaaaagattacttcacttccggctgttgatgaaagtgcaacatgcgttggttgtggaatgtgcgtggcttcatgttcaggtcaggcaattttccttgttgacgaaacatatgaagaaggctttgcaagtgttacgatgccgtatgagttcttacctttgccaaagacgggtgacagaggaatagctcttggacgtaatggacagaaggtatgtgcggcagaggttatcagtgtgaagtcttcaccggcatttgataaaaccaatctgcttactataaaagttccttcagaatatgttatgaaggcaagatttttcaagaaagaggcgtaatcctcccctcaccaggggctggattttgctacgcaaaataaggaggattgaatatgcatgaagtaaatgaccgttcaagggatataggagaattcgttccggcaccagatgacgatatgctcatctgccgctgtgaagagattacaaagggtgagataagaaaagctgttcatgaggggatgtggacaatgacagaaataagaagatatttaagaacaggaatgggactatgtcagggacagacctgtgcaaagcttgttaagggaattgttgcaagggaattaggagtatcacctgcaacacttgaaccggcaacaagcagagcaccaatgagacctacagaaatgagaattcttggtaatgaagcagaggacaacaaggaggtgtaattatggcaaatacagcagatgtaattattataggtggcggaattataggtaatgctatagcctattatctggcaaagaaaggcactgatgtaattgttcttgaaggcggcgaccatattggaaatggtggctcgtcaagaaatggcggaggtgtccgccagtcaggacgagacccgagagaacttcctcttgtcatgtacggaataaagaacctgtggccatcactatcagaggaacttgaagttgactgtgaatatcatcaggatggaaatttaagacttggaaagaatgacaaacataaacagatccttgaagggcttaccgaaagggctgtcaaggtgggacttgatgtaagaatgatagatggagatgaagtacgccgtattaatccttatctgtcagatgaggtaacatgtgcaagctggtgcccaacagatggtcatgccaatccgcttacaacaacattaggcttctataagacagcaagaaagcttggagtaagatttattacgggcgaaaaggtaatagaattaaagaagataaaaggcagattaagacaggttatcacacctaataatatatatgaagcagatacagtcgttgtagcagccggatatgaaagtaaagaaattcttggtacagtaggaatagatgtgccaatgagcagagtacttatagaggcgcttgtaacagaagctgaaccacatatgtttgaccagatgttaggaacagcagaagctgatttttatggacatcagacaaagcatggttcattcgtatttggtggttcatcaggttatgaggccgtcaataaggataatggaactccgatatgcagcagtattaccgctccttgtatatgcagaggtattatgaaatattttccagatcttgcggatgccaagatagtaaggacgtgggcaggctgggctgaccagatgaaagatggtgttcctgttttaggaaatgtatcagaggttccggggcttgttcttgcaacaggattttgtggccacggttttggaatagcacccgcaattggtcatgaactggcagatttaatagtggatggaaaaacatctatagatataaatgcattgcgatatgatagatttaaggctaaaatataagtaatatggcttggacttttggtggggttatgaagtggtaatctaaaagtagacaccaacccaattattgtagacattatttatacattttaaaattctcaaagaatttcaaggttgtctttctattcagttatcaaagatctgtatcactcaaacccagtatttatctggtgttttaagtcttatttgttaccgcttaccgcggcgacttgtatataatatcatcaggtacacacattgtcaacaacttttttcaaaaagtttcaaaaaagttcaatttttttcaatcattgacttttaagcgagactgacatggctgcgaaaccgcttgtttgctgactttctgcacatttacattgtaatcagaaagcaaagacctactgttatattcctgtatgcatttttagtaggtgataattcttgctggttgagatattttcagaataaaagcacacgcaaacatccaatacagcttattgcgtaggtctctgctctgaagccatagcaatattataagaaaaccacccactaattatgttatccaatagcttctagtaggcattcgccccataacacagcacccacatccctataacacattcccgtaacacatcttctcattgcaatctgccataacgcattaacacattttctcaatcactcaaatattgacatagtaacaacatcaatatactttcgaagccacttatttactgtcttttttcattatacccattaaataaaggaggtcttatgcgacctccctgattattcctatgcttttaatgcattcttagcttcatctgttatctctctctgataagctatctcattttcaatatttcttgcaacctcattagcagtatatgctgcatctattactttcttaagcacatttccaacatcatctgctttttccttctgctttgatgaattatcataaatattcttcatagctgtgaccgtttcatcaaccgaagtctgaacttttgtaattgtgtctgttatctctttggatgacttagcagactgagctgcaagatttcttacctcactggcaacaaccgcaaatcccctgccatgttcaccggctcttgcggcttctattgatgcattaagtgaaagtatattggttctgttagatattgaactaataacagctgcaaattcttcaatcttcttagacaaagcttcaagttctttaatcttagctgaagactcctccacaactttattcattgactctatcattccaagaatctcttctacacttgacatgctttccttaaccagattaagagatgtatctgacgaattaataacatcaaatgcatctttttcaagcttttcctgtgaatcatcaagtccattaagaatattggtgagattattcaccattgcttcgttactcataagtaatcccccatcctgtgtattttatatcagtttaattgcttcctgaacattattaacaccaattatttcaattttatcattcttctttatatttttcaagcatacacccggcaatatacatgttttaaaaccaagcttaacagcttcattaactctctgctgtgcctggcttacagctctcacttcacctgcaagtccaacttcaccgaatataactgtcttttcgtctatcgccctgttcttaaagctgctcacaagtgccatcacaattcccaaatcaagtgctggctcacttactttaattccgcctgcaacattcacataagcatcgctgcctgacatatgtatacccgctctcttttcaagaactgccataagaagattaaccctgttatagtcagtacctgctgcagtccttcttgccattccaaaattagaatcgcacaccaatgcctgaatctctaccattatcgggcgtgttccttccagaaggcatacaacaactgaaccagaagcattctctggtcttccgttaagcatatattctgatggattctcaacttccgacagaccactctgctgcatttcaaatacaccaatttcattagttgagccaaatctgttttttacgcctcttaatatcctgtatgaagcatatctgtcaccctcaaaataaaggaccgtatcaaccatatgttcaagcattctcggtccggcaactgatccttccttggtaacatgtcctacaataaaaatagtaatattcagcccctttgcaagctgcataagtatggatgttgtctctcttacctgcgaaacacttcctggtgctgctgacacatcttctttatacatagtctgtatcgaatcaattatcacaatctcaggcttatttcttgtaagaatatcttctatgctatctaagcttgtctcacataataacttaagtgttccactgcattggccaattctgtctgcccttagctttatctgcttaagcgattcttcaccggatatataaagtacatctcttcctgctgctgacaggttgtaacacatctgaagcagaagtgttgacttacctattcccggatctccgcctacaagcactaaagaacctgcaacaattcctcctcctagtaccctgtctagttcagctatgcctgtggatgtcctgtcattctcttcaaagcttacactgtttatctctataggaacaggagctgatgatgccgctgccctctggcttgtgcctgctattcctttagctgacttaggtttacttactggttcttctacaaatgtgttccattccttacacgccggacactgcccgaaccatttagcagactcataaccacattctttacaaaaaaaagctgtattctttgcctttgccatatatccccctaaaaaaggctgccacaacatataaatgtgtagcagccctgtaaaatcaaaatacttttaattataatcaagccttcttaatatctactttaacaggcttgtcaccatcaaattcaaccgaaagaacaagctttccacccatgttagtagccattgttcctgcctctttatcgttaattctgatatcatatgatgtaccttcttcaaggcctaatgtaatctgtgcatcttcattaccttctaccataaatgatacacttgtatctgttgccttaaaatcattaactgctgtacctggaacagattcatatacaaaagagccgttcttctcaagctttgtgatttcgttaaatgtcttaaccttgtatgtatctccacaatgttcgaaatctggcagctttgacttggtatccaacttataattaccaaaactgattgctccatccgcttctgaacgaatcaattcatttactactggcatattattatcctcctatatgttacgatatgtatgtactgattatacaataaactgacaaaaagcgccagcaatttgtcagttgtttattgtttatttattaatttatttgttcattcctctcttgagggtaaagttaagcttattgtcctttacagttatctttactttattgccagcgtggacttttcccataagaatccgctctgcaagaacatcttcaacctcattctggattgtacggcgtaatggtcttgctccgtatttggaatcatatcccttatcgacaagccactgtctagctgcatcatcaagctctattgataatttcatctgttccataatacgcttattaacattggcaatcattatatcgacaatctgtgctatctgctcttttccaagaacatggaacactactatatcatctattcggttaatgaattctggcttaaatattctcttaacctcgtccataaccttgcccttcatctcctcatgattctgctgttcagtcattcctgacgagaatcccagtgatttaggcgatacaatattttcagctcctgcattactagtcattataattatagtattcttgaaatctataaccctgcctgttgaatcagtgatatgcccgtcgtcaagcacctgtaaaagtacattaaatacatccgggtgggctttctcaacttcatcaaaaagaattacagagtatggatttcttcttaccttctcactaagctgtcctccctcatcatatccaacatatcccggaggtgaacctataagctttgacaccgtatgcttctccataaattccgacatatcaactcttataagagaattctctgtaccaaacatagcatctgccagtgcctttgaaagttctgtttttccaacacctgtaggtcctaagaaaaggaatgagccaattggtctgtcaggatctttaagtcccactcttcctcttcgtattgccttagcaacagctgcaacagcctcgtcctgtcctataaccctgttgtgtaaagtttcttccagtttcataagacgctcagactctgcctgtgcaattctctgtacaggaatctttgtccatgtcgatacaacagaagcaatctcatcttcatcgacaataagattattcttattgatactatcctgccactgctttgtcatcttttcaagctgttcttttttctttaactgtttcttcttaatttcaccagcctgctcataagcttctgactttattgcttcttccttatccttggtaagctgttctatctgtgcctctaatgtcttaatctcatcaggcattacatatgcatcaagccttgtcttagaagatgcttcatcaataagatcaatagccttatcaggaagaaatctgtcattgatatatctcttagataacttaacagctgcaactactgcctcatctgtaattgtaacatgatgatgctcttcatacctgcccttaaggcctcttaatatctgaattgcctcttctgccgtaggttcttcaaccttaacaggctggaatcttctctcaagagcagcatccttctcaatatgttttctatactcctcaagagttgtagcaccaataagctggatttctcctcttgcaagagatggttttaatatattagacgcatctattgctccctctgctcctccagcacctattattgtgtgaatctcatccagaaaaagtaatacatttccagcatttttaacctctgctattaccttcttgattctttcctcaaattcacccctgtacttagaaccggcaaccatacctgacaaatctaatgtcagaagacgcttgtccttaattgtctcaggcacatttccttcaactattctggccgcaagtccttctgctatggcagtcttaccaactcccggttcgcctataaggcaaggattattcttagttcttctgctcaatatctgaataaccctctgaatctcttcttccctgccaataacagggtccaatctgccttctcttgccatctgtgtaagatccctgctgtactggtcgagagttgctgtgctttttttatcattccctcttggtcttccattctgaaaatcttctttaaccctgccggcatcttctcccatagccataagaagatcaacatacatcttcttgacaggaacccctatagtattaagaagccttgaagctacgctgtctgtttcttttattattgctattaaaatgtgttctgttcctataagctctgacttaaatcttgctgcctctcttgctgcattatcgagtatatgtctaacccttggagtatatcctgatggttctttgacattaactacactatctggtgctataagctggcacacaagattaattatcttctcatccgtaatatcattgctaagaagaactgaagatgcaagtccgccctccgctttaataagtcctataagaagatgctctgaacctatataaccatgacctaacatagccgctgtatctgccgcataattaagtgcctcctgcgctttgctggtaaatctgctctgcatatctataaccctttctatgattgatttcgtaaatatctgttaatgtattgttggaagatgttctcttataaaatcagctcgtgacacttccagttcctcttcattcatatccttgttagaaatcataagaagatttgccggatgaattccaatcataagctgatatatattactctcatcaaatccgtcagccttaataagccctgatgcaagtccgaatcttatctgggaaagcagcagttctccatcattaagtgtaacctttctggcatattttaacacaccatatgacctgtacaccatatcaagtgctgtcatttttctttttgtaatatactgcttcctgtaatttctttcctgtgcaataatctgttctgctatattatccagattgtcaattatatctttctcactctttccaagtgttaccagattagtaagctggtatatatcacctaaagctctgttattgtcaccctccattgcttttagcacaagtccgaatcttccaacctcaggaatcagccctgatattttatcatttcctgcaagtgctggcaaatgtagcatataacttgctctcattcctgtacctgcattagatggaagggttgtaagatagccaaacttctgatcatacgaatagtcaagtacatctccgataacatcatccatcttatcagccagtgtataagctttctgcatattcattccggcagcaaatgcctgtattcttatatgatcctcttcattaatcattattgacacatcttcatcaggtgcaacaaatcctgctgcgtaatcctgcttttcaagatacggacttataacatgtctctccctcatgcccatcttctgataagcatcaagatagtcaaaattatatgaattataaccgcttattggcgatattgtctttaactggtcagtaacattttttaccagctttttagcatctgtgtctgacatcttgtaagaaaaattatatccattaatattacgggcaagccttactctgcttgatataacaacatcagagttattgccgccctcttcaaaccatctaagcatcgtgaccgcctccctgtgttgaatcatccgtattatccattttctttaactggtgaatcatgtcccttaatctggctgcctcttcataattctctatctcaacagcctctcttaactttatccccagttccctgatacgactttcataatcatcattttcatcctgcatgactggcagagtatctgtctcattattttcatcagacagccctgagtatttcttatatatctttcccctatgaactgaatctccatgcagtcttttcatattatcctcaataagaggtccgaataccccatagcactcagcacaaccaaatttaccaaccatagtaaattcatcaaatgtcattccacagcctgggcatctgatatgcatcataggtccgtcttccacctgggctgaattaccagccagcagacccgtcagaagccttacaaatggaaactccgcatctgaactgtctgacattcctgcaaaattaagccttcttgcacaatccatgcatatatggtgttccttcttaactccgttaattatttctgtataatgaattgaagcttcattctgatgacaattctcacaaagcatattattcctttccagtcaggaatcacattcctgctttattcaaatactctcatcttagttaaagcatagtaagggccaaaatatgttattaatgcaaccataaaggctattaccagtgccagaacattagatgatgtaagtgtatacattcccttatatgaaagccatgtgaacacgcccattataagtgccgatatacctggttttgcaaatacacttatatacggcatcgtataatcaatctcctgatataaggttcttagattaagtataaatattaatattggaaatgttgcattacctataaccactgcatatattcctagtgccgagaacttaagaagcacgaataccagcacaatatgaacagcaagtgatatagatgaatgaatcattggtacatttacacggtcaattccctgcagtgctgtacttgtaactgtagagagtgtatagaatactaccgcaatcgcacctatttttaacatcattccgccctgagcgctgttatagcgggaaaataacagctttattataggctgacctataacaaacagccctacaaatgatggaacagcaataaacatgttagtctttaatgtcttagtaatcttatcatatatagaatcataatccctgtctgtaaatgatgcaacaacgctaggcagcatcgaagcagacattgcagatgcaaccccctgtggaattcctataagcaggctgtagcttgaactgaaattaccaagatccatagatatgctcttagtaatatctcttccaaccattatattactaaacattacatcgtctatcaaagcacttatctgataaaatgtctgtccaagtataattggtatcattgtatatatgattatcttacaaatctgccctgtgctctggttctctgtatgtctgtcttttcttttcagtctgttaaatgtcggtgtatataccgcatacaaaaatcccatgaataaaacagccgtaagtgctcccatagcagtaccaagtgtacttcctgccgcaccatatgctgccacatcaggtgatgaagcaaatgctttcatcattccatatcctgctgcaatactaacaatcgcattaacaatctgttcaagtatctgcgataccgcagttggaatcattgtactctgtccctgaaagaatcctcttataaccccaagaattgcaacaaggaatattgtcggtgcaagaatccttaatggaaccgcaagtcccggaagccctcctccatatataacattctctataaatgaagcgccaaaaaatacaagaagtgctgcgatacctcctgtacacactgcaaccattaaagaacatcttaatactttagcagcacttttatatcttttctttgtaaatcttgctgacacaagctttgatacagccattggcagtccgtacgaagacaacacaagcattatattatatatgttgaaagcagctccatatataccattgccttcacttcctataatgttaactacaggaattctgtaaagcatgcctattatcctgacaagaatacctgcaattgcaagaatacttccatgaactataaaattacgtttattagactccgacatattcatctccaaatcttatgtaataattgttttcgaattagattttacatcttatatacaataaaatccataaattttttgttaaaaaagccgttccaaccacatacgattagaacggcttatatttttatattaattaattaagaaatcagccagcatccatgtaccattctgttttacaaatgtatatgtaagcgatgttttatatgttgtattacctgtcttgtaatcaacataaaggtcataataaacatcacatgagaaacatttgtctgaatactttctgaaattagtaatagattcattgttgaactgataagtatatgacttaccccaaaggtacgcccatatagcaggaatatcactgacatactcagctgcagtaccaaccatatagcttgaaagcttagaaagacttcccctgttgataatataagctccatactgttccgctattgtatatatccttgattccatacttttatacaattcatcatccgatggatagtaaattgtatatcctgtcttcttgtcataatcaactgtcagatctttaccattaagctttgctgttatatcaggctttgctataagctgtcctacatcatacacatcattagttggtaccgtaacataatctgatacatgcagacaaggtgcaaacttaacttctgactctgtcttgtatgtatcagtaacctgtactccattaatataaacatcagcacctgttggagctgttattttaacttctgcaaggttctttgtaaaatctccaaaagaaatagttccaagagtccatttattaaatttatgtgcattctttcctgccgattcaagttcaacctttgctatcggcgtatcacctgcatatactacatacacaggagttttttcagaatattcaccagcctttttcttatatgatactgtaccgtcatttaatctatctgtaaaatatgctgctatcgtatcattcgtttcaaactcatttactttcacgtcattatctgataaaagctttccaatcccatcaggagtaaactgattcacaatcttatccattgttcctgatggcattccctcttcataatcttttaaaagactatgaagcataattaatgtaatcacacctgccagaagaagaattccgcagtatatacataagaattttttaaaatttgaaagcttcttttttcttttattatttcgtggcatactacttttctcctccttacttaattaaaaatgctgtcggacagcttcttggacctgttggtgaatatggtacatttattacttcaccatcataatacatctgtgttgatgttccaccatccattgtagatgcatttacagctccatactgtgccataatatcctgtaggtctgaaaatgtagcacctatactgttaggctgtcttccatctactgcaagaagaagaatctttccatctgctgtctgtcctatggcagttcttggattagttccccctgcaataccaacaatatcctgagcctctccattaacaataagaaatggaccaatatgattgcttatgcttacgcagtctcttatattaagttcctttgcctttgcagcattcatattaccaagaacaagcttattatcaaatgtaattccagtaacatgagatgttccaccattatcattaagaatctctccgtctttcattacaagaccaatcggcattgctgtataagttgtttctccatcaacaaattctccgccattaactcctccgattgcatcatatctctttgcaatatctgcaacaaccattccatttccattggtaaattcaggaactgttcccacaaataatctgcttggatcttttacaatcatgagttttccagaatatgtagcaccctttacatctacaatctcaatatcaggagtttccggatcctgggctgctgtatcaatatttacaagtcccgcatctgttatctcatctgtatctttaattgcgttattggccttaatctggtctatctcatcctgagagcagaaccagttagcaagaaatcctattgcacttgtctcctgtacagaaagtacaaactgaatctttgctgtcttagacggtccatacacaagcattgccataacagcatacagaaatatcaccagaataagaatagttgacaaaagtgtcgcaccgactcttcctgcccatacaagaactggattcttctttttatttttatttcttttattagatgcgttgccacctcgtggcttatcgttaccatacgactttttatcttcatagctgtcatctaaaacgtcaaatggatcaaaatcatcaatatcttcaagttcaaaatcatcaacgatatctatatcgtcaatattattctttctttttgccactataacttcctcctaaaccgttacttaaaaacccatcttttctgaatctgataacttacaaagaacaatgcaagatcaattattatcttggcaattcctgaaagcacaatgcttaatgccagcagctttgtagcaatatacaccaaagcataagaacaagcaagctgacagaaccataaaatgtaatatcttaccaccgtctgtttaagaccggactgtgatttaaatactgcatttctgttaagcgagaaattaaaaactgatgaaagcactcttgccgctgctgtacttatgaatattcttaagctgactgtaagccctataagcacaaattcaagcacattaaatattatattatctatagcccacgaagcaatagagcttcctacatatttcatgcctgtgcttttaaataaatatttaaatatcactttgtatatcttaattgaatctttgacaggattaaaatgtgatgatgaattatcttctatgtacacagtttctatcgattcttcctgaaatccaatattatactttttgaaagcaagcagcatattagtctcatactcaaatcgttcgccttctaccttgtcaaatgtctcaaggtacttgtaaggtattgctcttaagccggtctgggtgtccgaaatattcaatctgcaaagcaccttaaacactccactagtcatattattaccaaatttacttcttgccggtacatcatcaccagtaaaatcccttacgcctaaaacgacattgcctgtactgaccatagtttcactgcatttcttaatatctttggcacgatgctgattatcaccatctactgtcacaactccatcaatatcttttctattctcaaggcagaattcaaatgcagtcttcaagcctcttccttttcccttgttaacttcatgtgtaagaattgtacattcactatgtgctgctacttcattaaaaggagccatatgttcctcatcacttccatcattaacaataatgatgtccttaaagccttcctcaagtaaagcatcaactacagctacaagcttattatcaggattcagtgacggtataataaccgatactttcataatattcatcccactctttgctaatatttatagtgcttttccatttaaacgcaccgtatttagaatataataatttcctaaagattgcaataaaaatttcatatactgtgtaacagggtcatgctgtaagccataatattgtattgtagattaattttggaggacttttacatgagtgatttagcagcaacaaactgcggaggatgcggaggatgtggagataactgcaattctattgtatggattatcattctccttctcctctttgacggaaataacggatgtggatgcaacaatggttgtggaaatggttgcaattccttctggattataattctcctcttcttctgctgtggatgtggcaatggaactaacttcctcaatggctttggttgcggatgcaacagcggatgtggatgcaacagtggatgcggatgccagtaattatttaatatggggctgccttaaacggcagcccttatatattaattattattatgttccatcatacattttccatctatttcatatatggtattctcttcttcaacaagtatattgccattgtcctgaacatccatattaattaccatatcataattccttttttatatattatatgggcttatttattaattgctaagacttacaggaataattaagacatataacctaatatatatagaataaaatattccgccgagagttcacatgaaagaacttcccataacagaatttgatatgcagacactgccacaattcatacagcttgccaaagcaattcttccttttatggaatttaatacccagcagacacttagtcctctgctccgtgcatatgaattttcatgtacaatgaactattacagccgtcctgaaagccttcgtattgcggcatgttctgcaaagccccacctttcattaaacagtccaatacaggatatactttcagatgaaaatatcatgaatgttattcttacttactgtccagacaattttaagaatatccttagtaattttaagaactataacaaaatgtccgatttgttcaacattttaaatcgtgatcagaatggcagtaatagttttcttaatcctgcccagcaaaaaatgtatgaagcttatacagaacagttaaacaatcttaatctttaatatttggaggactttatgtcagaattagattttagaaagcagcttcttctcaacgaattcaagactttatcccagggaaagaaaaatgatgaaatcattcctcttcttttcgctattaatgataaagctaaaaaatccggtataaccttcacaaaagaagattgtcagttagtaatcaacagtatgtctgggcaattaagcgaaaaagagctcaggcttctgcctgagcttctctctcttcttaatatgaattaatgttttattattcttaattattttgcaacaatattaacaattcttcccggtacatatatttctttaataatgttaccagaaagcctgcttccaagtgcttccttagcggcagcaattacactgtccttgtcagcatccttggcgatattgatagtagccttagtctttccattaatctggactgctatctcaaccgttgactcaactgtcttagcttcatcgtattcaggccatgtctgctgatataatcttccattctcgccgattgcttcccacatctcttctgtaatgtgtggagcaaccggattaagtaagataaggtatgtcttgagttctcccctagtaatcttacctgccttgctgaaatcattgagcatagtcataagctgtgcaatagctgtattgtatttcagattctcataatcaaatgaaactttcttaattgtctgatgcatctttgtctcaaattccttagagaaaccttcctcatcagtcattatatcctgaagcttccatactctgtctaagaatctgcggcagcccttaacgccatcctctgaccatgaagctgctgcgtcaaatgcaccgataaacatctcgtatgttcttaatgtatctgcaccataatctcttacgatatcatcaggattaacaacattgcctcttgacttactcatcttctcgccgttctcaccaagaatcataccgtgggatgttctcttctgatatggctctgggcaaggtacaaccttctggtcgtaaaggaatctgtgccagaatcttgaatagagtaagtgtaatgttgtatgctccattcctccgttataccagtctaccggaagccagtacttaagtgcttcctgacttgcgagtgtctctgtgttatgtggatctgtatatcttaagaaataccatgacgatccagcccactgaggcattgtatcagtctctctcttagctggtccgccacagcatgggcatgttgtattaacccagtctgtcatggctgcaagaggtgattctccattatctgtaggcatataactttctacctctggaagcagtaatggaagttcgctctcatcaactggaacatagccacatttgtcacaatgaacaattggaataggctcgccccagtatctctgacgagagaatacccagtcacggagcttataattaacctttgcattaccaattcccttttctgtaaggaattcaatcatcttttccttagcttctttaacttcaagtccgttaatgaaatccgaattaataagaacacctgttgctacatctgtaaatgctgcctcattaacgtcaacttcttcaccgttctttgctacaacctgaatgataggaaggttaaatttcttggcaaactcccagtctctttcatcgtgagcaggaacagccatgatagcacctgtaccatagctcataagtacataatctgatacccagattggaacttccttgccattaaccggattaactgccttaagtccgtcaatctctacacctgtcttatcctttgcaagctctgctctctcgaaatctgactttcttgaagcctgctctctatagctttctatttcatcccagttcttaatctcgtccttatacttatcaagatatggatgctctggtgatacaaccatataagtaacaccgaaaagtgtatcgcatcttgttgtatatattcttaacttatcttccttaccagcaattgcaaaatcaacctcagcacctgtagaacgtccaatccagttcttctgctgtgtcttaactctctcgatataatcgacatggtcaagtccttctataagcttatctgcataatcagtaatcttaagcatccactcactcttgaccttacggacaacaggtgaaccacatctttcacatacaccattaactacttcttcattagcaagacctaccttacatgaagtacaccagttgataggcatctcctgcttatatgcaagtccggccttaaaaagcttaaggaaaatccactgagtccacttataataatcaggatctgtagtattaatctctctgtcccagtcaaatgaataaccaattgactgaagctggtccttaaaatgatctatattattcttagtaactatcttagggtgaatcttgttcttaatagcatagttctctgttggaagaccaaatgcatcccaacccattggatataaaacattatatccctgcattcttctctttcttgctacgatatcaagcgctgtatatggtcttggatgacctacatgaagcccctgtcctgatggatatgggaactccacaagtgcataatactttggttttgaataatcattagttgcagcaaaggctttttcatcctgccatacctgctgccacttcttttcaactgttttgtggttatatactgccgacataacacattcctccttaaaaacgcataaaaacattctacacacatcactttaatttgtcaattaaatagccgtctttacattatcgctttaaagtgttaaaataccactattcgcatgaatattaatatttcttacatggaggttataacatatgaagacaaaggttggattcataggtttcggactcattgcaggatccttagcccatgcccttaaagaaagcggcagggattatcatataactgccacaagcagacatttagaaccagtaatcgctgcggttgctgatggtattgttgatgtcgctgctcctgcggtagacgaaacatttgcacagtgtgacataatcctgttatgcacacctgtaattactatcacagaatatcttacaaaattaaaagccattgccagtccggactgcataattaccgacgttggaagtgtcaagactatcatacatgaagcagcagattcattaggacttaatgaccgctttattggtggacatcctatggctggctctgaaaaaacaggttatgagaattcaggttcatcaattataaaagatgcaaggtacataatcacaccgaccaaagaaaccaagcctgaaaaaatcgaattaatgaaacagtttgcatcagatgttggcatgcgccctatcgtcatggattatcatgtgcatgacaaatctgttgctgccataagccatgttccacatcttttatcaactgcactagttcatgtagtatcagataatgatgacgaagaaaagcatatgcagttacttgccgcaggttgctttcgtgacatgtcaagagttgcagcttcttctcctgaaatgtgggaacagatatgtttaactaacagctctgcaatcagcaacattcttgaacagtatattgaaatgcttgaaacaattaaagataacatcgataaaaagaccccaggctatgtcgccagtcttttcgagatgtcaagagaatacaggaattccttggaaagcagacacccagagcactaagccctgggtgtttgtgtttatccagtattaaattgcatctcttttggacttcctctgtgcctatcactactttaaagtccaatttataccaggctagaatatatcatatacaccgttggagctgcctgtctgtggcacaaaattgaattatggcgagctgtgcaggagttaatgtcgctatatacataagttcagtgcccaaaagctcgttcaaacatagtgcgtttgcttttgggcactgtaaaagactttgtagatagcgacatttactcctgctaagcgcagtcatactgaaattttgtgccacagacaggcagctccaatggtgtatttcatataataactgtcctcatcacaccttaaaacagccaccgcctacgaattcccgtaatatagaatcgattggtacgttctcgtagccgcatggaaggaaatagttcatgaacttaagcagtctgtttgcttcctgatattcagggtcagcttctgttacctgaaaaagtataggctcaacgaatggttttaatacgcatggttcatatggcattgctgagttaaacataacatccgcctgctcctggaatgggaagatgttcttctcttcacctcttcttacagactcccacatcgaaagagtcttctttgcagatgctcctcttgtcctgtaatctcttacaagccttcttaaaagtcttccatctgtagttgataccctgttatgttcgtcaacattaagctgtgtaagtgcactaatatatatcttgaatttactgtctattggaagtgaatatgataattcatcattaagacaatgaattccttctattacaagaacatcctcttcccctaactgtaagaaattaccattatattcctttcttccgaacttaaagttaaattccggcagctccactttttctccgttaagaagtctggtcatatgctgattaaaaagttcaatgtctactgcatgaaggtcttcataattgtaatcaccattctcatcaataggtgtctgctctctttcaacaaagtaattatcgacagcaattgggtgtggcttatatccattagccataagctgaattgataatctatgtgaaaatgttgtctttcctgaagaagatggaccggctatcatgatgaatttagtatgcggtcttttctttatctcatcaactatctcaacaattttctgttcctgaagtgcctcctgtgtaagcataaaagaagtcatatccccattagttatatggtcattaagctctccaaccgtagacatgccaagcatctttgcccagcttgtgctttcctttaacacattaaacagctttgtttgtggattaaattcaggaacttcaagaggtgcgttcttaaccggaagctgtaacactattccctcgtcatacaggaatatgtcaaataccccaagcatgcctgtagaagatgccatatatccgtagaaataatctttgtagccattcaggtcatacacattaacaaatgaacttcttctgtatttgaaaagtgatgtcttatctgtcattcctttttctttaaaaagattcatagcatcagatatcttcatcagctctttcttgattggaagatccttctcaaccatactgtgcataactgacttaacttcatctataaactctttgtcaggtctgaagtctccatcaaatgtgcagtacagtcccttgcttaaagaatattcaacaacaactctgtcaatattcctgtctatcttatctatggctgcaagcataagaagaaccacgcttcttctatatgtctcgttacctattgatgtcgaagttgtaacaaatgtaacatcactgtcagggatatattcttctccaagttctttaagcttaccattaacattagcgagtataatctcatccttatattcgttctgcttctctgctgcaagctgtgccagtgtcattcccatagcatcctcctcttacgcatcagtcataatatgacaatgcatccataattatattattcttctgcgaaagctgctgtaatcttaacttaaccgtaggattactctcatctttcttaagactgttacttatcccatcattagtctctttctcttttataagatattcataaagagtcttatctttgttctctaaaagcttccatccgtactgatattgcgtctcactgtattcagaataaacattttcgtctgactttctgcatttgataataaaataatacttaccgtcttccttaagcatcttctcatcatcaacaaccaatctctgtgaaacaagaaaatgtctgaaatctcctacttctgactgcggtgatactataagtgttgtattctgggtaataacattcattcccttagttacaatatcagctataagcctgccacccataccacatatggttataatatcagcttcattcgctgaaagcttttccaatccgtctgaaagtcttgtctgtattctgtcctctaaacaattatcacatatatgcttctttgccttatcgagtggaccttttcttaaatccatcgcaatagcagaccgagctattccttcctgcacaagatatataggaagatagccgtggtctgtccctatgtcagccacgactgctcccttttcacacatatgtgcaactgttcttaatctgtcagatattcttaccatagcttaatcctaatcaagataatctcttaacttacgactgcggcttgggtgtcttaactttcttaaagccttggcttcaatctgtctgatacgttctcttgttacattgaattctttaccaacttcctcaagagttcttgctcttccatcatccataccaaatcttaatcttaataccttctgctctctttctgtaagagttccaagtacttcaacaagctgttccttaagaagtgtagaagctgctgcctctgccggaacaggaacattatcatcctgaatgaaatctccaagatggctgtcttcctcttcaccaataggtgtctcaagagataccggttcctgcgaaatcttctgaatctctcttactctctctacaggaatatccatattatctgcaatctcctctggtgatggttctcttccaagttcctgaagcagctgtctctgtactcttacaagcttgttaattgtctctaccatatgaacaggaattcttatagtacgggcctggtcagctatagctcttgtaatagcctgtctgatccaccatgtagcgtatgtactgaacttgaatccttttctgtaatcgtatttctcaacagcctttataagacctaagttaccttcctgaataagatcaaggaactgcataccacgtccaacataacgttttgcaatacttacaacaagtcttaagttagcttctgcaagtcttttcttggcttcctcatctccttcttccattctcttggcatactcaatctcttcatcagcactaagaagaggtactttacctatctccttcagatacattcttaccggatcatcaagaccgattccatcaggaacagaaagatctatcttctcaatatcaatctcatcttcatcatcaagaataatatcctcatcttcatcaggtacatcattcattcttacatctactttttttagctcaagaatttcaaataccttctccattctgtcagcttcaaaatctgtatcctgaaaatatgtcataatttcctgataatcaagtacattctttttcttcttggctattgcaagaataccctctatcttctcccagaatttagcttcctgtgcttctgcatcatctgcgtcactgttttctgtctcttcttttacttcttctttaatctcatctttcttagttgtcttctttgctgctgctttttttgcaggagtcttcttttctgttgtcttttcttccttagcctccttaacattctcttctaatgtttctaccattttcttagccatttctcttctccattcttcttcgcgtaacacgctctatatatttataacttaatatgaatctgattcagcttctgctgttcaattattatctcctgcatacgcttcgggtctacagtcttattaagttcatgattaaggctgttagccttaattctgataacaatgtcattaagagtcttttctctttccagattattaaggctctcatccaggtctgccgaaaacattgctgcgacttccgtatgttcttctgttgttgcataatcagctataattgcagcagggcttatatttcctgtcccatactgttcatatactttctctgccacacccgaaaataacgggtcaataaaatcctccggcttaatgtaagctgcaaccttatcaaatatgtccctgtcacttatgagccatgtaagaagcattttctctgcctgtcttaaaccatcttcacgcttcttcttcggcttacgctcaacagttggctgcatagtacctgcacctgcatttcttgaaataatccctttctgattaccaagtcttgataccatctgcctcatgccatcttctggtatcataaactgcctgcacactgctttaaggtaattatcacgttccagcttttctttaaatgtaacaagctttgctgcaacctctctttcaaatgcagtctcgctttccggatcccccctgtcgtaatttcttaacatggttcctatctcatacataaagctgttctctgcattatcaattctttcctgaaatgcctctgcacccatagccttaataaactcatcaggatccttatatggccgcatattaattaccttcgttgaaagccctgcttccttaagaatcggtattgctcgaagtgccgccttaactcctgcctcatcactgtcataggttatgagcacattatctgtatatctctttaacagccttgcatgtcccggtgtcagtgccgttccaagtgacgcaaccgcctggttaaagcccgcctgatgcattgatataacatccatatagccttcacatattatcatgttaggctttcttgatgttcttgctatattaagtccatacagattgcggctcttatcaaacagccttgtctccggtgaattaagatactttggcttggcatcacccataactcgtccaccaaatcctatgaccttattattaatatccatgattggaaaaattactctgttccagaacttttcatgaatacctctctcataagtaaaaagtcctgattccttcagaatatcatcatcataacctttgtccttcaacagcttgtacagattacctgttgactgtgttgcataccccagtccaaagctgttaattgtactgtcagacaattcacgctttttaagataatcaagaccggctttcccattctcacttctaagctgcctgtaataatatgtggcagcaatcttattaatctctaaaagcctgtctcttatccctctttctttgcggtcttcttctgacatagacgtctgcggcagtgcaactccggctctttcacctagcatcttaactgcctctaagaatgtcatattctcatattccataacaaatgttatgacattacccccagcgccgcatccaaaacaatgatataactgccgctgtcctgaaaccgaaaatgatggtgatttctcattatgaaacggacacaatccggtatatgaacttccattcttcttcaatttgacatacccggatataacatcaactatatcattccgggatattacttcatctattacttctcttgaatacattacttcatcccttccaggcctttggtacaaagatttcctgaaacttgcttattgaatactgatcactcatgccagctatataatcacacacaacctgctccggtctttcatcaaattctgttataaatctcttatatgtatccggcagtttatctgtgttcgcaacatagtatctgtacaattctgttatcagcttatctgctttcgcttcctcacttttggctgtcggattaagatacagactttcaaacatgaattttcttaattctgtcattgctttacgtacaggctctgacattacaagatcattctttcctatgctgttcattataatatcgctaatcatggtattaagtctttccttggttgaattaccaagaacatcagtatattctgaaggaatgtcactttccttcaatatccctgctcttattccatcatctatatcatgattaatatacgctatcttatcggaaagtctaactgcttttccttcaagagttgatggattgcctgatgttctatggttcaatattccatcacgcacttcccatgtaaggttaagtccctgaccatccttttcaagaaattcaacaactcttatactctgtttgtaatgagcaaatcccataggacataaagaattaagtgttctctcacctgcatgtccaaatggtgtatgtccaaggtcatgccccaatgcaatagcttctgtcagatcttcattaagattaagcgcccttgctatacttcttgcaatctgggcaacctctaaggtatgagtcagtcttgttctgtaatggtctccctctggtgcaagaaatacctgcgtcttatgctttaaacgcctgaatgtcttacaatgaataattctgtctctatctctctgatatattgtcctcatagggcatggttcttcgtctctgtcgcgtcctcttgactcatcagaaaagcttgcatatgggctgaatatcagatgttccctcttttcctgttcctctctaatgttcatctgtatgtgcctcccgcactgaaacactaattttaaagctcacaatttaattattcaacaaaacatgtatttttccttttttatttttaaaaatttttcacaaaataattatttgttattatcatttcccacattatggactaaaaaatccaccaaatgcccccgcagctatacatgcagctactgacatggcaatattattactactgtctggtgcctgtttcttcattattgcagctattaccaataacactgtaatatacactgctccatatataattcctataactactctcctcttttttatcatccatgcactaagcattgcacctgtaaagcttcctgccacatatattccaaatataatattatcaaccgctttctcatcaagtataaattttctcataaaatatgtaagaagtactagcataagcagagttattacatatcctgcaataagagatttaaccatttttcttatataatccattgatttcctttgttgtcctctttttattaattgtatgattaaaaatgttatcttatgattatctcctgttttctttaatagcacttgacggcacaatgtgcgtactgtagaatgaaaagaaatattttaattttatgactggagggatttttcttggatacggatagtatcatccaacttattgcaattgttattttattggttttatcagcatttttctcatctgcagagacttcatttatcactgtgaacagaatcaaagtgctgtctttagttgaagagggtaataagagggctgctcttgtaattaagattattgaccagccggcaaagatgctctctgctgttcttattggcaataacatagtcaatatcagctgttctgcattagctacatcatttacaatcagtgtatggggtaataaagcgacaggtattgttaccggtgttcttacgcttcttgttcttatatttggtgagattacacctaagaatactgccaacatgtatgccactaatatggcaatggcttatgctcctataatatgggtgcttatgattgttcttacacctgttatattcatagtagaccaccttgcaggcttcttcttatggttattaagaattgacaataacaagaagaaagatatatttactgaggatgagatacgaaccattgttaatgtaagccagcaggaaggtgtaattgaatctaacgaaaagaaaatcattaataacctctttgattttggtgattcaacagctaaagatgttatgattccaaggattgatatgactcttgctgatgtcagctcatcatatgatgatataatttctctgttcaggcagacaatgtatacacgtatccctatttatgagaacacacctgataacgtaatcggtattcttaatatcaaggatttaattgtcaatccttctgataacgatacatttaacataagaaacattatcagaaagccattctttacatttgaacagaagaatacttctgacctgtttaaagaaatgcagttaagttcaacaagcattgccattgtccttagtgaatatggaacaacatcaggaatgattactaccgaagacctgcttgaagagattgttggtgaaattcgtgatgaatatgatactgacgaaaaggaagctttatctaagattaatgatactacatacagagttgatggctcatttaagcttgacgatttaaacgatgaacttggcactaaacttgaatctgaagataacgattcagttggcggacttatcgttgaaagacttgacagacttcctaaagccggtgataaaatcactattggtaatgtctggatgtttgtcgaaaaggttgcttctaacagagctgaatctgttattgtaaagattatacctgataagaaagacgaaactaaaaaagctaattaattttataaaaaatgctgtgcattaacatcatcttgttaacgcacagcatttttatttttaatacttatatattactgattaaagtgccttgattctctcaagtgccttcactgtattctcatatgaaccgaatgctgtcagtctgaagtatccttcaccacttggtccgaatcctgagcctggtgtaccaacaacattagccttctcaagaaggtaatcgaagaattcccagcttgtcatcttatcaggagtctttaaccagatatatggtgcattaacaccacctgatactgtgtatcctgctgacttaagtccttcaaggattgtctttgcattgttcatgtagtaagcaatctgctcgcctgtctgcttctgtccggcttctgaataaactgcctcacctgctctctgtacaatgtaaggagctccgttaaacttagttccatgtcttcttgcccagaggctgtgaagtgttacatctccacacttaagatccttaggaataactgtaaaaccaagtcttacgcctgtaaatcctgcattcttagagaatgatctaagttcgattgcacatgttcttgcgccttcacactcatatattgtatgaggaacatcaggttctgaaatgtatgcttcatatgctgcatcatagataataacagcgccaaccttattagcgtaatcaacccacttctgaagctcgtccttagtgattgttgaacctgttggattgttagggaagcagagatatatgatatccggtgtttcttttggaagctctggtgcaaagttagtctctgctgtacaaggcatataaacaacattgctccatgcctgcttctctggaatataatctccagttcttcctgccattgcattggtatcaacatatacaggatatacagggtcacatactgcaatcttattatctactgagaagatatctcctatattacctgaatcagactttgctccatctgatacgaatatctcatctgctgatatatcacatccacgcttcttgtaatcatggtctgcaattgcacttcttaagaattcatatccaagatctggtgcatatccgtggaaagtctcggcatgtcccatctcatcaactgacttatgtaatgcatcaattactgctggtgctaatggctgtgtaacatctccaatgccaagtctgatgatttccttatctggattagcctgctgataagctgctactttcttaccgattgttgaaaataaatagcttcctggaagctttaaataattatcgttaatcttaaacatatattcctccttattttctgccttgttttacaaaactaacgcttattatacatcatttttcattatgttccaagataaaatcttgataatctttcatattctgtattaattgcctgtaaaagttctttatctccatgcatattatcaggatgatatatctttaaaagtgccttataacgcttttttaaagatgttgtatcctcaacccccttgaagaatatctttacattttcagcattagacatactgcgccttgcttcacggtaaaccttgtccttatatataagcttttcccgctcaaacttatctttatcaattgcaagctgtctggtttccctctccagaatattccatttttgttcaaataaatctttctgactctcaagctgtttcttcagcagcatattcttactctgctgtctctgaagcattcccatctgaatctctatgagttttctctcatcttccagatttctgcttaattcctgcagccttacattctctttaaacagccatttcttcttctcatcttcactacttagttcatcaaacattgcaacctccatatcagctccccatcaagccagccgcaaaatatatctaatcagattccactatgaaaccagaaaaccttcaatggcttttctgagtcaaccgttttcattgtatgtctgacacccggtaatgctataaatgaatcacccgctttaacctcaaactcttcgttgtcaagcctgacaaatccatttccttccaatacaaaaaatccctcctggtcatcatgaaatcctggttctggattaaactctgtttctgaacatattgtaactcctgaacaacagccattgatacatccattagcctctgtaaggaatttaacgcttctccttccttcttctcttgctgcaagtgcttcttctaatgttatatatggtttcttcataattaatctccttctgaaatataaaaaacggagtcccaggcatatgctgtaagaccccgctttattatgttctatattctgcctgttacttattctcgtatcttaaaagttctgtatatgcaagaaggaatggtcctacacctttggcatcatcttctacgattggctctgacatataataatcatatgtaccaggtcttcttccattaccaccaagtcctgcaacaagacagataccaccaagtgataatgaaccatcttccttagtcttaaggtatctttcacagataccatcgattgctttcttggcatactgcgcataatcatcagaaagatatccaagacgtacagccttaagaagtgcatatgccataattgagcttccacttgtctcaagatagttcttatccataccaccataattaactacctgataccacataccactctcatcctgatacttaagcattgaatcgacaagatccttaaatgcatcctcaagcatcttgcattcagcatcatacttatggtccttattatcaacctgatcaagtgtatcaataagcgccattgtataccagccaatagctcttaaccagctatgctgtgataaacctgtaaccttatcacaccagaatgcttccctgcttgtatccattgcatggaaataaagtccgttaataggattcctcatattctcaattacgaacttgaactgtccgaaaatatcagagtaattctttctgtcattgtatcttgtctcatattcaagatagaatggaagtcccatataaagaccatcaagccatacctgattaggatatatatccttatgccagaaacttctggcttcattctggcatctaggcataatctctatctgtgaatatactaaatctactgccttcttatacttttccttacctgtaagatcatataattcaaataaagtcttaccagcattaacattatcaatattcttctcacctatgctgtagccatctattgtaccatcttcaaagactctgtaatctataaaatcatctgcaaacttaagatacttttcttccttggttaagtcatacatctgaagaactgctttaatcatacagccatcaatatagttccactttgacttaagaccctgcctaatcttttcaatgttccatacaggagcatctggtgtgcttttttccagaagcccgtcaatatactttactactgcatccattatttctgtctccttatcaacttatatggggaaacatatatatcaattccgcccatattttatagaaattgtacactaaaaaatgcctttaagcaacccatttttaacaaatatagccaaaagcacagatttttattgactatatgctgattaaatacgaaaatataatcaataattcattgtaaatgcttttataaaaatatcatacacattttgtataaagttattattcagaaaggtcagattatgaaaacaggaattgtatttgaaggtggcgcattcagaaccatattttcatgcggtgttatggatgcaatgttagaaaataaaattatgcctgattacatgattggtgtatcagccggcgctgcatacggcgtatccatggcatcaggacagattggaagaaacttaaagattcttattgattatagaaatgataaacgttatgtgggacttagcaacatggtacacagggataaccgttctctttatgggcttaatttcacatttgacaccattccaaacgaacttgtgccttatgattatgatgcatttctcagatataaaggtactttcaaatgtgttgtaactaatgtactcactggaaaacctgaatataaaactttcacaggatatgaccgcaccaaccagcttttacgggcaacatgtgctctcccactggcttttcctcttatatatcttgatggaacaccttaccttgatggtggtttaagtgattccataccttttgaaaaagcatttgaagatggctgtgacagagttattgttgttcttacccgtgaagcaggctatcagaagcagacaaccagttcagtgcggacccttgcaagagctttccttaaatatcctgaaattcagcgtgatattcttcttcgtgctgaacgttacaaccggtgcttaaagcgtcttgaacgctacgaaaaagaaggccgctgcctcgttatccgccctactaagagcaaaggctttggaaagattgaaaaagactttaataagattctttcaatgtataacgatggatataaccagacttattcgttaatcaatgaaatacagaggttttatcattaatatatgtagaagtacctgtattttagtctgataacctcagatattactcaccttgtgtaagtaaatgttgccatttgcagagttttttatattgcagaaaagcaaacgcgcttcgcttgaacgagcttttctgcaatacccttttgcaaatggcagcataacttacactgggttcgtaataattcagttatcagactaaaatacaggtacttctttatatataaataataaattcttaaaaatttccgaacacaaaatcttttactattccgattgcttctcttaccatatagtttatgaaaagtacatggtcgctttctgctggcattccacaggtattgtttaatcctgcatgtctggcaagaaggcggcttcttgctatatggaagttgttggttactatgccaaccagtgaatctgtattctctatgtattgtactgaatacttcatattctctgatgtatctgttgaattatcttcctgtattatacgtgagccatctattcctttagatacaagataattatacattgcaaatgcttctgttgtattttcaccttttcccctgccgcctgatactattattgttgtatcagggttatctattgcataggaaacagcaacatctaaccggttcttaagtgaccttgttatgtggtcacctcttatctggcagccaagtactattatataatcacagttatcctttggctttgccatcattcctttaattatcagtgcttctataaaaataaaaagaaacgcaccagttgacattatcactataaagcaaattcttaagacctttgccacatgaattattcctttgatttctaatactctcactgcaaatactaatccaaaaaagacagcacccagcagccatataaatataaatgatgaacctacccctgcgtatgttgcacacactatataatatcccatgcatataagtgccagcacaagccatattgtatacataaaactactattctccgttactttttccatactttattccacgctcatacatcaattatcctgcataatccacatttttacccgcaaattcaggataatctgctgatttctggttctgtccgtaagatgtggcaggatatttaattgctgtattggtgacaccacctgacacatacgaccttccgcactctggacagactgccattttaagtgtaactgtcgcattcagtacttcgccatctttactggcagccttcctgttcgcattagaaacatgctcctgttcatgtgccataaccttcgtggccgctgctgacgggtcaatatgtgctgcactcttaaatgaaacatttacttcatctgaaccatccttatattccctgttcgcacatgtttcacattccacctgtccggaacgcttcattgctttaagtcttgcagagcttatatcctgtgtatcaacacctgctacattaacagacagatttctattcatatcattaacgccgttaatcatcatcttaatgtgcacccccttcatgtaaaatgtttaaacaatatatctgtatttaatataacatagtttgataattatgctagttttttttgatgtaaaagtttaatatatacatacaaacaatcaataatatagaaacgaggtattatatatgtttacatttaacaaagatgttacagctactaactgcgaacctggtgttacaagaaaaatattatgctactctgatgaccttatgatgtgcgagattcattttgaaaaaggttctaagggcaatttccatagccacaagcatctgcagattacttatgttgctaagggaagctttgaattcactatcggtgatgaaactaaaatcgttaatcagggcgacagcgtatacatgccttctggcgtaacccatggtgttacatgtcttgaagaaggaatcctctgtgatgtattcaatcctatgagagaggattttcttaagtaaaatgaaggtaccatttaatattaatctttcaggtaaaactgctattgtaaccggaggaagcggaactctctgctcagccatggcatatggacttgccgtatgcggtgctaaggttgcaataatcggacgtaacaaagaaaagcttgcttctgtttctgagaagcttactaaagatgctctggatgaatataacaaaaatgttactgttaaaggctacagctgcaatgtgattaataaagatgaacttacagctgcttatgaaactattaagaatgaactcggcagctgtgatattcttattaatggtgcaggcggtaaccagcctggtgcaattacttccatcgagatgttaaagaaagaaaaagaagattctgactattctttctggaatcttgatgaagacagaatccgtgatgttatggatcttaattacatgggaactcttcttcctattcaggtatttactaaggatatggttgaaaaaagaagtggcagtattatcaatattgcttctgtaacttctattcttcctcttactaaggttatggcttatggcaatgccaagagtgctattcttaatcttacacagtggcttgctgtacattttggcgaaagcggcatccgatgcaatgcaattgctccgggattctacgctgccgaacagaatcatgacctcttattcaatgcagatggctcatatacagaccgcgccagaaagattattgccggaacacctatgggacgctttggcaatcctgaagagcttattggtgctgcactctttcttgcaagtgatgaaacagccagctttgtcaatggtatagtgttacctgttgacggcggatatagtgcttatagcggagtgtaggattctttggttggaaactgtatataattcagggcgatgtcagctttgacatcgccctttttgttacgttttttgttcattgcattttttgcgtgtttttctgagcttcaacatccaatctgacatgttttctcgttccgtttggacttttgcttgcattcccactgcttcaacgtccaatctgacacgttttttcgtcccttttggacttcttctgtgactttctccacttcaacgtccaatctgacacgttttctcattccgtttggacttttgcttgctttcccactgcttcaacgtccaatccgacatgttttctagtcccttttggacttcctctgtgactttctccacttcaacgtccaatccaccccgccgcctcacaataaaccatctccagtctcacatatgcctacactacaactcagccctgacaatctcagccgccttaaccatattcttaaggcttgcttctgtctctggcacacctcttgtcttaagtccgcagtctggatttacccacagcttgtctttgtctatctttgtaagcattatctttattgcacgggtaatctcttcaaccgatggtattcttggagagtgaatgtcgtatactccaggtcctacctctgtttcaaaattgttttctcttaatgaatcaagaatctgaaggtctgaacgtgatgcttcaaatgtgataacatcagcgtccatatcgtctattgctgggattatatctgtaaattcactgtaacacatatgagtatgtatctgtgtttcaggttttacgccgcttgctgtaagtctgaatgctggtattgcaaactcaagatattctgtattccagtcagattttcttaatggaagcttttctcttaaagctgcctcatcaatctgaataatcttaattccatttgcttcaaggtcaagcacctcatctcttattgcaagtgcaatctgcgaaattgattccttgattgtaatatcttctcttgggaatgaccagttaagaattgttaccggacctgtaagcattcctttcattatcttatctgtaagtgactgtgcatacacagaccactcaactgttatcggcttcttgcggtaaacatctccccatataacaggtggtttaacacatcttgttccatatgactgaacccatgctttctctgtgaacagaaaacctcccaacgcttcaccaaaatattcaaccatgtcatttctttcgtattctccatgaacaagtacatcaagtccgattttttcctgccatctgacacattcttcaattttcttcttattaaattcaacatactgttcttcgctgatttcacccttacggaatgctgaacggttggccttaacatcttttgtctgtggaaatgaaccgattgtagttgtaggcagcttcggtaatgcaaattctttcttctgaagctgctgtctctcacttcttgcaggaagtcttctgtaatctgcctctgtaacttcctcaagtcttttcttgacagcttcattatcacattttcttgtacctgcaaatagctgtctgtttgtcttgaatctttcatcttcttcaatatttccacactcagcaagcctgcttaattcctttaattccacaagcttttcttctgcaaatgcgaagtaattcagatattcatccgaaagtttattctcatgctttaatgtatatggaacatgctgcaacgagcatgatgttgacaaaactgtctgtattcccttatcttcaagctttttaagcacattcaaagtcttctcataatggttcttccagatattctttccatttacaagtccagcgaataataccgtgtcctttggaaatccatatttttcaatgagttctgctgtcttctttccctcaataaaatcaagtccgattccgtcaaacgacagcttaacaatatcttcatacacatccctcacgtctccgaaatatgtctgaagcaatactttgcatgatttcttcttacctaaaatatcactatacattttgacaaacagttctctgtcttcttctgtcatgtcctgtacaagtgcaggctcatcaaactgaagccactggattcctacagcttcacatttgctataaacatctttatatgcttcaataaatgcattgataaaatcatctgccctcttcttgcctgtaaatctgcacagcttaaataaagtatacacacctgtgattaccggttttgtctcgattccaagttcttttgcctctgcatattctgcccacagcttattacctgtaagtcttatctgcgtgctgtcctcagcctctggaacaatataatggtaattagtattaaaccatttcttcattgcaagggcttttacatcaccgttctctccctgatagccccttgccattgcaagatatttatcaagctctgaaacctcaagttccttgtatctttcaggaattatattaagtaaaaatgctgtatcaagcactatatcataatatgaaaaatcattgcttgtgatataatcaattcctgcctctttctgtataagccagtgtgtctttcgtaactcctttgctgtctgtgtcagttcatctgcacttatttcttttctgaaatatttttctaatgcaaactttaactctcttaatgttcctatccttggataacctgctactgctgtcttcatacctgctctcctcatctataatttgatgttgtcattataaattcgaaaaaaacatttgtataatacataaaaaaatgagttagccatagtttaaagctatggctaactcattttacatacatgcaatgactacttaagatacttccttatagcctcaagatatgtacttccaagcctgctaagcatcccttttctgtgagttatgtaaccaatatgcatatctgattcatcagcaagtggcactgctataatgtcttttccgttgagcttcttgtcaagaataccactgctcactgtgtaaccgttaagtccgataagcaggttaaaaagcgttgccctgtcacggactcttatattcttctttcttgctgtctctgagaatatctcctctgagaaatagaatgaattatgttcgccctgctcaaatgacagataaggatattcttctaactgctcattatgaatgacactgcactctgcaagtggatgttttctgcttatgaatacatgtggtcttgctgtaaaaagctcatgaaattcaagttcatatgactttaaaatctttctaataacagcctcattaaaatcattaatgaacagtattccaatctcacttcttaaccttgcaacatcctcgataatctcataagtctgcgtttctcttaagctgaaatcatactcatcctgcccgaactgctttataaggtcaacaaatgcgttgactgcaaatgaataatgctgtgtcgatacgcagtactgcttcctgccaccattaccacccttatatctgtcctcaagtatggctgcctgttcaagtatctgccttgcatatgaaagaaaatcttctccttccttcgacacgcttattcccttattagttctgttgaatatcgtaatattcatctctttttcaagttcatgaattgcattggtaaggcttggctgtgaaatatataattttcctgccgcctcagtaatcgtgcctgtctctgcaaccataacgatgtatcttaactgctgtaatgtcatactcttacctgcctgaataatatttaaaatattgtaacacatttttgttgttttttaaaaaatattatgatacaatcagcccgtaaaaatttctgattatgaacggaggtggattttcatggatagttgcgatcgtataggacgaagtaagaactgcggtgtatactataagtgtaagctcggaatgtggctgtctgtgagaatctcataaccacattctaataaattgtgccttttatacatcgcatcagaggatccttactatcacaatcatctgtagcgatgtatttttatgcccaattcaggcaagaaggaggtcacaatgaacaaagtattatttccaaagaaagattatgtaaaagaacttggcaggatttttaagtcatctaagaattcacagaaattagttaagacactttctaaatatcatgagaaggatattgctgaagcaatcactcttcttacacctgctgaaagacagcatatatataacgttcttgatgaacatatgattgctgagattttctcttatcttgatgatgccaaagattatcttgaagaattatctttagagaaagcagcaagggttgtctcttacatggattctgacgatgcggttgatgtacttgacgatttgtcagaaactaagaagaatgaaattgttgaacacttagacgctgatgcaaaggaagatgtccagaagcttctttcttatgaggacgatgagattggtagctgtatgactaataatttcatatgcataccggataatcttactataagagaagccatgagcgcccttgtcaagcaagctggtgagcatgataatatatcaactatatatgtagttaatagtgctgacaaatttgccggtgcaattgacttaaaggatttaattattgcgaggcagaatgataatcttgccgacataataagcagctcatacccttatgtatatgagcatgaaaatatcaatgaatgtattgataagattgcagattacgaagaggattccattcctgtacttactgatgatggaaaaatatgcggtattcttactgcaacagatatagttgaacttgttgacgatgcaatgagtgatgactatgcaaagctcgctggtcttacttcagaagacgatttaagcgagccaactcttgtaagtatcaagaaacgtctgccttggcttattatactgctgtttcttggaatggcagtttcatcagttgtaggaatatttgaatcagtagttgctgtccttccgattgtaatatgcttccagtcactcgttcttgacatggctggtaatgtcggaacacaatcacttgctgtaactatccgtgtacttatggatgagactttaagtgctaagaagaagttatcccttcttttcaaagagatgaagattggtttcattaatggtgcaagtcttggaatcatggcacttgtattcttaggtttctatattcatatattcaagaaatatgcgtggatgtcagcatttttaatatctggctgcgtcggattatctcttattgttgctatggttgtatcaagccttgtgggaacaattattcctatgttcttccacaagattcacattgacccggctgttgcgtcaggcccgcttatcacaaccgtaaatgacctagtcgcagttgttacttactatggactcgcaatgatatttcttgttgagatatttcatgtgtgaggatatattgataccggcacaaaataagcatgagcatgttacacaatttcatgtaacatgctcatgctctttatgtatatctatattatgataagaggatatccacctgttatacatttaaattaatatatactatttaataatataccattgtccttccgctttaaaagcacctattgacatgtaatctatactggtatttttgtataaatacgatgaggtttttttacaaaattcatcaatataataaacaccaattccatcatacactaatgcttttccattccagtatacgcttgcatcttttgcccttaatttttcattaagactataatccataaagatacattccccatttaaatcaccagctataagaattttatcatttgtaaaattaacaaatttatacttttgtgttgatataattctattttcataacaaatgttatataaactaccctctaatgaaagtgcatagtacttatcattaccataataccagctactaaattcattataaggcatactatatgtatgtcctgtgtctacattcatcaatttccaagcatagccctgttctggaatatatcctctcatttttatccagtgattatcatatgcaacattctctcctacaacctcattagaagaaatttctctcccattacaaccatcttttgtaataatatacataaataatttgtcattttctatatcttctataaccgcaactgcagaatggtcatttgtctttgaacttgtcgctattccattccaattatcgcccgatataggaatatagcttttcccaaatccttgcacaatattttttccggttcttgcatttataaacttaacatatacagaattccatacacctgatgaaccatttgatgacatactccaaccgcattcaacagtctcaattatcattccctgccagtactctctttttattatgttgtcaggataatttacatattctgatgattctgttattttttcatacttatatgcagaactatcttctattgtttcttcaataagataccgacaaataagatttagtgtattactattatatacatatccaacattatcttttaccaaaagtatttcatctactgcaacttcctttgaattatctgcattgtatataattggtattattaaattttcatttgcatcaataacaccacataaaccatctttcacgactaagtattttccttcagatatcattttaacgacatcataatggccattaagtttaactatatcataatcatcatatttaactctatttaattttattatcccgcaatcagatgttttattcttaaagacgctaatgtattttgaaacaatttcataatcatttgtactaatttccactttataattccctatacgtacatttttaaataaaaaatcacctttctttatttctccagtatttgatgtactagttactccgtttaaaaccacttcacctgtatcaacatttacaacattaactacagcattacaaactgggttattccaatcatcaaccaccttcccatatattgttccatatccatatgtacaagcaggaacaactttattattttcaatatgaagtttccattttaatggactattattttcattatatacaacccaattaagattcagattaatgtttaaaaagcctcctccaaatttcaataactttgccaacctgcattccttgtcaattccaaactctaaataagcatataaagaaaaatctccacattccaatgcaggatttatatctctatgaatttcttttttcaaattcattgtgccccctacatttgcattcatttgtattagattttcgtttccaattgttgtttttaatttacttacaattgaaggtcccatttttgcgtttgcatttccctgagaaactggttgttttaaattatcaaggcggaattgctttattattctaaatgtcccatttttatattgcactccgctagaacctgaataactccaaacaacagatgtttttccagaaattgatacatacaaatataaatccacttcaaccttaaatagaccatttataggtatggaccagactttacccaatttatacatcttatcgtatttttcatttgagttgtccaatttggtattatattctatatttccacttacttgcccactgtaattcataatcattgaagcttcattaatattccaattaactatataagttggtatgtctgcttctatctttgcatttacatattccgttcctattttcaggcttaatttaccaggtttatttggagtctgaatttttaacaaagatatatcgctttcttcatcattatcacaatccaagctaaccccttcttctaaaaccaaactatccgtgtctatttgtatttctttagaaattttaatatcttgaacaatttcttcatattcaggttcacaatataccagctttatttttccattatattcataactatctaaaacctttcctgcaagcacataagaatagccatctttagccgacaatacaaataaatctcccattttcaaattatttgtttgattatctttatctataattacacatttttcatcattttcttcactaatactataattatctgtagctatttcaattacttcagacttataagatatatttgcctcatccgtaacttcatttaaagcatcattaaaccaatcaattctttttactattgtctgataatcacttgacgaaatatatttgtctggtaaaaaagctccatttattagtggtataaactcctgtgcagctacaagagcaacttcatttctgtaatttactaattctgaatcattataatcaattatgtaatctccctcaaatcccattatatgataaacaatatatgccgcatattctcttgaaatatattcattttctttaaatattttttcatcatctggtaacaaaccataactccatgcatattctgcatccaaaccatatgtactgttatatgtatctgaaaaatgaaattcatatgtactatcatttaactctaatctttcaacatctaaatgatctaacagattatgaataaactctcctttagtaatgtagtcagagttactaattgtattataactaatttctatatctaaattttcctttaaaccatctactgttatttcttttgatatgctactgattttattattaatcacttctgcatgcacattatcaataaataatccaaatagagcagataaaaataataaaatacttataagcaatgaaataaatttatttctctttttcttatctatagtaaaatatattgccattaatattacaactgtaattattactaaccatattataatatggtgtgaatctcctgtttgtggacttactctactaccattatacacatatttcaattcatacgatttttcttgacctgcttcaattatttcacattcatcatattggagttgtcctttataatctgcgaattcagaatattctatatgatttatatttatatcatcttttccattattctttattgtaaacttagcatttatatcttcgcgtgaataattttctttatctgtttctacacttatatctacttctttgctatttaccatttctgtagcattaacattattcagctgcattacacttacaattataaatataactgctgcataaattattttctttattttattcatacattttctcctcatcaccattgattaatatatatttataatatatattaataattcattccatatactcaaagaatctctctctgaaatcttttctcttatctcttgccagtggatgtctgacttcattttccagatatgtcatgacaacctcactattttctattctctttacataattcatatttactaatatacctttgttgatacagtagaaataatctggcatttgtgaacatatgcttttgaacgacacataaaaagactgtattccgtcaagcatgtatattacagttttatgggcttcactttttacatatactatttcattcatctttatcctgaatacagtattattgaagcttagtaccagttcctctttcggctgttctttgttatcgtgcatactgtcaattactttctcaaggctttctatattcataaatataacatcatattttttcttatcttcaatcactttggaaaacagcttttctacatcgtcatataactctattattatctcagcattataaccaagtactttttcttttatatcttcagcgtgatctatacaatcatcacatatcgcgattatcatatcttttgttctctcttttatcggagcatcttggtcaatacccatctgccgttttcatatatagccgttccattgattattttgtcagtcacaatattagatgtcataggtccctgatatttcacattaactgagaaatgacattcattatcagaattatcattaacagtaatagaatatccatcccatataatgtaatatccaccacctgccatataattagtatcaaaatataaatcgccatttatatctgtgtatccaggacagcccgttgttatataatatgatgcctgatcattacaatatacagaatgaaccatattataaaattccgaataattggcaaatacgttggtatctactttaatatatctgcctgatgattcattagaaagtattgttggtgaaccattgaaaactgataataataaaaatacattattatcaactaactcatataatttatctatgcttattgtattaactgtatcatttccctcagtctctgttagttccacttcagtttctatagctatttctgtatcttgttcatctgactcttcactctctactactgtctcatcgttttcatactgtatactctcgctgctctcattaacattttttgtttcttctgtatttctttctaataattccctatgtgtttcattaattgtctcctgattattctgcacgacattatctttcttggaattttgtaatttattatttttattaatatttaaagcaagtataactattgcaattataaaaatagcacttactaaaacctcaagacctataactgtatactttttcatttctcctccataattattcataattatctggtgtaagattcttatattcaattgttatctttgttccaatatcataatcagaatagttttcattctctgaatttcttgtttctacactacctattttatcgaagctatcttgttcttcattatatttatataacgtatacggccagaaataaggatcaactcctatattatgagaatacagttcttttacatatccactgtcatatatctcggctgttacataaaacttcatttccatatatattgactctgcattttcgtcatatccatatatgtacattgccattgtcgcaatagatgtatcagtatatgaaaatatcaattcttcttttccatcattatctatatctacaatggcatatctgttttgctctatatttgtatcactggtaatagttctattatctggtaatatcataaaatcatgcagattggctaatgcctgtttatatgcttccatgcacataatagaataatctttcttactctcagtctgaacttcctgaccagcatctgattcacttattatgtctgtgcttttttgttctgatgatgtgaatccctcttttttagcagtttctttagcaatattagtttccacagcaagtgaatctctgtctgctttgttctcttgtgaattcttgtttatatttatacccgctaacacggccacaccgataactaatattattataaaaacaaataatcctatttctatcttcttaatcatcagtctgtccccttatttcttccgcatacacatgaagtttcataagccgggtgaattctgttacaatctggacatttccatccaccatttgatattatttcattttctcgttcttcttctgatttcaaaacaccattatcattatatttacactctgaagcgactttttcttctttcatactatgaacatcttccatcatctgacaaaatgcaaccatgaatattcccatgacatactcaaaaaacaatattaaagccagtaccaataatgatagaaaaaatgttcctgtcttaaaattacttgtatcactgtactcgtaatacattgaatacttgtctggtgtagctctttgaatagagtaaacaagtccaataataaatgttgcaattaattcaaatactacatatacctttacaatactcagtgccttggttcctgcgttctcaaacatataatcgcctcctatttatttattttttgccaattcatggctgctctcgattaatgtattgttattgtatattttcaggaatgatttgcctattgcttttacactaagtgttgttttgcctgcattaattgttaatatactatctgtctcaatatacaaaaaactcttaagcagccatgttaactgcttaagagttttaattatttatcatattaagttattatcctatatactcaaaaaatctgtttttaaaatcttttcttttttcccttgccacaggaagtgtaatcatctgtttccgatataacatcacaacttcactctgctctatcctcttaacataattcatgttaactaataagcctttattaatgcagtaaaaatattctggcacttgtgaacggatactcttaaatgatacatagaaagacttttctccatcaagcatgtatattatagtcttatgtgcctcactcttcacatatattatctcgttcattcctaccctgaataccgtatcgttgaagctaagcacaagttctttcttggacttatccctgctgtcagctattttaacaagcaccttcctaagactttccatattcacaggtttattaataacaccaaatatatcaacattgttccagaacagcttctctatgtatttcatggtatatgctgtcacgcatactattcttgcacgacagtccatatcgcttaacatctggacataatccacaccacttctggtattattctcccattccatatccatgaatactgcatcatattttttcttgtccgcatttacttccacaaataactgctctatatcatcatacaagtctgttaatatcccttcgttaacagaagttatcttttcttctatatctcttgcatgttccatgtaatcatcacatatcgcaattctcatatctgtaatctttcttcgtattcccgtttcatgttatccagtattgctattgctttctgcggctctgttaccgctactgcattcacaacagttatctgattaatataatcatgcctcagctttgccatattttcattctgcataagaatgttatcaagtctttcctgctccttttcatatacttccctatattccacaaggtactgctttctatgcagtatagtacttcttattagtataatggcaagtatgactaaggtaaaaagattgactattataaaaatgttggtattaacactcagattgtattgtgcaattattcttttaacatagctaggatatattgaacagtagcatgcaacaaacaggattgcaaaaatacccttttcatcaacatatacattgtcaatataattctttatccttctcaccagaagatataacagaaaatccatcattgatataaatataagctcaatcagactcattgaaaagaatgtgtctgaaaagatatttccatcataacttacatttaatactacaagcaatgactctgctgtaaaacatatgaatgtcattattccatatgcaagtatgaatttatatattttgccctttaatgctgtcagaaatattccaaaaaataatacattattcaacaatataagagcaagatcaaccttgctgtttgtctggacaaaatatttaatatttcctataaataaaccgaatattaataattcaataaataatttttttagactaatcttatattctggtataataaaaagtgaaaatgcagaaactatatttgcaaggcttattattaccagattaattactattctcatactatttctgcctcctctcctttcccagagcataatataaccttagcagtgtattctttcttattaattattgtattaaattgtcctccgtatttctttgcaatatcccgcacaataattcttccccaaccatgttccttaacacctgtccttatgcctgctgcctttgattttatcttgcctgcataagaattaactacactgattgtcaaataatccccattcttcttcattgtcagattaatgtatttctgtgatgattttccatcacatttgcaataattatatgcattatcaagaagattcagcataactgacgataatgacaaatcatcaatttctataatagaattcacatcgatatccacattaaaatcaatatctgtgcaccggttcttcatcaggtaaataatctggttaacaatggtgttggaacaatactctttaatgtgcatatccataaccgtattcctgatattatcatcaagctgttgtctagaaacattttctttaattgctgctttgatttcatctatactttctatcgatttctgtccaaagccttgatatagctgcattacatccgcctgattttcccttagcaccctgttatcctctatcttacggaacgccttcctctgattcttcatatccggaatatcaaataaactatacatgctcagattacagaaagcacttcctacaaaccatgatgtaagcatcagtgcaacattcgtaccatccggtacagcatatatacacagaggatacataatcaccagtggaacaaacactgctatattaataaaatttctattatatttctttatccagagtatgaccaataccgccagatacaccagtatcatctctataattaacgacatcttataactattaaaaccagcctttaatccgaacaatcccaattcaataatataacttgccagcacagccaaaatgcctttaattttcttgttctcgctattatcaataagttgcactgcaatataatagcttatcttaacccctggtgtcatcaacagacatactaaataatacattctcttttgtataagctttttaagctttccccctcttgctttttatttcatacttataaactgatttcatagtacatttgttgtctatttatgtcaatatattatattaaaattaaatatatttgaaaatggactattaattaataacatgtttgattacctgaaaatcagacaggaacatgttaccggataaatagtaacacgctcctgtcctttttatgtatatctatattacgaattaagctttctgacaatgatgtttcaaccatcgttgtctgtattatatcatcaatgtaagcccaaaaccatttgcttcctcaatagcttctttttctacctcaattgtatacaagatacaacgctatccttatgaaacctgtctatgattagtaacacagaacctgataatatatatagcaagcagttcaattatcacaatagccgcaatgattatcatatatttattaaagctgtgtatatctgtcaatgtatgcaacagccatgaatacatcatacttgtaaagcatgctcctatcagactgtactcccttccagtctctccttcatattttcgcatgttgacataattctgaataataagcaatgcaagattaagtataaatataataataagctgcacatttataattcgtcctatatttccgtctatcttccatgactgaatttcatgattattaaatatgccagttacaattatcatcataataaaactgtatgccatacttccaaatccgataatattatatatccgcttatccgcattttctctatttggatctgcaccgattaatctttctttcagaaacacagctacaagaataaccgcaagagatatcccaagataatacatccccgaactgtcaatatgtcccctgaatgagtaccacccacacataagcatatatccaacaataataacagcaacaattcctgttataagttctcttttctttactctgtcctgcagctttgccactctcacaacttctgtaaccgctgtttcactgtcggtattcttctccttaatctcccctattacaatatcctgaatccttatgtcaagtattcttgataactcttctataacacctatatcaggaaaactgtctcctttttcccatctggaaattgctttgttagtcactccaagcaaaccacccaattcaacctgggtatacccttttttaatcctcgcattccttataagctcgcccgtcttctgcttatccatatgtcgtcctccttgattgtcaattaatttcacagcactgtctgtttattaaaatgttactaacaaatgcctgaaatatcaatccagcgtagcgagaatcgcgtagtttcctcattttccttccatacataaaaaaccccttcacttaacataaagcgaagaggtgattttcaaaccattcattttcgttctctgcctatataatcatatcttcttgctctcttataggcatattttccactttttctccattttagtttcatatttacctataaagctgcttatttcatgccgcttataggttattatgcttcaaaaagctaaaaataatttaaattctccttctttttccctataaggattcttacaatgcgactatctataggtatcatgtgtataacaccttgtatcggaccattatcactctgctgatgttcttcttacgtacagtatccagacacattaccctacacaatctccagcacatgctccgtaacattcttatccttatcaacgctaaatgccttaaacacaggattatcattatccataagggacataatcatatatacagcagtcgaatcatatgctagtctcttatcctcctcggaaggtcttgaaggagtttccgggtgtgaatgaaagtttccaagcatagttaaaccaagacttcttgcatccttgactgctgtgaactgttctttaggatccatagtaaaatgtacattattatggtcaagattagtaagaaaataaaccttctcaatagacttaacatccccatcagtaaatcccgcaataagcccacaggattcattaggaagcccagataaacaatattgcacaactacatcataatcagattttttcattcgaataatcatgctcatcctccaataaaaaatatcactttcatacttatccagcgtaagccccgcgcacacgctggaagagaaaacatatataagcagaataatgagataatcatgtgcagcgcactttggagtcaccggcacttagcaagccaacgccttcggcgttggcgagcttagtaccgctgtgaacgacaagtagcgaaagcgtgcctgcacatgattatcccattattctgccatcacatatattttctcttattacttatgcatatcacattcagcctgttcataatcaataagctcatgaattgtaggattatctccgcatatagcacaatgatgatcctttggaagcttaattgtatggaattccatctttaaagcatcatatgtaagaagtcttcctgtaagaaggtctcccttgccaatgatgtacttgatagcttccattgcctgaaggcttccgataacaccacccattgctccgataacgcctgcctgcttacatgtaggaactgcgtcctttggtggtgggttcttgaatacacatctgtagcatggtccttctcctggtacataagtcataagctgacccttgaatcttatgatacctgcatgagagaaaggctttccagccataacacacgcatcattaataaggaattttgcagggaaattatctgttccatcaatgatgaaatcataatcctttataagttccataacattctcagatgtaacgaattctctgtaagtcttaactgttacatcaggattgattgcttccattgtttctttagcagatttaacctttgccttaccgatatctgctgttgaatggataatctgtctctgaagattagataaatcaacctcatcagcatcaacaataccgattgttccaactccggctgctgccagatacatagctgcaggagcaccaagaccgcctgcaccgattataagcacgctcgcattaagaagcttcttctggcctttagctccaacttcctttaaaataatgtggcgtgaatacctttcaagctgttcattagtaaacgccattagtatgctcctcctcccatgaaatataagaattcaactgcatcgccttcatttaactttgttgtctcaaaatcatctctctcaacaaaatcatcattaacagtaactgttacatattctggattctcaacattctccttaacgataagctctgctactgtaattccgtcttcatattccttcttgtttcctgcaactgtgatcttcataacattcctccctttaattaaatctcatttcttgcgccgtttattatactaatccttcaaataatccaagcagtgcatccttagttgtctttcctgcaattctgcctgtctcagcacctttgttgaatgcaacaaatgtaggtgctgccaatacttcatatttagaagcaagcgattcatcaaagtttacatttaccttgtaaacattaagctttccctcgtaatcatcttcaatgtctcctacaacccctgccatcatcttgcatgggatgcatgaatccgaatagaaatccacaagaaccggaagttctgacttaagaaccagttcttcgaaattctctgcattagctctggctgccataagccctcctttccttaatcctcgtcttctacctttcttacgataagagtatatgtaccatcctcattagctgtaagctttaatatctgatgtccctcttccttaatacttcttggaacattctgaacaggctcaccgtcattcattctgactgcaagaatctgtccgtcatctaactcctcaagtgctacctttgccttaacaaatgttgttgggcagaccacatcagtaatatctactgtatcatcaatctcaaaatcagccattgtatgcctccttaatcttcttatagaattcttctcttccaactctgtcgagtgtgaacttaaatctttcacttggttttgcgttgtctgcaaagaactggattgccgcatcacagacacggaataactgttcttcatttctgataagcggaagtggtgattcacccttgcttatagaattaccaaatgttcctgcaaatgaaatgatatatgcagaaggtgcgtcccacgcatctgttggacaggatttagcgcatctgccgcagtaattacatttgtcataatcaactgcaaccttgccatcctgcattgtgattgcacctgtacgacaggccttctcacatacaccacagccaatacatttgtcttcaatccacttaacatcagcagcgcccttgataccaacatcattctcctctgccttaagacagttgttctgacatcctgtaacaccgaatttgaacttatgtggaagttctcttccgaagtatctttcgtctaacttaactgcaatgtcatatgaatctatgttaccgctaggacatattgtattgccctgacaggctgtgactgtacgcactctcggaccacatacaccaggtctgcaaccgccctctgcaagttcttccttgacagcatctatatctttaagtttaataaatggaatctcaacgccctgtcttgatgtaagatggacatgtccgtctccatatttttctgcaacttcagcaatcttggtaagattctcggctgtaagatatcctcctacaactgcaagacgaagtgagaagttattcttctgcttctgtctcatgaatccgcccttcttaagtgttccataatcaactttctctgccataatatcctcatttccgtgccatgcactattcattatcagtagactctaaggctgccctgaaatcttccttaagatcatctatatcctctattcctacgctgactcttatcagatcgtcatacactcccgaagcttctttatccttgtcgcttagatgaagtgcaatcgttgaagcagggtggataaccagtgtcttggtatctcctatgttagaaacaatattaggaatctttaatgcattaattatcttaaatgctctttccttgcttccaaccctgaaagttattatcgcaccatagcctttagtaaactgcttatcagccacttcatgatacggactgctctcaagtcccggataattaactgtaattccttcaaatgtgtctaagtatctggcaagttcatacgcattagaacagtgcctctccattctaagccctaatgtctcaagtcccaggttattaagaaaagcattatgtggtgaaagacaaccaccagtatttctgaataatccgttacgaagtttaattatatatgccattgggccgaatttcaaatatggtttaagtcccggatacttttctttatcaaacttgaactttccattaaaagtaagtattccgcttatcgcatcactgcttccattaatgtactttgatgatgaattaactaccacatctgcgccaagagttataggctgtataagatatggcgttgataccgtattatcaactataagcggaattccatgtgcatgtgcaacatccgctactgccttaatatctgttacatcaagctttggattaccgattgtctctgcaaatacaactcttgtcttatctgttataagttcttcaaaacactctggcttattatcagccacatatttcactgtaatgccaaagctttctaagtcttcaaacagttcgactgttccaccatataatccacatgaagcaacaacctcattaccctgtcttacaatattagctatagaattaaatattgccgccattccggaagaacacgctacacttgaaaatcctttttccagcttggtaattcttttttcaaatgcttctatcgtcggattattgattctcgtatatgagaatcccatcgccttattatcaaatattctctccagttcttctgcactctcatgcttaaatgcgcttgactgatatataggaacaagtgttgctccgttgggataatcgtcaacgccatcatgcagcagtgatgtgttaaaaccactcatatatttctcatcctttcatctgttatgcgatgaacattcaatatttattgaactgtccatatattaaacccttttacctagtatgtcaataggttatttgagaaaaaatataactgcctgaacaatctcaggcagtcatgaactatcattaacatttactatataatataactgtctattcccacattagaattaaccaaatctgctattgtaatattgctgaagtaatcattaacaagcttctcaaagtcttcccacatctgtaaagtcttacattctgccaccttcggacatctgtttggcttcttctcaagacatgctaccggtgcaagtgaaccctctgttacaagaagtatgctaagcactgaataatcctccggattgcgtgcaagcttgtatccgccaccctttcctcttaatgatatgagaaaatcattcttgcttaatgttgcaacaatcgcttccagatacttctcagaaatatcctgtcttctggcaatatccataagtggaatatattctcctgtattatgctccgcaagatcaatcatgaccctgagcgcatatcttccctttgttgaaatcttcatatatataacctcttttctaataacacattaatactgtatgttaaacatactttaccacaatgtttgtatatttttcaagtgttaaatgaatttatttggctggaatacttgccgcaacgcataattctccccagcctctggctgaatcaggccatacatttcccacccgtgttgcaccatttataaggtatgctttaagcttttcaccatacatatattggtcattgcccttcacaatcccccattccatcagcattgcagcagcacccgtaaccatgggtgttgcaaaagatgtccccgtgacagttttctccttatttcctggaattcttatattaactcccggtgctgttatgtcaggttttgcatacagcagaaggccgctttttacattaactcccctgcctgaaaatgtggccgcactccccggagcacgcccattggcgccaacacatattgcccgcctcgaagtccccggtattgtaaatgtgtactcaggcgacggccttaaaaatcctgttgcactgcttaatgtcgaaaccggaggaagccacatattaaagaatccatccaacacatttgctgcggtaaatcttatatcccatattccagaagtaatatatccgcttgtcgcaactatggctgcatatatctcttcacccatatagaatggtcccggtccatacgcctttgatacgatacgcatattcttaatgttatgatgcacaacccccgcatttctttcacttataaccagtctttcccctgttggcgcaataagttcaattcttgcattgtccattgcccttttccatatctgtatacttatctgaggctcataatcaccaattgcaagctcttcatccagtacatttccactgacaagctgacctgaataatgtgttctgccttctccttcattgccaacacctatacatatactgcatctgtatgttgaacagcagtcatctataaacatttcaaatatagaactgccctcatgattgccataagttccaccataacttatattaaccgcaaccggctgactatattcaatagcttttcttatgcagtaatcaacgcctttcataatctgcgttgtccttatatatgcgtttccccctgaatttcccagctttacaattataatatctgcgtctgaagcaacaccgctccttccacatgcaataactgcaacttcattgccatgtccggttacatccctagctggcagtgtctttacagctccattcctgtaatcttccagtatactgttaatttccttgtcagaatatgtaatgcctgttgtctggtcccacaacgtcttaattcttgttttccctgaatcatcaagaaattcaccattttctatatctatcccagaatcaattaccgctactagtacaccttttccagtcacgcctccatactgggtttcttctgcttttgcaacattaacgcaagcttctgactttgctgcatacaattcaaaatataatgccttaggcttttcaataaatattatctccggttctgtagcaagtgcttcaatactatcaatcgttgttcttacaatccagtatccacatagaagctgcgtaaactcagcatttgtataaatgcttctaatcctatccagacttccagctgtcttgacaattatctcccatgttctgtcagagtcatcaaacccggcatccatatcaggtacctgctgccttatatcttcacttgtatcagcactaatctgcaatagattttcaattctcggattcacatataattctccagttaagctcacataatatctatgctgacatctccaataacatgaaaacagctgatgcatacgcaccagccgttaattaattaaatatcatgttttcttgataaattctatacgacacttaggacacttaatactaattctgccctttcccttaggaactcttatcttctgcccacagcttggacatttgaaaattctatgtgtcttactgtccttaattcttgctcttaccttgttaaacctactcataaatttataatgaatcttcatatacttctggttttcagcacttcttcttgatatatttcttgaaaacattctgaaatatatgtacacaataccaaggagtgctactgtatatattacattactccttaaaaagaaagtaagtataatcagaacaagaactacatatgataaacatctcgaaagctggtccatgccatatcttccatacataaatcttgaaaaactctgcttaaatcggttcataaaaaacattccctttctatatattgaagtaattcacatcaacatacatatggtaacacacaacccaataaaagcaattaaaaatgtataaaataaatatgatatattaatattccatgtactcttccccatcgaggttcttccagtagaacttatcctccagtatcatataactgtgttctgagttttctttaggaattgaaactgaaccaggattcatgtatatgtaattatctctcttctcacacttaggtacatgtgtatgtccgcaaagtagaatatcgccttcctttaatgcaggtatattcttctcatcaagcttgtgtccatgtgcaagaacgattgatctgtcattgaaattaagatatgcctgctctgcaagtacattaaagtcaagcaccatctggtcaacctctgtatcacaattacctcttacgcatataatctcattgcgtaaaggattgagcattgcaataacctccttaggtgcgtattccttaggcaggtcatttcttggtccgtgatagagaatatctcctaaaagaacgagtctgtctggcttctctacttcatatctttcaagcagctttctgcaataatatgcagaaccgtgtatatctgatgcaatcattatcttcttcatattctgtcctttccttagataagccaattcttaattatcttgcgagcttattaaatgttggcactttataatgtgaagcattacttaaaaactgagataaagtattagggaccttgtatgtatcaagaaccttcttcataaaagcaattgatcttttcttatacttcatgcttcgcaatactgttaccgcggcctcatcatcataaccccttgcaaactgctttgcatatcttgcaaacttagttttatcaagttcaggaatgtcaaaataattctggaatatctccattgcctcaataattcttgtattatcaaaatcaagttctactgcaggtcttttcacctctatattaccaatatgacatacagactgcttacacacgttagaatacaagcttatattatcagacttaacattcgtaagtgaatatttgttatacaggtgtattccggtaaacattccacttgaattatcctctccaaagaaataattcagtaaaagctctgtaatatctccctgtgcgtctgatttcttaatatacatacctcttccaacacggattatctcaccctcgtcagagagcctttcgacagcccggaagaatgcttcctgattcatcctctcaaatccatgctcatacatatcattagccgacacaattgtgccatctgccacattatcaaagtaatctaatatcttatctctgttcttcataattctttagcatagtgaagttattacacttcttcaagattaatagtctctgtttcttctgtatcatcatcagattcttccttttcaggcttttcttcttccttgccatctgccttctcattgattaccttgacttcaacctcaacgtctccgtctttctcatcaaatataacaacatcatcaaaatcatcatctgatgcaaggcagtcatcctcatcaacaaaatcaggatcttcctcatcttcttcatcgacatagaaattaacaggaataacttctacattactgcatacagccttaccaataatatatactgtatggattccttcctcatcaacattatcaacaaggttcttaactcctgctatctttcttgaaatatcacatgttgcattgacaccttctggaagaataatagttactgaacttgcattacttgagaaattaatatatacatccttctcaaacactgcaagaccaaggtctagtactgccttagaagccactgctttaagctcacagccagcaaatacttcatcttcaacctctataaccttcttctctccgatagcattatacttacggatttcatcatcaaaactatcattctcttctttagcgaatctttccttagtctgcttgaacttatcaaaagcaaccttgcctgctacagcagcagcgcctactcctaaaacaatcttagccaatccatgtttctttgccatagtattatcctccaattcacgcattataatgcaatctactctttaaatttaatcaccacaaaatcttgttttagtatatcatactccctatacaaaaatcaacgcgaatagacacatccgcaataattctgcctgtatagattatactcatgtgaaagctcaatagaacgcttatatccctcttttttcttaaaatcagataaaagataaggcatatcatattcctctgaaagctttaaacctatttcattaagcctgacgctgttctttagaggacttattgtaagcgttgtcgtaaaataatcaaattcaccagcctttgcagtctcacaagtctttcgcagtctcagctcataacagcggaagcacctttccccaccttccctgcactgttcatatcctttagctatgtcatagaattctttagtatcataatcgccttctatgaaggaaaccttatactttgccggaaattcactgatgaatctcttctgttcttcaactctttttctgtactcttcctcagcagatatattcggattatagtagaatacagttatatggaaataatcagaaagatactctatgcaatggctgctacacggtgcacagcagctgtgaagaagcagagtcggtacaattccgtccttctggaagcccgctatcttcttatcaagctctttctgaaaatttctctgttcaaaaggtattcccatattacttaacctgtcctgttatctcttctaacgcagcgtaaagcttttccatctgctcatcagttcctattgaaattcttaagtaattatcaataagtggctggttaaaatatctgacaaatatgttcttttctttaagtttttcaaatatttccttagccgaaacactcttgtgtgttgcaaatataaagttagccttagagtctgggaatgagaagcctaactgtgaaagtctttccttagcattctctctggtcttaactatcttacccacgcactcttcaaagtattccttatcattgacagactcaatgccatagcttattgaagttctgttcattgtgtacgaattgaatgagaatttgacatcattaagtgcctttataagctcaggattaccgaaacagtaacctattctcataccagccattgaacgtgatttagaaaatgtctgtacaaccaacacattttcatacttattgacaagctccattgctgactttccgccaaaatcaatataagcctcatcaacaataacaactacatcctgattatgttttataatatcttcaaccttatctagttccatataaagtgctgtaggagcatttgggttagggaataccactccgccattctccttgtaataatcttctggaattatattaaaatccttatcaagcggctgcttctcatatggaattctgtaaaggtcagcccatacactgtagaaagaatatgagatattaggaaacagtattggcttgtctgaattaaagaatgtcaggaaacacattgacaatacatcatcagaaccaactcctacgaacacctgattatcattcattccataataagctgcaattgcatgtacaaggtctgtaacctcaggatccggataaagtcttaaatcactgatattcattctctctgctgcctcatgcaccttaggtgttggaggatatggattctcgttggtattaagctttacaacatctttaaccttaggctgctctcccggcacatatggctcaactcttctaatattcttctcccatgtcttcatatataagtcctcttctttcacgaataattataatcccatctctttagcaacttctgcaaaatgtggtaatgaattaacaattgtctcataagatacgcagtatgcaattctaacatatccagggcatccaaatgatgacgcaggaaccataaggatattgtgcttcttagctgcctcacagaaaacagtttcatcttcaacaggcgactttacgaaaagatagaaagctccctctggctttacacattcaaagcctaaccttgtgagtccttcgtatattgcctttctgttcttgtcatatgcctcaagattaacctgtgcatcaacacattttgcaacaactctctgcataagtgaaggcgcattaacgaatcctaaaattcttgtagctacagaagctgctgacttaacatcttctgaatctgtaacctcatcaggaataacaagatatccgattcgctcacctggaagtgaaagcgacttactgtatgaataaccaacaatagtattgtcgtaatatttagtaagatatggaacatcaacaccgtcataagctaactctctgtatggttcatctgctattaagtaaatctctgttccgtactccttctgcttcttatccataatagcagccatcttctttatagtatcctctgaatatacaacacctgtcgggttattaggattattaacgataacagctcttgtcttaggtgttatctttgcttcaaactcgtcaagcttaggctggaaatccacagtattaggtgaaacaaccactaattttccgccaaaattgcttacataattcctgtattcaccaaagaatggcgcaaatgtcataacctcttcgcccggattaagtaatgtcttgaatattgtattaagcccgcctgctgctccaacagtcattacaatattagtatggttaaaatgtgttccgaatcttctattaagcgactcagctatagtctgtctcacatcctcatatcctgcattactcatatagccatgtataaatgttgattcttcattatctactatatccttaactgcttcattaacctctgcaggtgctggaacattagggttaccaagtgagaaatcatacacattttctgctccgtataacttggcaagtctgttgccttcctcgaacattgcacggattaccgaactgttttttactaaagaaaccattgaatcagctatcattgtttatatcctccaaaaaaaatatgactacattataatcaaaatcatttgattttacaactttcaatagatgtaatcatatgttattatttagattagcatttcattaattccaactgggggaagaatattatgtctaaaactctttattcagtatacagatatattgttttaggtctgtttcttattattaacatatggctgtttctgctaagcattttcagtacgagcagactgacagctgatgcaagtgaacgcacttattacacaggagaccatgtatggcttcatataatcatacttgtagttcttattgctgcagtcttttatcttgtgagaaataacattttcaccagaattaacagttatctttccaataacgagaaaacatttatacgaatccgcaatatatgtcttattataattggtataagcggtgccgcctgggttctgcttacgcagagtaatgcaggcgctgaccagtattatgtacttgatgctgcaagaggacttagaaacggtgattattcggcattccgatacaatggctatatatcaaaatacactaaccagattgggcttctgttcattgaatacattataggtttcatagttggtgactataattacttattctggcagcttcttaatgttgtgatgattgtattcacttacaagatgttttctgacatacttgggattttaaagcttccgcggattgtaagcctgtccactgttatgctgggaattctgtttttcccatggactctctacagcgtattcatatatggcaatgttgcagggttattctttgccactgccgctttcaaatacacaatgctttttattgacagccttaaagagtttaacagctttaagatttcatatattgttataagtgctgtttccatgatgttaagcgttatggttaagaataattatcttatattcatgattgcgctcataatctatacggttgcagaaacactaagacacagaaatatacagattattctcgttacatgtgccgtaattgcaggatttgcaattcaggccattgttccaaagcttgttatcgaaaagatttccggctgcaatcttggaagcggtgcttcaagctggacatggattgcaatgggacttcacccatctgatggcaatgtttatgcagacggctggtacagcgggcgtattgctgcattttacgagaataacgattacgatactaagaaagaagctgaggtttctaaagcagagattaaaggttatattgacacatataaaaatgaccacaaagcatttacatcatttctttcaaagaaggttgcctctcagtggaataaccctgaattccagtgtttctggataaccaatgtccgcagcagtgatattgagaaaagccctgttatctcggatattctttcattaaagggaagcacaccatttattgcatttcttaatataatgcagagtattattttatttggaagtatgctttatgctattaatacacttattgaaggtactttcgcaggcactgctgtgcttcctcttacttttataggcggattcatattccacctgttctgggaaggcaaatgccagtacacgcttccttatttcatgctgttactgcctcttagtattattggtttttacagcatggcaaagaaactgtcctcagtcacaaagaagcatttatacaaatgtggtgtattcgctgtaattcttttattcatagcaattatattcaaccgttttattattcttaatcaggataataagagttacagacaatacagggaatacactattgaacagcaaaaactttaacgggaggttttatgaacagacctgattgtttatatattgtaattccatgctacaacgaggaacaggttctgcctgttacttcaggcatgtttcttgatgaacttaaccatcttatcaaagccagcaaaatcagttctgacagcagaataatgtttgtcaatgatggaagttctgacaatacatgggatatcattactgatttatcaaagaaggatgaacatttcatcggaataagccagagccgtaaccgcggacaccagagcagtgtgcttgccggtcttatggaggcttcccagtatgctgatatgactatatctatagattgtgacggacaggatgatattcacgcaatggaagatatggttgacgcttaccacgatggctgtgatatcgtatatggtgtaagaaatgaccgttcaacagatacattttttaaaagaaacacagctaaaggcttctataaaatcatggcagcacttggcgcagaaactgtatataaccatgccgattacaggcttttatcaaagcgtgtgattaatgaactggcacaattcaaagaaactaatctgtaccttcgtgggcttatcccgcttgtcggttttaaaagtacaagcgtatattattcaagaagcgaacgacttgccggaaagtcgcactatcctttcagcaaaatgcttaaccttgcattaaacggcataacaagccttagtgtaaaaccactccgtcttgttatgtcacttggtattatcgtttcaatcctcagcttcatcggtgttatatgggctgtcgttgacaacctgctcggcaacacagtaaccggctgggcaagtacagtatgtatcgtatgcttcatggggggaatacagcttatgtgcctcggggttatcggggaaatacatcgggaagatatatatggaggtcaagaatagacccaggtttattatcagtgagaggacttatgagtgcaatgaagatgaaaagtcttgatgagtgatactggaaactcatttcctataaaacactcatgtatgtgtttcttatgtgtttattttcgcttctgtcctattagaatcctcatacctgttaatttataggtaacttttcatataattcacgatttttcagcctgtaagtatctttttctcaggttcttatcctataaaacccattatttcagataaagtccatataatggtgtaaattacaaatttatataaaaaagagcctagagctcatctttcagttataattaagttaccacacaaaaacataattgaaaggatcctttcaattatgtttttgtgtggtaacttaattataactgaaagatgagctctcggctcttttttatataaatttgtaatttacaccattatatggactttatccgtgaatgggcgagaagacctactagatgagaaagaagtgggcattgagtaggtctttatccttcagaattatcttttaccaagcagaaatataaaaaaagacctactacatcatgcaattccaaagatttagtgggtcatcaagcatagacacattgtttaaaatgtaaaaaaagacctacaaaacaaagagaatattgcttttagtgagttttataacgacatcggattcaatattacaatgaattgatacaggtatcattcgagaggttgtgcaagtaaaaaagattttgttaaatttatgcataaaatattatattaagatacaataatataaaataggcgtttacaaaatatatataatatgatatatttttactattccagtatacaaacaaacgtaacgaataaatgttcgaaaggttcttgacaatgcagacataataagatattatttagaaaacgaacacatgttcaaaaggagagtttaaggtatggttaatgaagataagatgaaagcccttgatgcggcaatttctaatattgagaaacagtttggtaagggctctgtaatgaagcttggggaatcaacagctaatcttaatgttgaatgtattcctacaggttctttaagtctggatatcgctttgggaattggtggagttcctaaaggaagagttgtagagatatatggacctgaatcaagtggtaagacaacagttgcacttcatatggttgctgaagtacagaagagaggcggtattgcaggttttattgatgcagagcatgctctggatcctgtatatgctaagaatattggtgttgatattgataatttatatatttcgcagcctgacagcggcgagcaggcacttgagattacagagactatggtaagatccggtgcagtcgatattgtaattgtcgattcagttgcagctcttgttcctaaagcagagattgatggtgatatgggcgattcacatgtaggtcttcaggcaagacttatgtcacaggcattaagaaagcttacacctgttgtaagcaagaataactgcgttgttatatttatcaaccagcttcgtgaaaaggttggtgttatgtttggaaatccggagacaactacaggtggtcgtgcacttaagttctattcttctgtaagacttgatgtaagaaagattgagacacttaagcagaatggtgaggttattggtaacagaaccagagtcaagattgttaagaataaggttgcccctccattcagagaagcagagtttgatattctttttggaaaaggtatatctacagaaggagatcttgttgatcttgcttctaatgcaggtattatccagaagagtggagcatggttctcatatgagggtaataagattggacagggacgagagaacgctaagcagttccttcttgataatccagagataagagaagaagttgacagaagagttagagaacactacggaattgtggacggtgttaaggaagcagaagcatctgatgatgctaagcaggctaaggctaagaagaaagcagatacagaagagtaatattaaggtgggttatggaagataatattgaacttattgtcacatccattaaagaacttactaagaaacgcaggcttgtatatattaattatgagcctgcatttgctttatatgcagcagaattaagaaagtttggaattaaggatggagagtctgtcaggaaagaagcatatgattctctgatagatgatgtgttatctaagcgtgcaacggtaagagcgatggcattgcttaagaataaggattatacaagaaaaggattagaggacaagcttagagatggatattatcctgatatgtgtatagattatgcattagagtatgtaaccaggtttggatatattaatgatgagcgctttgcagagaattatgttaattttaaggcaggtaataagccaagaagacagattgaacttaagttaaagcagaaaggcgttgatgcagatattatcagcagggtttgtgatgaattctatgaagataatagtgatatagaattagaacaggcaaaggcatttgttgaaaagaaacatatagatatagagaacgctgattataaagagcttcagaaggtcaaagctgcattatatcgcagaggattcagtatggatattattaataaaacattggattctaaggggcttttccttgacataatcgacaattgagtataatattagattgttgtattttttgtacaatgaaaactaaataaggaggtgctcctgcgttgattccaatagtaatcgcaattattgctactttagtgatagtcgctcctattacttggcttatctcgtctaatgcaatcaacaagcgtaacgatgcaacaatcggtaatgccaatgagaaagcaagagagataatagatgaagctcttaagacagctgaaaccaagaaaaaggaagctcttttggaagtcaaggaagagtctttaaagactaagaacgaacttgagaaggaaactaaggaaagacgagctgagataagcaagtatgaaaagagagttctttcaaaagaagagacacttgacagaaagattgaggctgtagagaaacgcgactctaacattaccaggaaagaagaagaacttggtaaacagaagcaaaaggttgaagaacttgagaagaagagacagcaggaacttgaacgaatctcaggattgacctccgaacaggcaaaagaatatctattaaagactgttgaagacgaagttaaacatgatactgctgtaatgattaagacattagaaagcagagcgaaagaggaagcagacaagaaggctaaggaaattgttgttaatgcaattcagagatgcgccgcagaccatgtggctgagacaacaatatcagtagttcagcttcctaatgacgaaatgaaaggccgtattattggtagagagggtagaaatatcagaactcttgaaacacttacaggtgttgaacttatcattgatgatacacctgaggctgtagttttgtcgggctttgatccggtaagaagagaggttgcaagaatcgctcttgagaagctcatacttgatggaagaattcatccggcaagaattgaggagatggttgagaaagcccagaaagaagtcgagacattaattaaagaagaaggtgaagctgcaacccttgaggttggtgtacatggtatccatccagagcttgtaagactcttaggtaagttaagattcagaacaagttatggacagaatgttttaaagcattctattgaagtagcacagcttacaggtctcttagctggagagttaggacttgatgttaagatggctaagcgtgctggtttattacatgatattggtaaagctgttgaccacgagatggaaggctcacatattcagttaggtgttgatctttgtagaagatataaagaatcagctcttgttattaatgcagtagaagcacatcatggagacgttgagccagaaagcttaattgcttgtcttgtacaggctgctgatacaatttcagctgcaagacctggtgcaagaagagaaacgttagaaacttatacaaacagactgaaacaattagaagatattaccaactcattcaagggagttgagaaatcctttgccattcaagcaggtagagaggttcgtgttatggtagttcctgaagtcgttagtgattcagatatggtaatcatggctcgtgacatttctaagcagattgaggatcagatggaatatcctggtcagatcaaggttagtattgtcagagaatcaagagctgtagattacgcaaagtaaactaacataaaccaaggctgttacataatgttaattcgttatgtgacagccttttttgattttaacacacttaatttaattaagcattttaaagagatgttttaaaatattaagttatttttaaaaatatttgcaattatgaattatacattgtagaatagagcatgttgattatatgctgattaggaggaagattatgcagtacaatgatatgagtaaagaagagcttttagctttaaaggaaagcttgaacaaagagtatgcagaagctaaggcaaaggggcttgcgttagatatgtcaagaggtaagccctcagctaagcagcttgatgtttcattaggacttcttgatacaatcaatagttcatcagaccttaaggctttagatggaacagattgcagaaactatggtgttttagatggtattccagaagcaaagaagcttatggcagatatgatgggaacaacaccagatcatgttattgtgtatggaaacgcaagtcttaatattatgtatgaccagatttcaagagcatacacacatggtattcttggtaatactccatggtgcaagcttgataaggttaagttcttatgtccagttcctggatatgacagacattttgcaatcacagaaagatttggaattgagatgattaacattccaatgtcagagtctggtccagatatgggtatggtagaagagtatgtaagcaaggatgcttctgtaaagggtatctggtgcgttccaaagtattctaatcctcagggatatacatattctgaagaaacagttaagagaatggctgcacttaagccagctgctgaagatttcagaattttctgggataacgcttatgttatccatgatttatatgatgacaataaggatgagatagctgatatcatcagtgaatgtgagaaagctggtaaccctgatatggtatttgagtttgcttcaacttctaaggtgagcttcccaggttcaggtattgcagcacttgctacatctgctaataatattgcagatatcaagaagcagcttacaatccagacaatcggacatgataagcttaatcagttaagacatgtgagattctttaaggatatcaatggacttaaggaacatatgagaaagcatgctgagtttatgagacctaagtttgaggctgttgaaagtgttcttgaagaagaacttggcggacttggaattggttcatggacagagcctaagggtggatattttatatcatttgatgctatggatggatgtgccaaggcaatagttgcaaaatgtaaagaagcaggtgttaagcttacaggtgcaggcgcaacattcccttatggaaaggaccctaaggactctaatataagaattgccccatcattcccaactccagaagagatgaagcaggctgctgatctttttgtactctgcgtaaagcttgtaagtgtagaaaagttacttgaaaacaaataattaaatgaatataattaatataagcttgctttttataagcaagcttatttaataactgggtatataataatcagatgttatatatcatgatatagttgggaggatatacatatggctaagattggttttattggaatgggtaacatgggatatgcaatgcttaaaggtgctttggcagcattttcaccatcagatattatattttcatcaccagacagagaaaaatgcgaaagaatatcatctgagacaggcgtacgatttgcagaaagtaatgcagagtgtggcaataatgccaagtatattgtgcttgcagtaaaaccacagatgtatccaacagtacttaagaatattgtcaatgtggtaacagaagaaagtattattatatcaattgcaccgggaattactattgcgtctataaagaatgctcttggaagcaacataagagttgtaagagcaatgcctaatacacctgcacttattggagagggaatgacaggagtatcatataatatgacagatttttcatttgacgaaagagatgttattgataaattctttaattcatttggaaaggttgtttatgttgatgaaaagcttatggatggaatagtgtgtgcaagtggcagctcgcctgcctatgtatatatgttcattgaggcaatggcggatagcgttgtaaagtatggaataaagagagatgacgcatataagctggttgcccagactgtccttggttcggcaaagatggtacttgagtcaggagaacacccggcagtacttaaagataaagtgtgttcgcctggtggaacaacaattcaggctgtttctgcacttgaagagaatggtttcagaaatgcacttatcaaagcaactgacgcctgctatgacaaatgtacaagcattaagtaacatttttatatagaaaggctgaatatgaaagaacatattaaaagagtggatagaattcttaaatataagggttcaatacttgatatatatacagatgttatagagactcccgacggacatagggcagaatgggattatattgaccacagaggagcggcagctgttgttccggtgttagatgatggacgtcttctcatggtaagacagtacagagacgcacttgacagagagacgatagagattcctgcaggtggtcttaatggctgggatgagccgacaattaatgcggcggcaagagaacttgaagaagagaccggatacaggtcagataatcttaccaagcttgtatcagttgttactgcggttgcgttctgcaatgaagtggtagatgtatatcttgcaacagatcttataaaaacaaatcagcatcttgatgaagatgaattcatagatgtagaaaaatacacactggatgaacttaaagacatgatatttgcaggaacgatacaggattccaagacaatttcagcagttcttgcttatgatgccttgcttaaccgtaaaaagaataattaagacaaagtcttcatatattgattcaaagtacattttgatggatatatatgaaggcttttttattgtgggtgattaagaatgtaagatttgccgcattaattattgcgggaattatacttggtacatgctttataaaaatgtggcactatggtgatgtgttttcaactgaatatttgattgtatacattaattctaatgctgcatatgcaaatgtatggcaggaggtgctatcttacagattaaggaagttcataacattggtagtattcatgattaccccattcagaaaattgtatgtatactggctgtgtctatacaatggattctgccttggaatatgtatgacaaaggctgttatgtatcacggtgcagggggagtagttatggttctggtatggctgtttccacattatctgttatatataatgaccgttctctttatgtgtcattattttctaaacagaattgacactttaagaagaacggtcattattgtgagtatgtcattgttacttacattaatcggaacatttgcagaaagctacattaatcccgacataatgaaaatgtttttaaataaggtctgcaatatcgtataaaagcttttcagattcagcccatccgaggcatgcgtctgtgattgattttccataaacaccgtcgccaaccttctggttaccaggctcaatataactttcaatcataacacccttaacaagcttcttaacatcagcagagtgatggcagctgtgaagaacttccttgacgatacggatctgctcaagatactgcttacctgaattgctgtggttagcatctacaataacagcaggattctcaagatctcttgcagcatacatgttataaagtcttattaaatcctcatagtgatagttaggaatagtctggccgtgtttatttacggcacctcttaatattgtgtgtgtaagaggatttccaggtgtattaacttcccagtttctgtatataaatgtctgcttagattgggcagcaactacagaatttaacataactgaaaaatctccacttgtaggattcttcattccggctggaacatcaattcctgaacatacaagtctgtgctgctggttctcaactgatcttgcaccaacggcaacatatgaaagaacatctgaaagataccagtagttttcagggtaaagcatttcatcagcaggactaagatgtgtctctttcattacatcaatatgcatttttctgattgcaacaagaccggcaagaaggtcaggtttcttttcaggatctggctggtgaagcattcccttgtaacctacgcctgtcgttcttggtttgttagtgtaaactcttggaataataataactttgtctttaatcttctcctgaaccttaacaagtcttgatgtgtaatcaaggacagcagtttcattatctgctgagcaaggtccgataataacaagaagtttgtctgatttgccagtgataacatcagcaatttcagcatctctttcagcttttaatgcttttatttcttccggtacagggtactgttctttgatttcagtaggcgtaggaagctttgtgacgaactcgaaactcatataattttctccttaaaaatgtatattcaattaattacatttgcataaaaaacacaatgtctatgtgattataacatttgttttcaaaaatgcaaaataataatacagaaagtactctttgtggtacaatatattaaagattgtcgggaggcgtggctatgaatattaacagaattatatggatagttttggatagtgttggaattggtgaggccagggatgcagctaagtttggagatgaaggtgcagatacattgggacatactgcagaggctaatggaggtcttaatattcctaatatggtaaagcttggaataggcaatatagacggtgcacataaccttgagcgttgtgataatcccatcgggtgttttggaaaactggcagaagtgtctgcaggaaaagacacgacaattggacactgggagatggcaggaatatattctcctgatccgtttcctgtgtatcctgatggatttccagactgtattattgatgaattcattaaaaagacaggaattccaggaatactttgcaataagccggcttcaggaacacagataattgctgaacttggtgatgaacatgttgcgacaggaaaaccaattgtatatacatcaggagattcagttttccagattgcatgtcatgaagatgttgtgccggtagaaagactttatgaaatgtgtgagacagcaagacatatccttacaggaaagaatgctgtggcaagagttattgcacgaccttttgtcggggagaatggcaattataagagaacacctaacagaagggatttctcactaaagccaagtgaggataatatattgtgcagagtccgtgataaagggcttgatgtaatcggagtcggtaagattcatgatatatttgccggagttggacttacagagtctaagcacactaatgataatcaggatggaatggatgtaacacttgattatatgaagcaggataataaaggaattatatatactaatctggttgagttcgattcaacatggggacacagaagagattataaaggttatgcaagaggtcttgaagaatttgatgatagactcgcacaggtgttagacactatgaaagacacagatatgcttgttattacggctgaccacggttgtgacccaacctataagggaactgaccatacaagggagtatgttccattgcttgtatatggcaaatgtttaaaacatggcgttaatcttggaacaggtgacacttatgctgatatagcacagacactggctgagatttttggcacagaaccggttaagataggaaagagttttcttaataagattatgtaggaggtctgcattatgagaatggttgatattatagagaagaaaagagatggtggaaagcttactaaagaagagattgatttctttgttaatggctatgtcaggggggatatacctgattatcaggcttctgcacttcttatggcaatatatttcagaaatatggattatgatgagactcttaacctgacgcttgcaatggaaaacagcggagataagctggatttgtctgggattaatggaattaaagtagacaagcacagtacaggtggcgttggagataagacttcacttgttcttgcacctatggttgcagcacttggcggcaaagttgcaaagatgagtggaagaggacttggacatacaggaggcacgattgataaactggaaagtattccgggatttaacacttctctgtctgaggaagcatttgttaagcaggttaatgatataggaattgcaataacagggcagacaggtaatcttgcacctgcagataagaagatatatgcgctaagggatgttacggcaacggtcgagaatatttcgcttattgcaagcagtattatgagtaagaaactggcttctggtgctgatgcgattgttcttgatgtcaagaccggaagtggcgcatttatgaaaaatgaggctgatgccgtaagtcttgctaaggagatggttcgtattggaaagggagctggaagaaatgtaacagcacttattactgatatggaccagccgttaggatatgcagttggaaatgcacttgaagttatcgaggctatcaatactttaaaaggtgaaggaccagaggatttaactaagcttgtccttaatcttggaacatatatggtgcttgctgcaagagatgatcttgataaagaaactgtaagaaaagaattggagagagtaataagtgacggaagtgcgttggacaagatggcagagttcgttaaagcccagggtggagatcctgacgcagtatataacatagataagttaaagatatctgatacaataacagaggtgtgtgcagatagcgatggatacatccagtcaatccagtctgagctgataggaaaatcttcaatgattcttggaggcggaagggcagccaaggacgatgtgattgatttatcagttggagttgtgctttctaagaaaataggcgacaaagtcagcaaaggtgatgtgattgcaagaatttactgtgataatgcagaaaagactaaagaagcagaaacaatgattaaggatgcgtatacattttcgcaggaatatgtcgaaaaaaatgtacttataaagggaatagttggttaatagttgtaaataattggattttgtggtattataaacaccaaacggggctttgccctaggtttgtgaattgaaaaggagagttacgatggaagtaagacagggtgctaacgcaagagatgtaaagggttatgatacagaaagactgagaaatgattttcttatccagaatcttttcccagctgatgatttcaagcttgtttacagccagattgatcgtattatcgtaggcggatgtatgccggttaataaggaacttacacttgaggcaggttctgagcttaaggcagcatatttccttgagagacgtgagatgggtatctttaatgtaggtggcaacggttcagttatcgttgatggtactgaatataagtttaaatatagagatggtctttatattggtatgggttctaaggagattaagttcaagagcgaggattcttctaagccagctaagttctactttaactcaacaccagcacataagacatatcctacagtatttattgatccagaaaaggatatcaaggatgagttcaagcttcagcttggttctgttgaaggatgtaataagcgtcttaacagaaagtatattttaccaggtcaggttgagacatgccagttagagatgggtatcacaactcttgagccaggaagcgtatggaatacaatgccatgtcatacacatgacagacgaatggaagtttatttctacttcgagattccagaagaagatatcgttgttcactacatgggtgagccaacagaaactcgtcatatcatcatgagaagtgaagaagcagttatttcaccaagctggtcaattcattcagcatcagctacacatgcatatgcatttatctggggaatggctggagaaaaccaggatttcgatgatatggactgggtagacatgaaggatttaaagtaatccgtcagtacatattttactaaggaatgtaacctgtagagggtttcatttataaattattattaggaaaaggagaattaaaatgtcagttaatttttcacttgaaggtaagattgcatttgtaactggtgcatcatatggtatcggcttcgctatcgctagtggtatggctaaggctggtgcaaaaatcgttttcaacgatattaagcaggaattagtagataagggattagcagcttataaggaagctggtatcgacgctcacggatatgtttgcgacgttactaacgaagaagctgttaacgctactgtagagaagattacaaaggaagttggaccaatcgatatcctcgtaaacaacgctggtatcattaagagaattcctatgtgcgagatgacagctgctgagttcagacaggttatcgatgtagatcttaacgcaccattcatcgtatcaaaggcagtaattccttcaatgatcgaaagaggacatggtaagatcatcaacatctgctcaatgatgtcagaattaggccgtgagacagtatcagcttacgctgctgctaagggtggtcttaagatgcttacaagaaatatttgttctgagtatggtaagtacaatatccagtgtaatggtattggacctggttacatcgagacacctcagacagctccattaagagagagacagccagatggatcaagacatccattcgactcattcatcgttgcaaagacaccagcagagagatggttaaagccagaagaattagctggtccagctgtattccttgcttcagaagcatcagatgcagttaacggacacatcctctatgtagatggtggtatcctcgcatacatcggcaagcagccacagtaatcgcggacatagattagcggtgcagataacaataaagggcttgagacaagtttacttgtgctcaagtcctttttgttatctatagcgcatagagcgcgacagcgcgtgtggactgaccgcaggtcaggacacggcactgcgcgaaagtagtgggacgcacctgtcccgtccatcaattcccagccgcaagagtgaagcgaattgcggcgtccgttccggcacagaggaattccattgtatatgtggtgttataattagcctgataggttgtccaatatcctgtcttttaacatgatacctataggtagtcgtataaaatgcaaccttataggtagaaaacacaagtgtctatatttataactatataataaacctataaaactattttaaaattgtatcttataggtatatgcccatctaatctcatattaatcaccaaaaatcaccctaaatccgtcaaaaaacacctataaagtatattaaaaaatataatttataggaaaagattcatttatatgtgtagaacatgcttaaattatttataaacaacatatttagtaatcagcctgataaacaacctgaaacacttataaaacaatacttgtaattatgccaatcaatgataaaatcaagtaaaagggggatatgcacatgtcaatatttaagaagaacacaaccaagaaagagatagaaacatcactcaatgaaatccagattaatcttgagaataattacaaggatttagcaattaaggctttcaaagactcatcagagcttgttgaacggtatcataatgagtctttgattgatgagaaagcgtatggtaaatataaaggacagcttgatgtatttgcaaagagaatggaaggctacagtcacagactgaatgtgaaatattaaaaagtattgaaaaaaataataatatattgtcaagatatagatacgtatgttatattaaatatgtagatacaaccataacctgacttgtgaatggaggggtactatgaaaaaagtatttttaattgggtttacattgatgtgttttgcttctatggcaggttgtaagacaaagccgccaaaggttgcacatccatatgtgcaggagtatgtggctggcagagagcatggcaatgtaaaagtacaggattttcttgatcatggagaagaatttgcaattggggcagatgaaaatggaaaagcggtatttaaagacccgcagaaagcatttgaggcgttagtaagggattattcagatggtattaatctgattagggatgagtacaagcttggaccaatcactccaagaaatttttatgattatatgacatatggctggcaggttaatactggcacagaagaaagcaagaaacaggctgcttttgtgactcaggttttagatatatatgagaatagttatgattttgataaatagaatatgttttaatataataaccgcaccgtcgtaagacggtgcggttattcgttaatccacaacccttatagtactaatcacaggctgtttactcttatctgtaatcacaccattctgattagtatcagtgcagtctttacatatcttatcgacaatgtccatgccgctcgtgacagttccgaaagctgcgtgttgtccgtcaaggcttggagtgtccttttgcataatgaaaaactgagaacttgcagaattattagcagaagagcgtgccatagatatagtgcctcttatatggcttatattattttggacgccatttgacttgaattcacccttgattttctcagaagagccaccagttccgtcaccattagggtctccaccctgaatcataaatccatcaattacgcgatgaaaagtcagaccgttataaaatcctgaattggcaagattaataaaattagtaacagtaattggggcagtatctgcatcaagttctacctcaatcgttccataattgtttacttcaatggcaacatggtgcttgccggataactgagtgtttccatcggaagttgatgaattaccagaattctgtctgccacatgcagtcaggctgaataaaatacataataggattatgcttaataataaatgttttttcttcattttaaaatattcctttctagaattagtgaatcaagtataacattatcagccggtatgttaaacatctaatatgcatataaacaattaaaatgtatataaatttgactatcaaaatttctatacatgtgatacaattatcaaagatttcacaatatatgagaggagattaatttaatgaaacttgaagtgaaaaatcttaccaagtcatttggtgagaaagaagtccttcacggcatttcatttgatgtggaaggcggcaaggcattaggtcttcttggacgtaatggtgcaggaaagactacaactataagaattattatggatgtatttcatgccaattcaggagaaatatttcttgatggtaaaaaatttaatccaaaggagcatctgataggatatctgccggaagagagaggattatatcctaagaaaaaagtatcagaacagcttgtgtatcttggcaggttaagaggcttatctaaggctgaagctaagaagaatactgataaatggcttaaaagactgcaggtatcacagtatacagatgtgaagttagagacactcagcaaaggtaatcagcagaaggtccagcttgcatcaacacttgtctgtgagcctgagattgttatattagatgagccattcagtggacttgacccggttaattctaagatattacaggatgttgtaacagaattgatagaagaaggaagaatagttatattctcaagccatcagatgagctatgtggaggagttctgtgaggatatagcaataattaataacggtgagattgcattatcaggtgatattgcagatattaaggctgaatatggaaagaatcagcttataatatcggctgttggaatgggagcagaagaactggcagaaaagttaaagactagctgcgaagatacattatctgtaacaggaatacataaagatggtgttatagtaaagaatattcaagagctttctggaaatgcacttattaaagaaattatgaatgctgatatagagatagcatcatttgacagctacagaccatcgcttaatgatatatttgtaaaagctgtagggggtgacagataatgaagaagttcggagtaatattccagtatgagattatgaattatatcaagaataaaagctttatgatttctacaattgttatagctgttcttgctgcagtgatactgtttcttccaagtgtatttgatatgtcaggaattcttggaataaataaagatgatactgatgataccgctgataatacggagattactgatgttatcataatctgtgatgaaaaagacatatttgcgggaacaggaattgtagaaggtgtattaaatgatgtgaagattgaaaatgtttcgtcaagagatgcacttgtagataagattgaaaatgatgaaaatgtcattgctggttttgttgtaaagaatgcaacagattttgaatatgtcgttaataatagtgatatgtttgatgatatgacgcagagatttacatatgcaatgcagctgctaagccagtataactattgtaaggagaataatctggatatggcagagattgaaaatgcttttaatccggttatcaattccgagacaactgtacttggaaaagacatgatgagtaattactggtattgttatgcacttataattattgtgttcatggttatcattctgtatggagtaatggtagcaacttctgtaacacaggagaaatcaaacagaacaattgaacttcttgtaaccagtgctgatactaacagccttttctttggaaaggtactggcaggtacatctgcagcacttttacaggttggaattatatttgcagtaatacttggaagctataagattaacagagactcatggggtggattatttgataaaatatttaatattccttcagatgtgcttataacatttgcgttctttggatttggagggctgctgttctatgtattcatatatggtgcaatgggagcgcttgtgtctaagacagaggatattaacaaaagtgccggaagtgtacagtttgttattatgattgtatattttataggattatcccagcttaataatgtagatggaattcttatgaaggttctttcattcctgccgataagctcatacagtgcgatgtttgcaagagtggcacttggaaatgtaagttttgctgagataactgtatcgtttgttattcttattgtaagcacaatagcagttggtatattaggctctaagatatacagaatgggaacgttaagatatggtaatccaattacattaagaaatgcatttaagaatcttaagcatgaataaaaagagggcggctaacctgtaatggtaagccgcctttaataatgcattattataatttaactgtttcgccgccttttacttcaacaatagtactattatttactgcaagccatactgacttaacagaagggttatgaacatatttgttatcagcaaagaactcaagtctgtcaaacaattcgttgtattcaacaatatcagaattggttgcataccagatatcatcacggttagcaatcatttcacagaattcctcaatgatttcccaattattgtttctttcaaattcaaagctgtgtccccagacatacatcatgtaaagatactgttttttagtaagtgccatgaacttcttgccaaaatcaataagattatgattgtgatgacaggttggaacccagcacatatagtcttcaggcatagaaaaaccattctcatcccctataagcataggaccatcggcattagcagcataggcttctgcagctttagtggcagcgtatttatcattagtaactcttgcatatttgatgccaactgatttagcaatatcaactatacggttatcgtaagaaccattaggatatgcaagaccatatataggacgtttaaatattttttcaagattatccttatcatcgagaatttctctaagggcattataatcgttaagtctgatcattgtaggatgtgtaaatgtatggacagcaatatcatgtcctttataaagctcaggccattcctcctgaggaattcttatggcagggtcaataatacctgtattaaggttaaaggttgctttaagattaaacttgttaaaaagctttacaagacgtctgtcctcaattttaccatcgtcataactgaaagtaagaactttgaatttgccgccggggaatactttatatactttattcatagttgttgtctccatattatataactagtttaaaatcaatgttcatattatataacacaattatttttatgtcattctttttttataattaattagaataaatcagaatgattaaaatgtttattaaaatattttacggattatgtcgagtgcatgaacttttttgggaatactctgctttgctttaagactgatgctgcggattggttcattgtttacatatatattaattgttccataaatttgtgctgaattgacaggtgcagaaagcatttcaggaatatctgcctgtatagttactgaatcatcttcacaggcaagaaattcaattgaacagtcaggtataagttcacagaaactattttttcctttggatacaggaatgtaaaatgtgtattcattattaaaatatttctgtcggctgtattgttttccaagggctataagataacgggcatcactccatttataattcttatttggtggccagccacatgcaagcagggcgatgcacagtgtccggtttttgtctttgtatgcacatacatagcagtatccggctttgttagtgaaacctgtttttccagagataattccttcatcaggatttaaaagcctgtttttgttatttagctggtaatggtatctgcctgttgtgtctgaaattgttttagaaacagtctgtgttatatataaaaaatcctcattattaatacaatatgccatggtttttgcaaggtcatatgctgttgtatgatgaaaactatagttatcctcggcatcaagaccattaggtgttatgtaatatgtgtctgataagagaatatcatccgctttttcattcataaggccggtaaatatatgaacaagtatttcactttgttcatggttaatctcagaaagaaatgaggaatcgtaattataattattgataaacggagtttcagaccttaaagaaggatttttacatagtaagtaataagcagcattttcagcaattattacagcggaatcattatgtgattcaagcataagtgagtagtataggtcgttaattatgaattgctcaccagttacggcgttaagctgtacatcaggcatggaagctgcgtaggcggaagttgttacgacaaaattcttgtcacagttttccaaagcaataataagagtcataattttagttgtgcttgccatgcttacagccgttgtttcattgctgccagaaagtatcctgcctgaatcagaatcaataagaacagagtattttgaatatagtcctgctgcctgagttgttacaggacagaatatgcaacaaaccaacaacgataatacgagtataataattgaaaaattcttaaatgatttcatagaaatttaataaaatgtctttctatgattatattaaaatgatttgaatttatgagtgctataaggtattattatatatagattaatatgtgatttaatactgtctggaataaaaaaggagaaactatggcatatatagaatttaaaaatgtaaagaaaatatacaaaatgggtgatgtaaagataagagcattgaatggagtggattttaagattgataaaggcgaatttgctgttgtattaggacctagtggtgcaggaaagagtactattcttaacatccttggaggaatggatacatgtactaccggggaaataactgttgatggtaaaagaattgacaagtatagttcgagacagcttacagcatacagaagatatgatatcggattcgtattccagttctataatcttgtacagaatcttactgtcaaagaaaatgttgaactggcaacgcagatatgtaaaaagcctcttgatattgttaagacaatagaagctgtgggattatctgacagaataggaaattttccgtcacagttatcaggtggtgaacagcagagagttgccattgcaagagcacttgcaaagaatcctaagatgcttttatgcgatgaacctacaggagcgcttgatattaatacaggaaaaaccattcttaagcttttaagtgatatgtgtaagaagaatggaattactgttgttgttataacacataatcaggcaatttcagcaatgggagataaagttattaagataaagaatggtatcgttgacagtgttgttattaatgacaatcctgtttcagtagacgagatagactggtaatactatggaggcttgtacaatatgggaaaatcagtgtggaaagatctctttcgtgagattaagagaacatttggaagatttatagctatatttgcaattgttgctattggagtagcattttttgcaggagtaacagcatcttctaatgatatgaagaattcaacagataactattatgatgattataatatgagtgatttaagacttttatcatcaataggttttaatgaagatgatattaaagctataagagcagttgatggtgttaagggagtgtatcctgcatattcacaggatgcagttatcaggaaagacagcatagagaccgctgtacatataatgtcagtacctgataatacagacaggaataatgagaattacattaaccagttacgaatcaaggaaggacggcttcctgaaaatagcggtgaatgtgttgtaagatatgaagataccaaggataatttttctataggagatacaatcaagctttcatccggaacacaggatgatattaatgacagtcttaaagattcagagtatacggttgtaggaacagtatatacaccatattatgtttcttatgaccttggaactactaatgttggaagcggcaggattaattatcttatgtatattacggaagatgaattcatgtccgattatttcaatgaagtatttgcgacagttgatggagcaaaggaattggatacatatggaactgaatataaagatctcgttaaagaaacggctgacagaatagataatatttcacagagcagaattaatgtaagaaaagatgacatacaggatgtatatgaagattcagtaaatgaggcaaaagaggctgccaaagcggctatatacgaccatgttgtagaatcacttacagaacagtacagtaattattttgtaggaatggatgtttcagctattattgagccatatatccagccggcatatgagaaagcacttgctgattatgattttaatagcattgagacgcaggctaaggaagattttgaatctaaatatggtgacagcgatgactggaaatggtatgagcttacaagacaggaacagtattcttttaaagattatgaatccagtgcagacaggatgaaagccattgccacggtatttccaatattctttatagttgtatctgcccttgtctgtcttacaacaatgacaagaatggtagcagaagaaaggggacttataggaacatataaagcactaggatacagcaaaaaggtgattgcattcaaatatatagcatatgcattaattgcttcggttactggaggaatagcaggctgtatcataggtcttaaactgtttccgcttgtaatatataattcttggaatataatataccagcttccgccaatagtgtacgacagccacatatttctttcaattatagccattacaaccatggttttagtaacagttatagcagctcttttttcatgctacagtgagttagaagaggttccatcagagcttatgcgtccgaaagcacctaagagcggtaagaaaatccttcttgagcatattacacttatatggaaacacatgtcattcacaatgaaggttactatgcgtaatctgttcctgtataagaagagatttcttatgactgttgtagggattgcaggctgtacggcacttatgacagcaggctttggtattaagaacagtatagaatgtcttattcataaccagtacggtgaacttatacattatgacagtgttgccacatttacagatgggattacacaggaggatatggatacacttgaaagtgacatgtcagcggacgtacacattgatgattttctattaaactgtggttattctgatgatgttaagagcagtgaagatacacagacagcagaatatgtcatagttgatgataagaatgcatttaaagattatgtgacattaagaactagaagaaaacataatgatgtggctcttggggattcaggcgttgttatcactgaaaagttatcaaaagatttaggggtaaagaaaggtgataagattacagtaacatcatccactggaaagcagacagaggctgttgtatcaggtattacagaaatgtatgttaatcattatgtatatataagtacagaatattataatgaactttttggaaatgttcctgataacaacagggtacttataaagattaacggagatgtaagcgaaactgaaagttatatgggagatgaataccttacaagagattatattaagggtgtgagtttccttaatgctaatgtcacacgatttgaaaatatgatacagtcacttgacctggtaacatgggtacttataatatcagcggggctgcttgcattcgttgtgttatataatcttacaaatgttaatatatcggagagaagaagagaaattgcaactattaaggtacttggtttctttgacccggaggtaggtatgtatgtgtaccgtgagaatatattccttacactaatcggtggtgtgtttggactattattaggaagacttcttcatatatacataatgcttactgtagagatggatgcaataatgtttggatatgctattaaaccgacaacatatatatattcatatcttatcacattgattttctcagttgtagttaatctggccatgtatggaaagttaaagaagcttcctatggtcgaatctttaaagtcagtagaataaaacggacagccctttcatatattgtgaaaaacaatagtgaaggggctttttttgtatgacgaatcactctataaaattcttccggatgaattaattaaagacattggaatatatgcaggatttcagcatgtcagggaaatccgtctgcgtacaggaagactgcctgctgccatatgtgataatggagaacatatgggaaccagtcttgtagatgaacatacgataacaaggatactgtcaatagcaactaattattcatcttatgcatatgaatcctgtatggcaaatggatttctgacaatcaaaggcggacacagaataggacttggcggacaggttatatgggagaatggtaaggtaaagaatttcttacatgtgacattcatgtgtataagaattgctaaacagatggagggctgcgctgataatataatggatgagcttttaaaagacgggttaaagcatactattataatatcaccgcctggctttggaaaaacaacactgcttagagacattataagacagttatctgatatatatagaaaaaatgtggttttaattgacgaacgatgtgaaatagcggcctgtgtcaacggagttccatgtaatgatattggctgcaggacagatgttttagatggttgtaataaacttacgggagtatatatggctgttcgctcgcttagtcctcaggttgtagcaatggatgagattggtggggaagatgatattaaagctgtaaaatactgcattaaaagtggctgttctgtaataggaactgcacatggaagcggtatatatgatacagatgaaagacttgcaggtcttttcggaaaaaatggatttaagagagctgtaatattggaaaaatgtggggaggcaggaaaatgtctggatatataggcgggatattaatactttcaggctgttttatgtatggtctttcatacagccagagattaaagaacaggataataatattaaaagacatggtaagaatgctttccgttatgaataatcatattggatattcacttatagatatgacgcagatatttgaacgccttggagattttgacatgtgttcatatgtcaggaatttcaccggatacatatatgaagcattgaataaatcggacattgacacatttgcattgatatggaatgaggctgctgataaagcatttgcaggaatacttggcaaaagacagctggagattataaaagaggcaggctctataagcacatttattgacaaggacagtcagttaaaacacatacaatctgttgtgtgtgaacttaatgaggaacttgatgtggttaagactaatgcagcaggaaagatgaaggcttatatcgttacaggaatatcagcaggacttatacttgtgattgtacttatatgaatcggaggtgaagtatggaggtaagcataatattcaaaattgcagcggtaggcatagttgtttcaatacttaaccagatattaaagcataatggaagagatgaccaggcagcgcttactgcactggcagggcttcttattgtcatatactggatattaccttatatacttgaattgtttactaccatgaaaaagctttttgaattgtgatagggggtggtacatattaatgtgttgtcgctttcggtgtgtgcagttacaggtgtgattcttgctctggttttgaaaagtacaggctcttcaatggggacttttgtgtcagttgttctgtgtgtaggaacagcaatgcttgtatttaacgggcttatatccgtgtacacaagaatcaatatgtttactgccggtattaatcaggaatatataaagctgatagtcaaagttataggtatatcgtatgtaacagaaatatcatcaaatatatgtaaagaaaatggatttgcagcacttgcgtcagctatggaaatatacgccaggatttctgttgcgggtttatgcataccggttatagtaactctttttgaaatggtttcagaggggattgtctgactaagaaaataattgcctttatgatagcgtttctggcggcgctcatcatacagaaaacatatatatatgcacaggatgaggatacagttaattatgattcactgatagatgaagctgattacagtggcatagacagtacgcttgatgattatggctggaaggggacatcttttaaagaacttgtaaggtcggttgccagttcggatacggatataggctttaactttacagaaacagttaccgaggcaattatttctaacagaacagttctgatacagatattacttttatctatatgcgcaatgtttcttactgtgcttgataaaaatgcatctgattcagcgatgctttttatatcattcattcttatgacgatgatagttgcggtgtttattaatgcagcaaggacaggctatgaatgtgttcagatgtcggttgatatatataaggcactctgcccggtgttttttccggcagttgcatattcgtgtggggcatcaagtgctgcagcatattatgagataattctttttcttatgtacatagttaatgtccttgtgaaaaatgttcttatgagatgcaattatgtatatatgatattaggcatgtttgatacattcagtgaaaaagataagtttaacaaaatgtgccagcttataacaaagattataaaattgtcagtaaaaggaatgcttatgttttttctgggacttaacggaataaaaagtctgatacttccattaagcgattcacttaaaatgtccgttttattcaaagctgtttctatgattcctggcattggaaacagtgcacagactgtatctaagacaattgcagggtctgctgtgcttgtcaagaattctattggtgtggctgcggttattgttatggctgtaataataggaattcctcttcttaagcttgttgtcatggcattgttatatcagattcttggagcagtattagaacctgtggcagacagccgtatagtcaaagctgttcttgttctgtcaggaagtcttgaaaatatgatatatatgattgctgtcacagttgttcttatgtgcctaacaatggcaattatatgctttgcaactaatattaatctatatgtttaaatgtggtaatgtgcaatgacaggtattattaactggtttaaaacaatatttattcttgaaattacaggagagattgcattaaagcttgtgccaccaaagtataaggaattcatagcatttgtaatgaaactgatacttgtaatggcgataataattccgctgcttaatattaagaatgcagatataagtgagattacggatggtataagtaatggatttaaaacatattctaaggagaacgataatgtctcacaggctttatataatacttcagacaagaaaatggctgaaaaaattataagtgaagatatcaatagcactgcagcttcttacggtctggaaactgtttctgtaaaatgcagcttcacatcagacatgacggcggtcagtatgataaatgtatatgttaaagaaaacaatattgcaggcaatgataatattgacagattaagaacagatatagctggcaggtatgaaatatctgtagaacagatagatatcagggaggcaggcgaaagtggataatggtggtaaaaatgaagcattttttacaggattactgaataaaacaaggaaagacaaaatatttatagtaatactggcagggatacttatgatggtgattgcaatgccaactaaaagttcatctgcaaaaagttatacaacaggtccggttatatccacagggtcagaagattatgagaaaaatcttggcgaagaactacagcagatgcttgaaaatacagatggagtaggcaaagtaaaggtcttggtaaaaacaaatgatacaaaagaggttacaggtgtattagtagtgtgtgagggaggtgatgataaaaatctggttgcttatatcacagatgcgataaatggccttttaggtgttcctgtacataaaattaaagtgatgaaaatgtcggaataatttttttggaggcagttttgaaaagagtaaaaaagaatcatattataattacggcacttgctataatgatagctgctgccgggtatattaattatgcgggtgaccttgataatataattaaagttaaagataaagaaaaggcagctgcggttgtagctgacaatgtgtcaacagatagtaatgaggctgaggctgctgacacagattttacagatgagccgggaactgttatacttacatcagcaggagttaagtcagaggctgttgcagctgctaagttaaacagggaacaggtcagagcttcaagcatagagaatctgaaaagcatagctgatgatgcaggtattgcagaggatgctaagaaagcagcagttgaacagcttgcaaagcttgagaacaatgctgataaagaaacggcaatagaacttttgttatcagctaaaggctttgattcatcggtagttacagtatctgataccaatgtggatgctgttattaatgtatcagagctttcagatacagataaagcacagattgaagatataattaaaagaaaaactggctttgctgcggataagataacaataaatatttgcaataattagtgtttatgttataatctttttaactttgagttaaatatgaatatatggaggacggttatgacaaaagagtttgaagatagaggtacaacttattctatacatgagaatgttaatattggcgaagttaaggtggctgatgaagttgtagctattattgctggtcttgctgctacagaggttgaaggtgttgacagccttggcggtaatatcactagtgaaatcgtaagcaagcttggaatgaagaatctttctaagggtgttaaggtaacagttgaagagtcaagtgtccttgtagatataacacttaatcttaagtatggaacacagataccagctgtttcagctaaggttcaggataaggttaagtctgcaatagagacaatgacaggactttcagttacagaggtcaacattaaggttgccagtgttaatgtagaaaattaaattcaggagttaaaagatgacaagatctacaatgagggagcatatttttaagttattattcagagctccttttatcgataacaaagatgagtatgaagagcagattaatctgtattttgcagatgcagatatggtagatgcttcacatcttaaggaagaagaatataattacatcaaggataagacattagcaatagcagagcttatacctgagcttgatgagaaaatcgattctgtatctgagggatggccaacaagccgtctaggaaagacagagctttctattatgagacttgctgtgtatgagatgctttatgatgaggatattcctactaatgtagcactcaatgaagctgttgagcttgccaagaagtatggctcggctgacagcacagcagcttttgttaatggtgtattaggcaagttaattaaagagtaatgcagtttttgcatgtaaagagaggatatatggctggagtatatactgtaaagcaggtgaattcctatattaagaatatgtttaagcaggattttctgcttaactcggtttctgttaagggggagatatctaattgcaagtatcatacctccggtcatatttattttactttaaaggatgctgatgcggcactttctgtcattatgtttgcaagtcaggcagcaaagcttgcatttaagttaaaggatggaatgtcagttgttgtatcaggaagagttgatgtgtttgatgcagcgggtaaataccagttatatgctaatactgtgcagcaggaaggtattggagaactgtaccagaagtttgaacagctaaaacaatattatgaggatatgggatattttgctaaagaatataaaagaccacttcctgcatttacgaaaaaattaggtgttgttacatctaagacaggtgcagcagttcaggatattatgaacatttccaaaaggcgtaacccttatatccagattgtactttatcctgcatatgttcagggagaacatgcaaagcagtcaattgtaagcggaattaccagacttgataagatggggcttgactgtattatagtaggacgaggcggcggttcaatagaagatttatgggcttttaatgaacctgaggttgtagaggctgtgtttaacgcttcaacaccagtaatatcagcagtaggacatgagacagattttacactcacagattttgtagctgatatgagagcacccacaccttctgctgcggcagagcttgctgttacagaggtagcggctgttgagaacaggatatatgaatatgaaagacgattaaagcaacagatgatgtattcgttgtctgcaaaaagagactatctggaaagattaaagctacagatggaatatcttaaccctgtcaatcagatatatgataaaaggcagcggcttatgaatatggaagataagctgaacatgttaataaaaagatgtgcggctgaaaatagaaacagacttcgtctgtatgcttcgaaacttgatggcttaagtcctttaagaaagcttgatatgggctatggttatattgagaattctgaaggtaatagaattgtatcagccgggcaggtgtcgtcagatgacgagattacagtttatcttaaagatggaagcatcagatctaaggttattgaggtaggggaagcatggcaaaaacattagaacagtcatttgaaagacttgaagaaataattgcacagatggaaaaatcagacacaacacttgatgcatcatttaaaatgtatcaggaggggatgaagcttgtcgaaagctgtaataaccagcttgacaaggttgagaaacaaatcatagttttgaatgatgatggagaacaggacgatgagtgattttaagaatgaattggaacaggaagtagaatttattaatgatttaatatcaagatatcttcctgatgagacaggacttgataaaaaaataagagaagctatgaattacagcgtcaatgcaggtggcaaaagagtaagaccaatgcttatgcttgaggtgtataagctgtgtggaggtgatgactgtcaggttgtctatccatttatggctgctttggaatgtattcattcatattctcttgtacatgatgatcttccggcaatggataacgatgattacagaagaggaagacttacaacacataaagtatttggtgaagatttcggaatacttgcaggagacggacttcttaatctggcatatgagattatggctgaagcacttatatcaggtgaaggagatatgacggcgaaagctaaagcaatggaagttattgcaagaaaagccggaataaaaggaatggtcggtggacaggctgttgatgttgaacttactggaaaggcattatctgatgaacagcttgattttatattcagattaaagacgggagcattgattgaagctgcatttcttgcaggagcatatcttgcaggctgtgatgagaaatcggctgacaggttatgcagggcagcatcacttataggatttgcattccagataagggatgatatacttgatgtgacaagttcgcttcaggaacttggtaaacctgtattttctgatgaaaagaataataaaacaacatatgttactttatacggaatggaaaaagctgaggcagatgtacaatctatgtctgatgaagctttagatataattaagagcgtgggaaagaatgaatttttagaggaaattgttcttaaccttatacacagaaacaaataaagcaggtgtgttatgattcttgaaaagataaataaaccaaatgatataaaacaattatctccaattgaatataatcagcttgcagatgaaatccggagatttcttatagaaaagattagtaagacaggtggacatcttgcatctaatcttggtgttgtagagcttacgatggcactccatctggcttttaatcttccacaggataagctgatatgggatgtaggacatcagtcttatacgcataagattcttaccggaagaaagaatcagtttgaccagttaagaaagtttggcggaatgagtggtttccctaaaagaaatgaaagccattttgatgcatttgatacaggacacagctcaacatcaatatccgcgggattaggacttgttaaagcaagggatttaaagaatgaacattacagtgtcgtatctgttataggtgatggtgcacttacaggtggaatggcctatgaggcacttaataatgcttcttcacttaagactaattttattattgtgttaaatgataatactatgtcaatagccaagaatgttggcggtgtaccacatatgcttagtaatataaggtcatcagattcatattatgaccttaaggaaaatgtgactaatactctgtataagcttccgggtggagaccatattgtagaaagaatcaagaaaaccaagagtaatcttaagcagataatacttccaggacaaatgtttgaatgtatgggaatatcttatcttggcccggttaatggacatgatattgagaagcttattaaggtgtttcatgttgctaaacgaattaacggtgcagttatcatccatgttgtaacacataaaggacatggatataagcctgcagagcgtaatccggctaagtttcatggaataggaccatttgatattgtaacaggaaaagaattgaaatcatctgataagccgacttattctgatgtattttcggaaaaaatatgccagcttgccaaaaaggataagtcaattgttgcagttactgcagcaatgcctgatggaacaggacttaataaattctccaagtggtttcctgacagattttttgatgtcggaatcgcagaagagcatgctgttacgttttcggctggaatggcagcaggtggtcttaaacctgtatttgctgtgtattcttcatttttacagagagcatatgaccagatacttcacgatgtatgtatccagcatcttcatgtggtatttgcaattgacagggcagggcttgttggaagtgatggtgagacacatcagggtatattcgacctttcatttctgacttcaattccaaacatgactgttatggcacctaagaatggcagtgaactttcagcaatgcttgaattcgctctgcttaactttaattctccgattgcaataagatatccaagaggtcaggcgtatgatggtcttgaagagtataatgcaccaatccggtacggaaaagccgagatgattattgaagagtctgacattgcacttgttgcagcaggcaatatgcttattacggcacaggcagtcagagaaaagcttaaagaaaagggttataatataacaattgtcaatgagcgttttattaagccggttgataccgatatgttggacagattatcagagtctcacagacttatagttactatggaagaaaatgttttgtcaggtggctttggtgaagcggtctgtcaatattatgatgatacatgtaatgatatagatgtacttaatattgctctgccagatgattatgttgaacatggcaatgttgatattctgcgacgggaatcaggtgttgacagagacagtattattgcgaaggtgcttaacagatgggcaaatgtattgaataaggataagagaaatgagtaaagaaagattagatgttttattagttaataaagggcttgcgacttcaagagagaaggcaaaagctattattatgtctggcaatgtatatgttgacgggcagaaggaagacaaggcaggtcagtcatttcctgacactgcagtgatagaggttcgcggaacaactcttaagtatgttagccgtggtggtcttaagcttgagaaagctatgcagaattttgatgtgacgcttgaaggcaagatatgtatggatgtaggttcatcaacgggtggattcactgattgcatgcttcagaacggcgcaattaaagtttatgctgtcgatgtaggacatggacagcttgactggaagttacgaaatgatgagagagttgtatgcatggagaaaactaatatccgttatgtaacccctgatgatgttgcggacagaatacagttttcaagtatagatgtatcatttatctcacttactaaggtacttactccagtaagaaatcttcttacagatgatggccagatagtgtgtcttatcaagccacagtttgaggcaggacgtgagaaggtaggaaagcatggcgttgtaagagataaagatgtgcatatagaagtaatcaataaggttattgattatgcaatgtcaataggatttgaaatccttaatcttgagttcagtcctgttaagggacctgaggggaatattgagtatctgctgcatttgcagaaaattgcagaaccacagataaaggaaattccatttattgtagaaaatgtagttgaaaaagctcacgaagtattgtaatatatatttaattcttttcgtatactaaatgaggttcagcatgaaatatttttatattgttactaacaggtttaaagatcctgatggtgttaatacaagaaagatcgcacattttttacgctcaaaaggagctgaatgtgtatgccagatagaacaggaacaggcatttaataaaacaggttcatacagtgatgtaagactggttcctgataatactgaatgtgttattgttcttggaggtgacggtacacttattcaggcatcaagggagttgtctgagaaggatattccttttataggcgttaacatcggaactcttggttatcttacagacacagatatgtcaagctttgaggagacattagagagtcttcttagagacgattatgagattgacagacgcatgatgcttgatggatgtatatatcgcggtgaagaacgcattttttctgatatggcacttaatgatgttgtaattaacagaaatggtgctttaagaattattgattttgatatatatgtcaatggcgagtatcttaatacatattcggctgacggggtaattgtttcgaccgcaacaggatcgacagcgtacagtctgtcagcaggaggacctataatacagccgacagcaagacttataatggtgacacctatatgtccgcattcacttaatcagagaagtattatatttgctgccgatgatgagattatgattgagatgaaggataataaaagctcatcaggaagaatgacgggttctcttaagaatgacagcgcaagagttgccacatttgatggagaaagcttctgtgaagttgtaacgggagacagaattgttattacgcagtcagagcgtatatcaagatttgtcaagacaagcagaatttcattcttagagagaataaggaacaaaatgtagttggggataattatgaaaacagacagacataaaaagatattagaagtaattgacagatacgaagttggaacacaggaggagctggcaaagattctgaacgatgaaggctataatgttacgcaggctactgtttcaagagatataagagaacttaatctgtcaaaagtttctgtggatggtaagagaacaaggtatgcaacactttcaaaggacaaacctgttgcaagtgataaatttttaacggttcttaaagaaggctttgtatcaatggatatggcacagaatattcttgtaattaagactgcacctggaatggcaatggctgtatgtgcagcaatagatgcactggaatggaatgagattgtaggttctattgcaggagatgatactatcatgtgtgcagtaaggacagttaatgatactttgcttgttatgaacaagattaagaaacttattaagaacaattaatagacagaattgaaaggcaggatatgttagttaatttacatgttaagaatcttgcacttatagaagaagagaatattgattttgatgaaggacttaatatactttctggtgaaaccggtgcaggtaaatctattattcttggttctattaatgctgcattaggaagcaagacatcacctgattttataaggtcaggatgtgaatatggactttcagagataacatttgcaataccagaagataagattgaacgaatcaaagaactgggggttatatcatgcgatgatggtgaacttgttatttcgaggaaaattatggcaaatcgttcgcagattaaggttaacggacagtcttttacatcagcccagacaagagttcttgcacatgaactgattgatattcacggacagcatgataaccagcttcttatggatgagagtaatcatttgtctgtaattgatgattatgataacagtattaatccacttcttgattcgtataaagaatgctataaggaatatactatatgcaaaaaagcatatgaaagtctttctggtgatgatgaatcaaggattaaagagatggcttttcttcaatatgaaatcaatgagcttgaatcagctgctttaaaacctggagaagatgaacagattgaagctgattaccggagaatgagtaacttccagaagattgcaggaaatctttctgaggtgtcgatgctgctttcagaaggtgacaataatcttagtgatatggcaggagctgcattaaagaatatgatagctgcaagcgaatatgatgaatctttgaaagatgactgtgatattctggctgatattgagaatcttatatcagatgtggctcataacctttcatcttatatggatgattttacatttgaccagtctgaattcaatatacttgaagaaagacttgatatgattaattctcttaagatgaaatatggcaagtcgattgaagatatattatctgttcttgatgataagaaacagaagttatctgaatatgagaattatgatgaagttgttgctgcaagaaaagctgaatatgatagagcttataaaaaacttatgaatgcggcttctcttttaagcagccagagaaagaaaacagcactaaatttttcgcaggatataataaatgccttaaaacagcttaattttcttgatgtaagatttgaagctgaatttgaagagaaaaatcctgattcaaccggaactgacaatgtcaggtttatgatatcaactaatccgggtgaagatatgaagcctcttgcaaagattgcatcaggtggagaattgtcaagaatcatgcttgctattaaaagtgtaatggcagagacagatgtatccaaaacactgatatttgatgagattgatgcaggaatcagcggaaagacggcacagcttgttgcagagaagttaaatacactctcaaaaactcatcagataatatgcattacccatctgcctcagattgcggcaatggctgataatcactatgttattgagaagtctactaaagataatcggacaataagtaacataacaaagctttcatatgatgaaagtataggtgagttagcaagaatgcttggcggttcaagtattacagatgcagttgtgtctaatgcaaaagaacttaagaatatggcacagacggcaaaaaataattaaatacattttaactgaatttacagtaatacccttttttaaaagtatttcattggtcaatactaatcttagaaggatggtggattgatatgaaggattttaaaaaagggttaatttatgccggggttctggcattttgcataggttttggagcttatatatactgtaattcaattaagaaaaagattccagataagctatatatatataagcaggataaggctgttttttctatggacatacctgttgttggtactgtatatgacagcagtaataatatatgtgccgataatattgattttggaaagcaggttacaatccagtcgggaaataccggtcagtattatgtggattataagctttttggactgctttctgtcgcaaggacacatatggaggtagtcgatgaaaaatacatttattctggtggttttcaggtaggtatatatcttaaatgtaatggagtatatgttgttaatacagagacaatatgcacatatgatgggcagaatgttgttcctgccaaaggaaagattaataaaggtgattatataattaaagttaatggttctcagacagatacgaaagaacagcttttacaggcggtgtcagaatcggcgggaaatagtatggacataactgtcaggcgggatggtcaggaaattgaagagcagattatacctgtgaaaaatgttgcaggagaatacaaaattggaatctgggttaaagatgatacacagggtgttggaactgttacttatgtgtgtgaagatggcacatttgccgcattaggacatggaatatcagataacgaaacagggaaggtacttgatataaaagatggcatgatatacagaacaaggattctgtctattgtacctggaaaaaatggagagccgggagagcttcttggtactattgattatagagaggacaacataggaagtataagatgtaatactgataaaggcatatacggtgaaaatgcgtactctttatataaggagtattcacctgaactgatgaaagcagccgggtcatatgaagcttcaaaaggaacagcatatgtaaggttttataacaatggcagttttcatgattatgaaattgatataacagatttaaagtatggcgattctaagaatataacatttaaagtaacatcaggagagcttctcaagctgactaatggaattgttcaggggatgagtggaagcccgattattcagaatggaaagataattggggcggtcacacatgtatttgttgatgattctacttgcggatatggtatatttattgatagaatgcttgataaagactaaaagaaactaacaaagaaaaggattatgatacgatggaaagagagaaatttggcagcagacttggattcatacttataagtgcaggctgcgcaatcggaattggaaatgtatggcgttttccatatgttgcaggcaataatggaggtggaatatttgttttattatatatgttattccttcttatgtttggaatacctgtactatcaatggaacttgcgatgggaagagcttctaaaagcagtataataagggcatatcatgaactggagcaacctggacagaagtggcatattcatggatatcttggaatgataggcaattatatacttttattcttctatactactgtttcaggatggatgttaggatattttattaagtatgtaactggtgatattactaaaaatactgacagttcacagatgtttgctgatgtaacagctaatccatggataatgtttgtatggatggcagtgatagttcttattgcggttattatctgcagtatgggactccagaatggtgttgagaagattacaaaatatatgatgcttattcttcttggacttattgttgttcttgctatccacagtcttacgcttgatggtgccgcaaagggaatacaatattttcttattcctgatatgaataagattgaagaggctggtcttggaaatattattattgaggcaatgaggcaggcattctttactttaagtgttggaatgggctcaatgatgatatttggaagctatatcggaaaagaacgcgcgcttgtaggagagggaatacagattacattacttgacacatttgttgcaattatgtcaggagttatcatatttccagcctgtatgtcatataatataccaacagacagtggtccaagccttatatttgtaacacttccaaaggtgttcgaacatatgtcaggtggaagattctggggcgcaatgtttttcctttttatgacatttgcggcattatccacagttattgctgttctggagaacattattgcatgcaatatggaagcttttggatggaaccgtaagaaagcaggtgtaattaacctgtttattataattatcatgagtatcccatgcattcttgggttcaatgtattaagcggatttacaccgcttggcgctggaactaatgtgcttgatctggaagattttcttgtaagcagtcttattcttcctataggaagccttgttatacttctattctgtacgactaagcttggctggggatatgataattatatgaatgaagttaatacaggaaagagtatcggcatgcctaagatttttaagttttatcttaaatatatcctgcctctgattattttattcattattattgatggtttgatttaataaacaaaaaactgtgtcgaattttgtcgaatgctgcgatatcttgcgataaaaagtgcttgcagactgctgctgtaaaaactatactaactattgtgaagttgaaaaatgtcggattatttaattttcacattatgaaagggcttgaatgtatggagaggactaaaatagctatcgcagatgataatcagagtattctggaggcattaaggagtgtaattgatgaggaagatgacatgagaattgttggaacggctgataatggtgcagataccgtgaaaatgattcatgagagccagccggatgttgttttacttgatcttataatgcctgggatagatggaattactgttatggaaaaagtaagggcagacaaaacgttagattcaaagccagactttattgtaataagcgctataggcagagacagtgtaactgaggatgcatttaatatgggagcagcatattacataatgaaaccatttgacaatgaggtgctggttaacagaatacgatacataagaaatcagcatgacaaagtaagtgtaaaaacagtgccaagagaaccggtttctattacagacagaaatcttgagacagatataacaaatataattcatgatatcgggattccggcacatattaaaggttatcagtatcttagggattcaattactttatcagtaaaggatgcagaaattataaacagtgttacaaaagtactttatccaactattgcaagaaaatacgaaactacacccagcagggtagagagagctataagacatgcaattgaagttgcatggaatcgtggtaatacagatacactgaatgatctgtttgggtatactattaactgtggaaaaggaaagccaactaattcagaattcatcgcattgatttcggataaaatccgtctgcagtacaatattagataatatttaatataaaaatgttcacatatttttcatgtatatttaattgtaaagccttgataaatagcagcgtttatattataattacaaaatcgtaaacgatttttaacaattttgtaataattattttagttgaggttatatatgcgtaagagaatatttaaaggttttgcagccgtgttattatcatctacattaactgtatccacagtatttgctgtatttgcagatgacgttgataagttaaagcagcagaagcagcagacacaacaggaattggataatcttcaggatcagtgggcttatctgttacaacagatggatgatctggaacttaagatggctaataaatctgacgaaatagatgcagctaatgtaaaacttgaagaggcagagaagattcagtcagcacaatatgaggatatgaagcttcgtatcaagtatatgtatgaagatcagtctgtatcattagctgaagtttttcttacttcatcagacatgagtacaatgcttaacaaagcagtgtatatgcaggaagtttataattatgacagaaacaagcttgatgaaatggctcagactgctagtgaaatcaaggaactcaaggaaaaacttgaaagtgataagcaggaacttgatgaagcacagacacagcttactgagaaacaggcattgctttatagtactattcaggaaacacaggctaaggctgatgatgtaaacagccagcttgaatcagctgttaagaaagcggcagaagttgcggctaagagagaacaggaacgtcaggcagcagcggcaaaacagaaccagcagattaacacaacagttacaccggcaaagggtgattcatctgtagcaagtggtgttgtttcacttgcgtattcacttcttggagttccatatgtaagcggtggaagttcaccatcaggttttgactgctcaggatttacttcttatctgttcagacagtatggaattagtatttcaagatcatcaagtgcccaggcatatggtggtacagcggttaacggacttgccaatgcacagcctggcgatgttatatgttatccgggacatgttggattatatgtaggtgggggacagatgattcatgctaatgttccaggcggttcagtaaggcttgttggtgttaattcaataggtatgagtgtaattgctataagacgttactggtaatattataatatatgtgatataatgagtgcagttttacaaggactgcacttatttttttataaatgcatgaagagtatgggattataattaagaagaaatgaggactaatgtatgaaaaatgtattgttgattgcatcagaagctgtaccatttattaagacaggcggacttgctgacgttgcaggttcacttcctaagtattttgacaagactaagtttgatgtaagggtaatgatacctaagtatacatgtataccttgggagtatcgtgaaaagatggtttataagacacatttttacatagatcttgcatggagaacacagtatgtaggtgtttttgaattagagtggaatggtgtgacattttactttattgataatgaattctattttggtggtaataagccatacagctggattcatgaggatattgagaagtttgcattctttagcaaggctgcactttcagctcttcctgtgcttggcttcagaccagacataattcattgtaatgactggcagacaggtcttattcctgtatatcttaaggaaagattctctcagggagagttttatcagggtatcaagtctattatgactatacataatcttaagttccagggcatatgggatcttaagaaagttaaggatattacaggacttccagatgaatattttacatcagataagcttgaagcctatgatgatgctaattacttaaagggtggtattgtatatgctgacagggttacaactgtaagtgaaacttatgcagaagagataaagacaccgttttatggtgagaatcttgatggccttatgagagcaagatctaatgttttatctggtattgttaatggtattgattatgatgaatataacccagagacagataagagaatttacaacaactataatcaggtaacctttagaaaagaaaagtggaagaacaaggttgcacttcagaaggaacttggactcacagaggataagggtaagtttatgattgggcttgtatcgagacttacagatcagaagggacttgatcttgtagcatatgttatggatcagctttgtgcagaagatgtacagtttgttgttcttggtaccggtgaagagagatatgagaatatgttcagacattatgactggaaatataatgacagagtatcagctaatatatattattcagaagatatgtcacataaggtatatgcagcctgtgatgcatttcttatgccgtcattattcgaaccttgcggtctttcacagctaatgagccttagatatggaacagttcctatagtaagagaaacaggtggccttaaggatactgtagagccatataacgaatatgaaggtaagggaacaggattttcttttgctaattataatgcacacgagatgcttggtattgttaattatgctaaggatgtatattacaatcataagagagagtggaataagattgttgacaggggaatgaagacagacttctcatggaacagttcagctagaaagtatgaagaactttataattcactttaattaagtgacagttttgtatttaacggtgattttctataaaagaaaaaggaagctgcgataaaagcaacttccttttttaatgcaggtggcgggacttgaacccgcacgatgttaccaccggcagattttgagtctgctgcgtctgccattccgccacacctgcgcgactttgatagtttatcataataaatcttaaaaatcaagtaaagaatacttgcgtacataataaatttcgaatattattttattattgtattataatccttttatggaggcgtttatggataactgtaaggaaatccagagcaggatagaaagctttgaacatggcaatctgtcacttaaagatgaagaagcatttaccaatcatattcttaactgtgcagactgtcgtgaagagatggagatatattatataattttatatggattagaagatgataatgagaaaagaacagagaacagcagatatagtgcatatttagatgcatttgattttacagggctggttgagcagaagcttaaggacagtgaggctaaatgtttgtttttaagacaatggactcattttaccagggtaagatatatttttgtttctacagttatggttcttacagcattgcttcttatcattattaaattcttttaaagatgggagattgttatgggtgaaaaacttatattaatagatggacacagcatattaaacagggcattttacggagttcctgaccttactaatgcagaaggcatacataccaatgccatgtatggctttcttaatattttatttaaatttcttgatgaagaaaagcctgactatattacggttgcatttgatttatctgcaccgacattcagacataaggcatttgatggatataaaggaacaagaaagcctatgcagccagaactaaagcagcaggttcctcttatgaaggagctgcttaaagcaatgaatattacagttgtcgagcaggagggatacgaagctgatgatattctaggtacaattgcgaaggaaagtgctgctaaaggaatagatgtatcaattgtttcaggtgacagagatttgcttcagctggcagatgagcatattaagataagaataccaaagacaaagaaaggtgtaacagaggttgaagattattatccatcagatgtatttaatctgtatggagttactcctcatgaatttatagatgttaaagcccttatgggcgatacatctgataatataccgggagcaccgggggtaggacctaagacagcgtctgccattattcagaaatatcatagtcttgataatgtttttgaacatctttgcgagttgaagccgcctaaagcaaaaacatcaataactgagaatatcgagcagattaagatgagcagattcttgtcagagattaaaatcgatgttccgattgattataaagttgaagattctaaagcaggtgatttctttaatgagaattcatatgaactttttaagaagtataattttaaaaatatgctaaagaagtttgagaatacagatataattgctaaagatcctgaatgttatgaatatttcaagaagatatctgattttgctgaggttgaaaatgtatttaacaaagcgatggatatagcaggtggaattgaaaaaatcggactttctattgtaagagagagtgaactggctgcagttggaataacactatcagatacagaaatatattatattccggtatcgggctttgttacagagagttatcttgcagaccgtctgtcagatgttgtaagcgtggcttctaacagaaatatagcatctgccaatattaaagattatcttgatatatttgaaaaagacaagataaatggctatccgcttgtttcagaaaaagcatttattgatactgcaattgcggcatatctgcttcatccaagtaacgaaagttatgattatgaaagtcttggaagagagtttttatcattaacatatccttcaaaaacagaacttctgggtaaattgtcaattaataaggcagtaaatgaagcggaagacaatcttattaagtatgcatgtctttcatcatatgcttattacaaatgtgctgataaaattacagaacagttaaagagtgagaatatgtataagctttttgaaactatagaaatgcctcttatatttgttctttttgaaatgcagcagcaaggcataagtgttgataaacaggcacttgttgattattcaaaggtacttggtactaagattttggttcttgagaaagagatatatgaagcagcaggcgaagagttcaatatcaattcaccaaagcagcttggtgtaatactttttgaaaagcttggaatgcctaacggaaagaagacaaagagtggctattcaacagccgcagatgtacttgaaaagcttgcacctgattatccggttgtaagtaagattcttgaatacagacagttatcaaagcttaaatcaacttatgctgacggtcttacacagtatatatcagaagatggaagaattcatggtacatttaaccagacaataactgctactggaagaataagcagtacagatcctaatcttcagaatattcctataagaatggagatgggtaaggctataagaaaggtatttgttccaaagaatggctttgtattcttggatgcagactactctcagatagagttaagaattcttgctcatatgtcaggggatgagaagctcattgaggcgtataattcatcagcagatatccacagagcaacggcggcacaggtctttggcgtaccgctcgatgaggttactgatgaacagagaagaaatgccaaggcagttaatttcggcattatctatggaatgagttcatttggattaagtcaggatcttagtatttcaagaaaagaagctaaagagtatattgaaagatattttgcaagctatccgactatcaagacatttattgacggactcgtaagtgatgccaaagaaaaaggatattcacttacaatgtacaatagaagaagagaaattccagagattaaatcttctaatttcatgcagcgttcttttggagagagagttgccatgaatgcaccgattcagggaactgcagctgatattataaagctggcaatgattaatgtatataatgcacttaaggagcataatctcaggtcaagacttatattgcaggttcatgatgagcttcttgttgagacggcagaggatgaggttgaaactgtaaagcagattatgcttgatggaatgaaggatgcagtaagccttaaagttcctcttgaggtagatttaaaggaaggaaaagactggctggaggcacactaatgaaagttattggaatcacaggtggtgtaggagcaggaaaatcttctgttcttgcactccttaaagaaatgtgttcctgcgacattatacaggcagaccttgttgcaagaaatatataccactcaggtaatattggatttaaaaaggtcgttgatatattcggggagcagatggtaggagaagatggagagataaacagacctcttctcgcagatattatatttaagaaccctaataagagaatcgttcttaacagcataattcatcctcttgtaaaacaagagattattaatcagattaataatcataagatagcaggtgatgttgattactgttttgttgaggcagcactgcttattgaagatcactatgatatattcatggatgagatatggtatatatatgtttcggaagatgagagaagaaaaagacttgctgcttcaagaggctattctgatgaaaagatatcaggcatatttaaaagtcagctatctgatgctgagttcagaaagcatgcagataaagtgattaataatggcgcagatattgaaaaaacacgcgcccagcttgagattatacttggaatatgatacattatacataatttgtttattctagaggtaggttatggataatacacagtcaagaaatgagacccttgtttttggtcttgatataggaacaagaagtattgtcggtgttgtgggatacatggaaaggaaccgttttaaggttattgcaatggctgagcagaagcatgaaaccagagcaatgcttgatggtcagattcatgatatctataaagttggcgatacaatcagaaaagttaagaattctcttgagaatcagctagaaagggaactttcagatgtatgcattgctgctgccggacgagttcttaaaactgttaattcgtctgctgagtatgaatttgaagaagaaacacgggttacacaggaacatatctattcacttaatcttctggcagttgagaatgcacataataagattaacgaaaaagaagataaagcaagattttattgtgtcggaaacacccctataagatatcagcttaacggctatgatattaataatcttgagggacataaggcttctaagatttcagttgaacttattgctacatttttgccggaagaggtagttgatggactttatgaagctgttgaatatgccggacttaatgttgcaagtcttacattagagcctatagcagccatgaatatagcaattcctgagcagtacaggcttcttaacatagggcttgttgatgtaggtgcaggaacatcagatatctgtcttacaaaggatggctgtataattgcttatggcatgataccttgcgcaggtgatgagataacagagtgcatcgcaaaaacttaccttgttgattttaatactgctgaaaagattaaaatgtctgcaagtactaagaaaaaaggacttgtaacatttaaagatatcatgggtattacgcagaaggtagatgcacttgaaataagaaatgcagcagctgatgttgtgaatgcgatggcaaaggatgttgcggaaaagattattgagcttaatggcggtaagcctgtaaatgctgtgtttgttgttggcggtggtggcaagataccaggttatacagaaagagttgccgattgtcttggaataccgcaccagagagttgcggtaagaggcgaagaggttctaactgcagttgattttcaggttgacaatttcaagaaggattcattatatgtaacgcctgtcggtatatgcactaattattatacgcaaaagaacaattttgtatttgttactgttaataaagaacgaataaagctctatgatacaagtaatcttacagttgtagatgctgtcatgcagattggcttccctaatgaaaagcttttcccaagaagaggggcagagattaactttactgttaatggaaagtcaagacttgtaaggggaagtgccggggaaggcgcagttgttacgcttaatggaagaccggctaatcttcatactccgattgaacagaatgatataatagttgtaacggaatctacagtgggagaaccggcaagcataacaataggacagcttgaagagtttaattcccagataacatttatagtaaatgataaaactatagtctgcccaagatttgcatatgttaatggagaattaaagtcagagttctatgatattaatgacggcgacaaaatccgtatggagaacttctatacagttgcacagctttttgagtttcttgacttggattataagacactcaatgtaactgttaataatgaaccagcagataagaatactaaagtatatgagaactttacggtaagaacttcttcattagaggaatataatgagaatattatggcatcagaaaagctgcaggaatcagaagaaactgatgataaggtagcagaagaaccagttatacaaccgcagaatataactattacggttaatggtcagagcgttgttttatcaggcaagcctgattatatagttgtagacctgttccagttctatccatttgatcttacaatggtaagggggaatcttgtattcttacataacggaaatgatgctgattattcatcgccacttaatgatggtgatgttatagagcttcgctgggaggataaataattatgagaatgatgccgattgccagcggaagcagtggaaactgcatctaccttggtacggaggacacacatgttctttttgatgccggaataagcaggaaaagaattgaagaagggcttaatacggcgggtttaagtcttaaagatattgatgcaatatttgtaacacatgaacatattgaccatacaaaagggcttggtgttatatcgagaaaagatgggattccaatctattcaacgtctggtacaatagaggggatagaacagatttcatcacttgggaatattccggatggaatatttaataagataaatgcggatgaagatatttcaattggagatgtaacagtccacccatttcgtatatcacatgatgctaacgaaccggttgcgtatacatttactcaaaaatgtgcagatggcataaaaaaagcatcggttgtaactgatttagggtattttgatgattatgtggttgataatctgacagaatctgatattatgcttgttgaggctaatcatgatatcaatatgttacaggttggtccttatcctttttatcttaagaaaagaatattaggtaataaaggacatctctctaatgagacatctggacagcttgtcaattccctgcttcatgataagcttaagaaaatatatcttggtcatttaagcaaagagaataactatgataaacttgcttatgagacagtgaaattagaaattgatatgtcagataactcattcaaatcttcggattttgatatagaggttgcaaagcgtgatgttttatcaggtatttgcgaaatataacaggcgcttacaaggtgcagaaagaggaaagctatgaaaaaatgtgtaattactgttgtaggaaaagatactgttggtattattgccagagtatgtacttatcttgctgatacaaaggttaatatccttgatatctcacagactattgtttcaggatattttaatatgatgatgattgttgatatgtctggttctacaaagaattttgacaatgttaatgaagatcttaataagcttggcgaagatattggtgttgtaattaaatgccagcgtgaagaaatatttgacatgatgcaccgtatctaagaaagtgaggagacttaaatactatgattaatattatggaagttacagagactaacaaaatggtcgagaaagagaaccttgatgtaagaactattactatgggtattaatcttcttgactgtgctggtcctgatttagctgaggtaaatgagaaaatatataacaaaatcacaactcttgctaaggatttagtttcaaccggagaagagattgcaaaggaattcggtgttcctattgttaataagagaatatcaattacacctatttctcttgttggttcttctgcatgtaagacacctgaggattatgttactattgcgaaaactcttgataaagcggctcatactgttggtgttaatttcattggtggttattcagcagttgtatcaaaaggtatgactaagagtgatgaacttttaataagatcaattccacaggcacttgcacagacagagcttatatgcagttctgttaatgtcggttcaacaaagactggtattaacatggatgcagtaagacttatgggcgagataattaaagagacagcagaacttactaaggataaagattctttaggatgtgccaagcttgttgtgttatgtaatgcccctgatgataatcctttcatggctggtgcattccacggtgtgacagaagatgatgcaattataaatgttggtgtcagtggtcctggtgttgttaaatacgcacttgagagtgtaagaggaaagagctttgaggttctttgcgaaactatcaagaagacagcatttaagattacaagagtaggacagcttgttgcacaggaggcttctaagagactcggtgtaccttttggcattattgacctttcacttgcaccaactcctgctgttggagattcagtagcagagattcttgaagaaatcggacttgagagagcaggagcacctggtactacagctgcacttgcaatgcttaatgatcaggttaagaagggcggtgttatggcatcttcttatgtaggcggacttagtggagcattcatccctgtatcagaggatcagggaatgattgatgcggttaatgaaggttcacttacaattgaaaagcttgaagccatgacatgtgtatgctcagttggtcttgatatgatagctattccaggtgacacacctgcaacaacaatttcaggaattattgcagatgaagcagctatcggtatggtaaatcagaagacaacagcagtaagagttattcctgttgtaggaaagggtattggagagacagtggaattcggcggactcttaggttatgcgcctattatgcctgttaataaatttgactgttctgcattcgtgaacagagtgggaagaattcctgcaccaatccacagctttaagaactaattaagaattaatataaaaaatgcaccggttgaatcagattaatggttcagccggtgtatttttatatacgtattatattctgttgcagttcattcttcattacatacccatacttttcatatacagcctgtgcatatatgtcagaacatgcaaggtcaaatataagttcttttttataatcagcagctttggtaatgaaaggtacatcaagttctttcttgatgcttccaagatactgctgtccggttttattaaaacctaataatcttatatatggtatattattgtatgaatcggacatggattttcttatttcaagaattatatgcataatgcagcggcatattcttgaatatactatattctttgatttgactttcattgcaaattctgtgatagtgtcacttcctgtaaatgtacctgcaaatctgtttgcgatgtccggactgatatcttcatattcagcaagtctgtcagcaaagtcagtattattaatgttacatatctgcttaataaataacattttatgattaaatataatactgaaatcatcaagaaataaaggacagctcttagaattgctgatttcttcatacataccggcagtaaggtatgtttttaatctgtcatgttcatctgatataagcatttttcttattccaaatgcacttgcatactcagcggtatctgtgtcgtcattgtagccagcaccttcacgaagcaccggataatatgtcatgttaaggttgttgtaaagaattgcttttatatattcaattgcaagaatgttattagaacctgttattatgtctttgcattcaggcagatattccagaagagcagtctgtcttgccgcagggtatgagagcccctctgcaagagctttgttaagaattgccttatattcaggcaattctgatattatagtacggcttatctttgccagacaatctgcattatcagtttcagcaccaaaacagattgaagcggctttcattgtattaagtgtaagaactgcacctttagcaaaattctctgcacttgataatgcgtagtatacaggtagttcaacaacgatatcagcaccagcttttaatgcagcacttgttcttgcatacttatcaattactgccggttcaccacgctgcacaaaattgccgctcataacaacgataatgcagtcagcctgcgaaatctgtcttgctttattcatctgatatacatgtcctgtgtgtaatgggttatattctgcaacaattccgcatgatttcatgtagtgtctcctttatgtttttattatattttactgaaatcgtacatttatgtcaaaaatattgctgaatttagtcaatgtatcgtttttaaaacatttttaagtgccagacgaccttgttttcgactaaaaattggtatataatttttgtcagagttcagtatgtttactgaaaatttacttttttataaggaggagtcattaatcatggcatttattgacacaattaaagaaagagcaaaggcagacaagaagactatcgtattaccagagtctatggataagagaacttatgaagctgctgagaagattttaaaggaaggcattgctaatttagttatcattggtactcctgaagagatcgagaagtatggtaagggctatgacatttctggcgccacaatcgtagatccatttaacgatcctaataagcagaagtatattgataaattcgttgagttaagaagcaagaagggtgttacacctgagatggctaaggaacagatggagaaggattacatgtactatgcatgccttatgtgtaaatgtggagatgctgatggagcagtatctggtgcatgccactcaacaggtaacacaatccgtccagctcttcagttattaaagactaagccaggtatcagctcagtttcaggtttcttccttatggaagttccagactgtgaattcggtgagaacggtctttttgtattcgctgactgtgctgtaagcccagattatgattcagagaagcttgctgaggttgctaagctttcttcagattcattcaagagctttgtaggaaaggacgctaaggttgctatgcttagcttctcttcatacggaagtgctaagcatgacagagtaactatggttgctgatgctgttaagattgcaaaagaaaagtacccagatatcactgttgatggtgagcttcagttagatgctgctttagttccagaagttgctgcacttaaggcacctgagagcccagtagctggtaaggctaatacacttgtattccctaaccttgaagctggtaacattggttataagcttgttcagagacttgctaaggctggagcttatggtcctgttcttcagggactttctatgccagttaacgatctttcaagaggatgctttgctgacgatatcgttggtgtagtagctatgacagcagttcaggctcagaatgcataattaacatttttaaggagaatttttgtaatgaatattttagtattaaactgtggaagctcatctcttaagtatcagcttattaacatggatgatgagagcgtaatcgcaaaaggtcttgtagagagaatcggtattgaaggttctgttcttacacataagccaactggaaaggataagtatgttgttgagactcctatgaaggatcacaatatcgcagttaagcttgtacttgatgctcttcaggatgctgagcatggcgtaatcaagtctacagatgagattgcagcagtaggacacagagtacttcacgcaggtgagaagtatatcgagtcttgtcttgtaacagaggatgttaagaaggttgtaagagagtgcttcgaccttggtcctttacataacccagctaaccttatcggtattgaagccgttgaggcagctatgccaggcaagccaaatgtagctgtatgggatacagcatttggtggaacaatggagccaaaggcttatctctatgctattcctcgtgaatactatgagaagtacggcgtaagaagatatggtttccacggaacaagccacagctttgtttctaaagagacaatcaagtttgctaaccttgatcctaagacagctaaggttatcgtatgccaccttggtaacggtgcttcaatctcagcttctattggtggtaagtgtgtagatacttctatgggtcttactccacttgaaggacttattatgggaacacgttcgggtgaccttgatccggctatcttagagttcttatgcaaccatgagaaccttacaataagcgagatgctcaatatccttaacaagaagtctggtgtacttggtatgtcaggcggaatctcaagtgatttcagagatcttaatgctgcagctaacgacggtaacgaaattgctaaggttacacttgaagcttatgcttacagagtagctaagtatattggtgcttacacagcagctatgaacggtgttgatgccattacatttacagctggtgttggtgagaatgctgcatggcttcgtccaatggtagctaaatatcttggataccttggtgttgaacttgatgaagctgcaagcgagaaggcttgtggagtagaaggaattatctctacaccagaatctaaggttaagctttgcgtaattcctactaatgaagagcttgcaatcgcaagagaaacattagcattagtaaaataattgacatattcgcgaaaaatattgaatttaagtgtaagatgtaagattaagttacaaaaggtagtaaacaccttagatatgtaatttctggcacttccattaatgattacaattttcatgcgtgtatcctccaacttccaattgttttaattcttctcagttccaccttcttgcccttcggacaagaagtatccctcgctcaaagagctcggtcaattccgattgagatttcacctgttttagggaatttaataactgttatattttgttattaaattctctgcaagcccttgaaaacactggatttatcgcaggtgagctttcccttattgtttcccttgtgttatatcgtcccgtcagtgtttacgaactctgataagggcaaatacaagggcaagaaaaatctataaaacagtataacacaaaataaaagtgacatggtgaactgattgaaatgcttctgatttttgtaacaaatgactgattgaatgataaggagattctatacgatgagaacaatatttgcagaatacaatccacacagaaacagcattgatatttatacttctgctggttatatgctccgcattgactgttgggaagccgaaaaggatttaaaaaccacacccggatcagactgtgcattgaacgcacttgccattgataaaccgcttgaatatgcaaaattatatcttgatggaacaatgcagatatgggtagatgcagaagattcattagaactatggtgattttttcaacagcactaaggttactttttcccaatctcatttattgagaatcgtctttttaccgtgcatatatattcaatatctttttatctattataatgaaatcaagggctggtctaatgccagccctacaaaaatgaaaattcacatagaaaataaatttacaatttttccgatataaacctgttatcaacaaatacaaacataatttatattatcgtatctattgatatgatatgtatttcaaagagttaccagaagtttttgaaaacttttcccttgtgatattatctaaagctcctaattttatacttttcccatgatggagcagcttatttgaccgtatctctagcaccaaagatgttgtattctatactgatacatcaatagaattgcgaactaacctattaccatttttgacaagcgtagattccactgattctcttgtaacgttatcaagaatgcttgtatcaaacttttgtcccggcttccaatttggattagccgatttcactgctgcatacatagcagctctatactgtccttcgtattgctctaaagtccatgtaccacttaaacgtttgtctttacttacgcttaactgataatccttaaaaatatctgaacgcttagttgtatcaccatttgaaataccgttttccttaataaattccctcttcacattatcaaacatcttttgacgatattcctcggatacactcgtgagctgctgccatgatgtaccttttccggtaacatccattcccgccactccatttgcattcagtaaatcgccatccgaatcaaattgcttcatcagattcttaataatggtatctcttccaccgaatgtttcatatatcaatctttcttctgctgacatcatggcttcattttgcataataccagataaccagcctttttctttcaaagccttatattgtttgctatttgtattgatgccattatacgtgttacctaatccgctgatattcattgccatataaaaacctccttgtaaataaattcaaaatccgtttagaattaactcaatgttatatggtatatatcgtcataaatctccaagaaataaatttcaccgttaagtgccctcacaattatacaggtaactcacaatcctttagccaaaatcgcagttccataacagtcacagcaattttatattttacttcgatttcaactttttctggcggattggctaaaagcctgtcaatatcctgttcctcaacatcagccatttttgctatcgttagcttggatatgccatgataggaaacaagcacttccaaaaaaccgcttaattgcttatccttatcttcaatcgctccaaaatacagaaatcctacttctatttaaaattctgaattatgaactcaattccgttaccagtgaagaatatctttttgtccggttctttatatcctcctcactgacaccataataacaatataaatctctggctattttcttaaacctttttatgaccgacttatttccagagtaagatattccaaatatattccaggtataatctacctctatttccattaaatcctcaccaatttttatttcatataaatgaaaatccatgggaattacattatcaggcatttggtcaatcaatttatttttaatttccatttcattcaaaaaatttttaacagattcttcattatgaaaatctggttttggaatatccttcctttggcccaaaagttctggtttatgctgcataatcaaactagcttttagatttttctgtcgttctatccaatttgttgcggcaggattgatttccactaaatcataatgatcctttgcgtattgcaccacttccgcaagggtatgcgggttggccgctattctcttttctatcctttttcgtctggattgatagatagcatttcggattctaatctttagagattgcttttgagcttctccaaatataaaaacacttgtgggaccatcttcaccatttattatggaaacttgattgatacttttatttttcataagtgccctctactcacaaatcccgattatatcggtgattcacaatcttttagccaaaatcgcagttccataaccgtcacagcaattttatactttacttcgatttcaatcttttctggtggattggctaaaagcctgtcaatatcattttcctcaacaccagccatttttgctatcgttagcttggatatgccataataggaaacaagcacttccaactaatgcattgatttgatattttccttttaccgaaccttcttatgccttaatatcaaaactcgatctatcaggtacagaaatactcacagatcctgctacaaggctttgtgtcatactttttacatcagtaccagttacggataaggtataatcacccgtttcctttctttctgccgatttttctgcacgtttctttgcagctttttcttcctctgcttttttagcagctcttttctcttttactttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgcagctttttcttcctctgcttttttagcagctcttttctcttttactttttcctctttttctctgttctcttttgcttttcgttcagcattctctttcgctattttcccatctggatcatttgtaccagatactgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccccgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacctgtaattgccataatcctacctccctgttattgaaacttaaaataatttctattatattgaacgacttggatatttaatttccgttgatgtaaattcatcttccgccgaaacattgatatgcccactgctgtcaatagcatactctttaccataaacggaaaacgtatctccttctttatatccgatttctatccagtttatatcatttaactgttttatctttgcgtcaacatttatggtctttcctgattcctgcaataaataagtgtgttttcctgctcccgcatctatagaaaagaatcccggagaaatcccgactttctcacagacggacaatacctcctcattgctgtagagatacccccacacactctttccctgtgccagatcagacaggatattgcctgccttacacatttcccacttataatttgttcctttttgatttgtattctctgcaagcaacgattccgaggctgcccagcctattcttccattattgaccgtccatgtatatttaccgccacttgatgttgtccatgcataataacttttattacttagtaccagagaattattcgcagcacaaatgcctgacatggtgcttgtattcattttcggtactgcataattaggtactacctgtctgctcccattaaggtcaaaggaaataaccccgtactccttaaaatcagaattatatccacaggaaacattctccccaaaattgattgcatccaaaatagcacttgaattattatagtttgcaaaataataagctaattcactgttagaaatattcgcatttttatctatcagtgcagctatggattgctttgaaaagcctcgtgcagcatcagaaatacttaaactgtcctgttttttattatttcctgctccaagcaacatctgtattgctttttggtgtattcctgcctctgcctgctttgaatatgtcaacagctggtttactgtgtttacatctgttactgtcttcataattattctccaaaccctttttcaacattaaacgccaaacatatgctgcaatttgtccagcatattatttactctgccttcaacagcttctggctgattccttaattcatacctgcttccatagtaatcatttaaacggtctttcatctcattacaaaataatttttgatctgttttaccatttaaaaactgattgcagataccacttatctctttcttctcatttgtataaaaagctgtctcatctgagattatttctgacttgtacttataagattctgttttgcttccaattccaacaaccatgtaatctggtgtcattttctccatgatagaattacgtgccgaatcattaaaatgaacatattcgtcaatcatgtctgaaaaacctgcttgtaattgatctggaacatacatttcatttacttttcttagccccgcttcacttgcacttaacaaaaatacagattcataggaagttcctctatatccctcctgagcattcaaagaatctacatctgctgtcattgcattaatcttctcttttaaatctttcatttcatcttctgtcaaatattcagaagcattttcgtccagccatttttcaaaaacctctgattgattttccgaacagccttcaaacgcattttgttctccagaaatggaagttgctttcaaatctaatttgaataaattttcacatttatattctgctggtatttcttttatctctccattgattgacgaaaaatgcattgtatgaaaatccgataccttattacgagcagtctcaactaactttcttgctgaatcactgattttcacatcatcctccgaaataatattctgaggaacagttgttttcttctcaaccttattttttatcatctctggattattaatatacctatttccttgaactttcatagcaacctccttaagttagtccacactttctatacttctttatctatcttgctcgatgtcaaagaacctgcatctattttcaggtaatctacatcactgtcattgctcaatgaaccaataaaacgatttatatctactgactttctgccactctactctctggtgatgccatccaatgcaccaatttgatattttccttttatcgaatcctcttatgccttaatatcaaaacttgatctatcaggtgcagaaatactcacagattctgctacaaggctctgtgtcatactttttacatcattaccagttatggataaggtataatcacccgtttcttttctttctgccgatttttctgcacgttgctttgcagctttttcttcctctgcttttttagcagctcttttctcttttactttttcctctttttctctgttctcttttgcttttcgttcagcattctctttcgctattttcccatctggatcatttgtaccagatactgtctctataatatttccgtttgcatcaatcatataactctgatttgtcacagtgcccaaacatccattaatcgtatcttttgtacaatccggaatggctgctaagttttcctccaaatactttgctttttccggatcattcatgcacttttgtaaaaatgcacttgaaacagataccgttgtcggaataccctgcattgaagtcagccctatattcatataatggtattttccttgcaagtattttgaataatcatttacattactataccccgtcttaatctgctctgtttttgtcacaccgggacgtgatgtttttaattcaactgtacttgttgtcacgttgccatcttttgtatttgtactatccttttcactatctgttttttttacagtattcttataatttgaagcataatacgatgtgtaactgctgttattgatacctgtaattgccataatcctacctccctgttattgaaacttaaaataatttctattatattgaacgacttggatatttaatttctctcagcctcaatatgatatgtaattactatttttatttgtaaatcatagtactaacatcatcaaatcttaatactcatcaataactgctctctattaggctgaatcattgtatatttctccttaaatgaggtaattgcaccatacattttctcagttaaattttctgggatttcgtcctttcccctggttttttgctcctcaatgtaagccgatgccaaagttgaccttgtggtaatttttgaaattttattcatttcttcaccaataattccacgggcatgctgattggttgtctccattgtcacaaagtcatccactgtttttttatatgcagcatctaaattgcttaactcttcatcctttgtaagcttatgagttccattttcatctgtcacatatatttcccgtgtaccagattcatatccctgaacaatttcatcatacaactctgcatatgctgcaacataaccgttcgctctgtctgtagtgcttaaagcattttgcccggcattagcagcatctttattcaattctgctgctttctttgaaatttcatatccataatcaatatctctgattttttcactttttaacagttctctccgctgaagtacatcatcataggtttcctgtctgttctgctgtatacagttgcgataatactccattccctcattagaaatagaaagctttaccgattgttccgttgtatgtttttcgtttgtctgcttattttctttctggactttaacattatttttttctacgatcagattcgtattgttcatgtaattagatattttcatatcctatttttcctccttaaaacccattatcttagttccacctcgtagctcataaataaatctatctataactttatatctactgacttcctaccactttccaccgactctctggtaatgccatccaatgcaccagccggtattggtttcccagctttccatgtaggatcagcggcttttgctgcttctgcaaatgcctgtctgtattgatgttcatattgttccattgtccagcctgctgataagcggtcatctttatccatttttctatataaattgttatatacgctctctcttttggtagtatcaccatttaaagtaccgttttcatttaagaattctttctttgccagttcaaacatttcttcccggctgctctctggaatagaaatgatatgtttataactgtttctgttctcatccgttacagcaagtcctgttaatccggtattcggatcaatccagtctccgtttttgtcatactggctcatcaggttcttaattgcctgaacatttgtaaacattgcaccgtttccattcttcatcatctcactcagtgctgctttatactttttactgtttgtgtcaatccctgctgcttttaattgtttttgtacagaactgctgttcattttggacaactgaatattgttgaccaaatttgtttttgatgttccaaatgttgtttgaaataaaaaaccgtagtccgtaattcttgacataagcgaaacctcccatcattaaattttttatatgtatcatccactttatttttttctatcgacacaccccttctgatattttaccttttctgcaccaagtacgatttttttgcacgaagtaagactctttacaaaaaaatagccaaaaatgctcttttatgaattaaggaataactcagcagcaaatttatttccatcattcttcaatgttaaatctccatcatatttttttatactgctctgaacattcagcaatcctattccaccattttttcctttatttgatactggaaaaccatttctccactttacttcattacaattattttcaatgctgacaactatcatcttatgatatgaaccaatcttaatgcaaatatatttctcgcctttcagcttttctgttgcttcaatcgcattatctaataaatttccaaaaatagttgtaatgtcgattggttcaatgaaattcaaattcacattatctacctttattgttactgaaatccccttttctctcataacagattctttatctgtaagaagtatattcaagatcggattttctgtgtattgaaccggaataagcggcttcaacaactctctgatctttgttgcatattctcctgccgttttttcctgctctgcaccatataacccttcgattgctttaatatgcttatttacatcatgtaatatctgaatggtttgatcatacttttttgcctgggtcaaatagtattcgtattgtacctttgcctgctgctctaatgcgatcaactgcttttcgtaatagttcttttcatctgccatttttacaaaatataaaaggtataaatctgccagaacaatacatcccatgttgactgcacacaaataattttcttctccatttttaaaattctctacaattacactcatgttaatcagactgtatagaagtataattccatacatgatgtaccgtgtctttgaataagggacatcactttttttcacaaacctgtttatgaatgtgtaatacaaaaaaataagtatcacctttgaaaatgttacctcaaggcaataaagcatcgtttcattcacattttttatatctgcggcttgcaaaatgcattgtaaaagaatcactcccaatgattcacagacagacatacaaaatactaatgcttcacattcaataatacgtcttaagggtttatctatatcctcataatacagaacatatactataatccccgtcaaaacgccccagactactagatttaatatggaatgattgagcatatttatacagaatgtaaatattactgtggtagtctcaatcacaatatatacatatctatttcgactactctttttatactttccattcataaactgaaataatatcgtacttattataaaacatgaaagtgcattacataataccagtaaaatcgtattcatttttcctcctatgaatttctctgcaaaaatttatttacttcttctctaaaatcgttgcttctcctttgtgcaatctgaagttcttttccattatccatataaataataaagccctttattttttcaatatgccttaaattaaccagatttcctctacaattcacaacaaaatcatatggttgcagttcttcaaccagtttttcaaagatacaatcatactcatatgtaatatcagacaatgctatcagtacttttctggatctttttatgtattcaaaatataaaatatccctcagtttcagtttgatcgacagatactcttttccattgctgtcagtcactttataaaaattcttttctactatggcatccggcagttgattcagaagttccaatatctgcaattccagtttatcatattccaatggtttacatagaaatgaaaatgcatgaacttcgttaatgacctgcatacaatattcttcataactcgtaatatacactaatttcacatctggaaatttttctttcaattttctccccagtttaataccattcagttcttccatcgaaatatctaaaattccgatatcaatacgactgatattttcaagcatttgatttgcagacataaatttctctatatgataagcaatcttttgacttgtaaaaatcttatgcagcatattcactgcacactcaagatctgctatatcgtcatcacaaacagcaatttccagcatattactcaccttcttcctatcttcctactatatcggtaatttttatttttccattaaataaatataaagtactctgcatattatctaaataggctctaaataaatatcatatatatagaaaatgtgccatcatcttgacggcacatttcctatattttccctccaaattatattgctacagtatagaataccattgtctgtccatactatcagcttcatactgatatgtaatcaactgattcatgtcttttaaacccgccatttctattaggttctatcattatattatagttttcatatttttatagtatcctgcattatccataacactattattgccagatgtacccacagtacttacctcagagtccgaaatattataccctgccttaaatgcaagaatatcctccaatccatattgatttttataatccgtcagcatatagatattatctcgtatttcctcatatttcgcattggcttcctgggagttcattattttacacattttctctggaagtccggtaatcttcccattgtcatctacgtttatatcgtcaaatgaatactgtccatttgttgctttctgaatgaactgttccacttcatagtaagcatttactaatctatattgtgtgttagaaatatctgctgtctgaatatatttttcccacatatcatcagcaaaattttccgatatcatattttttatctgttctttgttttcttctgtaatgtccccgttaatcgtaatagttccagatacatctatttcaattttccatgatgtatctggcagttcaattcctttttcatttgctattctttctatttctgcataaaaatcgttttttatataattcgacttctctgctctctcataatcagataaattggcaaatattttcacatatgccatttccgacacacttaactgctccccctttttcatcttatttaataattcttctacactatccgttcccgaatatttttcatcttccggcaacgcttcaaattgcatctgatgtaatttgtcaatttcgctttgatatgttttttcatatttctgctttattgcatttttttcttctgaattatctgcatttgctatttcttgtgagtgctgcacattactacttgaagtgtccctgtttttcgtttccgtaatttttattctataggaaccttccccggaatccgatgtcatattggaattttctactctgatcacataatctgatgtaacgcagtcccaattaggtaccgtaagctgtttattaccatgtccatcatctgtcgctattccaatctgattgccatataaatcgtacaatactaaattatatgcctgactattcttgctttccaatgaaatcgttatctctgaagatatacccattttagagtaaaaacttttttgcggataagaaaaagaatagtaatctacatcatattttgaatcgattgttccctctaaataactttcattattatgcaacaatgttcctatatcatatgtactgtaatagcgatctacctgatcatcgtatttcgtatgctgatgataactatcattcttatttgttttggcattttctattaacaccgtttgctcatttaattctttcatcggcgatttaaaactttttgctgcatttcctgtctcatatattttactatctactattccgccacctatataatgtacatagtgtcccatcttatcgtcacctcttggaatccacggatggtataaaaataccatccgtaatttatttatctttctaaatatttagcccactattattccgaaaggaactaaataatccaatgtcatctgtgtcattgtagtgcaactagcatttacataagaaataccacttacccaatgtactgtaacagatgttgcatagtttccatcaattgatcctgatggtggattattgtcaaccaagtcactccaccaaccacctgtttgtgctagtttttttgaataactagcagttgctggcgtataataatagtcaatgcttgatgcgtatgtattattagcaaatgcttttgatttatccgaaaatttcacacctgtcaatgcatactcatcttcacttccactaggacaattaatggtcaatgtttgcgtacttgctgattggctagatgagcttcgattccactttattgttgtataatgtgtaagatccgaaaaggttgttgtttgtgctattggcaatggttgtccagcataatatccataatgataaccggtagttgctgttgcatcttttaccttaaaaacaatataataatttccatcaataagacctaaactaattaccttattcgacgttcctgcaatcgttttagttgttgaataatatctgtcaaaataactggtaactcccgcctcatccgatgaacgatatattaaatttatatcattgtcaaaaataaatacattaacattagattctaacataaatgtaatattattacagtcctcatccgaaacaacacattgataataatgtccctgattttcatcatatgcagaatcattcagatacccctctcttaatgccgaattatagttgctctgaccttttggattcagtaagaaaccagacattacaaacccttctgatgtttttgcatatgtactaaaaatttctgtattcgatgtccatttctgatcagagaaattatattccatcgtgcttgcactccacatatatttatttgacacccttcttgtatctgcatatgcacttgctccatcatttgttgcatccgtaaagtcacaagtcacttcttcggttgcaattttcgattgtaataatgttaaatccgtgtcgttatcttctgtattgaaatgtactttattgccattatcaatacttgccgcattcgctactgagacatttcctaacagcaaacatgctgccaataatattgttgctatttttatctttttcatgaataattcctttctgttcatagttctttattttatagttttttgatttatatagattcattattaaaacgctttccctccctctattgtttattttttaatttaaaaatttcgaatcatatattttatctaaaaaaatatattactatacttgacacacttccctatattttttcaaaaatattatatttctaaagtacagaataccattgcctgtttgtactatcagcttcatattgatatgtgatcaactgattcatgtcctttaaaccactctttccatataaaatgcttaaagtcatatccggcacattgttccatcctttagttgacatagttgaaaccaggtcatgtatccaattcttcatttgctgcttgaactctttcggaacttttccagaatcttcaacagccttatccactaagtctaatatattctctcctgactccgtataatatgtcccgtttttttcctcaagtttatctaattcatatcctgtataactataaacttgatgatatgcttcgtatttcatttttgattcctttgttatctgagaactctcacagccatcttgtgttgaacaataatatatatgcttatagaggttttttccgttatctcctacatttaaggcatcctgcatcaacacctttgtttcttcatccacgccatctaccgttatttcataactgtatggatcgacagtaaaagtacaatctttcgtaatagaagatgtatctacaccagcctgctttaaaatatttgaaatttgcgaatttatcaatgctctttcaaattggattttatccgaatctacactgtcaccgtccacttcaattcccctgaacaaagaatcctgataatttacaccatttatctttcctgtccggcacatctgcatctcataattatatgcaatcctacgttctgtatcagtcagattagtctcgtaatactctgaactcttatcaaaatacttggaatgaatataattttcaggattggaatgcgtttttgcttctgcggcaagtttagaatacttttccgttaatgcctccctaaatgctttacctgtactcatatattcacttgttttcgcattaatctgtgttcctgcattctcaatgatctcctgattcgtttttttggctgaagctatataggactttaagtcaatgctgctatcaatacttgtattatgtgttcttccacttgtactttttgtaagtttttcctttcctgatgcgcttatcgtcaaagtatctcttgtgcctatacaaccattgcttcgactgattgtcgctttttgttgttgaccaaacaggacattaagcaatgactgattagcataaattcggctgttaaaaaaaatattcatagtatcacccacatttctaatatgacttatatcctgtatttgctatatcgtactcccattccagtgttattttaacatttttcattgttgattttgctgttgctaaagcattatatttaaattgccatctttgtgctgcctgaaatccatccgaaacatctatattgtaatgtccactcgatgcacttgctaccgtagatgtataccaagtacttgattctgttgcaggaagtaccatatgatgaacatttccctgactcggtgattgagtacctgatgtatttactgatgtaacaatggcttctggtggaattgtagtattatttgccaaattcaatgtaagaacagaagaatctacacctgataaacttattgatgaatttccaggattagatgctgttccactaaaagaaaacactcctcgtccagttttaattctctcattcatcgaaagtgaaaaatacattgtaccctcacaagttccacgattaacatgaatataatatgtctgtgatgaagaagtgagattatcacaagccaccgccataaatggaataaccgtgtccatatccaaaacatcgtcagggctgtacttttcatctaaaattctattcctatttataaaccattattttaatcgcacgctctttacgctttcatatcaaaattgccttgtgacattatattttcattcataccaccagttctttgttcactgtttaatgcttttcttgcatcacaaaaagcctcataatatgtcgattttaacgccgaatgtacctgtgactctgcttttgtttccttttcttgccagcctactccctctgtatatgtcagaacttcttcaccacattcgttatatacatgagctgctgatcctgttccctctccctgaaactcagcctcatatggtatcccaaataaaatacacagccatcttttgtctgcttcttgtatttttttcatatcccccatatttccagaactcattgattggttgaacttacctatcagtgccgcccgatttggtgccactttagcgacctctgctttccgcaagttcataaactcatttcccatatatatgttgtttttcgcatctttcttagccaattcaacaattttttcttttaatgaatctgttaatttccacttgttcttttcagaagtttttttagcactactgctagaacttccagatacgcttaccgtattgatagcatttgatatattcatctctattacctcacttgaaaatttgttttcaatataaacatttggcacatatcatcaataccccttgcagaaaatggcataaaaagattagacaacagacactatctgttatctggtctttttacgtttgaactcgacaacaaacagattatcctactcatatcttgcttaatgttcttctaaaatctgctgttcataagcctttgctaccaatgcctttctgctaagttcagcattttgctctttattcttaaaatactcttttgtacgaaattcctgcatatccttacgagcctgtatgcgtttctcaacatattcctctaaaagctccttatttctatcttctttcttcttttttacattattttcatgttttgaagaatttcctttaatataactatcattctctttcattcctttagtatatccgtaacacccttcccacgtaccatctacatgagtatacgctatttgtggaatgttacttccaaaatcaactgccttattcttcgccaaagcatctaatattttctgctcatattccggttcagtctgcatccttttataagcagcatctgtaatatcaataacccaattcatatttctctgtgacggatgagtatatagcgcatccatcttttcattaaaatacgctttgtattcctcaaaagtcatatcttctggggaaaccggatttttctctgtgaccttgccagcaaatccgtcattttttcccgtgctgtttacattcttggtgtttctcgctgttgctacattattatgataataattctgtcctattccactaatgcccatttcttaatatcctccattatttttgtattgcgactcatctgtcgttcagagtcgcccctgttcccttgcagtccacagaggcaaagttttatgtgcctctacggaatagagtttaaggattatatctgtatatccagtgaactgcccgaagatggtgcttttttgcccgctgctaggtcagactgtatctgctgataagatacagttccctttgcgttttctccatactcctttttcagtcgtgccagttcatcattatagatagatgtaaatacgcgtgcccttgcaaattcttcctctgtgcttatggctttccagttccttgattcaggattgtaagacaatgttttatttccattgttgtcccaaaacatacaagccgcattcatctttccgcctgtctttctcatacttgattcatagatggctttcctgtccggggaaactgtctcaccatgctgcatacataattttcggtatgccgcatcatcccgcttcccggtggcaaattccttctgtgcaagttcctttatagctttctcgaattcttcctccgacattgcaggcttatcacgtttcgtcataatattatcccaattcggttttgtgaattgaatatcaaccggcttgaaacgcagtgcgaaatttccataatcacattgagctaacggattattgggatttttcttattgccaaacatctgctgcaccatgttggcatactgtgaataattgcctcttgttatctgcatatttattcctccttgataaataatatgaaatccgtttctattgttcattacctatttcatgccaacaaattttgcaacctccacatcgaaatagtcgtccatattactactgaatccggctgccttccatgcctgatcaaatgttatattttcaatattacttaaaaaaataaatgtgctatctttttctgcattattcattcttccggtaatctctaatcggtattgataggtataatcatccgttttccatgtaccatcactcatttcataatgtttaaccataataaccggctcagtattctcaaatgcctctttcgaatccgttttttcataagtcctaacgacagatggttccttttgcgaacatccacacagacaaaacatagtgcagactgttatcataattgacaatactatctttctctttttcacataccactcctccaagcgaaatgtgttcttatttctcatatcgaccagatttcttctcttgcaaatccaccttgcacttatcgactatttgttgcactaactgactataaaattaccactaccctaaactctttctcatcacagtcaaatgcaattctgccatcgtatttttctaacaccgcttccgcattcttcaaaccaatgccatgttacatcagcacatccggcagacagctctatttcattgttgcaggaactgccctgcccgtcctctgtggcttattagggataattttctgctatgccttggcatcaaagctactctgcatattatccacatttaccgtctcttcacttgccagcggaatccctctctttgcattcccccatgcttcattgtagatcatgcacatttccgtctgtctggatgcctccgcattggttgtatacatcgtccacccattattggaataagtcgcgaccatctccccattcttatcgtaaaactctatgtaatcgctgttgcctgacggcaatttctgatatttcactttcccttcaagcagtgttgccacaaaatctattggcttcagcacattctgtctgttccttgaaatagctttcagcccggaagtaataatcccttttctgtctggggatacttctgatgtgtagcttttcatcagcctattaaatccttcggatttgttttggaactgccctttttcaaaatcctcataagcttgttccctgatctgcttccggtattctttatcactgacaccgcttttctttttagagaaaatatatttgtcattgaagtccggcagatggatgccgcctatactgcctgttccagaaaagaacctttgttgtaatgaaccattggacgaattaacttgcattataccaccctctcctgtaaatttcctagtctattcaatatttgatacatctggctattgccaaacatataactttgcaaaacaagcggtttctctgcccgtctgttttctcggtacagcttcatataggcatccttagcctgataaaagctgtcctccaattcttccatctcctctgttggcatttcaggaatattcccctgaatgacctgcccctgggctgttattctggcacaggatttctgccatgccacttcctgctcaaattgtatatccagccactctatctcatcttcttttgtcagcggcgtcccatctaccttataatactgttcattttcatagcgctgttcaatttcagaatacagccttgcataactcagcccacaagcattcacaacatccgaatagccatactgccctttttcttccctgatttcctttaatattccagctctcatatcgctgagtgatgccgccgactgcaccactgtatgcttaattttatccattaagatttccctgtttttcgataattgggaaacttctaaggaatccctatgaaatactttctggtattcactttgacttccctgagatttcaaacattctctattaggtttaaagccatcctgcaaatgtacaggataattggaaatactaattgacatacatttttctcctcgtatgattgaccatttactaatcctgccattttagacagtccactgcaaagttgtttttatgtaactgcctgctcgagcaggtaagcgtaccgccccttgccagggtaaacttcttttcagtaagattgctgtttctcccctccgttgctcccctgcagatatccgtccggcttgttgataagcgaagtcaggtcaatcgtcctcccaaagcagtccacgccttcagctttattactctttcagtaataattattgaaaactttttcattttccttgataactttattgaaattctgcttcacggcaaatttcttcggattccaatggattacttggtttgataatgatacaccattcattacactatacctcactgcctgtcgcggtttccgtcataacatttgcgtcataagcattggaagccatcgccatctgcctcttactgctccttgcctttgtcagcctgctcctctccaattcctgctttgcaatcttttcttccaacgcctcctgctgaaattccttcatctgcgcccgcttttccaaatattcttccagcagttccttctgccttgcctttttctgccgtccggcatcagttccctttgcggaggaactcccggaataaccgtcattctccttcatgccctgcgtatagccgtaacatttctcatatgtgtcatctatatgcatatatgatatttgtggaatatagtttccaaaattaactgccttattcttcgctaaagcgtctaatattttcttctcatattccggatcagtctgcattcttttataagcggcatccgtaatatctataatatcatttctattccgctgcgatggatgtgtatataatgaattcatcttttcattaaaatactccttgtattcctccaaggtcatatcttccgaggaaacctgacttttgtctgtgaccttttccgcaaatcccgcttgtttttcctccttcctcaaacccatgtaactctttgctgtttcataataactgccataaactgaacctacatccattactacattctccttcctttttcatatttttttattttatttccttctgctgcagcattactgtgactttaaacacatcgttttttattttgatatccatatctccaagataatggtctgccacattctttacattttttaaccctattccatgctccatcaaaatatccggcagatcgctctgtttcgttgtcatcgggacgatacctccatcttcccatatcactttcccatcaaagctgttttccacttcaatcagtaggaaatgattctttttctttaaagtcagattgatatatcgctgttccttgtttgtaatttatacttttaaaggctaccaaaaacttctctttagcctgctccattattgatactgcggttttctgatattttgtatcaaacatttgagccttatcttgtgtttttacttcattttgagggctatttctacggaaataccatgaactgtccgcgttttcaaatgctttattggtttgttgacaggtaatatatccttctaaatttgccagacgcattttaaaggcttcgtccaatcctgctaaatcttcgtcaagtgtcaatgaccttttccccgtaagttcgtaggaaacttcacgatctccattttcatgttcttttacgatttcattataacgggtttcatatcatttcccgcagcatatttcttcctgcatcagaaatagaaagatttgccgactgcttcaccatctttgagattgcttccctaacagttgcttttccccgtatataatttgtagtcgttccgaaataatcataattatgtccgactccattaatagccatttcctaatcctccattgtcatcaattttttatattgccgcccctgcccccttgcaataagtccgggcagtccgcaaaagcaaaggtttatgcgccttgcggaatatgaacaatttctccttatgcctttatatcaaaacttgcccctgtcggcgcagatgtaccagaaaccgcagctaagaggttctgcgtaacactttttacatcagtgccagtagccgatattgtaaacgtttcatcttctgtcagcttctccaactgcgcttttttctctgcccgtctcttagctgccttttcttctgagatttttctttcctcacgctttttcaataatctttctttttgtttcttttccgcattcaatatagttgaattttgttttgaaccactggttcttgtcatacctccgcaagtaacagaagcattcccatcggcatctattacagttgtaacaccatgtatcactgcattatcagctttggcttgtgcaaacattctattctgtcccggtactgcaccagttaaattaaactctactttcttggcaaattccggatcatttgccattttctttagacattcgctagaaagatttattaccactttattttcatttccactcataagactgctacccgtattaaaagtaatctccgggaactttttacacagtttctcataatattcctgcactttgtccttgctgtttgtctttacctccgttgctacattagtgtttcacactcttatacttcgagaattaattgctttttcatatcctgtcataaaactcgctatattaaacaattccaccgtgcttatattgctgttcccgaagcttatccaacgattttgctccatctgggctatacaaatccaataattccaaaaaattaccagactccttacacccattcaatatcatacgcatactatccgcatctttaccgaataacatacccaacagactcatatcatactgattttgactatcacttaatactccctgctgatgtaaatcctccataaaaccataagaacgaacctcggaacctattcgcatcgccacattatataaatccggatcaacagtatgaagataatttaggtagcgtgtctcaatatttctattgggcgtgccgctcatcatccaatttgctatatcttccaaagatgcacctatggcaacatcatcaatcaaatgcatctgccatcttccgctttcagtctttgtaaaggtatattttccatcttccgaatacaatgtatttgaccatgagttttttggagccgcctggtctctgacaagcacttcaaatgcatccattgcaactctgtctaggatacactttttctcatctgttggtaattccattttccccaatgctactgcagtttgcactagttcataatccgatatgttttctccatgataaaaataagaattttgttctttcaatttatcaaatgatgccggtagttttacttctgccaactgttctttggaaacctcagtccaatcttcttttttcttactacctgcggtctgcatctgcactctcggaccgtttgtaatctttgtaccatattttgcatttaccatatgttctgttattgtcacatgtgcaaactgaaataaactcctttggtttcttgtatttccgtaaccttcaactttcacagcatatggaaatgatgacttcgtattcaaaacagagtaagtacctatataaaatgtatttgccgcttgtattctcataatataacctccaatccaaacagaaacagcgtctattttcacattcaatcccttgaaaacagacgccatccttagctcataatatttatcgacatttattcatttttctttacagaatggaacgaaacctgaaatttgggcgtgcctcttactatatctgtaaccctataagttttcgatactcctttgcattttcacaatctgatacaatttctgattgcgcatccaagcaaaacggtaacatctgccaatcctcattgccacatgctcctaccaataacaattgttctaaataagtattaaaatctttacccagtatatatccatgtccttcaccatcgtcatggctaagatataccacagacggatttatttcactctctttcatatcaaatgctattacatcaccattagggacattcataaaacccaattttgtgtttcccatttgactcataaatatttgcttgcttctctgatactcaatttatccatcttgtctttatgagtttcaacaaaatttcttacccaatcctgatttgtcttagaataatctctcagactccaaccgatggctttgttgataaagaactctgaactgccaaagttattcactaatattttttcaagcaattccgtatttgttcgctctttcctacaaagctggtggtcaatagcaattcggcgcatccaaaaatcttcatctgttgaccactccaacattaggtcatttattcgttcatctgtaaaagctataatctatgccgagataccccatcacatcggatacaccttctgtccatctggcatactcctcctgagaatatgctactgtgtgcatattcccacaagcattccgcaacagcgtagacagcgaacccgccatcttctgcgctttcatatatgcctctgtatcataaggatcattaccgccggaaacctccacaccctgttgttttacctccaatatgtaaccgttgtttacagcgatgcgcatgtcggatgcaatattgacggaattgctcagcctgtttagagaagaactatctgccagcttaatcggcgttttgagcacctataccaaatcctctatgggatttaacagattctgcatcgaaccattgaagacctccctgtcctttattgctgtatttttcacatttgatgtgaattgtctggtattcggattgatataataagattgattatttgaaatttccattgttttggttatgttcttcacaagctctgcttccatcataatatttgcatcataagcattggaagcctttgccatctgcctctcactgttccatgactgagtctgtctacttctttccagttccatctttgcaatttttttatttaacatttccagctgctgtttcttagcctgcgcccgattttccagatattcttccagcagttccttttgcctgtctttcttttcactcgtccttttatagaaactgttctgtgaacgcatatcaaattcagagtcataacccacaggccatgaatccgccctatactcattcaaagtcgcaccgactgttatcagcacagaacagttcctcggtgcataggaatcgccccaatccctctggatcagtgaaagaactttctccctgtattgtgggtcatccttcattgccttaaatgcctcctccgatatattcaccgccgcattgctcactgtcctgtggtttgtaattttagaaaggtcttcatagaattcctttttgaataattccatttcttccgcttccgacaattcctgcgttccgcttgtttttttctaatgcgaattcttctgtgctgtttacatttttggtgcttttcattgttgtcacattgttctgataataactctgtcctactccactaatagccatttttaatcctcctttatcagcactttttcataatatccgatagtatgcttgttgctgttccttgtttgtaatttatacttttaaaggctaccaaaaacttctctttagcctgctccattattgatactgcggttttctgatattttgtatcaaacatttgagccttatcttgtgtttttacttcattttgagggctatttctacggaaataccatgaactgtccgcgttttcaaatgctttattggtttgttgacaggtaatatatccttctaaatttgccagacgcattttaaaggcttcgtccaatccggctaaatcttcgtcaagtgtcaatgaccttttccccgtaagttcgtaggaaacttcacgatctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcaagtgtcaatgaccttttccccgtaagttcgtaggaaacttcacgatctcctttttcatgttcttttacgatttcattataacgggtttcatatgtatacgctccccgtctttattgtatatatcaaaacattcagcttcattatcgggtacgattctataattttcggattcgtactctgaatattcctgtttcaaagtatttatcgtttttcctgacagtgccagataagaatccatcactgtacttttcttagcacgattgatatccgctctactgctaatatcctccttatccaccgtctgagccaaagtgtcagcccacttattctggtttcgatttggttttaggttgttataacctgttgaataacggctctccgctcctatacttccaatcattttttaaattcctcccggcattttattctcttattttagatgccagtacggtataaaattctttttcctgttgcagatatgctgccctttcatctgtaactgctgccagcggattttctattctctccaatattttgttgatagctgccaaacagctttctttcgtttctccaaaaatattatcattaccacctgtctgaaaatcctgctccacagatagctgcgttaatgtactggataaatcagtctgaaatggattaacccccgtttcttctaatgtttcctgccacgccgcctttacactctccggtactgtttgaaggtaataatcactaatataagcaatctgttttttggttttttcgtctgcaaactgataggttctgttattcgcttttaactgttcatatgccgcctgcgcatcactgttcgcttctgactcataccagccatctttatttttgctatatttcataccattgaccgtaaaatctttggaagtgtctatacccagataagacataacatccgtaattccttctgtataccgggcatattcctcctttgaatgtgctacagtagtcattgtcccacctgcatttcgcagcatggatgccaatgcctctgccattctctgtgcttttacatatgattgtgtatcatacggattatctccaccagaaacctctactccatgcgccgtagccgtaagcacatgacctccattaacacggattctttgcccttccgcaatattaacagaattattctgtctgctaagtgacgaactcttcgccaattttataggtgtttttaacacttgaaccaaatcttctaccggatttagtaagtgctgcgacatcgcctcattataggtttccttatctttaatagctgtatttttgtaattagatgtaagtcctcttgtattaggattaatataacttgatattgactgcattgtctcaatctccttcgttttttctaaattctctttccttctatgtccaaatagctaagccttatttgtacttactatttgcacttgtcaaatcaagataagcatccatacttttcgtccaaagcaacgataaatcaaaccttcctaatttgtttaaatcttctatgctttttttgaacattgcaataaaatctcttctgtcgttaagtcccatattaccagcttcaagcggcagagacgtgaaacctccctgcttttccactttgtaatgtgcctccaatgcacgcatttcgactactgtagcatttgatggattaacatcattgatataaattctttgctcaaactctttcccgttttcatccacacctttcgctaacaccacaggattttcatccgtcgaatcatccgcatatttaagacaataagaaagacctgtaccattacctcctgtccacaacatattatctgttgtgaatatctgatataccttcggtgtttctgccgtataaaatgtcttttccccagatgcaggagttttcatttgattacctttttgttgaccgtacaatgaagatacggtattcagaccagaaccaatgtgcatacttctattcctccaatcagtttatctgaattgtaaatgtactgcttgtattccaccatcgtcatatctttagcagacacagaacctatttttgaattgcccactatacttccactagcttcgctcttttctcttacactatccgcaaaccttgtatcttccttctcctgatctttagccgcatttttctgctggtactgattgaaagcccgtgtcatatagttcacattaattgtattactcatagtaacctcctttgctttctttatcggataaaataacctgttctcctagtcccatatcatcaaacgaccatattacgcacacaaagaccatatttttacaagatggccactgccttagtagaagctctgtatctcaaactctttgaaatacaatgcttccctgcattttctatatcgtcatattgatattattgctttactatccagcacctctttggagtgactgtctctatcaaaaaagaagccagcagtttatttactcactactgacttcctatactactcattttttttatttacttcgctgcgtctcagacaagttttcattttaaacataacctctgttttcccgccagccttttacataccacctaattccaacatataccagttgcacgaataataagagaaatagcatattgatcggcaagactgtctttatccaatctccaaagtagattgctatttccatgcttataagtgttgccagtatggtaatcatatcccaacagcacttcttatataaccctgaaatgttctgtatgaaagttacgattggcaggcaatgactaaataaaactttcccttatttcccttacgattatctcataagggtaaaaataagggaaaatacatatcatttcactaatgaattggctgaaaagcctgtaaaatagggaaagttagaaagatatttcggcaaactggaagttgtttgtacaatgttcaagatataactgttattatgtcttgattagagtacaaactcatataagaggaactccctcggtactccaatatcaacatatgtgatttcaactttatccacatacttaaatccaaacgacatatacattttctgtggaatatcatttccctctatgcaatcaagacgaattgatttaaggtttctttcccttgctgtgtctattgcgtgttgaactaactgcttcgagtatccacgacctccatattccggaaggacacgcaaggcatgaagaactactgtctcgttatcatttgcatcaataagccatttaactgcgtgatacgcctcatcacgatcatgattcataatatacgccgcaacaattcgaccatcttcaataccgataaactgatttctctctttgattgcatctttgatcatttcatctggagggaaaccacctttatctccctccggcagaaaatcttttccgctcaaaactttacacataccgtcataaaactgtcgcaattctataaaatttttctcttctgcatatctgataatcatagaaatctatccctccaggaagtttggtaatttttacagacagagtactcttgcaatctgtctatttttctcatttaatattcatgtataatatatgtatctcctttttcatgcaactccatatacgttttaggtgatttactaccataattactctatcgttaattgatttcattgtctatatacagacaactaacatgcacaaaaacagtaccaagatgcataattatgaaaactgcttatcaaattcttgtgcgtcctgctcatccacaagatagccttccggtgttgcatactctccagtaatctcatcaagataaccaagcatgcaactaataatccctgatatccatagcgcaggatgtattttttgagtctttcgtgtaataatagaaatcacgataccaataaacgagcataatggtccccaaaatatgacatcaatataggtatacggtgcatgatttgcactgtaaaagtaaagcacaaatgaaaataatgagagtataccaaacacaagtactgctgctttcatgatggtgtcttttcttgaagtcccttttgttcatcttcttcccactccaagatcaatgttgtccaccccacctgacatactcacatattataccacaagcaaaacttttatctcaataatgaaatcattcccctgtattcttgcacttatatctccattcatacgctccacaagctcttttgcaatagataaacccagtccggttgaggctctgcctcttgccacatctgctttataaaaacgctcaaacacatggcttaagtcaatattttcaggatgttccgtataattgctgattttaagcaaggcgtaattatcctcacgggtaagcttgatacttatattcttttccccatgatcaagaccattttttatgacattctgtataactctccttaaaccctgcttattacctgatatatacagcatttcctcagtaatactaatatatgggcagatgccctgcttcttccattcatcataataagaaaatacggcttcttttaatattctgttcatacaacaatccgtaagctccagcttatatgaatcatttttcagcttagtgaatgtaaaaagctcctccagcatttcattaaggctgttaagcctttctctgattatatcaagatatctcctctggtcatctatattgtcacattcctctataagctggaaatacccatccagcgatgtaagcggtgtccttatatcgtgtgaaagattagtatatgtatctgcaatcagctcttctttttttctgtactcatttctttcttttttacgcaggtcaagaagctcattcaatttatctgaaagctcacctattccccccatatctatttcacgttgaatcagcttgttactatcgtgttccataagaaacgacaactggcggcagatgtccttaatctgccgctggtatttccacataataaatgcctgtataataattattactgctaatattccaataataatcctcatcctctaaatatcccttttctgaaaaatataactgcttaatgacagcattataataataaatataactgccacacacattgaactaacaacatcatccctgcctgcattcataggaagcattgccatccttccagttactgtatacttatagatgctgaagttatgaagtccctttctgttaactacataatctataaaggcatacacaatgctcattatattcatggtaagacatactgacaaggtcatgcttatgacattgttcttaattataactgctattgccatacatattaacacaaatgcataatgaagcgtaagttccgttaagaaataaggtataatctccttccagttaccccacaccacacatttaaacgcaagcatattcgctgctgcctggaatataaatatccctgcaaaggtaattgctgtaaataaggcaagagcaactgcccttgaaacaataagcatacccctttgtgacacctgtccaccaatattcttaatataaccgctcttaatatctgctgttgcaaacataaccgcaaatattacaagaaaaagtgcataaaactttccctgtgcattagaaaagaaaacatccattaccgtaaccttcttccctggctccgtaggtaattccacactcataccaatattgacattatctgtattctgctgcgaaagctgttccttgttgctgtcatctgcctgttgttgctcccattccttattaactgcatcataatctatttttgaaagaaatgaggtaagcagtgccgatgccagcaatataatccatattacatacatactctttgtacgaaacattctgtatacatccatctttatcatattaagcacgattgtcaccccctgtaagccttaagaaataattctcaagttcttcacttgtaatagatattcctttaactggaattcccgcctttgcaagctccatgttcagcctggcactttctcccagtctttcaaatatatgaatatgttctttatctataacctgatagctgctaaagcccatatcatcaagcacaggaatagcctgtttaggattatcaagtgtaagctctatgcgctcactgcattttttcataagctcttctcttgtaagctcctgcacaaggcatccattatgaataatgccataatctgtagcaatctttgataattcctccaggatatgacttgaaatacatattgtcatacctcgctccttagcaagcttctggatagtttcacgcacctccactattccctgcggatcaagtccgttaatcggctcatcaagaataagcaggtcaggctcacctacaagtgcaagagcaattcctaagcgctgcttcattccaagcgaataatgctttgttttcttttctccaacagtatcaaggcccactgtttttaacagctcttctatatatccttttttcttaatccccgtaagcttacatttaatgttcagattgtcatatgccgacatattgccataaagtccgggagcttctataagacaccctactcttgaacgtaccttttgtaagtcctttcccttatacccaaacatttctatttcgccataagacggtgttgacagtccgctaatcatcttaagacaggttgttttaccggctccgtttcttccaataaagccatatatcgcaccctttttaatgtgcatatttacatcatcaaccgccctgtgtctgccatactgcttagtcagattccttgtctgcaataataactcactcaaagctttttcctccttttcttaactgctcttatcataaaaaataaatcctaatcaatcgcaaataaatagtaaaaaaagagtaaattattcatgcaggcgatatccaatcccccatattgtttctatatattcatcaggtgtaacggtctttattttctttctaatattgcttatatgcacatccagtgtctttgtttcacccatatatggctcatcccacgcatattcaaatatatcctccttgctaaacacctgcttcgggtttttaagcagcaattccagtattgcaaattcctgttttgtaatcttaggaagcaccctgccaccgatacttacctcaaaggtagagcgtgtgatcaccatatccctgaactcaagccttccgctgccttgtccttcctgtataccatcctttattatcacttccgtttctgcttctgtttctgcttctgcttcactttttgtttctgcctctatatgacgaagctgcacctgaatacgtgccaatacctctctaatctcaaagggctttgttatataatcatctgctccgtctgtcagcactccgattttatcatctatactatcctttgccgtcagcacaatcaccggaagccttccctgttttcttatctcttttaaaacctcttcaccacttgcaccaggcagcattaagtcaagcagtacaagcgtataagccttttcttttatatccagaagcagctttgcctctgttcctgaaaatgcctgttcgcatgtataacctgccttcctaagtacctcacaaagaaggttattaatatttatatcatcctctacaattagtatattaggcataatttttactcctgtccgatattgttttatcactgattccctgtttaatctatatcataatactaacataaatcatattgtttcatagtttctacatttcgatattcatgcttctcataatatcctatcagcttaccttcatctctgagtgctaccatgtaaacatctttattctgtttcgcatttatttttcacattataacatctatcaaattgatccgcactaaaaaaggacgcagaatctctcccacgtccccaagactatctggctttatctcctctcaccttcgatacttccttatgtgccgcttcctgcttccactcactcagcttctgccatctccggctctgtctgtctctgctccttctccatatacttttccttatcaagctgcacattaatagccagattatccagtttatcaatcgaagcatccaaatgaagctccattgatactccacgcttaaggtgcacgctctttctctccatatatatgccacatttactctgctactacaaatgtgatagttattagactttgttgtattttgccaacttatctctcgcaacctagccttatatgtgatttctgtccttctgaccagagatttgcttacagcttccttcagattccacctcacaatggacacccttgctgttcagctatgcatttcccactaataaagtatggattatacatctaaaactcgctctttacaatcacttgtaaaggatatgaataaggggacaattaatctttctcataaattacagcgaccagagggacaatggaatcgtaagcaaaaatcagatttgattgattcactacttcgccattatccaattaatccaacatatgcaattgtagaagaagacggcactctatcggttattgacggtgttcagcgtttatctactataagagattatattgagaatatatttgctttatcaaaggatataaatggtattattattaacggtgaagaaaagaatgacgatactccctatgatatttattattgcaatctttacagaaacttcttatatacccattattaattccaaatttatctaatggaagttctctcccacatcccttattcttcggctccgactgatgaatggtactcttgcgataggacttctttttatcatcagatacctttgcaccgatagtcttaggacctctctctactgtatagatgttgctgcctttaatcttggctccctttggttcgtgggcatgaatcttggctttctccttggtgtgaatgaccatcggtttgtcatcaacctttctaattttcaattttctcacctcctactttgaaaaataaaataagccgctagggagcaaaaattactccttaacggctatgtaaaatcattcaatattcaattattaaaagcaacatgaaactgaaagttgtcgtctcgcttgcaaagataaaatttcaattttcagtgcctacactaaatcttttagttctttcgcaattgttctataaatagctttcacatcaattttcaactccgtgctagtgctatattcttttctcttcattgaagcaaatggttcatcaacatcctgtggcatataagatttaattgctgtaatttgcacgttatcatcatcaatggaatcaatttcctttttataccaataatattcatgccatggatgatctgcatctaattcacttttaaatcctagatttagcagattactatcttctttttcgtccccggtaataaaaacggaaaaagtgccctccgattgttttctaatttcgcatctatacccacaatacttttccattacaaatacataataaacgtcttctatttcttcaggcataactttcttataatacaaatcatcattcaaatcgtaattcatattttttattataggtatctcatgcttaaattctctcccaatagtaaacccttcttcgagaaaggccgagcatattatcagataccctttttccctatgataaccgacatactgatattgtttacccccaaactttactacatatcgtccatttccaagcatattctcagaaagttccattttgcgtcgttccttatatttcactagcaacaatctgtttcctacattcatattaatcaccaaacctttgactcgagaaataggaatttttatcatccctacaaactgaaagtttcatttatttatacttactgatttaatagtataaatctcaattaaaataatctgtattatatacctctaataaattttcaacggcagtaactccgttcggaatttcccttttactgcgatttatccatattgcatttattccaactgccgaagctcctttaatatcactactcaacgaatcaccaatatgtaccacttgttcagcagacaagcctgtactatttagtgcaaactgaaaaagttcttttcttggtttgtatgatttagcatcttcacttgtaaatattccattaggctttaatccatgatattctatcgcttttaaaacatcatctctatctatgttagatacaacataaattggtactggacacatttcaaaaaactgtttggattcctcaaaaataggtggctttatccaatgtgcaaacatcaaatcacttaattcttttgcattagccgttgaattgaaatactctattgttttcttcaatgactcatattctaattttcgctgtgtttcaaaactatcctcataggctgaattaaatgctttttgaaattcattccaccagtatgtacctatctctgatttatcagtcactttccctgtactatatatttcttgtgatacctgtttaattacttctccatcctcatgtacaacagtaccataaaaatctataaacaccgcttttatcatttaaatacctccgactcttcaccaacttcaaattttcttttccctaataattacaaatattccatggaaattgcttccacaccatacatttatataaatgcatccaggtccgctgcatccccaatcaacaaattctcgtcaaagtgtacgatatgcatatcttaaaatccagccacatgttctccggtacaaatgatacattttagaactgcttccttatttatttttcatatcgaatcttatatgcttttttctttaaaatagggaatatctaatttattatcatcaaggtcggatattcatccgacctcttgattatactatagattctataaaaattcatctgttatcactgcagcattgcttcttttttcttctgttccgcaatcttctcatgaatgttggtattatacagcctgtacaaatctgtatccttactaatctgattatcaaacggaatcaccaccgagccacacttgataagtcccattcccgatgcggtattggttacaaatctaagctgtgcctctgatactccgataacctctgccatcttggaactgtccgtattcgcctgctttaaaagtgccacaaactctgagtttgcaagcattgtggttcttatatgtaagaagtacctatgaattagaactcttatcttaatatatatctgtgaaatatatacaaagatgtatgtatgcgtgattcctatgaatccccattacgcccgcatactcggaactaccatctagtcgcatatgcgttcacgatacactaattattaatcagcataatctcctcttttgccttctgaggataaggactttgacaccctttgtggtttattatccatccgccatatatctttccctgctcgctatgcaccttcatctctcgatccatcaattctcatcacgtaagctatgactgatatttgtcaggaactacaccggatttttaccagaagaaattactttcttttacagtagttgaatattcagttgtatgcgatattcttacgaacatcgtaaacatatcttaatacactagatacatattgtcggtaacatcatatgcactaaattaataaatttagtaacctattatgattattatgcgcgcatataagttctcttttgtgaatctatattttaattatagcttctaaaaatttatcgtcgggaaaaagttcctttttgtgttcttttgtgctatcatataatatgtatttaatgtttttatttgtggaggttattcaatggaagatatagaaaggtcaaacctagctagaacaataaaaaaatatagaaaagctcgaaaacttactatggagcaattaagtgaaaaaagtggaataaatttatcaacattaaagaaatatgaaactgataatagaaatcctaaactagaacagctttctaaaattgcagaagcgttagaagtaagtgtatttgaatttttagacatagaggtaaaatctgtaaacgatattatatctcttgttaataaaatgaatatagctactgatattgattgggatattgataatgataaagtatgtatttcttttaagaataaagaaatcaataattgtttaaaagaatacgctgtagattacaaaaaagacaatatattaatcaaaaaaacagaaactaattatgaatctacacttacaagacttatgcttataaatgacaagctcagataaaaataaatcattgcaacagtgaccaaattctcgtgcaagcgcggatattaactcgttgctcacataaatacaaaaataaaatcctggtttcacttcgtataacttgccatcaaccttaagactaaccgcacataacgctatgcatccacgcttaatacgtatgccttttatcctttcagctgcctagactgccatatttccaccatactttccatcaccagcaaccggcttgtttaatataatcttatctttatcctcgtatactatatccatcttaactaataattccaatactcttaatccactttttaagacggtttggatagaacaaagagagttattcttaagagtaatcggatgaaaaagtatttgcaaagacagatacgatatgatatatttagtatgcagttttgaaggagcaatccttttaaaagtaagctgctatgtggcttacattttttcacataatggaaacattagtgataatcctcgatagctcaatggtagagcactcggctgttaaccgagttgttgtaggttcgagccctactcggggagctaagaataagtggcatgcacttgcccatgaattctttattacggctccatggtcaagcggttaagacaccaccctttcacggtggtatcaggggttcaaatccccttggagtcatttattaataataaggcgacatagccaagtggtaaggcgtgggtctgcaacaccctgatcaccagttcgaatctggttgtcgcctctgtaagctttaatccgtcagggttaaagctttttttaatatatacgatacgtgcagatgccagaaatggagattaatattatgaaggtattaatatttacaacaagacaactatgctataacagtggatattattttgcacacagaattggtgaagaaattgaaaaacttgggattgagtgtgaatattgcgaaatacctgagaatgcaatcccatcagcaggaacacagattgcacagccagctatagagaatgcagggaaaagtgtagatgaagaagctgagaaaatgctggagagttatattggaaaggaatatctggcaatactagattttaattctaaacttccaagactcattcttgatgatgaatcttattatcttgatagcatagatgctcctttttataattttattctggatcacccactgtatcatcattcaacacttgattgtaagttgaagaattattatgcattttcaatagatgaaaatcactgtaaatatatacagaatttttatccacatataaaagctgtatatcaggttgcgctaggtgcagaaaatgttatctctctagaaaatctccaggagaaaaagaaaagcatacttattatggggacatataggaatcccgatatttatatgaaacagatatataatatgaataagtatgcagaaaaaaatatgcttgtaatgttagaaaagcttgaaaatgacaatgaaatgactgttgaaaatgcacttaaatgtataataaacaattcaaatatcgaaaaagacagttttccattaattcttaataaatattatctggtagaaatgtattacagaaattattatagaaagaaaatggtcgacgctcttgtcaatacaggatttcatatagatatagcaggggaatggtgggaaagttatgataaaattaatagtcctaatgtgatatggaataaagcagtaagatttgataagtcatatgaattgatagcaggatatagggcaatggcagattcatcaccgttttttaagggtggagtacatgacagggtatatgcaggaattgctaattatactgcagttatgactgattataatgattataggaatagatgtctgcaagatattgtacagatgtatggtcaagaatgcaattatgaggaaatatgtcagaaaactgatatgatgatgaataatgatacattttataaagaaatgacacagaaagcatatgaagaatatatgaataattatacatggaagtcagttgcaaaaagaattattaaacattttctttctgaataataatatgtatgttataattgtaaaaaatgtgcagtatggagggtataatgaaagaacttggaaaatgcagggctgtgattgctttattatgttttactgcaacagtttttagtggttgcgggaatagaactgaagctgtaatcacagatggagaggatattacaacagtaagtgctgaatatcccacattagaagaaagtcatgcagatatatttacctataaagatttaaaaattggaaatatttcttatcttatgacagaatcccaggttatagcaattttaggaaaaccaaaagaggaaacagagaatgatggtgagaagatttattcatataatgagatgtcaataggtttcgaaaaactcgatgataataacagacctagcggcagtggtgtttacaaggtaacacaggcagcatcaataggaagtgatgataagttttcgagaaatatgcgtgtaggacaatcagcagatgatattttaaaaatgtattatagagatgcagattatcagaatcatctttatatgtctgaagacaaaacacttacttatggaaagctgctctatggtgattttacaatagcagagcttgacaaggttaatacaaaagaaacagttgcatatggactggttaattataatggatatagtaatctggaaacggcagatagctataatattgaatttacatatgttgatggtaaatataaaggtgacagggcaacggttgatgatgattttgccacacttaattttgaaatagataacaatggtaagataacagcaatttcgtggttctattatccggaacagaattgatatgaggaggacgattatgaagaaatttgcaagatgcatattaatattaatattagttgccatacttagtggagttggaggttatatatatgaaaataatactatgactccgatgtatgaatcagtagcaaagctttatgtagtaccaggttcacagaatgaggcatctataagagctaagaatggtggtttgaatcatgattttatgattattttctcaagcaaggttgtaattgagtcagcacagagattagctggaacttcggaggatatttcggaatatctcacagtttcatcacctgctgacagtaatattgttgaacttaaagttgttaatcccgaccagaatacagctaaggcttatgttgatgctgttgctaaaactgcagttaagaccacaactattattccggtagagtcaatgcagattctttctgaaggaacaagtgatggcgtagcaacaaaaccagatttgtattattacacagctttaattatgggagcagcatgcgcagtatgtgtatttattgaaattgttgtgtgtcttattctgtgtgcattcaagaagaaggaagaccatagtgatgatgaatttgaatatgaagccagatttggaagatatgcatatccaagaagggaatatatagaaacagaggcagattcaacaaagagaattgttaatgataataagagaaaagccagctctgatgatattctggcagcatttgatgatgatgatgacgatgatgagtatgatgattcttttttatatcattcatctgataatagtaatgcaaatgtgactgaatcagaaaaaacaccagaagctcctgttatggaatctgaagaaattcctgacaaagcagtaaaagaggccgcagtgacaaaggaagaatataagccagagccagttgtagaagcggaaccgatacaggaggctgcacctgtagtagaagaacctatactagagaaacaggatgaaccaacattagttgatgaggagccagctcagattgtagttgatacaccagtagaagaagaacagccagaagaggaagtaaaaccggtagaagaagaacagccggaagaggaagtgaaaccggtagaagaagaacagccggaagaggaagtgaaaccggtagaagaagaacaagcggtagaagaagtggaaccggcaagcaaaattgtaattctaggaagaatatataagtaatacaggagaggaggagaaatatgttcagcgtaaatatagataagattgtcggaatgacagataatgagaaaaaatgttatgaagaacttagagaaaatttaaagaaagagttgaatggcgggaaagtccttgctattacaaagaatggcataggagcatttaaaattgcatatagttttgtatgtgcaggagaaaaagttctctttatcgatgctgatattatgtcagagatttttctcggaaaatataagcttggaaagaatctgaaaggtgtagcagattttttaaaaaaaccttctcaaatgtatgatttgatatgtaagacgaataatcctcagcttgacattatatttaccggagtattagatgatggtgtgatatcagaagatgaagaatcaatgatgaaacagtttatagatatgtattctgatagatatgacagaatagtgttaagctcagatgtagacggaagaatagcaaaatattgtgatggaactgttatcatgtacgaggaaagcgagttcggtgaattatcagcagagaattatgttgatgaacttgagaacaataaatgtaatgttctgggtgtggtaattaatggataatattgataaatttgtgcaattagtgcaggagagtgacaatattgtatttttcggtggggcgggagtatctaccgaaagtgggattcctgatttcagaagtccagatggattatataatcagaaatacaaatatccaccggaaacaattatcagtcattccttttatcagagatatccagaggaattttacagattctataaggataagatgttatatcctgacgcaaagccaggaattacacatctggcattggcaaagcttgaaaaagaaggaaaacttaaggctgtcataacacagaatattgatggactgcatcagaaggctggtagctgcaatgtaatagaactgcatggttcagtactcagaaattattgtgaaagatgtcataagttttatggtattgataagattatcgattctgagggcgttccgatgtgtgaatgtggtggaaggataaagcccgatgttgtattgtatgaagaaggtcttgacgataacaatataacaaatgctgtgaattatataagacatgctgatatgcttataataggaggaacatctcttggggtatatccagcggcaggacttatagattattacagtggagacaagcttgttcttattaataaatcagcaactccttatgacagcagggctgacattcttattaatgagccgcttgctgatgtattcaggaattttatttaattaatatatagcggaggttttgaatggcaggaattattccatacgaaactggtgatattgtagaaatgaaaaaaaagcatccatgcggtagcagcgaatgggagattctcaaagcgggtgcagatattaaaatgaaatgcttaggatgtggtcatgaaattattataaaaagatcacttgcacaaaaaaatacaaaaaaattgaaaaaagcttgaaattaacttctggatatgataagattttgtcttgtgatatatttttaatccttgttccttcatttacatttttatgtataaggatagaagggaccaaaagaccagaaggaggtgcgacgtagatgaataagtatgaattagcattagttgttagcgcaaacgtcgaggatgaagtaagaacagctactatcgagaaggttaatgagttaatcactcgtttcggtggtactattacagatccaggcacaagcgagaagaagaagcttgcatacgatatccagcatatgagcgaaggattctatagtttcattaagtttgaagcagaagctactgctccagctgagattgaaagcagaatccgtatcatggataatgtattaagattcttaatcgttaaagacggagagtaatttattaatcccgatttttaaagatgacgtttgacttacaactctttatagaagaggagataaagtatgaacaaagttattttaatgggaagactgacaagagaaccagatgtaagatattcacagaatgcagacggttctatggcagttgctagatatacattggctgtagacagaagacgtggaagaaacagtgataatgagcagtctgctgatttcataagctgtgttgcttttggaagatcaggagaattcgctgagaagtatcttcatcagggtactaagattgttgttactggcagaatccagacaggtagttatactaacaaagatggtcagagagtttatacaaccgatgtagttgttgaagaacaggaatttgcagaaagcaaatccgcagcagcaagtaatggaggagactctagttatgctgcgtacacaccatcaagaccagaaccaagccaggcggctggagatggatttatggctattcctgacggagtagatgatgagggtttgcctttcaactaagataggaggtaaaaaccatgccagataagaaggctgagagaccagagggtcagatgagaagaagaccaatgcgtagaagaaagaaagtttgcgcattttgtgcagatgccaacaaggtattagattataaggatgttgctacacttaagcactatgtttctgagagaggaaagattcttccaagaagaatcacaggaaactgtgcaaagcatcagagagctcttactgtagctgttaagagagcaagacacgtagctcttcttccatattcagtagattaatatatattaagactacgagccgtagcagggaaacctgctacggcttttttgcgcgggcagcgatgagagaagacatggaaagttcccagtcgtgcttgcacgaactgagaactttccatgtcttttcgaggagcgccgcgacaatgccagaacaaagttctggcatatgagctgcccgcagtaatgcgccaataatgaacaacgaaggtcgaagaccgggagttgtgaattatcaaggctcgggagtagcgaagctacggagagacttggcttacaaaatttgcccgcagcagtgagccgtgcaatccagaatgtgcttgcacaaagcatacttgtagtatatttgtatacatgatataattactctaattcgattatggagatgtgtgttatgccagataacaaatatggaaaaaaagcatttaaatatagcggactcttgaggtcgttttttgcatggccattatatattggggcggttctgattattatatgtgcaattatgttctgtgttaatgtgacagcagcgacagttgtaagcatttttatggttatatatctgatggcatgcggcctcatgtatttctatatgagaccaagaataatgtcaggaatagtggagtttgcatccaattattctcaggttcagaagcaacttttgtataacctcagtgtgccatactgtcttcttgataataatggcaatgtcatgtggactaataaggcaatgcaggattgcttaggcattaagagagatttcagaaagaatattaatactgttattccagaagttacaccaagcatattcccagatagtgaaattggatttaaggagataagacttacatttcaggacagggattataaggctgaattaaagaatattgatgcagattctatagcagatggtgttgatataattgagaaaagcatggattcttcaatgtatgtaatgtatctttttgatgagacagatatcaacacatatatacagaagttaaaggatgaaaggttcgttgtgggacttgtgtatatagataattatgaggaagcccttgatagtactgacgatgtaagaaggtcgcttcttgcaggtcttattgataagcgagttaacaagtatttttctccgggttcagcaattgtaagaaaactggaaaaggataaatatatcgttgtattcagatataatttcttagagaagcttatgcaggacaggtttagtctgcttgaagagattaagagtatcaagattggtaacgagatgacgcttactttaagtatggggataggaacgggttcggcagagtattctaagaattatgatgtggctaaggcagcaatggatcttgctcttggacgaggcggagaccaggcggtagtcaaggatggtgagaagattctttattatggtggcaagagtcagcagatggagaagaatacaagagttaaggtgcgtgttaaagctcatgcattaagacagattcttgataataacagtaatgtgcttgttatgggacatacacttgcggatattgatgcatttggttcagctctgggaatatatgttattgctaagaagcttggcaaggaggcgcacattgttcttggagaggttacaagcagtgtacggccttttgtgaacagattcatagacaaggaggagtatccggacgatatgtttataaagcctgatgatgcgccttctaagataaatgcatcaacagttgttattgttgttgatgtcaacagaccacagagaacagagtgtcctgagcttcttgaaaaatgcaagacagttgttgtatttgatcatcacagaagacagagtgatacaattactggcgcagttctttcatatgttgacccatatgcatcatcagccagtgagatgataacagaaatgatacagtatgttgatgataatattaagcttaaggcatttgaggcagatgcactttatgcaggaattaatattgatactgatggatttaacagtaagtcaggaccaagaacttttgaagcagcagcattcctaagaagacatggtgcagatgtaacaagagtaagaaaaatgcttcgaagtaatatgaatgaatataaggagattgcaaaagctgtaagccgtgtggaagtttataaggacgcatttgcaatatcaatatttaatggtgatgggattgacacaccaactgttggcggcgccaagacagccaatgatttgcttgatatatcaggaattaaagcttcttttgttatcactccttacgaggataagatatatgtgagtgcaaggtctattgatgaagttaatgtacagcttgttatggaaaagcttggcggtggtggtcatataagtattgccggtgcacagtttactgattgtacaattgaccaggcaattaataagattaagcttacacttgataatatgattaaggatggtgaaatataatggatgttattttattagaggatgttaagacattaggaaaaaagggacagattgttaagattaatgacggttatgcaagaaattatgtgttgcctaaaaagcttggaattgaggcaacagctaagaatcttaatgaccttaagttagccaggaagagagaagaaaaagaggcagcagaagagcttgcagcagcaaaggagcttgcagctaagattaaagagtgcacagttaccgtttctatgaagacaggcgaaggcggaagaacatttggaacagtttcaaccaaggaagttgcagaagaggctaagaaacagttaggtcttgatattgacaagaagaaaatgaagcttgatgtgccgattaaggctttaggtaattatattatccagataaagctccataaagatgtaacagccgaactgactgttaaggttgttgagaaataagttttaagacacatttgtaagaaagggaattactatggacgagtcagtggtaacacgggtgatgcctaacagcattgaggctgaacagtctgttgttggttcaatgattctggacagacaggcaattataactgccgctgaaatcttaaggcaggatgatttctactacaggcagtatggaactatgttccagacaatggtagacatgaataacgagggaaaacctgtagatatagttactctgcaggcaagattgaaggagacagatgtaccggctgaagtctatagtatagagtttgtaagagagctgttatcatcagtgccaacatcagccaatataagacagtatgcgggtattgttaaggaaaaagcagtactcaggaatataataagagttaatgatgatattgccaatcagtgttatgcgggcaaggaaaagactgaagatatacttgctgatactgaaaagaagatatttgagcttgttaagaataagggcggcaaggaatatacacctattgataaggttgttcttgaggcactcgacagaatatctgcggcagcaaagactaaaggtgctgtaacaggtgttcctacagggttcaaggacttagatacttatctgtcaggtctgcagccgtcagattttattcttgttgcagccagaccttcaatgggtaagacagcatttgtccttaatgttgctgaaaatgtagctatcaagcagcagattacaacagttgtattcagcttggagatgtcaaatgtccagcttgtaaaccgtatgttatcactggaatcaacagtagatgcggacaagataagaaaaggacatctggattctaatgactggggtaagcttattgagggtgcagacagtattgcaaagtcaaagcttataattgatgatactccgggtatctcaattgcagaattacgaagtaaatgtagaaaatacaagatggagaataatcttggacttattattatcgattatcttcagcttatgagtggcagcggaagcggacgttctgaaggaagacagcaggaagtatctgacatatccagagcgttaaaggcacttgcgagagagttaaatgtaccagtagtaacactttcgcagttaagccgtgcagtagagcagagaccagaccacagacctatgctttcggatcttcgagagtcaggagctatcgagcaggatgccgacgttgttatgttcctttacagagatgattattacaacaaggatacagagcaaaagggtattgcagagattattattgccaagcagcgtaacggtcctattggaactgttaagatggcatggctgccggaacagacaagatttgcagatctttcaagagacttaagacagtaattgaacaagctaaaaaaggaaaaccccgaatcagtattaaactggtccggggttttatgtaagtaccattcaggtacattgaacaccatctggtgaacgttaatctgtatcttgttcagactactgtgggttaggagcgccaactggacatgttccagcacaagcaccacaatcaacacaaacatcagcgttgatttcgtaatgagaagcaccctcgctgattgcttcaacaggacatcctgctgcacaagcaccacaactgatacaatcatcattaattacatatgccatagtatatatcctccttaataatctctttattaactgcattggcagtcgctttagtgatattatacgataggctttgataaaattcaatatgaatttttatcaataaaatatattattattgttaggtataactaacttgaggtagaatagtaaagtaaaattagtgtattattgacatttatccggggcaatattatagtaggtatgttgagcggtacaaaagtaccgataatattaacctaataacaggaggtcagtatgacaagaattacgaaggacactacaattggagaagctcttcagatagatgcaggaattatacctattcttatgggaattggtatgcattgtgttggatgcccatcatcagcaggcgagacattagaggaagctgctatggttcatggtattgatccagatatgcttattgaggagattcagaattatcttcagtctattggataatagatggataatagttaaaaataagaggctgtggatttaatgatgaaaaccattaaatccacagcctcttattatatataaccggtgattacaatctgcgtaatatatgaagtgcatgttcagcaataatgcactcgcagtgttcagcaaagaatcctatatgattatcaaaaccagattccttttgtccatattcagaaagaatattgcagactttattgaaatccttagaattgcatttggttttagagatgcacagatagtatcttctgtcagaaggattcttatatactgaattggaatctttgtaaaaggtatctataatacaagcagcattagttatatcatcaagtgaagaaaatgaaaatacccgtgatatattagcagattccctgtgctcaggcctgtccgtagttcctttgccagacggttgggaaggagaggactgggatgctttattgtcagaatctttattgaaatattctttaacacggttaaagatattcataagttcatcttcaggcagaccttcttcatctgtggcagcacattcgtcaagctcttcattggctgttggcagtgagaaatcggaataatcattaccttctattgtttcaatatcatcaaaatcaaaattatcatcatccgaatcagatggtgagaagcgtgaaaatcttgtatcaagttcttccggattatcaacctttgtgacaatgaggacaatacactcagaagagacaggaattgcttcaatcattaaaggagtatcttccgcctcaaaaccaagttcatatgaagcctgctgcatcatatcacgaaagagttctttcgctttatcactgccataggcaagctcattgatctttaattgtcttgatgccagatcagatttgttaagtgtgcatcttatctggttttcattaagtctttctattttcataagccacctctgactatattacattaatattatttattaaagatataatacccactttttgtggatatgtaaaggtggtggaataacacatgaataaaataaatataaaaaattttttaaaatatattgaaaattaaattattatattgtaatatttgtttaggagatgtttttcatatatcgccgtaagaggaggtgtataacgaattttacgacagatatgaaatcataagggaactatcttgttccagacattctaaagtttatcttgtaaggcaccggatacttgatgtatatcgtgtagccaagatattttcgggtaaccagtatgaggccgacaggctgcttaaggaagcccatctgataaagaatttgaaacatccccacatcccggttatttatgatattgaacagaatattggagaagataatagtagtatctgcattattgaagaatatattgatggtaaatctttgcggcaatatgttaatgatgaaacaggtgctggcggcaatctgagtgttcatgaaatatgccgtattggcgttgaattatgttgtatactggaatatcttcatggttttaatggcaatggaatattacacatggatattaagccagataatattatgcttgatattaacggaaaagttaaactaatagattttgacaatgcggttgcaggtagtgccggagtgtcagttgatagcggaagtccgttgtatgctgcaccggaacagtatagtggagagtatgctgtgacgcagtcggatgtatatagtgtgggaatggtaattctttttatggtctcacatggtcatattaagaccgataagggccataatttagcagggataccgaggcggtattcaagattgtatcatgttattgaaaaatcaattcatcatcaatggggactgcggtacagcagtgttacattattaaagaatgagttgcaggggataatgagaagaagtggcggtacaattgaaaaacactcctatatagtacaggttgcaggggataaggcaggtataggaactacgcatacggtaatgtgtatggcacatttttttaagaaaaatggaattaattgtgttgtcgttgacaggtctggaaacaggcgtgtacttccgccgtttttaaaaaacggacttatggaagatggctcttatatatataagggcataaggataattccagattataatggagcaatatcggtgagtgcgcagaaaacggatattattcttgttgattcaggacatagtatgcgggagctggaaaatgataaggatattatggatattgctgttgagaattatgcatatatagaagtttgtgtgactggaaagcatatatgcgaagagaataaaaggttaagaaaactaaaagaagacagggtttatatgctgaatcttgtaagtgccacacagttttatgaattaacagatatgctgaaaggtaaaaaatgttatcgtgagccatgcatatatgactggtgcgaggataatcctatatttgacgaaacaatgaatgatttcttacaggataacctttctgaattatgggaagattgcagacctgatagattaaaggagtgtattggcaggttatatgagaagattagtagtatcagatattttaaaggggttaagaaaaagaaaagcagataatgatgaagcggctatgaattataagactgtcggactgattggtttatgcagcggtgccggaacaacgcagcttggtatcatgcttgctaattatttttctaacggactgcatctgaaaacagctatagtaagtgctggatttgatgattcatttgacagaatcaaagaggaagaacaggttggtaaagtcaggaattatgctggcagcagacgggggttttcatataaggggatagacttctttggaggtgtaagagaaggtttcgtccatgttatatcagagtattatgacgtggttatagtagagattaatcttgctggcctgaaagaaaaacttgcagatggcttaagagatgttatgtcttgcgaatgccgtattcttgttggatcaatggttccatggaaatatggagaatgtataaagagactggggcggataagaagaatctacagtgttaaaaacatgcctatagtttcagttacgtggcaggaaaaacgagcaaggagcatggaacgtgaattcgaactcagagcatataaagcacctatggaggaaaacccttttgagatgaggggaagtgccataaaggctttgaagcaggttgtaacttaaaatttcatttatgtctgatttaaaggtctaaaagaaaatatatcgcaaatcatgccctatctgattccttttgcgtagtgtatgattaagttcagggcatatctttattatggaaaatctgtgataaaggtatgcctttacttgcaacggtattgtatcaggtggtacaatattataattgtagtgaataagaaaggcagacagatgaaaataaaagttgataaaaggattaagggaattactattgcagcggcggcattggtactgattattgtcgtggcagtaatgtttattatagtgagatatacacctgccaaagagaagatgagtggttatacatattatggcatagacaggaatacggataaggtttttgttataatagatggagaactgtatccggatactggaattatatatgaaggccggtattatcttccacaggaatttatagcagataatattaacgtaggattttattatgataaagaaagtgacgcagtattatattcggattcggaatatatgtatacatataagaaagacgaaaatgtatatacggacgatacaggtaagacatacaatacagattattctgttgtagtggaatcagagggaaaatgttatgtcaactgggaatatgttgcagagcatacagattgtgaatatgaatatggcaatgagccggaaaggattaacataactctcgaaagaggagaaaagcagtatgtaactgcacagaaaaagactgctgtaagatacagaggtggaatcaaaagtcctgttcttgagtatgtgaagaagggggacagattagtgtacgaggatgaccttgacgactggataaaggtgacaacagcgacaggttatacaggatatataaagaaatcagaggcatctgatacatttgcgtatataagagaagaaaagaattatgagactcataattataatatgaaagatgataagattacgcttgcctggtttcaggtaagcggagtggctggcaattcaggaatagacaataatattgctacagcgtcaggtgttaatgtgcttgcaccaacatggtattcggttacagattcatcaggcaatatgtcatgttatgcatcggccgggctggtcaataaaatgcatcagagaggaacagatgtatgggcgcttgtaagtgattttgatacgaatgtggattttgctgcgctttattcaagtaagaaggcaagaaccaacatggttaatacacttattaatgatgcagaaaaatatggatttgacggaattaatcttgattgtgagaatattaagagtgcatatgccaaagattatctgcagtttgtaagagaattgtcgattgcttgtgaaagaaaaggtcttgtgttgtcaacagataactataagccagaggcatataacagatgctataatttaaaagaacagtcaagattcgttgattatgttattgtaatggcatatgatgaacattatgcaggaacagatgccggttctgtagcttcacttccatttgtaaaggaggcagttgaggatacagtacagcttgttggtaaggaacatgtaatagcaggtattccattttatacaagaatatggacaacaacagatggaaacacaacaagcagggctgttggtatgcaggcagcagttgaccagttaaacagtgacggacaggttgcattgtggaatgatgactgtggacagtatgttgcttcatatactgtgggaaatgccacaagacagatatggtttgaagaagagaaatcaatagaggccaagatgcaggttatacaggaaaataatgtggcaggtgttgcaggctggaaattaggtcttgagaagtcatcagtatggccagttatcagcaaatataataaataaaagtaatatgcataaaccttctgtaataaattagtaaagaattacaggtttcggagttgttatgccagaaaaagctgatataagcaggacacttcttctgccgtttatgtcaataatactacttgttgctgtctacatgacagccaatgtacttctgccattaaaggccagtggcaaaggcagcaaagaaagtgaagatgtgcaggaaagacaacatttgtcagatgatgcaggtgatggtgaagtcgttgagatgaatattaatttttctgaaaaatgtatcgttattgatagtgggcatggtggcgcagacccaggtaaagtgggtgttgcgggaacaaatgaaaaagagattaatcttgcaattgcaaaaaaattacaggaacggcttgaagatgctcagattaatgttattatgacaagggacacagatgatgatttaagtgtggagtccgataagagtaaaaagaaagctgacctggaaagaagatgtgatataatcaatagcagtggtgcagatatggtaattagtatccatcagaacagttatgtcactcctaaggcagaaggtgcacaggtattttattataagaagtctgaggaaagtaaaagaatagcacagataatgcaagggattcttggtgagaagttaggtacaacaaggcagattaagtcagatgttaattattacatactgcttcattccaagcttccgacaattatatcagagtgtggtttcttgtctaatccagaagaggagcagagactgtgtacggaagaatatcaggaaaaagtggctgatgctctgtattgtggtataatagaatatctgatgatgaatatgaagtaatgaaagctggcgaaaggttttatggaaacaataataaagaagataacacacacagaagaagataagaaaatatatgaacaggcaggacagattctaagagcgggagggcttgtggcttttcctacagagactgtatacggacttggtgcggatgcacttgatgcgaaagcttcagccaagatatatgctgctaagggaagaccttctgataatcctcttatagtgcatattgcagatgttaatgcattatatgatttagccaaagaggtaccagataaggcacttgtgctggcagaaaaattctggccgggtccgcttacaatgattcttaagaaaaaggataaagtacctgattccataacagggggtcttggaactgttgcgataagaatgccaagccaccctgttgcagcagagcttataagaagctcaggagtatatatagctgcaccaagtgccaatacatcaggaaagccaagcccaacaagggcagagcatgtaattaatgatttatctggaagaatagatatgattattcaggatgatactgtagatataggtgtggagtctacgattattgatcttagtgaggaagtaccgactatattaagacctggctatattacacaggctatgtttgaggaagctattggaaaaacaataattgatccggcaattatgggaagccttaaagaaggcgtgatacctaaggcaccgggaatgaaatacaagcactatgcacctaatgctgatgtgaccattgttgaaggtccacatgaaaaggttgtccagtatattaacaggcaggtgtcagaaaaagaagcagaaggtcacagatgtgcagttatggcaactgatgagacaaaagataaatatatatgcaatgatattgtttcagcaggacataaggatgatgagctgagtgttgcaagaaacctgtatgcgatattaagggactttgacaagcagaaagtagagtatgtttactcagaaagttttgagacaaagaatgtgggacaggctgttatgaacagacttatcaaggcagccgggcataaaatagttaaactggattaatacatttttaaataatgaagatatgaggatttcctatgaacacatttgacaaggtgatattcgtatgtaatggaaatacatgcagaagtccgatggcggcaactgttatggctaatcttaaacaggatattatatcggaatccagagggatggtggtgcttttcccagaaccatataatccgaaggcggttgctgttgcagccaagcataatatgataattccgaacaattcagcaaaacagttgttgaatgaggatttcggaaatgatacacttgtactggctatgaattcgcatatgaaacagaagatatatgatgaatacagtgaggcaattaatgtttatactctgagtgaatatgcaggagagcctgaacaggacattaaagacccatatggaaaaggcattgaggaatataatgcatgttttgaaatgatatgcaggctggttggcaaggttgcagagtatctggatgggttgtcagaagaaaaagaagataaaggagaagaacaatgatagcaattggttgtgatcatggagcattagaactaaaggagcagcttatagaacatcttaagaagagaggtgttgagtgtaaggattatggcacatatactaaggattcatgcgactatcctgtatatgccaagaaggtagctgaggctattctttcgggcgagtgtgaggaaggaattcttctttgcggaacagggattggaatgagcatggccgctaataagattaagggaataagagcagcgttatgcagcgactgcttctcagcacaggctactaaggaacataacaatgccaatgtattgtgtatgggtgcaagagttatcggaccagagcttgcttttagaatagcggatacatttttagattccaagttttctaatgatgagagacatataagaagaatcagcatgttagaggattaataaatgggtgataagagaaaagattatatatcatgggatgaatatttcatgggaattgcaacactttccggtatgaggtccaaagaccccaatacacaggttggtgcgtgtatagtaagccaggataataagatattgtccatgggatataacggattgccaagaggctgttcagatgatgagtttccatggaacagagatggtgaagataataagtatttctatacaactcatagtgagcttaatgcgattcttaattacagaggcggaagccttgataatgccaagctttatgtaacactttttccatgcaatgagtgtgcgaaggcaattattcaggcaggaattaagactgttgtatatgactgtgacaaatatgcagatactgcatctgtaattgcatcaaagagaatgcttaatgccgcaggtgtcagatattacaagtatgaaagaacaggtcgcacaataacaattgacatgtaaaaaagggtctggaaacgaataaggtttccagaccctttagaacttgttattcatgtgattcaagaattctgatgtattcattaaaggtaccgttatagatggcggtaagaagcttgttaagcttgtgaagcgcatcagacataagctcacagcttataatattctctgtaagtgcatcgcctaattcatcaaggtcgacaacacggacgcgcccgtcattctcaattatgacatcagcgagaaggtcagtgaatatatatgtatcagagacagcatcataagaagtgtcaataatgtcacaatagatatatgcaagagagttgtctgctttatagaatttgcttatcttaaacccttcgttaataacataatatgatgttccatgtgtgaattcagctttgggacggaatgtgttccaactggtcacaatagtatcagaatctaagaatattatgttatcgtccttaagattaacgcattcatcaggaataagtctttttctgtataatgtaggcatataaaatcccccttttcgggtatagttaataatacacaaaatataatgacaaaattatatcagcagattaattaaatttcaataaaaagggttgaaaaatatacctataaattggtaaaattaatgcagacttttgtgaggaacatgatatgaagaatgatagcaaagcattacgaaatattgtactgatatcccagctcgctatatgtgtgatggtgccaacatttttatgtctggcacttggaatatggcttgataaaaggtttggaacatggtttacggttccactgctttttattgggatggcagcaggtgcaagaaatgcatatgttctggcaatggacacaatacgacaggagaagcttaagaaagataaggcacagcaggatgaaatcgacagaaaggtagaggaatacagaaagaagcaggaaaaagattccagtgaaattaagaggtgatttatgttaaaaagaattaaagatattaatgaagctcttccgggaatgctgcttatagaatgtatttatcttgttgttgcccagataattatatttattgctgttccgaataagataatgtgtgcagtgggactgcttgcgggatgtttatatgctgtattcagttcatttcatttaagctttactatacgaaaggttgtgtatggcgggcataagcagtcttcaacacttgtatttgggtacattgtaagatttcttgtaatgataatactgcttgcattattgtatatctttaaggcaggagatttgctgtgtgcaattattggcatgttctcagagaagatagcggcatatctgtcgcctttactggacaagaaaaggtccgcaaaaggggaaaacagtactggggagttacctcagactgataaaaatataatagaaaaggagagtgagtaggtgggaagcgagagtttgactacgatggtggccggagattcaagtttcatgattaagacgctgtacacatttaagctgaatggcgtttcattgaacattgacacaacacatgtggctctgctgctggtatcagtctttattcttgttatggctgtaatagcaaggattaagattaataaagtcgatgcttcagatacaccgggaatgttccagaatgtcatagaaatcatcgttgagatgttaggcactatggttgatggtattatgggtaagaatgccaacaagtttgtgaactatatatccacattattcttgtttataataatatctaacatatccggtctgtttgggttaagaccaccaacggctgattatggtgttactctgtgtcttggtctgataacatttatactggttcagtttaatggtatcaagaagaacaggattaagcactttacagcattattccaaccgatatggtttttattcccgattaaccttattggtgaatttgcagttccgttatcattatcattacgtcttttcggtaatgtaatgtcaggaacagttcttatgggattgatatatgatttgctcagtccattcacagttgcatacccggcagttctgcatgcgtactttgatttattctcaggctgcattcaggcgtatgtattctgcatgttaactatggtttatgttaacgacaagatagccgattaacggcaaatatttttattagacggaggatttttaaatgaatatttcaggaagtgaatttattagtgctatgtcagcaattggagcaggtattgcgatgatcgcaggtgttggtcctggtgttggtcagggtatcgcagcaggttatggtgcatctgcagtaggacgtaacccgggagctaagtctgatattacttcaacaatgcttcttggacaggccgtagccgagacaacaggtctttacggttttgccgtagctattatcttaatgttcgttaagcctttcggaaactaagaagaggtgcgaagataatagaaaggaggcctacaattgaatttgtcaggaaatacatttgttgccatagcggctgatggacgattattcggtctggatccgcagctcctttttgatgcagcagtaactgcagtcaatgtatttgtactgtttcttttacttacatttattcttttcaatcctgtaaggaatatgttaaagaagagacaagacaagataacaagtgacagggagaacgctgagaacgataagaaggaagcgagcgcccttaaagcagaatatgaggctaagttaaaggatgcccacaaggaggcagaacagattcttagtgatgcaagaaagactgctatgcacaatgagaccaaaatcattgatgaagccaaggctgaggcagcaagaattatagaaagagctaatgttgaagctgaacttgagaagcagaaggttgctgatgaggttaaacagcagattgtaactgtagcagctgttatggcatctaagttagttgccagatctattgatgagaaggacagcaatgctcttattgaagagactttgaatgaaatgggtgagaaaacatggctaagctaattgaagcaacatacggtgatgctttatttgagcttgccgtagaagagtccagggtggattctctgtatgatgaggccggggctgtcattgaagcatttaatgataatccggagtttggcagactgctcaatcatccagaagttgaaaagggagaaaaggaaggacttattaataacattttctctcagtttgtttcaggagatatgacaggtttgttgataaccatggtctcaaaggacagacagaaaaagattgttgatacacttgagtattttcgaaagagagttctcgaatacaagaaaataggaattgcttatgtaagcacagcaaagccactcactgatgaacagaagaaggctgttgctgggaagctgttagaaactacaggatatgttgatttccagatgcattattcggttgatgaaagtcttattggcggaatggtaataagaatcggtgaccgtgtagtagacagtagtattaagcataaaatagacgaactttccagaagtctgatgaagattcagttataggaatatcagacaggttagtttaattaatcagaaagcgggtgcatagagctaatgaatttaagaccggaagaaatcagttcagttataaaagaacagataaagagatattctaccgaacttgaagtatcagatgttggtactgttattcaggtagcagatggtatcgcacgaattcatggattagaaaaggccatgcagggagaacttcttgagttcccaggcgaggtatatggaatggtacttaaccttgaagaggataatgttggtgccgttttacttggtgattcaagaaatgttaatgaaggcgatactgttaagacaactggacgagttgttgaggttccagttggtgacgcattgacaggacgagttgtcaatgcattaggacagcctattgatggcaaaggaccaatcgttacagataagtatcgtaagattgagagagttgcatcaggcgttattacaagaaaatcagtaagcgttccacttcagacaggtattaaagctattgatgccatggttcctatcggaagaggacaaagagagcttattatcggtgaccgtcagacaggtaagacggctattgctattgatactattattaaccagaagggtcagggagtacattgtatatatgttgctataggacagaaggcttcaactgttgcaagtattgttaagactcttgaggaatatggtgcaatggcatatacaacagtagtggcatctacagccagtgaacttgctccattacagtatattgctccttattcaggatgtgctattggtgaagagtggatggagaatggtggagatgtattagttgtttatgatgatttaagcaagcatgctgcagcgtacagaacactttcacttcttcttaagagagcacctggacgtgaggcttatcctggagatgtattctatcttcattcaagacttcttgagagagcagcaagaatgtcagatgaatacggcggaggttcacttacagcacttccaatcatcgagactcaggcaggggatgtttcagcatatattcctactaatgttatttctattacagatggacagatatatcttgagacagagatgtttaattcaggcttcagacctgctattaatgccggattgtctgtatcacgagttggtggttcagcacagattaaggctattaagaagattgctgctcctatccgtacagagcttgcccagtacagagagcttgcatcattctcacagtttggttcagaacttgatgctgataccaaggaaaagcttgcacagggtgagagaatcagggagatgcttaaacagccacagtacaagccaatgccggttgagtatcaggttataatcatatatgcagttaccaagaagtatgttatcgatatagatgttgacagaattcttgatttcgagcagggattatttgactttattgatactaagtatccacagattccagagtctattaaagagactaaggaactgacagcagataatgagaaggcacttatagctgccatcgaggagtttaagaaaacatttatccagtaaatgttttggaatggaggtaatagtttatggcctcaatgagagacataaaaagacgcagagatagtattcaaagtaccggtcagattaccaaagccatgaagctcgtatctactgttaaattgcagaaagctaaagggaaagcggaaagtaccaagccgtatttcgaccttatgtatgataccgtaaagaatatgcttgccaagtcaggtaatatcaatcacaaatatctgaaagccggagattcaagtaagaaagcgattattacaattacagcgaacagaggacttgccggaggatataattctaatattaccagacttataacaggtagtgatattcctaaggaagacgcacttatatatgcaataggaacaaagggaagagatttcctttcaagaagaggctatcagattaaagcagattattcagatatggttgaagaacctgcgtatacagatgccaaggctatatgtaatgaggtgcttgatgcatttacaagtggagaagtcggagagatatatcttgcttatacatcttttaagaacactgtggttcatgaacctaagcttatcaagctgcttcctgttgatgcagattcaatgaaacaggatggagcagagactgataatacacctatgaattatgagccgggtgaagaggaagctcttaacctgattataccgaagtatgtgtgcagtctgatatacggagctatggttgaggccgttgcaagtgagaacggagcacgtatgcaggcaatggacagcgcaacaagcaatgcagaggaaatgatatcagatctgtcgcttaagtttaacagagcgcgtcaggcttcaattacacaggaacttacagagattatagcaggagcgaatgctatcaattaataaaacaatggagggaataatggcagagaataatattggtaagattactcaggttatcggtgctgtaatcgatattaagtttacagacggtaatctgccagaaatcaattcggccatcaatattaagactaatgacggcggtaagcttgttgtagaggttgcccagcatcttggtgatgatgtagtaagatgtatagccatgggtcctacagatggtcttgtcagaggtatggaagcagaggcaacaggagccccaatttctgtaccagtaggtgaacagactttaggaagaatgttcaatgtattaggtgagccaatagataataagccagctccagaagtacaggagcatatgcctattcacagaaaggcacctgcatttgcagagcaggcaactaatacggagattcttgagactggtatcaaagtcgtagatttactttgcccttaccagaagggtggtaaaatcggacttttcggtggtgccggagtaggtaagacagtacttattcaggaacttatcagaaatattgcaactgagcacggtggatattcagtattcacaggtgttggtgagagaacaagagagggtaatgacctttaccatgaaatgatggaatcaggcgttatcgagaaaactaccatggtgttcggacagatgaacgaaccacctggagcaagaatgagagttggtcttgcaggacttacaatggctgagtacttcagagataggggtggaaaggatgtacttcttttcatcgataatatctacagatttactcaggctggttcagaggtttcagcgcttcttggacgtatgccttcagccgttggttatcagccaacattacagacagagatgggtgctcttcaggagagaatcacatctaccaagaacggatctattacatctgttcaggctgtatatgtaccagccgatgaccttactgacccagctccggctacaacatttgcacatctggatgctactacagttctttcaagatcaatcgttgagcttggtatctatccagccgttgacccgttagagtctacatcaagaattcttgatccaagaattgttggtgaggagcattacaaggttgcaagatcagttcaggaaatcttacagaaatacaaagaattacaggatatcatcgctatccttggtatggacgagctttcagaggatgataagcttgttgtttcaagagcaagaaaggttcagagattcttatcacagccattcttcgttgcaggacagtttactggtcttgaaggaagatatgttcctgtaagtgagactattcagggcttcaaggaaattatcgaaggaaagtatgatgacattccagagagttacttccttaactgtggtggaattgatgatgttttagctaaggtagagaagtagaaaagaggttgtaatggcagatttacagacaataaagcttctggttaatacgccggacagagttttctaccatgatgacgctacatttgttgaactttctaccagtgaaggcgatataggtgtttatccgggacatattccgcttactgcagttgttgttccttgtgttcttagcatacacaatggtaatgatgtaaagaaagctgcggtacacggtggaattatagagattctcaaggataagataactattcttgctgaggtggcagaatggtcagatgaaatcgatgtagaaagagctaacgaggcgagactgcgagctgaaaagagacttgccagccatgattctaatctggatatggtaagagcagagacagcgcttaagagatcgcttgcgagaattaaggctgttaattaaataatatgtataaaccttccattatctgggaatatttcaggtgatgggaggttttttatatggtaaagatatatagatttcagaggctgatgatagcagccgcagtaattatatgggcagtatttgccggcagacttgtatacaagggcataaagggtgagactatggatgttgtagatacattttgtgaaaatgtttactatgatataagtgccgacatatcagcgacaggaaagcttgacaatggaatgtcggatactgcaaagaaactgatgatgacacagatggcaaagactctggggcttaacagatataatataacggaggatgaaacaggaatatatcttacacagcaatcagttaatggcagcgcagatatatcaataaaaaagagcagtacaggagaatattttataactgatatagaactgtataagggatttgagagcacttcagattatgaaaagctgatgaaacaggtgttagaggaatatggaatagatactcatgtaacagtcagcatgaaaggaagcattgctggggatatgtcacagtatgataagagcgaggtcagcggcagaatacttaagatgctgggtgcaaagactgtgactacgggacagatacaggattcatatgttgtgtatgcttacgctaaaagcgttaaggattctgtaagcataggaaagaacaagataaatgttaatataacaatgaattatgacgagacaaggggagtgacggatatacagctttcaacaccgatatataatgaggatttctgatgatgatttttaaggcataaaacttgctattgtggtttttgtctaaagagattaaaataactatgtatatccagaggataaatcaagaaaagatgaggcagatatggaattaaaagagcttttagataaatgtattaatgacaggcttattgatcttacaataagcggacagagggtaaagaatgaagaagatgtgatgagggttaagattcgtccggtccgacttaaggatgagataaagtatcaggcatcagaattcgtgggaagaaaagtgcttcacaccaattattcagaagaagacattaagacaagaattacagaatatatggagaacacatttaaacaggcgcagtttaatatgacagatgcgactgccacggtgcttagttcaaagaagggcgcatgtacctgtaagtataaaaggcttgcacagataaagagtcagaaggatatgtcacacaacagaaccaagacatatattcttaaagagggcgagaaggtggattttcttgttgatcttggagttatgactaaagagggggcaattgtaagaacaagatatgataagttcaggcagattaatagattccttgaatttatagaggatattctgccacagttagataaggataaagaacagacaataattgattttggatgtggaaaatcatatcttacatttgcaatgtattattatctcaaggtacttaagggatacaatatcaggataatcgggctggatttaaagaaagatgttattgagcattgcaaccagttaagaacgaaatatggttatgagagactcaatttctatgaaggagatattgcttcttacaagggtgttgagtctgtagatatggttgtaacacttcatgcatgtgatacggctacagattatgcactcgccaaagcagtaaaatggggtgcgaaggttatactttctgtgccttgctgtcagcatgaggcaaacagaacaattgctgatgaaactctttcacctgtcatggattatggaatcttaaaggaaagatttgcagcaatagcgacagatggtgcaagggcaaagcttttagaatctaagggttaccagacacagatactcgaattcatagacatggagcatacaccaaagaatctgcttataagagctgttaagaccggaaagcctgatgcaaaggcttatgaggaagtacagaatatgagcagggtgcttaatattgaccttacgctaaagaagcttttggaggattaaattgaaaagaatcaggaattatagtatatcaggttctaagtattttatacttggagttatatttttagttacggttatcataacatttatatcaatgaaattcgaacagataatgccgtcagcaaccactatggcagatgcaactcttccaacagttgcaatggatacagaggcaggaacgcagtataatgtgcttcatggttacacttcggagctggattcaacattgttttatggcaatattacacctgttgcaaaggacagaaagctgacagttacaattaatacatacggagaagatattgaaggtgtggcatacaaaatccgttctttagaggataagtcgcttatcgagaatactgaggttagtgattatgataatgcaggcagcagtataaatgttacatttaacataaagaatcttcttgataccggaaaagagtatgcgcttgaggtcgtgcttaagacaaagaagcatgagacagtatattattacacaagaattgtttatggagtggattatgaccttcagaaaaagcttgattttgtcatggatttcaatgcatgtacatttgatgacagtagacttaaggacatagctggatatcttgaaacttcaagttcaggcgataacactaattatggaaaggtaaatattaactgctcattaagccaggtcggctggggagaccttgacccatatgtagagagtgatattatgccggaggttatatcagttgatgatgatgtggcaatattaagacttagttacagagttggagcagcaaatgattattcatcaagtgatacatatacagtaagtgagtattatagaatacggcagactaacagtggtttctatcttcttaatttcgagagggagatgaatcaggtatttgacgcaaggaacgacctgacttcaacggcgaagattaatcttggaattaattcttcaacagatgttaattgtgcatctgatgaaaagggaatatatacctattttgttaatcagggttcactgtggtgttttaacagcagttcacagacatttacaagagtattttcgttcaagggtgaggagactgattctgtaagagaaggttatgatgcccataatattaagataatgaaaatagaagataacggagatgcaacatttttagtatcaggatatatgaacagaggagagcatgaaggacaggttggcgtatctttatgcagatattcatattcagataatgatgttactgaaagactgttcattccaatggcgattccttataacattctcacacagaatgttggtggcgtttcttatgtttctaacgacaaattctatatacttatagatgagactctgtattctgtagaccttgtaagtaaagaggtcatgacagagataacaggacttaaagagaattcatatgctgtatcagatgccggagatgccatagcatatagtgtgtcaggtgatatatgcaacactgatacgataagagttcttaatatgagcaacgacagcgcttatgagttaaaggcagatgaggcagatacattaagaccacttggatatatcgattcggactttatatatggaatggctcataaggaagatattgtatcagatgcagatggcagcagaacatatgcaatgtacaaagtcggtattatggatgttgattataatattattaaacaatatgaacagcctgatatatatgtatctgatacagaggttgaaggcaagagaattacgcttacaagaatagtgaagtcaggaagtggttatgtgtcaacgagcatagaccagcttatcaataaggatgagaatgttgttgaaaatgttgtaaaggctgatacaataagcacagacgcaaggaaacaggaattatatattgaccttataaccaaggtaaatgatatatctgttagttacagaacttcaggtgagattatatttaaagacaatacaagtctggaacttgaagatgaatttacatgggatggaaggtactatgtatatggatacggaacattccagggaagcaggacacagcttgaatcagcaataactcttgcgtatgacacatatggaacagttgtggattgtgattcaaagtctgtgtggaaacggtacagaagcacacaggcatcaatagacggggtttcgccggttatgggtggaagttctcttgaaaatgcagttacaacagtatgtaattatcttggggctgattataatgccgcggcttacatggaacaggggtatacagcagtgcagacaatgaacatgataagcggagtacatggaataagtcttacaggaataacatatgagaaggcattaagctatgtcggagaaggaagtcttgtgatagcaaagaccggagaagacgaatatataatcattactgcatataattcaagtgaaatagcatatattgaatcatcatctggttcagtaaagactatgtctatgaatgatgctggaaaaatgttttctcagggcggcaatatatatgtaacctattataagtgatgatatgcacagggattgaatattatggcgaagaaaaaattatcaaaaaagaaaagaagacgcagattaataagaagacttatacttcttacattactgctggcatttgttacaacacttgcaatattttcaccaaagatagtaaagattataaagcttgcgcaggaggctaaggagcttgtaaataaaagttccttagacacatttatggcatcaggaacaacagttatatatgatactgatggcaacgagctgtgtaccatgcgtgagtcaaaggatatgtattatgttgatataggtcagataccggatacattacagaaatcttttgttgttatggaagataaagacttttataaacataaaggaattgatttcaaggctataataagggctgtgatagctaatacagagaatgatgaaatcgttcagggtgcaagtacaataacgcagcagcttgcaaagaatatattcttaagtcaggaagttacatggcagagaaaggtaaaagaaatatttgtggcatgtgatctggaaaagaaatatacaaaggatcagattcttgaattctacttaaacaacatatatttcagtaatggatattatggagtaggtgcagcagcgagaggctattttgacaaagaggtaagtgagctgacagttgctgaacaggtatttatagcggcaatccctaacaatccgacaagatacaatccactgactaattatgataacacagttgggagaagagacctcatacttggaaagctgtatgaaaatgatatgattaattccatgaactattacactgcacttgatacgcaggtggttctggcacagcagcccgaggtttcaaagaacaattctgtcgagacatatgcaaggcattgtgcgacagagagcatgatgcaggcgaatggctttgtgtttagaacgaattttaacaatgatgatgattacgaacaatataaagaaatatatgaaaacagctatacactgtttcagcagaaactgctttccggaggatacaaggtatacacaagtatcaacatggatgtacagcagatgcttcaggatgctgttgacgataatcttaaaggatataccgcagaaaaagacggagtgtatgaaatgcaggcagcagctacctgtattgataattcaacaggaaatgtagtggctattgttggctcaagaactcaggatttagaaggatatactcttaacagggcatatcagagctacagacagcccggaagctcaattaaaccgataatagactatgttccgtatctcgaaaagggcaatacacctgacactatagttcaggatgaatatattcaggatggtccgaagaatgcagatggaacatatatgggaagcattacattaagaacagcggtaagtctttcacgtaacacagttgcatggaatgtgttaaaggaacttacacctaaggctggaagttcatatcttctcaatcagggatttcataaagtatggatggataaagaatacaatgcgattgccataggcggcttcacatatggtgtgtcaacagaggagatggcaggtgcgtatgcaacaatagctaatgagggcgagtacagaagagttacatgtgtatcccagataaaggatacaagaggaagaatagtatatgattcatctggcagggggcagaagatatatgatgctgaatcgtgcaggatgatgacggatatgcttgaaactgctgtgaatgaaggaacaggacgcggggcagcaccagataatgcaattgttgccggaaagactggaacaacgaactctaattatgattcatggttctgtggatacagtgcttattatacagtggctgtatggcagggatatgattatcctgcatcaatcccacagagtcatacaaaggatatattcaggcaatttatgcaggattcacataagactctggcaaagaaggatttccctaagtacagacagaagtcagacaataaggagacagaaactgaatctgtaagtgaaacacagacagaaacgcagtcagtcagtgagacgcagtcagtaacacagacgcagaagggcagtcagatccagtcgtcaagtcagatggaaacaggcacggcaagggataatgatgcaactgcaggcaccagacaggatagtacggcaggaggaagtgaaagccgggcagatacagataagccggcagagactaaaggggatatctcaggttattaattgcagatatatcgtagatgtaaataaaataatacttgcagaaaagtggattgtatgataaattttagtggggtaaacttatagaaatataaggacacaaaactagaagtctaaggctaatgctatgatggttcggttgcatttaggaaatgtttcttaaatgcagccttttttgttttagcagagacttgaaaataattgttgatagtgtcaaatggcacacgaaattaatgcatagcagggaaaacctactaaagttgctaaatatgatgaagtggtaggttaattgcaagaaaattccgaggagaattaatgagaataaagaaaaagacctactaagttgatgatatgtgtccgaatagtgggcttttttgctaactaaaactgtttgatgcagtcaagtccaaatttgtgtgtaaattcatctttcagttatgtggttttatctacgtagataaaaccacataactgaaagatgaatttacacacaaatttggacttgacttactattctcgcataactcataaatttagtaggcaattttctttaaccaccttaattttcatcatattttttcctcaataaacctactatttcatcacattttacaatattagtaggcttttcccaaacatatactctgatttcatgtgccatttgacactaacttgtctgtatatacattttattacaccttttcgggtataatgtcaatattttttaagcaaaaagcacccgatagggtatatttcatcaacaaaattgtatattacaccctaaagggtataaaaatagcagagacttaaatttcaagtccctgccttttttctaatatattactgttcattaaaaagtgctgttgaaagatatctgtcacctgaatctggaagaagtgcaacaattgtctttcctgcattctctgggcgggctgcaagtatctgtgctgccttaagtgctgcacctgaagagataccaacaagtataccctcgctctttgcaaaacttctaccctctacgaatgcatcttcattctcgattgcgataacttcatcatatatcttagtattaagtgtatctggaacaaatcctgcaccaataccctgaatcttatgtggtcctgcctctccctttgaaagaaccgggcttgtagctggctctacagcaacaatctttacatccgggttctgtgacttaaggtattcaccaacacctgtaacagttccgcctgtacccacacctgcaacaaatatatcaacctttccttctgtctgctcccagatttcaggacctgttgtagccttatgaactgctgggttagctggatttacaaactggcctaagattactgaaccaggattctgctcctttaattcctcagccttagcgatagcacccttcatacccttagcgccttctgtaagaacaatctctgcaccataagccttaagaagatttcttctctcaactgacattgtatctggaagagtaagaactgctctgtatcccttagcaactgcaactgcagcaagaccaatacctgtattacctgatgttggctctataatcattgctcctggcttaagctcacccttcttctcagcatcctcaatcatagcaagggcaaccctgtccttaactgaaccagccgggttaagatactcaagctttgtaagaagtgtaactccttcaattcctgcattcttagcgtaacggcttgcgttaagaagaggtgtgtttccaataagttccaatgcactgttaattactttactcatactaatcctccttgttttgcgaagcaaaatccgagtcctttgacgaggagaggattttagcctccttgtattgaatgcatttgcaaatatgcttttgcgttcccattaacctactaacttgatgtgtaaatgtgttgttgaatataaaataccactatcagccttcaatgtcaacaccattttcatgacgagttttaaccattgcatcatgtgtaatatctttaataacttcactggcaattataagtcctacaacagatggtacaaatgcggttgaacccggaatatcgcgtctttctgtacatttgtgggctgctcccggaggacatatacagttagtacgacagctgattcccatatcctcaataggacgaacgggcttttccttagagtatacgaccttaaggtgcttaacattcctcttctttaattctcttctcataactttggcaagcgggcataccgatgtcttatatatatcagcaacctcaaattccgccggattaagcttattaccagcacccatactgcttataatcggggttcctgcttcctgacacgccattacaagtgcaatcttagccgttacagtatcaactgcgtcaactacataatcatattttgaaaaatcaaactgatctttagtctccggaaggaaaaaacatttgtgtacagtaacctcacaattcggattaatatcatgaattctctctttgcacacatctgtcttatactgtcctattgtttttcttgttgcaataatctgcctgttaagattggtaagacacaccttatcatcatctatcacatcaatcgcacctactccgcttcttacaagtgcctccactgtatatccaccaacgccgcctacaccaaatactgcgacacgggaattctctaatatatccatagcttctttaccaaacagaagctctgttcttgaaaactgatttaacatagtttgtcctttctttactttttgtatctagattttaattcctacttatatggtatgtcaataatattactatcaatttatcttataacaaaacccctaataattacattttcatgtaatcatcaggggcctttagttttataatcttagcaacaccttttctttacaaaagctattacatcatcattttttgacataatatcaaaatcttcctccatctctccgattgacaaccatttaaatactttatctccaatttcaaattcatccttatccatatattctggcaactcatctaatctaatcatatataacttatgattataaatcttatatactccatcacttacagaatatttgcaatgctttgcttgagctatatatttggtagataattgtatttttagtaaattacttatactcaaatcaatattttctttattattattctgtgtacttctaaaataaggaaacagccagcacttccatctattatcatatatttgcaaaaatctattattattttttattgcagctaaagaaaattcatgaaaagtctctgttgttatctcagctactaattgtagaattttaagtaaatctctttctgttaattttcctattttacggtcaagattccactcacttatacttattattctatcaattcttgcccatgaaactttactaagtcctgtctgctcccaatcagttatctctatactataaggagtttccttatctttacttgtaacatacatagccaaaatagcgatttcatcatcattaattacaattgccgggcgatgtttcacaatattactattttcaaaaggaaaatgcgtccaccatacatcacctatgttatactttcccattattcttctcctcttgctgataaacagcctcccactcatcttctttcatccactcatcttctaatgtaagttcttcggctttaattgcatttgaatatatattattataattggcattcatgaaatccttaaaatcctgtattgttctaattgcttccatattacacctcttaaaatttataaattatattatatatcttacactatatcaacaacggtttcaacttttattttattcatattcaaatattattatttatagtaaaaatttcaataattattaattttatataaaacgcttgcattatcaaaccatttgttatattatcatgtcaacaagatgtagtttttaatactacatatcattataggaggagggatttattatgacaacttttgcaccagcacttcatttacagaatgataatatacacactaagataaaggcacagatgattattaaagaccctggcagttcgataacacattttatcggcatgctctgtgcaattgcaggattattcccacttattcttaaagcagtctcttatggaacaaccgtttctattgtttcaatgactgtatttatggtaagtatgattcttctatatgcagcaagcacaacttatcacacatttgatatatcaagtaatgtcaatattgtgctgaaaaggcttgatcactgcatgattcctgttcttatcgcaggctcatacactccagtctgcctaattgtacttcataatatatatggctatgttatgtttggaattgtgtggggaatcgccattcttgctatcgcattcaagcttctctgggtaacttgtcctaagtggatatcttcagttctctacattgtaatgggctggacatgtattatggctcttcctcagatatattcagcacttgccggagccgcattcttctggcttctcgccggcggaatcttctacactgttggcggcgtaatatatgcaattaagatgcctgcatttaacgcaaagcaccctaactttggaacacatgaaatctttcatgtatttgttatggctggaagcctctgccacttcatactgatgtataacttcgttgctattatgtaatcaccacacacctataaaatatgtaagcggcggattcccgccgcctttatctatattaagcacctgctttgccctttcaggcgttatcccacttatataatggagactgccggctgtttctccgcacacattgcttgtaaaatcataagcaggtgctgattttacacgtattgtcaacaattactcgccgaggtaatccataggattcacaggaataccgtcctttgtcattgcaaaatatattcctgggccctcttctttatagtatgctgttggctcggccacggtaccaagaagctgaccggctgtaactgtatctccaatcttaacattcacatctgaaagcataccagttgtcatctcatatccattacctgctgcaacccttacagtaagtcctgtttcagtattctctgcaacatcaacaactacacctgataccgctgcacataccttagttccaacatctgaagcaactaccataccaggactgcatttgtacatgccaagagtcttaaaatacacagtagaatccatattatatccaagcgtaacagttccgctgacaggccagtatataagctctccctggtcaaatgtatacttacttatagcatttgccataacctcagcttcagtcataggcttgaccgcctgttcctctgtctccggctcctttgtctgctccgtaacctcatcctcagttccatcaccatcatcagacatgcttgctcttgcgttggcattaataatatcatcatcaccaacagttggttcttccactggaatatccgggtcgtcatctgtcttgatagccacatttccttctgtttcattcagattcacaagattgttgttcttagatttcttaacattctgtgctactgaaaatatcccaaacacaagcgcaacaataaccgccagcgtaataaccgctgacacaaccttaaccttgtcggttcctcgcgttcttacattcgccatactaacatcctcctatcatttcgcaaagctttgatgttaatatgttttccagattcgtaaagtttatactgtttttaaatgtaaaaatccccgcacacaaagtgcggggaaatattcaataatcttctgacaaatccgatattacatctcaacaggagtcttagtaagcttccagatttctgtagcatactcttcaatagttctgtctgatgagaacttacctgccttggctgtattagtcataacagtcttggcccagccgttcgtatctctgtatctttcatcaatctttctctgagcctctgcatatgaacggaagtccttaagaatgaagtaagtatctgctcttctgcctccatcattattaagaagagaattgtagatatctctgaacatctctgtatcctctggagaatactttccattgataagttccataagaacatctcttatttcctgatcattgttaaagatttccattgggtcatatccgccctcattctcgaaacggataacctcatcagagctgagaccgaatatctgtgcattttcagcaccaacttcattaacaatctcaacattagctccatccatagtaccaagagtaattgcaccattaagcatgaacttcatgttacctgtacctgaagcctccttagaagctgtagatatctgctcacttacatctgctgccgcaaatataatctcaccattagatactctgtagttctcaatgaatacaaccttaatcttgcccttaatagaagcgtcattattaataacattggctacattgttgataagcttgattgtctgcttagcaatcttatatcctgctgctgccttggcaccaaagataaatgttcttggaaccatgtcataatcaggatttctcttaatctgattgtacagatacataacatgtaagatattaagtaactgtctcttatattcatgaagtctcttaacctgtacatcaaagatagaattaggatcaacatcaattccgttattctccttgatatacttggcaagacgaaccttgttcttatacttaatctgcatgaaatcctgctgtgccttagggtcatcaacataaagcataagcttctcaagctggcttaaatctgtaacccatccatcaccaatcttatctgtaatccagtcagaaagaagtgggttagcatgctttaagaatcttctctgagtaataccattagtcttgttattaaacttctctggcatcatttcatagaaatctctcaactcctgcttctttaagatttctgtgtgaagctttgcaacaccattaacagaatatccggcaacgattgcaagattagccatcttaacctgtccgtcatagataatagccatcttacgaaccttctcctgatttcctggatatttagccttaatctcttctacgaaacgacggttaatctcttcaacaatctgataaattcttggaagaagtcttgagaacagctcgataggccacttctcaagcgcctcagccataattgtatggttagtataagcaacagtcttagttgtgatatcccatgcctcatcccattcaagtccgttctcatccataaggatacgcataagctctgcaactgcaacagttggatgtgtatcattaagctggaaagtaaccttcttataaatgttcttaacgtccccattattcattgacttatatctgtcaacagctctctgtacacttgctgatacgaagaaatactgctgcttaagtcttaattccttaccggcataatggttatcattaggataaagtacctcaacgatattctttgcaaggttctcctcctcgatagccttctggtaatcacccttatcgaaagagttaaggttaaatgtattaacaggctctgcgtcccagattctaagagagttaacagtgttattgccatatccaagaacaggaatatcatatggaacagcgattacagaacggtaatcttcctgaacgaacatatcccttccagtcttctcatctctgtaagaacgtacatatccaccaaatttaacttcatatctgtattcagatctcttaatttcaaatgggttgccatcctttaaccagttatcaggaacctctacctgatatccgtccttaatttcctgcttgaacataccatacttataacggataccacagccatatgcaggatattcaagagttgctaaagaatccatgaaacatgcagcaagacggccaagaccaccattacctaaagctgcgtccggctcctgatcctcgataacattaatatcaagaccaagctcgtcaagagcttccttaatctcatcataagcacagagattaatcatgttgttaccaagtgcacgtcccataaggaactccatagacatataataaaccatcttaggatcgtccttctcatactgcttatgggtggcaatccatttatcaataataatatccttaacagcataagaaactgcctggaaaacttcctgatcattagcctcttcaatattctttctataaagagacttacaattactgattacattcttcttgaattcttccttactgaaattctgtgttaaacttgtcgccatgtatttaaaactcccttctgaatatggacggctccccaatacgccgatataccctgtaaaaactataatccgccccacaatagatgttttaattatacataataatatttacaaatgcaaactttattattcaattgtcctcaagccatattttcaatattttcctataattcttccaaaatccatcagaatctcaacagaaaaatatctcatagaattaatacctaatttaaataacatatatggcataacaaacaccataaatgtaattacaagacagcctttataatctaaagcccttgtaattccatatattccaattgacattattaataataaaaccagtctgaatgcctgaccaattatcatatacccggctatgctgatattaaaaggaaggtcataaaaaatctgaaggctctgaattggtgctgacaattgttctaatctgtacaactgacatatattaaaaatatcaataaatgcagaaagtccccatataagaaatgatataataagtatttttaataatttaacagcctttaccctgcttctctcttttgaagtgttaagaaaagctatcatatggcatcttttttcatatgcatattcacctgatattatgagaataagaaatattacgcatacaagattctgactttccgtgttctgatatttccttgagccaaatatatcctcataagtagcgggatttacaattctagcttctatccctttttcctcattaacttttcttacatacttcagacaattctccatattttcaagagtctgacttgcttcacggaatttatatttataattagcatctgtctctgatttttttcctaactcttcgacagcattacgacattcctcaatatatgcttcacactctttatctccggtatttccactaaacatagaataaaaattattcattgaaaaatccgtattactgtaatcaacacctctgtacattctgcatgatatcaataaataaacagcagcagcaagcaatattattcccttttgtaatataaaagtcttatataattcagatacaaataaaggtacttttcccaataacatctggataaactgagagcatttttctattatttttgttatggcactcttcctgccctgtgcatatttatgagaatatgtaatatatactccaatcaatcctgttattgccagtaatattgtcagaagccaagtcgtactctgaatatctgtaataaaattatccgttccccagttttcatatatgtaatatgactgccccggaaacaatacatttgaaatatttatgtattttaaaaatgcaaatgcactcttagatgatatattaatattaattatatattcaaaaactaaaaacaaccctgttcctgctattgataatttgtaattaccagtaataaggaaaacaaaatataccagccatgacaacacactcatagctatcgcaaatgttatacaatatataataaaaaatgcagccacatttgtctttaattggaacatattaaacatataagaattctgtatcagacttcccatattacagccataaatattcttatatattgccagaatgacgccattaaaaacaaacgaaagcactattgatataagcaatataataaaacatctttttaccggtaatacttttctggaatttttactgcctctaatctgaagaaacatattattttcaaactcttccataaaagttataagcacaaatatcatcatcaccagaaaaataactggaagttgtttgtctgataccagtttttctatagcagtagtgttagtaatagagaaattgatttcccctctgctttccaaatctgccatatacttttgcgcattaagtacatagtaactttgctcctccgcaaataatgtgctgttaataattttcttgtaattattctctgcccttgacatatcagaagaataaacatattgatatttttcctgtaaaagttttattgcttcttcaatatattccctgtctgcttcgtagtcatctgttttatcatgtacatacttgctgtatgttaaggattcaatcatttccgtttgattatcatattcatacatcaactgattataataagcatatacttttttatcattcgtattattaatcttaaaaatgctcaaccagattattattccaagaaaaatagcaataaatacaacacttttccgtaaaaccctcaataattccattttgctcctattccggagtaatctgtatccactccttgtttcctgttccaatgtcagctttgtccaacactgcacttaaacatacctgtgccagtttactcgaaccttcagtttccattctctttttcagttcttcatatttactcattaattctgaagatgctttgaactgttgaatatccgtatctgttgttgttactaacagatatcttctatctcctcccaatatatttacatcagcagtcgtcttagtactttcctgattaaattctaatgtatcttttatctcgccatttgtatctaatatataaacaatatttttatcatcagttgtaatattttttattcctttagaaaggtctggtttatcaaatacataaaaatactgtccatcatatcctgcaagttttgtataatttctggttgatttattatccagtttaaatacttcacttatttcctgtgttttaagattcattctataaagacaccatgcacttgaatctactcctgcaaaatacatgttgccatctttatcataaaataattctgatgtaacccagtgtttagaatctgccttcttagataattcgtcatcactacttatatcaataagtgtttctacattccctgtattagtatcgagacaatccacgatatattcttctgcctctaatgatatacttgttctccagttaatatagagtttgtcacctattgcgttaagtgacgcaagactaacccctataaaatctgttccaccattgaatgctgcattatattcttttactttttccggttcagatgaactattaatgtccaccttatacattacacaccccgaatcactatataaaagataatacatatatccattgacaatatctgcatatttaatgtcaccccatgctgatgacaaagacataccttctgttgataatgtcttttcagatttcttatctcttaatgttttatcataagacacaaggatatccttctcctttgtcttttctatcatgtatattcttccaccataataccatatagtactacccagacattcttcatctgacaaatatgcctcgcactctgcattatcatgtgtacaatttacatttgaacataacgctacactattggcattaaccatatcgtagtaaaacataaatttatattcttcactgctaactggagactttgcaagataataatagcctttttccgcagccgcagcatttttcttcatataaaattgagcctcatctttatattcataatcagaatatttgtaaacattgtcatcattcttaaccgtcttattattactacatgctgttaatacagccattcctgcaatcaatattgctaacactgccttcttcaatagaatctcccccttcttatcccgactacattctgactccactttacaacattcccaatatttttcaatacgatttacgcgaacggtcattttttaacgcgaattgtatttcactttcccaatgacagctcaactctgcacataatatagtccggtcgacgcatttcatacgatatttccccattatatttatcaacaacatctttaatattcttcaaaccatatccatgctttctgctgtcttccttagttgtctgagtatctgtatttatttccttaatgccattcattaccgaattgcctatattaaagctcaatgtatcttctgtcctgcatatcatcacatatatctccggtttgtctgttttcaggcttgcttccatagcattatcaataagattttctaatattacatacatatctatatcagctattgattcctccacatttcctaatacaatacatgttttctcaattctaagttcttcacactgtaatatttttctgttaagaagataattaagtacaacatttgaagaacatattacttccttttctacagactgctcacctgtgtacttctgcgtaatattctttattttttgcatttcccccttatcagctaaatccgaaatcagacttaatatgttcttttcatcatgcttatacttgctatatctttcctgaagttcaattatcccctgaatgtccttctctttctgtctgtatgcctctacaagaagttcttcctctgtattatgttcgtagacttttcgttcaatagacatcagtaccatatttataatattaaccgtgattattcccaccacagcaatcagcgtatataatgctctaatgctttcacttttattttcctgatatactatcagacagcatataattactgaaacaaccggaactatacttaataccatcatgtatctgttatccatatgctcattcattgtcttaaacttaattatcatatagaaaaatatgcataaaatcacctgcgtaagtacaagtgaaatatacctgcttgattctccatattgtcctacttttaagaaatctgttccttttattactcctacaattccagcgcctagcattgcggcacatacaattgccaccatcatcacaacattatacataatcttctgggcaacattcccacataagaatactgcgctaaacgccaatgatacaactagatatataagcactcccacgctctcaaaaaaaataattctgttcataatctcaagatacagaactgttactataactcctgttatatatgcacattttctattcttcccctctttcacgccaagacattttataagataatatgttattgcaaatgcctgaaaaatatttacaaacacttctaccgcctcgtacataattcatattcccttctcacattctttcgtctgcttctgctgattttacaaatactaccatttatcatgacagcttcatcaccggatatattttttatatatcttggattgagcataactgagcgcgatattttaataaacccatactcttcaagtttctcttcatatgtgtgcaacgaaccactaagtatcttttctccatcttttaaagtaatctttaattcatggtcatacacttcaaatacaactatttcatctgctgccagctcatattttctatcttttcctgtaatctctactctctgcgccctcttacgaacatgataaactgcatcatacacaaacttttcaaggtcactttcaaggcatttcttctgtacaaatcctatcggtctgccaacaaaagcattatatacattctccgaatatccagtaatatatataattgccgggtcggactccctaaatgtaagctcacgccccacctcatatcctttacagtcaccgaggtctatatcaagcagaaatatatctgcaccgtctttcttataattatccagcagttcctttcccgaatgatatctgacgaccgaatatgtttcatctcccatagtacatttattaaaaatgtctattatccgttcatcatacttatccataaaatcaatgtcatcatcacatattgcaatttttatcattatgatttctccgcatacaacatttttcttaattaaatagtaacatttacaataatatatatcaatatttctatagcataaaaaagctgtgcaccagcctcaaagaccagcacacagcttaatataacttttattcaattacctgcattaagcaagcttctcaacagcaagtgtaaccttctcaccattgatatcccactccttctcaaatcctgcagtctttccagtgataatatcctgtgcaagaactacagtcttaacctgagcggcatttctgttaacaatatcagctatcttgtcgttgcctgatacatagagattaatcttatccataacctcaaagccagcgtccttacgcatagtctgaaccttagagataacctctcttacgaaaccttcctcgataagctctggagtaaggttagtatcaagaacaactgtgatacccttgtcgctgcttgcaacaaatccttccttctgagtcatctcgataagaacatcgtccttagaaagctcaatagcctgaccttcaacatttaactcgaagcttcctgactcgttaagcttatccatagttgcgttaccgtcaacctctgtaagagctgttctgattgcattaagaagctttccatatttaggtccgagagtcttcatctgtggcttgaatgagtatgatgtaaatgctctgacatcatctgtgtattcaacttccttaacattaagctcatcagcaataatagctgtgtagaactcatcaagcttccagtctgccttaataaacatcttgccgattggctgacggttcttgatattagttgaattacggcatgcacgtccgataacaactgcgtctaatacatcatccatagtttcctcaagctttttgtcaatgaactgctcattaaccttagggaagtcgcataaatgtattgaaataggcgcatttttatcaatgctgcatacaagatttctataaatactttctgtcatgaatggaaccattggtgcagaaatcttagcaagagttacaagtgttgtgtaaagagtcatgtaagcattaatcttatcctgctccattcccttagcccagaatctttcacggcttcttcttacataccagttagaaagctcgtcagtgaagtcctcaagtgctcttgcagtctctgtaatcttgtagttctcaaggttagtatcaacgaatttaactaaagaattaagctttgataataaccatttgtccataactgaaagcttgtcatattcaagctgatacttagtagcatcaaaattatcaatattagcatacagtacaaagaatgcatatgtgttccagaatgttcccatgaactttctctgaccttctgaaacccactcatccttgaatctgttaggaacccaaggagctgaattctcgtagaagtaccaacggattgcgtcagcaccatgcttctgtaatgcgtcaaatgggtcaacagcgttaccctttgatttactcatcttctgtccatctgcatcctgaacatgtccgagaacgataacattctcatatggagctttgttaaagagcagtgttgagatagcaagtaatgagtagaaccatcctcttgtctggtcaacagcttcagatatgaacttagctgggaactgctgctcgaataattctttattctcaaatggatagtggtgctgtgcaaatggcattgaacctgaatcgaaccagcagtcgataacttctggaactctcttcattgttccctgacacttaggacacttacatgtaactgcatcaacatatggtctgtgaagctcaatattatctggacaattgtctgatttttccttgagttcttcgatacttccgatagacatcatctcaccgcagtcctcacactgccagatattaagaggtgtaccccagtatctgtttcgtgaaattccccagtcctgaacattttcaagccatgctccgaaacgtcctgtaccgattgtctctggaatccagttgattgtcttattattagcaattaagttagccttaacttctgggtctgtcatcttgataaaccatgactctcttgcatagtagataagtggtgtatcacatctccagcaatgaggatattcatgctctaccttaggtgctgagaagaggattcctctgccctcaagttccttaagaacctcaacatcacagttgatagcgcctgcttccatctctttcttagttggcttagcacgcattcctgcaaatggagtctcaggcttcataacaccagcctcgtctaccatctgaacaaatggagcgtcatattttctaccaactcttgcatcgtcttcaccaaatgcaggtgcaatatgaacgataccagtaccatcttccatagttacataattatcgcagtatacgaaaaatgctttcttgtgctgcttgtcagcggcatcctttgcacactggtaaagtggctcatattccttatattcaaggtctttacccttgtattcttcaataatctcataagcaggagttccttcttctctctcgattcctccaagaaccttgtcaagaagtgcctttgccatgatatatgtgaatccatctgctgccttaacttttgcgtaagtctcatccggattaacacaaagagcaatattagagcagagtgtccaaggagttgttgtccatgcaaggaaatatgcgtcctcaccaacaatcttgaatcttacaactgctgtacgctctttaagagtcttatacccttgagcaacctcatgtgaagaaagaggtgtaccacaacgagggcagtaaggaacaatcttgaagcccttataaagaagacccttgtcccagatctgctttaaagcccaccattcagactcgataaagttattgtcatatgttacatatgggttatccatatcagcccagaaaccaacagtagatgagaaatcctcccacatacccttgtatttccatacagattccttacaatgcttgataaatggctcaataccatactcttcaatctgttccttgccatcaagacctaacatcttctcaacttcaagctcaactggaagtccgtgtgtatcccatccagccttacgcggaaccatgtaacccttcattgttctgtatcttggaatcatatccttaattactcgtgtaagcacatgtccgatatgtggcttaccattagcagttggaggtccgtcatagaatgtgtatgttggtccttcctttctgttatcaatactcttctggaagatatcattgtctttccagaacttttcaacttctttttctctgtctacgaacttcatatccgcagaaactttctgataaatcattgcagcttcctttcttgccttgtggcttatattttctagtacattacgggcattcgtcataaatccatcatacaagcaagcctgatggctgcctgcagactcattgcttacgaaaaaagcccctctgccgtaatacaacagagggggtaacatacttatcctaaaatctgaatgattacgacatactatcatatgcgtccctggctttaacctgacgatgggattaccgtccccgcttagtctcgtaatgatttcagcgaagatgctcagaagtgatgttcagatggatagtactcgcaccggctctcaccatcccggctcgctcatgcttttcactccaacctactgtcttcgtcaatgcatttgattagattttatataataaatgtttagttgtcaagctgattcttagccacaattctcataatcagatcaacgcttccatcaattccataagttgaactgttaattgtgaggtcgtaattatctgcttcgccccacttcttgcctgtatagaacgcgtatcttttaagatgtgccttatcctcttttgaaacatacttcgcagcctgcttataagtaagcttctctttgcttgtatggtaagttctctgtatacgcagcttcttaggagctgtgataaatatgcttatatgaggaatgtggttcttagtaagaatattatccgcatatcttcccatgataacatatggttcctgctttgctaaatcgatcagcttcttagatgtattaaagaactgtacatccgaccttgaaagaccatggtacttcttaaaatctctccaccactgagccggtgtccttgctgttttattctggaataaagctctgtcagtttcttcatgttcttcattacgctgtaatatctcgttcatgatagatacatcataatagctgattcttaacttatcagcaagcttgaaacctatatctgttccggcacagccatatgaacggcctatgcttataataagattgtcgtcctttccaaatctgtttgcaagattggacatgttaagctctgcatgctccgggtcaataatatcatttccctctctcgcttcctgcatagccattgcttcatcaaaaatctcaccatattcatgcattagttctttatgaagctgaggattctttttagtggttcttgccatattacttataagtgcaagctcacttctaagaactgaagaatccgcactggatttaatcaaatctcttaaatcattaatacatttttccttgtttccctgatatacacgtcccagattagaacctgtagctttatatactttctcgtccagtgcgtatattctgttcgcaagttcagttattttatcattatctgccataatgcgcacctcctaattatataaagaataatagtgtgtcaataaggaatactggtacaaggcagcacaatgaccacacaatatacccaaagaagcttggcatcttaacaccattttcatctgatattgacttaaccatgaaattaggtgcattaccgatataagttattgctcccataaataccgcgccacatgatattgctgtaagcatttttgcaggaacaattccaagagctgttgtaagtcctgacacaaatcccattgaaccagccgttgtaaggaatacaaggtaagttggtgtattatcaaggaaacttgaaagtgcgcccgttacccagaacatctgtgatggatgtgtaagtccaagctctgcgcctgcgctctttaaaatcataagagctggctgcatagtaataaatatacctatgaaaagtacagcaacttcctgaatggcgccccatgtgaaatggttcttctttcttatctctgcattagttgtcttgaatgataaaaatgctgctaaaagaatcataaccacttcaataagtgaagtaattgcaagcttaacctctccaaatataggaattgagattacctcgccggcagcattctggaaaaatggtacatccggaagtactccgcttaatataactgctgcaacaataattacgatgaatataatattatgtaatccctcaaatcttataagtggttcattttccttaatctccggcatataacctgctgctatatccttcctgtatgctctcttatcaagaaaataaagcactgtaagaagaataatcatgttaaggagcagtatcggaaagaatcttatactccagaagaaaggaacacctcttgagaatcccatgagaagtggtgggtcaccgataggtgtaagacttccgcccatattagatataaggaaaatgaagaacaccataatgtgagccttatttcttctccaagaattcatcttaataacaggtcttacaagaagcattgacgcacctgtcgttccaatccagcttgaaagaagggttcctattccaagaagaataacatttactcttggtgaaccaacaagacttccctcaactgttatgttacctgctacgcagaacagaccgaaaagcagtacaatgaatgtaagataatcatttaccagacattcaagtacagtctctgctgctgttccagcaccatacttaactgcgaacggaattatgaaaagcagtgaccagaatattacagcaaatggtctgtacttttcccaccattctccttttacaagtggaattatggctatacacaaaagcagacatgcaaatggtatacaaagccataaaggcacattcgtcagctcggctgccagtgcaaccattggacaaatattaatactcataacttaagcctccgtaaaaaaacctgttccacacacggaacaggtaatcttaatattaaattatctctgcacatcaaaagacgaattcttcataagtctcttaatgtggtcaacacatgtgatattagtatcacctctgatagcatgcttcattactgaagaagcaacagcgaagttaacagtatcttcaggtgtcatattgtccataagggcatagataagtcctgatgaaaatgcatcgccaccaccaactcggtctactatctcgaaattaattgtcttgctctcataagtctctccgttagtataatagaaagcctttaaagagttgttgcttcctgagtgtacatatcttacagttcttgcaatagccttcatatgatactgctcgtctattgccttaaatactctgtccatgtccttaaatgatgggtccattgtaagaccgtctttaacatcagttccatcttctctgtatacatggataggttcgattccaataagcacatcaacataaggaaggtacttactaagaacatctcttgcagtctcgaatgaccagagcgtacttctccagttagggtcgaagctgacagtaagtcccatcttcttagctgccttaactgccatatccatcatcttacggcagttgtaagaaagagccggagtgataccgcttatatggagccagtcataatccttaagaatctcctcgaaatcaacatccttatagtcgtattctgcaaatgcagaatcagctctatcatatattacctgtgaaggtctgacagaaacaccttcttccagataataaagtcccattcttccttctgatcttataatgtgcttagtatgcacatcattagacttaagataattaatagatgactttccaaggtctgagttaggtaatactgtaaaaaatgttgaatcaacaccaaggtttgcaagggaaaccgctacatttgcctctgctccgccataattaactctgaaatcatgtgtagttacaagtttttcatagttaggtggtgataatctcaacatcaattcaccaattgctataaatttcatgtcttcctccaacgtcataatagattaagggtatcaaatacccagttttgcatattccaatgacatattacaccacatttgtacaaattgcaaacttgcatattactttttaataagatataattattttattaataagtaaggttaaggtacgtgtttatggatatatttgagtctctgaattctgtgcttgtagacttgttcaatgatatcttgaacattgaagaaagggctcttatcacagaagaatttaaagatatttctgttacagacatgcatattatagaggcaatcggaattgaagaacctcgtactatgtccacaatttccaagtcacttggagtaacaatgggaactcttacagttggaatcaatggacttgtcaagaaaggctatgtgataagaaagcgcggtgagaaagaccgccgtatagtgtatgcctccctgacagataaaggaattgcagcttacaggcatcatgagaattttcataaagacatgattgagaatatcacgaaggatttaactaaggaagaagctgaagtacttaccaagacatttatacgactggaagatttcttccaccagcttccataataactgcattaataaaggaggggtatttatgccagataataagaatttgctcaattttgatgatttagctgatgtattcgcgcagcttaatgatattgaagatgcgccagaagaacttactgaggaagagaaagcctcccagcgcagatatgaagagataatcaagaaacataagaataataattaaccaaatgaatctaaacgactgtccaaaatattcaaaggcagtcgtttttatatgtgttataacgcaaatccccgttaatatagattataccttgtaatattcacatttattcatatataacatattgaaacagccacccgcggggaaacccaagggtggctgttccatctttatatgaaagtgtttgaaagaaaaaagcttatttattggctgtgatacctgctgtcttgtaaacaaatgttacacttccggctttgtcatctgacttgcctaagaatgaattgtattcctgacctgccttaactaccgccttgattgtatcaacggctgtctgtgcgtctgagtctacaagctttgtgataggctcaattgcctcactattaaactgtgccattccatcctttaatgtaattgcaccttcatttaactgtgtaactccatctgcaagtgttcctgaactatcctttaatgtagctgttccatctgcaagctgtgaagctccgctctttaatgtatcattattagctgtaagctgtgaaagtccgctctgaaggactgctgttccttcctgctgaagttttcctgcattaagatttaatgcatataagcttgagcagagagttccttccttgtaagttgagaatgaaccaactgatgcgctgagtgtgttaagacctgtacttaatgtaccaagtcctgacttaagctgcttagaacctgcacttagctgtccggcccctgtgcttaactgattaattccgtctttaagctgtgttgcaccagaattagctgacttaataccagcattaaggtcgctcataccatcaaaatatccggcatcttcaagagatgataatgttgtattgcaattgttatatgcctgataagcctgtgaaagtccgcttgtcattgtaacaatctgctcatctgccttagaacttactgtcgcttcatcaagctgtccgccagctgctgcacttacagtagcagcaactacctgcttgacagatgcatagttctttaatatataacctgttgctaaagcgtactgtgtcttacttgttacatcaggtgtctgtgatataccagactgtgccaaagctgctgcgattactgcctgctgctgtggtgttgctgaattaggattaattctctgactcatgcatgttactgcaaatgctactttatagaaacttccataagctgtgctataactttctgttgcctttttctttccagcttcaagatcagtctttaacttattagttcctgctgcaagctggtcagaaccagcttcaagttttgtaagaccgcctgataatgtatctgccccagtaacaagcgctccagcaccagataaagcactgtcaattcctgcatcaagtgttacagcacctgcagccagatcacctgcccccttagctgccgaagcaacactgctgtcaagattattatccttaagagtattgtaaagagttccaattccgtcagcatatgtcttcatgttgttattaagtgaaactgaaccctcatatgcacttgcagcgccatctgcgtatgcatatataccatccttaagagaagaagcacctgtatttaactggtcaacaccatcagtaagtgctgggattgcatcacttaactgctgtgttccatcctgtaatgtaactgttccgtctgcaagctgtgttgctgcatcatctaatgaagcaacagttttctttaaatcatctaaagtaatgtcatcagcattcatatccgaaagaagattagatgttgctacagacattgtcatatcaagtgagaaattcttaacatctgctgttaattcaaaatactcaggaatatcaaggtcaagtgacttgtcattaaacttaagattcatagtatccttaagtcctggcattgtcataccgactgccacaatattgtctccaaccttagtaagtttaccattagtaacctcaacatttgagaatacatctgttggaagcatcatgcctgtaatcattgtaaatggtacggcaactgtctgcttcttaccattaattgttacagttttcttctgattattagtgtaatcaaagcgaatagtaacctttccgctctttccggccaggtcttccggcttaatttcctttccgtcaagcttgtaagtaaccttcattgttactggcgcattttcacttgactcagtcttattaagagtctcattgccgttagcgtctgtaatcttttcgttgacagtgatgtgattcttgttaccggaagcatcattgaatacataaactgtttcctgtcttgtgttagttgcaagtgtgctcttgttagacactgcaagttcattagttattgcctgtgtaatcgtagcctctgtactgcctgctgccatctctgttacataagctgtatccgttcctgttgttgcagctgtcttagaaccgcagccaacaagacttgccgcagtaagaacaacacacattaaaactgaactatatctgaataaattcttctttaccataataaatcctcctaatttaattctgactgttcttctttggcttgaagcctaaacttgtatgaataatcaccttatcaagcaatacaaaaagtgatggaagaacaaatataacaacaaacatactgatgattgcacctcgtgccataagtgtacaaagtgaagcaatcatatcaacactggctatcatacctacaccaaatgttgctgcgaagaaaccaagtgcgctgacaataatagatggaatagatgttccaagtgctattgatatagcctctttcttagagttaccagcagctctttctctcttatatcttgtagtcataagaattgcataatcgactgtcgcaccaagctgaatagttccgattactaccgaagatataaatggtatcgttgttcctgtataatatggaatacccatattaacaaatatagcaaattcaatagcagcaaccagaataaccggaagagatattgacttcaatacgaagaaaataataaagaatatcgcaacaattgaaactgcactaactgtcttgaaatccttatcagtaatagtgataagatccttagtacaaggagcttctccaattaccatagatttagcatcatacttctttgcaatcgcatcaaccttattaatctggtcattgatttcatcagaagcaattgtgtaattagttgataccatcataatctggtattcatcacccttaagctctgaaacaagcgaatcaggaagcatttccgtaggtatttctccaccgagtgctgagtcaatacttaatgcaaatgaaattccatccagatcatttacctcattcatcattgcattagaatcctctgctgaaagattactgtctgcaagaatcatatatatagaattagttccgtcaaagttctcggcaagcatcttgttagcctgcgaacagttaagcttctctggaagtgtatcagacaaatcatagtaaaccttagtattgttatatccgtagattgccggaccaagaagcagaacgaatattataaggaatatccatgaatgattaacaatccatcttgccggcttatcaaaattcggcataatctctctatgcattgttttctcaagagccttgtcaaatgtaagaataagggaaggaagtattgtaacacaaccaataacgcccaatacaacaccctttgccataacaacaccaaggtcaagaccaagtgtaaagctcataaagcagagtgctatgaatcctgcaactgttgttatggaagaaccaacaactgatgttagtgtattcccaatagcaaccgccatagcttcgtgatgatcatccggagtttcttccttagcttccttgtaactgtgccataagaatatagaataatccagagttacaccaagctgaagtaccgctgccagtgctttcgttatgtatgaaacctcacctaagaaataattagaaccaaggttatacacaattgccatacctatacttaacataaagaatactggtacaaggaatgaatccataaatatagcaagtacgatacatacaagtacaaccgctacaagtacataaaaaggagtctccttttctgccattgtcttagtatctgtaactacagcagacataccggcaatataacactgattatccgtaacatctcttacttcctgaatagccttcattgtatcgtcacttgatgttgtatcatcaaagaatattgcaaacaatgtagctcctgaatcctcattttcaaaataagaacggaacttatcaggaagaatttctgaaggaacatcatctcctactattccactgtaagagataactgacgctacatggtcaaccccctcaaccttctttaccaacttagaaacatttgacttattcattccgtcaacgacgaccattgcataagcgccctttccgaaatcatcaagcaaaatgtcctgtccctgcatagtgtcgatatcacttggcagataatacaggatatcgtaattaaccctggtattaaagtaaccaagaactgatggaatcaacagcaggaagctaagaaccagaattggaattcttaacttaacaacaacttttccaaactttttcatataaataaccacgcctttctgtaagatgcaaatgccaacaacccttagtcatataagtattcatgtctttaacaaatatgaccgatagtcattttcaatttcagttgacattatagcacctcaaaacacatagtcaatagaaaattgaccaaaagtcattttttaatatttattttataattggattggtgtataatgttgacataagatgtggtgttgtaattattttcaggcacgcttgcgctacttgtcgctcgcagcggacactaaactcgttgcagttcctgcaacttgttaagtgccggcggctccaaagtacctgcaaataattacaacaccacatcatatacgcattttaattaataaaatagtattatataaaggtgagtgattgatatgggaaagcttgaagctaacaaacaacagaaacttacttctctgctgaatactgcatttaatctctttactacccagggggttacgaagacttctattgcggaaatttctcagaaagcaggtattgctaagggtacattttatctgtactttaaggacaagtatgatataagaaaccgtcttatatcacatgaatcaagtaaattatttaagaatgctgtcgctgatttagaggaattttctaaagaaaagaacgaacagttaggtttcgaagaaaaaataatatttataattaatcatattgtagatgaactgaattctaatcagactcttctcacatttatatcaaaaaaccttagctggggaatcttcaaggaagctctcacaactaaggttgcatctgatgatattaactttaaagatgtatattatgaaatgattaacgctgaggatatctcacttgaagagcctgaaataatgctcttccttattgttgagcttgtaagttcaacttgctacagcgcaattctttataaagaacctgctgacatagatactatcaagccttatcttttcaagacagtacgtgcaatcatcaaagagcacactatccggtagctgcttacgctttcccttcaagctcctgatatatatccctctttgacactcctctgtcctttgctgcagctttcatggcttctttcttatccatgccctgcgacatatacatctgcacatgttctgccacactcatgttttcccactgctttcttgcctcggcctttaactgctctcggcttttaccggcaatcacaagcacatattcacctcttggctcattattttcataatattcacatgcagattcaagcgtgaattccatagaattctcatatctcttggtaagttccttacatatagtaatctgtctgtcaccgccaagcgtatcttgtagttccgcgagtgtcttagtaagtctgtgcggtgcttcatatataatcatagtccttgtttcacatgctaactctgcaagaacttcttttctctcattcttatccgctggtaaaaatgcttcaaatgcgaatcttcttgtctcgcgtcctgacattgtaagcgctgttatgcatgctgccggtcccggaagtgaagtaaccctgatacctgctgccctgcattgctttacaagctcctcaccaggatccgatattcccggagttcctgcatcagtaattacagccacatccattccacctaatattttatcaacaagaacctttgccttatcatacttattaaattcatgatagcttgtcataggtgtctttatttcaaaatgattaagcagcttaatactgtttcttgtatcctctgctgcaatcaggtctgcttctgaaagcacacgcaaaaccctgtaagtaatatcctcaagattaccaataggcgttgcacacagatacagcatacccggtccgtctttctttacatttttttcattatccataataaacctctatctattcatacatttttagaagcgcatcagtgtaagtaccgtccgtcttgtatacaataagcggttcttcaacaataagctgggaattacctcccttaaccgcttctataagcaccatattggcagccttattcacataaggatacaccagcctcattctcttcggctcaagatgatactttctcatagtgtcaaatatatcaacaagtctgttcggtctgtgaaccatatacattttccctttagatttaagacaacggcttgcttcccttataacatcatcaagactacacagaagctcatgtcttgcaattgccttggcactgtccggattaacaataccgtgattttcattcatatatggcggattgctcgtcacaacattaaaagaagcttccccaaatatagtggaagcttcctttatatcacccttaacaacactgattctgttctcaagatgattaagctccacatttcttctggcaagctgcgcgcttccctcctgaatctcaagagcactgtatgtgctacccggattcttagactgcataagcaccggaataataccattaccggtacccatgtccagcaccctgtctttcttccctgccgtggcataagtagacaacagcactgcatccattccaaaacagaaaatatctgtattctgtataagctttagtccatctctcatcaaatcatcaattcgttcattaatcatcactaatatgggcttttccttcttttctttctaattcttcaagtgccttaagttccttatcatcatcaatgcggaccttatcaaatcttctttttctcttaaaacgaagctcctcaaccggatattccttaagttccttttcgtcattatcatgagttattaataccttaactctctgccttaaaacattgacacttgaaacctcaccaaccagtttatctggtgtagtaacagaatctcccacattaggcagatgactatttaattcctcatatgtatcctgctcattctttaaacaacacataagtcgtccacacacacctgaaatcttagttggattaagtgacagattctgctccttagccatcttaatagataccggattgaattctggtaaaaatgtggcacaacataaaggtcttccgcaggaaccaattccaccaagaatcttagtctcatcccttactccaatctgtcttaattcaattcttgtcttaaatactgcagcaagatccttaacaagctctctgaaatcaattcttccatcagcagtaaaatagaacagcaccttattattgtcaaatgtatactcagccttaataagcttcatgtcaagattatgctttgcaatcttctcaagacatatcttaaatgcttctttttccttttctctgttttttaattctctttcatcatcttctggtgttgcaacccttataattgcctttagaggctggataaccgctgtatcttcaacttctctttcacctagaacaacctgtccatattcaactcctctggcagtctcaacaataacatgctgtcctgtttcgactgaatatttcccaggtgcaaaaaaatatatctttccaacctgtctgaatctaactccaacaactttagtcatctatactctccattctatgaattttccttaatcgccataataagcaattctataaccagatcaaaattaacatttgcctgaagtctgaccttaaccctgtcaatagaattaataatatcctgtaaaccttcatatgacatagtctgtgcctgactctttatcagtgtcatctggtcattaaatatgagcagattagtatcattcgtactcttaaacataagtacatccctgtaccacataagcataaggtcaaggtaatcatcaatagtcagcttataattggtaactcttttcaccgatgtcataatatcagtcgaatccatatccttagcattcttaataacgtccattacatcacgtcttaactctgcaaactcagtagattcgaccatagtcattgccctgccgattcgtccagctgcaaatcttgctgcaaatttacactcgtaatcaccgatattatcatagtggtctttaagatatttaataactacatcatcctttagtggcttaagatcaagcacaacgcatcttgacagaatagtctgtaagaaaacatccggattattagcaagaagaataacaattccataagccggtggctcttcaattgtcttaagcattgcattctgtgctgcaacagtaagcttgtctgcttcatcaataatgtatatcttgtaaggactgctgtaaggcttaatctgcatatccgatacaagctggtctcttatatcatcaacaccaatacttcccggcttctcatgtccaacccagataatatccggctggttcctgcctgctgcctgcacacaggaatggcacaccccacaaggctcaactccgcccgcctcacactgcagtgtctgtgcaaatgtgctggcaataagcttctttcctgaaccaagtcctccgctgattacataagcatgagatacctttcccatagatattgcactctgcaaatgttctttaatagtctcatatccatatatgtctgaaaaattacccatacttattcctcttttcattacttatctgtaatattataacacatattgctcctatgttgaaatatctaataacaatccccttatatcatcaatagctccaactattgcaagatgatccttttcatcttttaccagttctctggcaagattatcaagattctcatctaccatcttaacaattccatacaccctgtgtcttcctctcctgtcaagaaagttctctcttgaaaacttgtgtgaacggtttacaacttcatttaggaatcccttaacaagctctctgtacttcttcatatctcttatatccatatgctttgcaatcttttcaccctgctcggtaatttcctgcatcatatttcccagtttttcctgaaggtctttctcctcaatattgctaatcagtgtaaacttaaaactatcatctgatttttcctgtgctttaaccggagtggtctgattagccggtgctatatctttaaccttaatatccatacatacctcctaatatggcactcttaacttcactaatgcaatcctctaactctccattattgctaaatcttcttgtaataccagctttagcaatattctcttctgaaaaatcctcactgtctgcaagaaatcttctgcacatttcctcatagtgtggattatcctgtttctgttctctgtggatagcccttgtgagtctcaatccatcttctacttcaatgtatatcggcataatatgctgttttccatagaattcacagaatttatcatacgcttcaagcgttcctataaccagatacctgttaccactgttaaggtcaatctgtccgtcatcagctgtaaaatacttccacacaccatacacagtattatattctctcagttcaacaatcctgccgctctcctgcatcttaacagctgtctcatcatttacaaaaaaatactcaaccccatcggtctccccggctctcattggtcttgttgtatacaatataacagtattaagcttcagactttcatcttcaattaggtttttatatatcttatccttgccggacgcgctttttcccataataaatgctatctcaggcatcttatctttccttccttaagaccgggtacttccagcccggcatttatcgcactcttaataattctgcatacatcaccggtaatccgctcgcctacattaacaacaggcattcccggtgggtatataagaaccgatgacatacttattctaccacatatatcaggtgaattaacagataaatcttcatatccattttcatccattaaatcaattgcatctgccggacacatacatacttctggcttgttgttaatcgcataccctaagctttcccctacatcattttcactgtctttgctttcaactttccagctttcatcaatctccttcaatgcactaagaaatctgtcataatactcctgtttatcagcaactgaagtcattgcaataacatatttaaatgatgccatctcaagctgcaccttatattcatccaataatctgtcatataggtactttccatcatcacatataagaataatcttagaaatatcatcactatccatcaatcttatattattaagttttgcaatattttctcttaaattcttaagtctgtttatatattccttaaaaatataatttccctgtccttcaataattctcatacacctgtcaatactcgccataagaatatatgaggggctggttgtctgatatatattccaaaatctttccactttatcataatctacataatttccagaaatatgtagaagtgcagtctgtgtaagtgccggtaatgttttatgaatactgttaattacaatgtcagccccagcttttactgccgactctggaaattcctcactgaattcaaaatgtgccccatgcgcttcatcaactataagtggtattcctttttcatgcagataactggcaatctcccttacctctgacacaacaccttcataagtcggagaagttataataaccgcctgtgcatccctgttattttcaacacattttctaatctgttctaatgatagtcctctgtatattcctgtatcattatcaacctccggtataacatatactggctctaactgtgccataatcaatgcattgtacactgacacatgacagtttcttgcaacgataatctttccttttcttttcgtcgcaccgcatatagctgataatattcctgctgtacttccatttacaagcatcagtgttttatctgctccatacaattttgctgccctgtcagacgcatttttaataataccatccgcattatgcatattatcaaatccatcaatctcggtaatatcaagttctgaagtacttgcatattcagtattgcgctttcctcccggcatatgcatcggcacataaccagcttttgaatactcttcaagtttttccagaatatctatatttcccatcaatacaactccattatctcttattctgtaaccataagctttactgttacttcatcatggcttccaattgcatctgtaacttcatacttaatatcataagtacctgtctggtcaaatgtatatcttccaacagtcacaatctttgcagtaatatcattaccacaagtatcagttgcagtaacccctgtcattacatctatactctgaccaatctttgtctgaatatcctttgccccttctatcttagcactataagcattccacggattattctcgtcagggtctgtaggatcccagcctgcataagcactgtcctctggaatctttatagaatccggcttaccaagtggtccaggattaactgcatcatcatatatagttacacctgttcccgatggacagttatcatatatccactttacatccctaacgcacattctgacgcatccaagagaagcataatcaccaagcttattgtactgtccatcctccagatcacccttattcattgaataatatggaacagaatggaacagataacctccacttattctgaatgcataacgtccataagtaccatcaaccatatatccccattcgtacttatctgatgttacataattctcacccacaatagtttcgtcgcctgcttttccacatgatgttgcaaatgctttgactggtatagtgtattctccattctcatcaatcccatacactgtagcacagttagcagctctgtttaccttaataaaatatggaagataaacagcttctggcgcaatatattcttgttcttttgattcaggctctttattatcaatccacacaacttcccttgccgctgttgtctcttctgttgaaacaactgtctgttcatcattactatcatgattatcagcctgttttttcttattagaatgagacaacataattccagccgttaatgctcctgcaatagcaatcacagcaacagtaataaaaataacaagtggcagatttctcctgaaccatgactttcttcttttcaaatatttataattaatgtttccttttgacataatatcctcctttgtccattacaaaaaattaatatgtgtttataaatgtttttaacgcaaaaaaaagctgtttcatcacgaaacagctttaagtgcctagaaccggaatcgaaccagtgacacgaggattttcagtcctctgctctaccgactgagctatctaggcttagtagcggggacaggatttgaacctgtgaccttcgggttatgagcccgacgagcttccgagctgctctaccccgcggcattcactatatatattatgttaaatagatgtataatatacatcaaagtgggcggagaaggattcgaaccttcgaaggcagtgccagcagatttacagtctgtcccctttggccactcgggaatccacccatctattaaattaatattaataatgctctcacattattaatatagagccgactgtcggagtcgaaccaacaacctgctgattacaaatcagctgctctgccattgagccaagtcggcaaaattgatggggcctacagggctcgaacctgtgaccctctgcttgtaaggcagatgctctcccagctgagctaagaccccatatataattgtaagctgtttccagcaagttatcatctgggaaatgataacagcgacccggatggggttcgaacccacgacctccgccgtgacagggcggcgctctaaccagctgagccaccaggccaatcgctttcgcaattaagagataaactcttttgaaagattgctctttcaaaactgcacattaaatatatcatatcgtatctgtctttgcaaatactttttcatccgattactcttaagaataactctctttgttctatccaaaccgtcttaatataaataatgtctacaataattgggttggtgtctacttttagattaccacttcagaatgatgtaaaaggtccagaattgttgtgaaatctggaaagattggactttttgctgaataagctgcttgtagtgtccaatcctccttgtagtcaatgagttattgaacattagcatatgagaaagcagagaaaaagtccaatcagccagattatcatgatatataattaatctggacaacatgatacctataggtagtcgaatatttgaaagtcttataggacgaaaacacatgagactataatgacagttaataaattaacctataagtggtggattttttatgaattgataggaaatcataatgaattataaaagcaacatccccggcatgattaataaccatgccggggatgctgttttttatattctttaattacttattgttcttcttctcgttctcaagcttcttcatagctcttaccttaagtgaaagaccgaagaggttgatgaatccgtcagcatcatgatgatcatacatatcacctgtcttgaatgatgcaattgactcattgtaaagtgaatatggagatgttgttcctgccttgatgatgttacccttgtaaagtctgaacttaacttcacctgttacatattcctgagtcttctcaacgaatgcctgaagtgcttcacgaagaggtgtctcccactttccttcgtaaacaacctgtgcaaacttgtttccaacatccatcttgaatgttgttgtatctctgtcgagaactaattcctcaagctgctgatgagcttcgtaaagaattgttccaccaggagtctcatatacaccacgagacttcataccaacaacacggttctcaacgatatcaatgataccgataccatgcttggcaccaagtctgttaagctctctgataatatcagaaaccttcatagccttgccattaactgactttggaacacctttttcaaatgtcatagtaacatattctggttcatccggagcttcctcaggagtgcatccaagaactaataaatgcttgtagttaggctcgttagctggatcttcaagctcaagaccttcatggctgatatgccagatgttacggtcacggctgtagctgcagtctgtgctgaatggaagatgaataccatgctgtctgcagtattcaatctcatcttcacgagactgaagcttccagttagaatctctccaaggagcgataatcttgatatctggagctaaagccttgattgtaagttcgaatctgatctggtcattacccttaccagtagcaccgtggcagatagcaacagcaccttccttacgggcaatctcaacaagtctcttagcgataagaggtcttgccattgaagtaccaagtaaatatttattttcataaacagcgtgtgcctgaacacatggaacgatgtagttgtcgcagaactcatcagtgatatcttctatatataacttggcagcaccacatgagagagctctctgctcaagtccgtccaactcctcttcctgaccacagtctgcacatacgcagacaacatcatagttgtatgtttcctttaaccaagggatgatggcagttgtgtcaagtccgccagaataagcaagaataactttttctttcattatatattcctccgtatattattaagtttacatagtaaaacacatatgctatgcacctgcagattataataaactactttatttaaaaatgcaacaacaaattatgcatattatacattaatatacaacaaaaatgtataaatataaattttctttaaaatatcctttacataagaaaaaaagttgctataatgtaggttatcaatttacattttgcgttattttatgcataaatgttgaatatatgcattttgcttcgcaaaacaaggaggagttatgattaaagtaggcattatcggtgcgacaggttacgcaggtaacgagcttgtcagattattattaggacataaggatgcagagattgtatggctcggttcgagaagttacatagatcagaattattcagatgtatatagaaacatgtttaagcttgtagatgcaaaatgtatggacgacaatatggagcagcttgctaacgaggttgatgttatatttacagcaacaccacagggtttatgtgcatcacttgttaatgacgaaattctttcaaagactaagattattgatctgagtgctgatttcagacttaaggatgttaatgtatatgaacagtggtataagcttgagcataaagcaccacagtatattgatgaagctgtttatggcttatgtgagattaacagagacaaggtaagcaaagacacaagaattattgctaatccgggctgttatacaacaacatcaattcttacactttacccaatggttaaggaaggaataatcaatccggatacaattataattgatgctaagagtggaacttcaggtgcaggacgtggggctaaggttgccaaccttttctgcgaagttaatgagagcatgaaggcttatggtgtcggaactcacagacatacacctgagattgaggaacagttaggttatgcatgtggaagagatgatttaaagcttatcttcacaccacatttggttccaatgaacagaggaattcttgtaacagcatacgccaaccttgccaaagatgttacatatgaagatgttaaggcagcatatgacatgtactatgataaggaatatttcgtaagagtacttcctaaagatgtatgccctgaaacacgctgggttgagggaagcaactttgttgatataggatttaagattgagccaagaactaacagacttataatgatgggtgcgttagataatcttgttaagggtgcagcaggtcaggcagtacagaatatgaaccttctcttcggacttccagagaatgagggattacagcttgcaccaatgtttccataataaatgtacaataggaggatgttatgaatataattaaaggcggtgttacagcagctaaaggattcaaggctgccggatgtgaagcacagattaaatataagaacggaaagaaagatatggcacttgtatacagtgagaagccatgtgttacagcaggaacatttacaactaacaaagtatttgcagctcctgttaaatgggacagaaacattgtatataatgaagactttgcacaggctgtagttgtaaacagcggtgttgccaacgcatgtacaggcgttgaaggagataacgcatgtgcagaagaagcaaaggcagttgcaaaggttcttaatataccggagaatgcagtacttatcggttcaacaggtgttatcggaatgcagcttcctgttgacagaatatgtgcaggaattgaaaaccttgctccaatgcttgatgattcattagaagcaggaacacaggcagcagaggcaattatgactacagatacaagaagcaagcaggttgctgtagaagtagaagttgcaggtactaaggtaacaatcggtggtatgtgcaagggcgcaggaatgattcatcctaacatggcaacaatgctctgctacataacaacagactgtgatatcgacaaggcacttcttcagaagatgacaagtgcaattgttgatgattcatttaacatgatatcagttgatggagatacatcaactaatgatacagctcttgttcttgctaacggaatggctggcaacaagaagattacagaagagggtgctgattataatgctttctatgaaggcttaagctatgtatttacagagctttccaagatgattgcaggtgacggcgaaggctgcacatgtcttttcgaggttcaggtaaagggtgcaacaactaaggcagaagccaagacactcgctaagtcaattgttacatcaagtcttaccaaggcagcaatattcggacatgacgctaactggggaagaattctctgtgcaatgggatattctggtgctgactttgaccctgaaaaggttgatatattctttaagagtgaagcaggtgagcttcagattgttaaagatggaactgctacagattacagcgaggagaaagcaacggaaatactttcacagaatcctgtaattgctattgcggatgttaagcagggcgatgcaagcgctacagcatggggctgtgaccttacatttgattatgtcaagataaatgctgattacagaagctaatctgacacagcattttaaagcaaatagatatctgaataaatatgaaatggagattattatgagcgcaaaagatatgacagaggaacttatgaaggcacaggtgcttgttgaggcacttccttatatccagaaatttaacagaaagataattgtagttaagtacggcggaagtgccatggtagatgaagaacttaagagaaaagttattcaggacgtagttcttcttaaacttgttggttttaagccaatcatcgttcacggcggtggcaaggaaatcagcaaatgggttgaaaagtcaggcatgacacctgaattcaagaatggtttaagagttacagacgagccaacaatggagattgccgagatggttcttaataaggttaataagagtcttgtttcaatgattgagcagcttggtgtcaaggcatgtggtatcagtggtaaggatggcggcatgttaaaggttgagaagaagtattctaagggtgaggatataggatatgttggtgaagtgacagatgttgatacaacacttcttgattcattgcttaaggacgatttcctcccagtaatatgtcctatcggatatgatgatgattttcatgcatacaatattaatgcagatgacgcagcatgtgcaattgcaagagctgtcaatgctgagaagcttgcattcttaacagatatcgaaggtgtatataaggattttgacgataaggattcacttatatctgagctttctacttcagaggcgagaacacttttagagagcggaacaatcggtggcggtatgcttcctaagcttaataactgtatagatgctattgagcatggtgtatcaagagtacatattcttgatggaagaattccacactgccttcttcttgaaatatttactaacaagggtgttggtacagctattctttcagacgatgcagaaaaattctttgattcagataaataattgcgaaccttaagctttgaggttataatattatattggctcatgtgaaaatgtgtgctcataagaataggaaagtgagagtaataatgaatacacagcagattatagaaacagcagaagagaagctgattcatacatacaaccgttaccagatagtacttgataagggtgacggagtaagactttacgatacagatggtaaagaatatcttgattttggagcaggtatagcagtatttgcacttggttataacaataaggaatataacgatgcattaaaggcacagattgataagcttatacacacatctaattatttctataatgaaccggctgtagaggctgcaacagcacttacaaaggcttcaggaatggacagagtattctttactaacagtggtacagaggctattgaaggtgcagtcaagcttgcaaagaaatattattatgtcaagaacggaaaggctgatgcagagattattgcaatgcagcattcattccatggaagaagtatgggagcacttgctgtaactggtaataagcattatcaggaagcatttggacctatgataccgggaattaagtttgcacagtataacgaccttgacagtgtaaaggaacttgttaatgataaaacttgtgctataatatttgagacagtacagggtgaaggtggaatttatcctgctactaaagaatttattgaaggtgtaagaaagctatgtgatgagaagggaatccttcttatacttgatgagattcagtgcggaatgggaagaacaggaagtatgtttgcattccagcagtatggcgttaagcctgatatccttacagttgccaaggctcttggctgtggtgttcctgtaggtgcatttgcagcgacagaggaagttgcgaaggcattagttccaggagaccatggaacaacatacggtggtaatccacttgcatgtgcagcagcaaccaaggtgttcgaactttttgagaagcagcatgtattagataatgtcagggaagtatctgcttactttgaagaaaagcttgatgagcttgttgagacaatagatgttgttgtcgagagacgaggaatgggacttatgcagggacttgagttatcagttaatcctaaggatgtaattgcgagagcacttgataacggacttattctgttctcagcaggaactaatgttataagatttgttccaccacttgtaattactaaggcagatgtagatgaatgcatagctaagcttaagaaatccttctagaatcaggagtttactttatgaaattaagaagatttatcagtatgatgctgattgttaccatgctgacagtctttgcaggctgtggtaataaagatgacaggacacaggctgcgaagaagcttaatcttagtggacctattacagttaatgtctggtataatgacagtgcatatgagtcttatcttgaattcgttgccagacaatttaagaaatctaatgaactggtgactgttaagccaatatatattgaggcggattcatatattaattatatatatgacgaatcggtaaggaataacaatgcatgtgatatatattttctgacatctgaagagatggagaaggcttatctttcaggtcttacctctgagaatgatatgtatcctgaagtctataatgagaatgtgtatggtaaggctgcaatgactgcatgttcgtatggtggtaagttatatggttacccggtgtcgttcaacacttcatttcttgtatataataagaaatatgcagaagcagttgatactatagaccagattcgtaatataagtgataattatcagattacagatgagaaccaggatgtttcaatggtgtttgaatgggatcctgattcaatgttcattaattatgcagcagcaggagcctatattaatataggcggagttaatgcagagaacagggctgaggtatctcttaatgaggaaaagattaagaaggttcttactaagtacgctcagttaaaagatgcatttggtattgacagaaatacagtaagtcttaaagaatgtgcggatctgttttctactggaaatatgctctatacggtgctagatgcagacagtcttgcagagattaatgttacagatgtagattatggaatatgtgagtatccttcaatgggagatgaccttgattctaaggcaatgtctgttactacgatggcagtagttaatccgtacactaagaatgtagatgcatccaaggctgttgcaagagcaatttcttatgattatgcagattatcttggaagcatggctaagaaaagctgtgcaagggcggatttaaaggttaagagagcagaaagctatcagaagttacaccagatttattctgactctgttgtaaaagctaaatatatcggagtaggagaagtatacatgagatatgagattatgcttcatcaggtatatgatggtggaaatgttgatacagcttacagtacatttgcaacaacaatagaaaaaacaactaaaaataataatgaaaacagtacgcagagtactaaataatattatgaataaatatcctgttattaactaataattattctatgcagattaatggggaggttagttaatgacaggatttttgattgcaataatatcaggcacacttatgagtttacagggcgcatttaatacaaatgttacaaaagcaagcagtgtgtgggttacggcaatgtttgtgcagttgacagcactggcgacttgtgcgattatgtgggtaattgacggaagacctgatatcatgaagctgtttaaggttgataacaagattacacttcttggaggggtgataggtgcatttataacatttacagttattaagagtataagtggtcttggaattgctaaagcggaagttacaattgtagttgcgcagataattgtttcgtatctgctgggacttttcgggctgtttggaagtgagaagactacattttcatggattaagctcgtgtcgcttcttattacggttgcaggagtatgtatgttttattttcttggtaatccgtcaacggattaatatattatgaataattatgataaatgtcagaattatctggcaggaaggaacagaatggaagatttattcagcgtatgcggaaagatacgattaagaaaaggtgaaggaagaaccttaaaggcaggcggtgcctgggtatatgataacgaaattgaatggatgtctgacggaataattgacggacatcttgttgaggtgcttgattttgatgattatttcatgggaatcggatttattaacagaaaatccaagattacagtaagaatgcttgcaagacacactgatgttgttgatgaggcatttattgaggagagagtaagggctgcggttgaatacagatttgacacagtagatacctctgcctgccgtcttatattcggggaggcagattttctgccagggcttgttatagataagtactcagatgtgcttgttgtggaatcgcttgctttaggtattgacagatttaagtcacttattgtcgaaaaagtgaaggaaatccttcgtgaaaagagcattgatatccgtggagtatatgaaagaagcgatgccaaagtccgtactcttgaagggatggagagagtaaagggctttattggtgatgaatttgacactaatgttgagatagttgagaatggtgtccactacatgatagatgttgtgaatggacagaaaaccgggttctttcttgatcagaagtacaacagacttgcaatgcagaagctgtgcaaggacaagagggtattagactgttttacccatatgggtacatttgcattaaatgcaggaattgcaggtgctaaggaagttactggacttgatatatcagaatatgctgttgaacaggcgagagccaatgccaagcttaacggacttgaggatacagtacattttaaatgtgcaaatgtattggatgagcttccaaagcttaacgaagcaggtgagaaatatgacgttgtaatacttgacccgccggcatttaccaaatcgagggaagctacaaagaacgcaattaagggctacagggaaatcaatatgaagggacttaaacttgtcaaaaacggcggctatcttgcaagctgttcatgctcacacttcatgacacaggagcttcttaccaagactattaaggaagccgctaaagctgtacataaaagactccgtcaggtcgagttcaggacacagtcacctgaccacccaatactgtgggaggcgcaggagagctattatctgaaattctttatctttcaggttgttgatgaaaaataatgatacaggcattaatttaaactatccaggaccgttaatctgagtcttttatgatgttttgttataattaattatatgtatccgcaaactattccgagtattgcggataagcatataattaaaattggatttaattttttgaatgctaaaactacggatatcagaaatataattaatgttgtataaaaagaaatatcagtaaaaacagtagtattaaacccatctggtatgaaaacggttgaactcatcgaaattacagcagaaccaatcaaaccaactacagcaggttttaatcctgacatacatccctttatgactatacttttttgaaattgaataaaacattttgcaacaataagaatgataataaaggatgggagtatcactccgagtgttgcacaaaaagaaccgaaaataccgccaacttctgctcctacatatgttgctatatttacagcaaatggtccgggtgtactttcgctaactgctataaaatcaatcagtgactgtgaatctatccaattatgagcaataacttcatcctgaatcaatggtaacatagcataaccaccgccaaaggtaaatgcaccgatttttaagaaaatataaaaaagctcaagataaatcattaacattttctccttgatatgacaatagatgttactaaacctaatattgcacagctgataattacaataagcacatttacattaagtaaggcagtaaaaataaaagaacatgccataattatataagaaataatattcttaggacattgaatatacattgaccagagagctttgataatcagagcaagtacaccagctctgataccattaaaggcatattgtatgatttttatgctttgaaattctttaagtacaaaagatataataagaataatcaggtaggatggtatcacaactccaagtgttgcaaatagtgcaccccaaaaaccacagatacgaaagccaacaaaagtagccgcattaattgcaattggtccgggagttgactcggagatagccactatttcaagaatatcattatcagttatccaatgcttcttctcaacaatttctttttgaatcagtggtaacatagcataaccgcctccaaaagtaaatgcacctatttttatgaaagttaaaaagagttgtatagttttttgaattttgttattcatcgtaagtctccttctgcgtgttggtgattggcatggaatctttcatcttatcaagcagttcataaggaacgaataaatgtcccatgccggttccaagctggatatgtggtttattcttaccatgataatcagaaccgccggatatcagcagatttctttcagaagcaatccgtcttattgataattcatcacccatcttgtaggttgaatatatggcttcaattccatcaagtccggcagagcacatatggtcaagcaatttgttcatctgggcattgccaagatgatatagaaccgggtgagctaagattgcaataccgccggcttggtgaatacgctcaatagcttctgcagggtcaactttggctcttggtacaaaacaaggctttccctgacctaaatatctgtcaaatgcttcattcctatcaccaacagctccaattgcaacaagtctgtctgcaaaatgtgctcttgtaattaccgcatcgccataggtctttagcatatcttcatatgtaatattaattcctatattctggaagcgttcacatacccgcttatttctttcatctcttgaacttaactgcttattaaggaatgaattgaattcattgtcgttataatctataaaaagcccgacaacatgtatctcagtattatcataattagtacttatctcaactccgggaataacttcaagttcgtggcctgttttattaacattttcacatgctaaaagagcttccttaactcctctggtagtgtcatggtcggtaagagcaaatgcggcaagtcccttatcgactgccttattaaccagaacagcaggagaatcagttccgtcagagcatgtggaatgaacatgtaaatctatctgtttcatagtaagctcctcttataaaatgtaaatatattctaccatactcagacaacttattaaagtgtaaaacatttggcaaagtgtttaaaaaatgttgtaagagacggcattgtgcgataaaataacagtatatttttggagggaggtttactgatggaaagacagttagtaccaggcggattttataagcattttaagaataagctttaccaggtaaagtgtgttgcatatcattcagaaaccaaagagaaaatggtggtatatcaggctatgtatggtgaatatgctgtgtatgtaagaccatatgatatgttcatgagtgaagtggatcatgtaaaatatccggatgtagcacagaaatatagatttgagcaggtagatccgttgacgatgcaggagatatctgacaatttacagtctgacaattcacaggcagtaagagttaattcagacaatagaattgatgaagcatacacattaaaagaggacagtgtggataactcactgacccagccagagcagcaggttgctgcaggggacagcgtcctggataagtttttagatgcgagaggatatgaggagaaacttgatgtccttataagatacaaaagcagattcactaatcctatgatagatattatggctgaatcactggagatagttgttccagaaggtgaactttctggaagaattgattctttaagaaaggttttacaggcacatacaaagtatgaaggaagccatttaagaccgtaataatttgcacagattctgcataagaatatgtggattatataaatatattacaattatctgacaattttacaaaaaatttacaattaacaaaaaatgtgaataactatgtggatattgtggaaaagttcagggataaaggagaaattatgagaatagtagttttagcaggtggaacaagtacagaaagagacgtttcattagtcacaggatacagagtatgcgagagtcttagaagaaacggacatgaagcaaatatgcttgatatcttcttaggtgttgatgacagtgaggttaagacattttttacagaaaagaatgatttgggagaactgtctgacaatttaaagaagaaaacagcggacattccggcagaggttaagagaagaacagaggcaagagaaagctttttcggacgtaatgtattagaattgtgtaaagaagcagatatggtattcatgggacttcatggaagcaatggtgaagatggtaaggtccaggctacatttgatctgcttggaatcagatatacaggtacagattatttaagcagtgctatatcaatgagcaaggaacttgcaaaaaaggttcttgtaccagagggaattcctatgcctaagggtgttacattacataaaggacataagattgagtatgttccattcccatgtgttgttaagccttgttgtggtggttcaagcgttggtgtttcaatagcacataacgagaaagagtttgaagatgcacttgatgaagcattttcttatgaagatactgtacttgttgaagagtttgttgatggaagagaattctcagttgcagtgcttgatggaaaggcacttccggtaattgagattgaaccgcttgaaggcttctatgattacaagaataagtacaaggctggctctaccaaagagacatgtcctgccaatattccagaagacattgcaagccagatgcagttctgggcagaaaaatgctgccaggcagcaggcgtaacaacatacgcaagagttgatgaacttcttgataagaataataatatattctgtcttgagattaatacacttccaggaatgactgacacaagccttattcctcaggaggcagcagcagtaggtatatcgtatgatgaacttacagagaagattatcgagatatctcttgcaaagtatgaatagaagaaatgtaaatgtataacaatgcatttttataaaacgaggttagttatgttatgattaaggaacttgttaagaaaaacagatcatacagaagattttatcaggaaaagaagctgacaaggcagcagcttatggaacttgttgagactgcaagacttactccgtcagcagctaacagacagccatttaagtatagaattgtgtgtgatgtggaagaaaatgagaaagttttcagactattaggatttgccggatatttaaaggactgggatggcccatctgaaggtgagaagccgacaggatatattgttataacctgccctgcgaatgtcaatgatgaagttgatgcgggaattgtcggacagacaatgcttctggcagctacagaagccggatttggcggatgcttttttggcaatgttaaaagagatgagttaaagacacagctaaatataccgtctgaattaaagattgtgtatgtcattgcatttggatatcctaaagaagaagtggtgcttgaggatattcctgcggatggagatatcaagtattacagagatgagaatcaggtacatcatgtgcctaagaaaagaattgaggatattgtgttatgaagggaatgaccttaagagccatgacacaagctgttaacggcatatatcatggcaatggagaagattatgacaaagagattactgccattacgattgacagcagaaaggtaactgagggcgggctttttattgctattaaaggggaaagaagtgatggccatgattttataggacaatgctttgagaagggcgctgcatgcgttatttctgaaaaggagctgccagatgaagaacgttcgtatatacaggttgaatcaagtcttcaggcattaaaggatcttgcacttctttacagaaataatctggatgtcaaggttgtaggaatcacaggaagtgttggtaaaacaagtactaaggaaacaataagctctgttttatctgaaaaatacagggtgttaaagacacttggtaatttcaataatgagattgggcttccacttactgttttcagactgacagaagatgatgaagttgctgttcttgagatgggaatcagtgattttggtgagatggacagattatctaagatagcacagcctgacatatgtgttattactaatatcggtttttgccatcttgagaatcttggaacaagagatggaattcttaaggctaagacagagatatttaatcatatgaatccggatggaattgttattgttaacggagatgatgacaaattatcaacaataagccaggtacacggcaagcgaccgcttgtgttcggaataagcaacaaagacggggtatatgcagataatatcaagagtcttggacttgatggaactagctttacaattcatggaatcaaaacatcagataactattcaacatttgacctgactgtacctgtaccgggacatcatatggtatataatgcgatggcagcagcacttgttggttctgtgcttggactttcatctattgagattgagcgtggagtgaagaatttaaagacaattgccggacgaaacaatattattaaggaaaatggatttacaataattgatgactgctacaatgctaatccagtttcaatgaaggcatctcttgatgttcttgacactgctattggaagaaaagttgctattcttggaagtatgtttgagcttggtgagaacgagaaacagatgcattacgatgttgggatgtatcttggaactaaggatattgatgtacttataacagcaggcgaccttgctgcacagattgcggcaggaacaagggcgtatattgacactaattacaatgcgcatggttgtgaagtacatgattttgaaacaagagatgatatgttaaaatgtattggacatattctgaaaacaggtgataatatacttataaaggcatctcatggtatggaatttaccaaagttgtagaggctataaaaacaattaatttataatggaggttttatgaaattacttaagagagtaagcatattagctgtacttattacagtgattgcagtatttgcaggctgtggtaaggaagcaacggttgttggaacatgggaaggagatgattatacttacactttcaatgatgatggaacaggaatccagcagataggagagataagcgtttcaattacttcgtatgaagcaaaagatggaaagctgagcataacaatcagttttcttgggacagaagagacagatgagtatacatattcaatcaagaaaaatgtactttctttaagcgatggaaacaatacaatagaacttaataagaaatagtattttaagacttttgcattatattctgatgcgaaagtctttttttgaaatttatatatttttatactttacaaacttttaaatgtgtgataatatccacaatataaaaagtactttttaaataatttaatcaagaggaggatttgtatatgcatgatattattgaacattatggaaaggtcgttatagcacttgcgggggtacttgcagcagtattgcttacagcagcagttgttactattgtttcagacagaactaaaggtgctgttagtgacatttcgtataaggagcatatatatgatgctattgatgcgagcagacctaatcagtaatgtgaggaatgtatatggagaaagaacagcttcaggagctgatagagaataataaagaggatatcttttcagagattaaggatgagatatctgatgatactgtaactgatatcgagtgggatggatataatctttggataacacagttgggaagaggctgctatatttccatgaaagagcttagtgacaagtatatggataatctgtctataagacttgccaatattatgggtgcatcttttaacagaatgcacccgatattggaggctaatactgaatctttaagaatctcaatatggcacgaatcaaggtgtggaagaaagagcatggctataagaaagattccaagaaagcttagatttgggcatggtgaccttgtaaagtctgattatgctcctgagagtattattacattgcttgagaattgtgtgacggctcatctttcaactgtaattggtggacagcctcatgcaggaaagacagaacttcttaagtatctggctacatttattccggcagaagaaaaggttggtgtttatgaggataatcaggagatacattacaggcagattaatccacatagcaagtgtgttgagttttttgtggattctaagattacatatcaggatattataagagcaggtttacgacataacattgactgggttcttctttcagaatcaagaggaccagaagttatggagcttcttaacagtttatctacgggagcttattgtatgacgactatgcatctggatgatataagggatatgccagacagaatgtattctatgctgggtaatggagaatcgtcagacagatttattaacagtatatataagtatattgatcttgtgctgcttgttgactgtgatagatttgaaagaagacatataagccaggtgggttttttaagcaggaatcagggagagaatacatgtactgttatatatgaagatggggaatttctggatagtgatattccacaggatattatggataagtttattaaatacggaatagatgatccgtatatatggaggcataattgaagaagatattaagatatttatctgtaaagcagttaatggaggacattgcagatctgaatggcgttatgtctgtaagaagatttgttttatcaaccatgcttgcaggagttgctgtatatagtgcatgtctgttgtacagaattaattatatcgcagcgttatttgttatgattctggctgtaattatgattcccggactggtaaggaattattttatggaaagaagtaaagcgtcaagatttgcagatgtggatgtgtatcttcaccagatgacatactcgtttatcaggaatccgaaggttaatattgcacttcaggatgcgtatgcaatcagcagcggaagactgaagagatgtctttcacgggcaattgaagaacttcaatatggaatgggggaaagagtatatgaagatgcattgaagattgttgaagaagaatatgattgttcaagaatacggacacttcataagttcttagttagtgtagaagaaaagggtggacgatacacaggagcaatggaagtgcttctggaggattttgacagatgggttaataatgtatataagtatcagtcggagataagaaagataaagcgggatattactataggaataatgataagcatggtacttgcaatgcttactaccgttatgtgcagtactcttaatatgttttcgaaagagccgcttagcataacagatacactggcatatcagtgcgtttccattgtgtttgttgttctgtgtatgctgttttacatatatacccgtaagcactatggttgtgactggataggagaaaacagaacagataagcagataatgcgtgattataataatgtatttaagtcggaagcaaagaagattactttaaagatgatcccgttatgggggattatgctgcttacagtgataattctcatattagtacagttaaagatagcggcgatatgtgttgctgcagttatggttctgtttataataacgccatttacacagagaaaaggttcagcaggaagaattaagaatgacttatattgtggttttacagaatggctaagagacttagcagttaatcttgaaaataaaccattattgtcagcagttgaagatacttatgatagctgtcctgttatcatgaaagaatctttaggaaagttcatatatgagattgaactcaatccatctgatatcatgccatattatagtttcttaagtgaatttgatgtgatggatatccaatcggcagtcagaatgttgtattcaataggagatctagacagggacagcatgaatcagacgattaatgctctcgtaagaagaaattatgaattatcagataaggcagaggctgccagatatcttgacagtacaagcatgatgagattttctgagtatataccaactttttttgtggcatttaagatggcggttgatatgatgttagttgttaatatgtacttataattggaggtgtatattatatgaatcatattattgatgaatatgcaggagtgataattggactgattgtatcttattcaatgattaatatttttggaaatatctttacaggggtgataagaatatgaaggatgttattaatacatacggagaagcagtaataggaatgtgtgcagtggtggttgccatgacaatgattggaatgtctatgtctgcgtacagaaatatacttttaggtgtgataggttcatgccttggatagcagataaagggggtattaatgaaggggataattgagacatcagtttatcttgttatatttgcattggtatgtttcttttctattgatttcataaggattaatcagagagtttctgatgcaggagagataagccagtatattgagaattatattgaagcatattgtggggatattcctgatagtgaattatcagaggaagctagagataagaagctttatgtgttagccaggtcagttcagaaagggggtatgaggcttacatatggagacgtaagcagggcaggtgattatgaatatatagaatacacactggaatatccgctgtctgcggctatgtttggttattcttcgcaacatacatataaaggacttgcacgttactttgtaagctgaagatatttgagaggagttattacatgtagtggtattattgttgttatagcgttaatagtcatgatacatgcgtcgataacaggaaacaatattagaagagatgaagtcaacagaagtcttgacggtgcaatggattttgcatttgacaggatgggtgatgtatatgctgataaatattttacaacatatgatgctgggaaaagacaacagatactgactgatctgatggaagaattttgtgtggttttaagtgaaagagttgcatcagatggtaatgttactgttaaacttatagattcagatttagacagagggttgtttcagattggagttacagaagaatatgaatatccatttggcggaagaacaggaaaatgttactatgaaaaaacgtattcctttaattgacaaatgttttcttatatcatagaatattctggtgtgcctgaaaaggagcgtactagaatgatatgataaggagattattatggaacttcagattttacactggtttgaatcattacataatcctgtaacagatccggttatgtatgctataacctgtcttggtaatgctggaatattctggattttattatgtgcggcgttcttatttataccggtatttaagaaagacagaaagttaggacttagtatggcaattggacttattctgtcacttattatgtgtaacggaattatgaagaatctgtcagcaagaataagaccattcaatgcagatctgacatttgagaatctttatggaatctttaatggcattaaggactggtctttcccatcaggacatacatcagcttcttttgcagcggcattagctattatattgtgggacagaaagaaaggaattcccgcagttatacttgcagctctgattgcagtttcaagattatatcttacagttcattatccaacagatgtacttgcgagtctgttacttggatcactgtatggagtaataggttattttgttacaaagcttattatgaaaagatcagagaaagcaagaaaggtgttttcaggagaagaaccttataagaagctttttgccaaggcataatgaatatgtaactatgtgactgtttttaagaaaggacgattgtatatcatgatggatgtggtatttgatactattattgatagtgttaaactgttgccgtttctttttctgacttatcttgctatggagtatcttgaacataagacaagtgccaggacgaagaagtttgtcaaggattctggcaaggctgggcctgttataggagctttacttggagctgttccacagtgtggtttttctacagcagcatctaacctgtatgcaggtaaagtaattactatgggaacgcttattgccatctttatgtctacttcagacgagatgataccagtatttttatcagaacaggtagatgtattagtgcttgtcaagcttatactcattaaggtttttataggtcttataatgggtgttgtaattgatctgatagtgagaagaagcaagaaaagttataatatggtagaaaagattggacatgtatgtgatcatgaccactgtggttgtgagacaagcatatttaagtcagcgttaagacatacaataactatatttgcatttattgttgttatatcttttgcacttaatactttaattcactttgttggtgaagagactttgggaaatcttatacttaataagcctgtcattggaccgttgatagcgggaattataggtcttattcctaactgtgcatcatcagtagtattaacacagctttatattgaaggcgtacttggacttggctctcttatggcaggactgcttgctggttcgggagtaggtattcttgtgctgttcagagagaacgatgatatgaaggataattttagaattcttgcgattctttatgtgagtggtgtagcatggggaattataattgatgcattatcaaagattatattgtaagattggcaatttaacagattaatattaatctccggttattgggagtgtatctttcaggatacatttttgataatcggagatttttttattgaattagaaataaaacagtgatagaatgacttttagaaagatactttataaaagtttaacatgagttgaaaaaggaggtagtgtttttgcagagtgtattggatgctggatttaagaaatatggcagagttattgctgatattgataccagtgaaatagtgaaacttatggattcgtatgatatgcctgaagatgttgtatatgttgcaggtgatgaaaagcttgaaaatacacagattcataaggtaatggaagagagtatatatggtggatgtcctgtacagacagggtattgtaatggacataaccagaaacttaatgcactggaatatcacagaagttcagaagttaatattgcggcaacagatatgattctgctgcttggtagcagagaagatgtgaaagacgattttacatatgagacatctaaggttgaaggattttttgtgcctgagggaactgctattgaggtgtatgcaacaactcttcattatgcaccatgcggtgtggatggacagggctttaagtgcgtagttgtacttccaaagggaactaatcttgatgtagttaatactcatgcaacagcagaagataagctgcttgcggcatctaataaatggctgatagcccatgaagatgctcatatagatggagcatttaacggcttaaggggagagaatataacagtataggttaaaggagataagttatgaataatacaccagttatgaaaatcggtattgttgcagtttcaagagactgctttccagaatcactttcagttacaagaagacagaatcttgtaaaggcatatgaagcaaagtatggcaatggggatatctatgaatgtccggtatgtatcgttgagagtgagatacatatgatgcaggcacttgaggatattaaggatgcaggatgtaatgcactctgtgtatatcttggtaatttcggacctgaaattgctgagacaatgcttgcaaaaaatttcaacggacctaagatgtttattgcggcagcagaggagacatcagctaatggaggtcttgttcagggacgaggcgatgcttattgtggaatgcttaacgcaagctataatcttaagcttcgtggagttaaagcatatattccggagtatcctgttggaacagcagaagaatgtgcagatatgattcatgaattcatacctgtagcaaaggcggtatacgcattaagcaatcttaagattatcagctttggcccaagacctaacaatttccttgcatgtaatgcaccaatcgcaggtttatataatcttggtgttgagattgaggaaaattcagagcttgatttattcgagaactttaataagcatgcaggagatgaaagaattcctgatgttgtaatggatatggaaaaagagcttggtacaggaaataaaaagcctgaaatcttaagcagactcgcacagtatgagcttacattaactgactgggttgaatcacataagggctcaagaaaatatgttgcagtagcaggtaaatgctggccggcattccagacacagttcggatgtgttccttgttatgtcaactcaagacttacttcaagaggaatacctgtatcatgcgaggttgatatatatggtgcattgagtgaatttatcggagaagttgtaagtgacgatattgttacacttcttgatattaataatacagttccagcagatatctacaatgaggatatcgcaggcagatatgcttatacacagaaggatacatttatgggattccattgtggcaacactgcatcgagcaaattgtcattctgcgagatgagaaaccagatgattatggcacgttcacttcctgaagaagttactaatggtacacttgaaggggatatcgttccgggagatatcacatttttcagactccagaattcatcagataacaagctttccgcttacatagcacagggtgaagttcttccggtaagaacacgttcatttggtgcaataggtatatttgctattccagagatgggaagattctacagacatgtgcttattgaaggcaattttccacatcatggtgcagttgcattcggacattttggaaagacactttttgatgtgtttaagtatatcggcgttgaagatgtgtcattcaaccagcctaagggcatgctttacaagagcgagaatccatttgcataaacagatgcggttatagatatatgattgcggaaaggagtctggtatgaattatataggaattgaccttggaacttcgtcggtcaagcttgttcttatggacacagcaggacatatcattgcaaatgtttcaaagagttatccgattgattaccctaaggccggctggtcagagcagaatccttatgactggtatgatgcatgtatggaaggcatgaaggagctgcttgacggacaggatgaatcaacagttggtggtatcagctttggtggacagatgcatggacttgttattcttgataagaatgatgaggttattagaccggctattttatggaatgacggaagaacaacgaagcagtgtgagtacctgaatgaagtgataggcagggataagttatcagaatatacagcaaatattgcatttgcaggtttcacagcacctaagatattgtgggtgaaggagaatgaaccggataattttgctaagatagacaagataatgcttccaaaggattatattgcgtattgtcttacaggtgtgcattgtacagatgtttcagatgcttcgggcatgctgctgtttgatgtgaagaataggcgttggtcgcgccagatgcttgatatatgtggcgtgacagaggcacagatgccacgcatctttgaaagtagtgagtgtgttggtacggtaaagaagaatattgcagatgagcttggaataggaagtgaagtaattgttgcagccggtgcaggtgataatgcagctgctgcagtaggcactggtactgtcggtgacggacattgtaatgtttctttgggaacaagcggtacaatattcatttcaagcaaggaattcggagtggattccaataatgcactgcattctttcgcacatgcggatggaaaatatcatcttatgggctgtatattaagtgcagcatcagctaatggatggtggatggacaagatactcggaactaatgattacacaggtgaacagtcgcagataacagatgatgaccttggcaataataatgtgtatttccttccatatctgatgggtgagagatcaccgcataatgacgaatttgcaagaggcacatttacaggaatgacaatggatactgagcgtaaggatatgacacaggcagttctggaaggcgttgcatttgcaataagggactgcttcgaggttgctaagagtcttggtataagagtggagtcaacccgtatgtgcggtggtggcgctaagtcagaactgtggtgtaagattatggctaatgtacttggaattcctgtggaactgttagagtcagaggaaggtcctgctatgggtgcggcaatgcttgccatggttgcagccggggagtataattgcgttgaagatgcgtctaatgctctcgttaaagtacgaaagacaataagaccagacgagaagataatagaaagatacgaggataagtacaataagttcagatgtatctatcctgcaatgaagaatgtattcagaacaattaatgagtgattaacaaggagaattttattatgaagttttttattgatactgcaaatgttgaagatatccgtaaggctaatgacatgggagttatctgtggagtaaccactaatccatcccttatcgccaaagaaggaagagatttcaaggaggttatcaaggagattacttctattgttgacggacctataagtggtgaggttaaggctactactgaggatgcagaagggatgatcaaagagggaagagagattgcagcaatccaccctaacatggttgttaagattcctatgacagttgaaggccttaaggctactaaggtgttatcatctgagggaataaaggttaatgttacattaatattctcagctaatcaggcgcttttagctgcaagagcaggtgcagcatatgtgtcccctttccttggaagacttgatgatatatcacagccgggcattaatcttattcaggatattgcagatatatttgctaattatgatcttaagacagagattatctgtgcaagtgtaagaaatccaatacatattacagactgcgcacttgcaggagctgatattgcaacagtaccatataaggtaattgagcagatggttcatcatccgcttacagatgcaggaattgagaagttcaagaaagattatattgctgtatttggcgaattatgtaactgacacacaagttaaccgggattaagcgagaggtaatggatggattcatcacagaaactaacgaacacggatgtaaaaaaacttaataaaaaccgtatattcagactgatatataattcggataagatatcaaggcaggagatagcagaccagttaggtctgtctctgccgacggtcaatcagaatcttaagatgctcatggaagatgggcttatagaatatgttggcaatttcatttcaacgggtggaagaagggcacaggcaattactattaataataatgcaagaaaagctatcagcgtgaatatcaaagctgactatattaatgtagatgtagtcgggcttaaaggccagattatatacagtatggctgttaaagcacattttagcaagagcagtgcatatattgagaagcttacagatgcggtaagacatgcagtggattatgttggagcagacgcagatgacattatgggagttggcgttacagttccaggaatacttgatgatgaaaagcagattcttatctcagcaccaccattaaaagctaagaactatgattttacaaggcttatatcagctattgattatccggtcgtagtgatgaacgatgcgagggcagaggcatacgcagaccactggtttaatggaaagcctgaagatgaaaaaatatatattatgcttggtgaaggtgtcggaggtgcatatattaacgcttccgcaatcagaaatggtgttcataaccgtggtggcgaattcggacatatggttattcaccctggaggaaagcagtgcctgtgtggtaagaagggctgttttgaagcatatgtttcagaaaaggtattatcatcagagcttgatatgacacttgacaatttctttgaactggcagcgcagggaaataagaataattccaatgtgttagatgaatatatggacaatctggctcttggaattaataacatatacacgatgatggactgtgatattgttcttggcggaacagttgcaccatatcttaagcaatatgataatagtattaaagaacgtcttgttaatgattattcctttgatactgatgcggattatttaagaatatcagatggcggtggcagaaaatcagggcttggtgcagcattaagttttgttgccagatttattgatggtgtggaataatgaaagcttataagatagcgtgaagtagtgattcttgctgcatgagtgctgaatgctatgatgcgtcagagggttgcataagcttggaatgcctctgtgtttacctataaaaaagatgtaaagtgtgtgatttataggtgaatttcaaatctgactattaagatagataaaaataatgcttaaaatacctataaggagtcgattaatgacttcttataggtgtttttttgctttgaagaagaatttttgctgaaattggttggaaaactcctataaattagttgaaataaagtcaagtccaaatttgtgtgtaaattcatctttcagttatgtggttttatctaccaaaacagtatagggagtattatgctcattaaatgatgtataaaaatataaagtggtgtctactttttgttgactagtacacgaacagcaatgataacagtaaaattcaacggcaaacccacccaaatccctaaatcaaccccaatcaccaccttcctcaccacccataactacaacctaatccatgtagtagtcgaactcaacgaggtcataatcccgaaagactcccaccccacccaacaccccctactaataaatgaaagttaacagagacaaatatgctgatgcctctggatgattataagagttttatagcaattgatgacatgtcagagcttgcagacaatttgttgcagcttggaaggacacttggtgaagcagataacttcgcagagtattacagggcagcaaatgtaactgtatctgcgagattctgtctggatgatattcagctgggacattttcttcaggggttttataacgattccaaagaatttcggtttgataaagaagccagttcttctgaatgtgttgcaaagcttaaggagattggaatgaccgataaaggctggggggatgattttagcctacattatgaaatggagaaccgctcatttgaaaggggacagacatttcataattttaatgaccatgattatatagtgcttgaagcattctcaccaagaaatcttgtggtgatggatatgaagtcaggttctcttacaatcgcccttggtgcgacagagtataagcgttatccgaaggatgagaagcctacaaaggacaataccacaatcggggtaaccggaaaacgttacagcatggagatcagcctcgactatgacggtgagtttggcttcactgcggttctgtccattaacatggcagcaaagaacgtaggactctatgcaaacctgttctactacaatgaagcaacgggagagcttgagtttatctgtgcagatgagattgcagaggatggaactgctgacctgaccttcacacatacatccgattacaccatcgcgattgatgaaacatcgatggatggaagcgaggcagacgacagtacagaagctggcagcgaagatagcagtgctgacagcacggaagctggaagcggagatgtggtgacaaaagaagatgcttggaatcctctctggattattatcatcggaatcatcgtcatcgtggcaggacttggaatgttctttgtagttaagaaaaaagaagaagaataagataatctgtaacagctaaataagatgcagcatatgtgagagaaatttcatgtatgctgtatttttttgttataaaccattcgagaactcgattaagcatttgaaaagacgaatgtattatgatatgattatatgagagattttgtgtccatttttattcgtggtggagggatagaataatggaagataaacgcattcaggttaattataaaaaactgtggaagatgcttatagataaggatatgagcaaagcagagttgagagagaaaacgaaaatagctccaagcacatttcataagatgagcaataacgagtatgtttccttggatgtattagtaaggatatgttccgttatgaaatgtggactggatgatatagtagagatggaaagatagagctgtctatggattattagctatggaggtgttggtatggcgagaccagaagattccagagtaaagatacccgcacttgttcattttacaaggctgggatatcaatatatgtctattaaagatatggtgcgaggcgtggattatgatccggacaccaatattttctatggattatttttagatgcgataaacaagattaacaataccgatttgtcacttgaagaggcaaaaaagataattgaagagcttaaaatcaaattgtcaaatgatgatttgggtaaggcattttttgaaattctgcaaaaaggatacaatggaataaaactgattgattattcttcaacaactgacaataacagctatgtggttgttacagaattgccatatgaaaatggtgatgataattttcgaccggatattattgtactcataaatggtatgccattgtcttttgtagaggtaaagaggcaaaacaacagagagggtattctggcagaacgtgaaagaatgacaagaagattctctaatccaatctataaaaaatttgttaatctgacccagtacacggtgttttcaaataacaacgaatatgatgataccgatatagaaccgatacagggagccttttatgcttccagcaattatggtcgaatgttctttagtaaattcagagagcagcgtgcagaagaactggacaaagggataaaagaaattgatgaggatgtagagaggtttattctgaaagataacaatttgcttgcaataaaaggtacaccggaatatgcgtcatcaattcgtaaagactcgccaacaaatcgaattgtgacctctctttattctccggacagactgcgttttattttgcagtatggactatgctacaaggagacagtagataagaatggagttaagcatatagaaaagcatattatgcgttatccacagatttttgcgactttagcaatcagagacagattatctgaaggtgtgaagaagggggtaatctggcatacgcaggggagtggtaagactgcactggcattttcaaatgttcatttcctgcgtgattattatcagaatcagggggaaatagcaaagttttattttatcgtggaccggttagaccttgcaactcaggcaaaagcggaatttgaggctcgtggactgaaagttaatacgataagttccaaagaggattttaaaacaaacattgcggctgttggggaaacggacaataccggtaaaacatcaataaccgtagttaatatacagaaattctcagatgaatcagtcacaaagcagtctgattataatgtcagtgtgcagcgtgtctactttttggatgaagcacacagaagttataatccaaagggatcgtttcttgctaacttaatggcatcagacagagatgcggttatgattgctttgaccggtacacctcttataggagatggatataatacaaaggatgtgtttggtaattatattcacaagtattactataatcagtcgattgccgatggatacacattaaaactgataagagaggaaattgaaaccaaatacaaaacagaactggcatctacactggaaatgctggaagttcagcatggttccattgagaaaaaagaactttatgcacatccaaaatttgtatcggctatggttgaatatatcgtacatgattttgaaaaaggaagagcagctcttgatgattctattggagctatgattgtgtgtgattcagcaccacaggcaagagctgtatctgaacagttgagcagaacagcaaaatattcacatgccctggtacttcacgatgaaggaaccaagcaggacagaaaagatatacaggaagacttcaaaaaaggtaagattgatattctggttgtttacaatatgctgcttaccggatttgatgcaccaagactgaaaaaacagtaccttgcaagaatgattaaggctcataatctgttgcagacacttacccgtgttaatcgaccatataaggactaccattatggttatgttgtggattttgccaacatcaaggatgagtttgataaaaccaataaagcatattttgaagaattgcagtcagagcttggggatgaagtagctaactatagtgagatttttaagagtagggaagaaatcgaacaggacttgaatacaattaaaaatcagttgtttttgtatgatactgaaaatatggtggagtttatcaaccagattaatgatattgatgataagaaaacactgcttgatttaaagaatgcgttgacaaattataaagcacttcataatcttatcagactgttcggatatgatgatttgtatatccatttcgatgtggacaaggcaatacagatgctgaatgaggttaataacagaattagcattattaatcttaaagagagcatgggttctgctgatgatatgtccggaatattgagtatggcacttgaccagataagctttcagttcagaaagattaaggaagaagaactggttattgcagatgcgtttcgaacttcacttgagaaagcgagacgggaaatcgttgacagatgcttggacccgaaagacccggaatatgtagcgttgctggatgaactaaagagaatattcaagaaaaagaatattgaagagctgacatctgacgagatgaaggatttgatgggtgaattggatgacttgcgtaagaaggcagaaaagaagaatcacgaggatcagatgctggcgaaaaagtacaatggtgatgtgaaatatatgagaactcataagagaattatggagagtccgccaccgattgcggatgcggttacgatacataagattctgatggatgtaaaaaatcatgcggatgatacgattgctcataatgagagtatgcttgataacgaagcgtactttatcaaaacattgcagccttttattatcaatgcgtgcaaaacacaggagacgaaaataagtattgcacaggtaaaatttattgatatgtgcatttcacaggaatactttacagaaaggaattgggcatcataatgacatcagaagtgataatggcgaaaacaaaagccatgattgacgatttgaaaactgtttgtgccaattatggcttgggtaacgccagcagtgaatacaaaattattacagaggtatttttatacaagtttttaaatgataagtttcttcatgaaatcagaaaagtagatgataatttgaagaacgcagagaatattgaggaaactcttacaaatatggatgatgatgagtatgagtttcttctggcaagtctgcctccggcaacagcacagttgaaaaaggaacattttatttcattcttattcaataacaaaaacagagagaagtttaatgaactgtttgacgaaacacttgtggatatcgcaaatttcaatatagatgtttttgcggttaaaacaggaagcgaggacaagattcgtctgtttgatgcactgtccgtatttgtaactgagacaaataagagagcagatttttgtagagctattatagacaagcttgtggcttttagttttgaagaagcattttcacaaaaatatgatttctttgcagcagtgtttgaatacctgattaaagactacaataaggattttggtaaatatgcagaatattacacgcctcattccattgcaagcattattgccaaaattttagtgcctgaaggaatccagaatgtgaatatatatgatccggcagcaggttcaggaaccctcgtactggcactggcacatcagattggtgaagaaaactgtaccatctatacacaggacatttctcaaaaatcaaatgagtttttgagacttaacctgatactgaacaacttggtacattctttgggaaatgttgtgcatggagatacactgctggagccacaacatctaaacaagcaaaagaatggtttaatgaaatttgactatattgtatccaatccaccatttaatgtagattttagtgataaccgtgatacattagccggagaaaattataaggaacgtttttgggcaggtgttccaaaggttcccaataaagataaagacaaaatggcgatttatcagatgtttttacagcacattatctattcgttaaaggaagatggtaaggctgcagtagttgttcccacaggtttcctgactgccggaacaggtattccgaagagtattcgtgagtacatcatcaaagagaaaatgttacgaggagttatctctatgccgagcaatattttcgccactacaggaactaatgtatcgattctgtttttggacagggcaaataaagatggaaaagtgctgttaatggatgcttccaagcttggacataaggaaaaggtggatggaaagaatcaaaggacggttctggaacctgaagaaatacaggatattatcggtacattcattaatggtgaagaaaaagacgatttcagtgttcttgttgattatgaacagattgagcagaagaaactttctttttcagcagggcagtattttgaagtaaagatagagtatgttgagcttacgccggaagagtttgatgcaaaaatgaatgactatacggttgaattgcagaatctgttcgcagaaggaaacaagcttcaacaggagatattggaacagttaaagaaggtgcgatatgatttataatggtggaaaatataatcagcattggagtactaagaaactatctgaattaggtacattttccagaggagtatcaaagcatcgaccaagaaatgatacaaggttatttgaaaatggaaaatatcctttaatacaaactggagatattaaggaagcaaatttgtatgtgacaagccactctcaagaatatggagaatttggattaaaacaaagtaagttgtgggataaaggcactttatgtataacaatagctgctaatattgcagaaacggcaatattagcatatcctatgtgctttccagatagtgttgttggatttaatgcgaatagtaatgaatcatcagaattgtttatgtattatgtgtttgaatacataagaaattcaattcaaaattcagccagtgggagtattcaggataatataaatattgagtatttaacaggattgaattttaaggtgcctgacaaacaaaatcaggataaaattactaatttgcttggtgtaatagatggcaaaatattattaaatcgaaagataaacgataatttatcggctatggcttatgatacatatatgcacactttctatggcaaaaagcctaacggaaagttgtctgacatacttgttgaaaacgataaatcaaaggttcaggtaggcgaagctaaagaatctgatggtgaatatccatttttcacaagtggagaagcaattctacgctggaaagaacactttgttgatggtagaaactgctttctcaatactggtggcaatgccgatgttaaattttatgttggcaaagcagcctactcaaccgatacttggtgtatttcagcgaatcaaaacctaggtgattatttgtatctgcttttattgtcaattaaaccggaacttaacaaaaaattctttcaaggtactggattaaaacaccttcagaaacctttgcttaaagatagaccgatttacattccgacaacagatgaaataacgacctttaattcacaaattccacattggtttgatattatcgctgaaaatacaagggaaaatcagcacttaacagctttgcgtgactggttattgcctatgttaatgaatggtcaagccaccatttctgagtaaagtggtaaattatcgtttatactataaaaaacttctaccaacggcaggagttgaaacaacagaactgccgttgatgtcgttctcttgaatatcaaaaataaaggagaattgacatgaaacaggaactattaacagaagtattacttgaaatgagagagcatgtggacaatggacagctaaaacaacttgaaaaggtaatgaggcatatattatttcattatcacattacaaaagaaaatacgcatgatgagacttctaaaaaagactggatagagttgtttattgctgccaaaagaatagaaggctgttcagcaaagacgcttgtttattatagaaatacgattgatgctatggtggaatatgtcgaaaaagatatagtacaaattactacagatgatatacggaaatacctgatggattaccagaatgaaaaggggttaagcaaagtaaccgtagataatattagaagaatcatgtcgagtttttttgcatggcttgaggatgaggattatatactgaaaagcccggttaggcgtatacacaagataaagactactgctaatattaaagaaacatattctgatgaggcattggaaattatgagagataactgttcggaaataagagatttggcgatgatcgatttattatcatcaacgggtatgcgtgttggagaaatggtattactggatagacatgatataaattttgcagacagagaatgtgttgttcttggcaagggagataaagagagagttgtatattttgatgcaagaaccaaacttcatttgcaggaatacttagaaagccgcaaagacgataaccctgcgttgtttgtatcgctgaaagctccatacaatagattagaaattggaggagtcgaggtgaggttacgggatttgggtaagaaattgaatatttcaaaagtccacccacacaagtttagaagaacattagctacaaaggctattgataagggaatgcctatagaacaattacagcagttgcttgggcataagcgaatagatactacattgcagtatgcaatggtaaaacaaagtaatgtgaagattgctcatagaaaatacataggttaacacggaggtgtatgatgttaaagataaaaataggtgaagtgtgcgatgtttacgatggacctcatgcgacacctaagaaaatagacaagggcccggtatatttagggatagatgccattacagataatggtaaattaaacccttctgggtataattatttatcagaagaagactataaaatatggaccaaaagggttactccacagtatggtgatttagtgttttcgtatgaggctactttaggtaggtatgcacttattccgaaagatttttatggatgtttgggaagacgattggcggttgttcgcccaaaagacgaaagaatcaatataaaatggctttattattactttttatcgccagaatggagtgtttacattgctaacaataccgtgaagggaagcaccgtaaatagaatttccattgaagatttccccaatttttatattcctttattggagcgaactgaacaggataaaattgtcaaagtattgtctgctattgatgaaaagattgataataatgtaaatataaacgataatttaccgtatcagttatcaatggtagcttgaccattcatgagcattggtaacaaaaaatcccttaattgaattaatttgtcattttcaagtatattctgctcttgaaaatgtaataaattatttagtttttgtagcaaactgatatcatctggaatgaatagagggatattttcaacatcactcttagtaataaatttaacaatcgaacctgatgaatttgatttaaacaaattcacttgatacaaacacgctaaatataagatagcatagtattcagacgaagctgttaatacataggttctttggtaagcattaaacttgcccgaataatattttacattgaaatcaccgttacctgcaataagtatagaagatgattcaaaagcatattcatcgcattgtaatggcacattagaacaagtgaagaacttatacttcccattaactgtagaaaaattagcatcttccttgccagttgtgatatctgccatttcttttactgtgacaaaattacccttgatttgatttgaattagcttttgctatcatgttttcataaatcaaacgtaattgggattgtaaattatcgtttatcatcggaaataatataaataacagagaaagtgaggtcatttacatggaaaataatcagttagcagttaatgataaatctaatatggaatcagtagtgactgaaattaaagatttgatcgccgaatctcgtcggaaggtcgtaagacaggttaatgatgaacttttaatcacatattggaaaataggagaaatcattgtaaagtacgaacaaaatgaacagattagagctgcctatggagaaaagaccttactgcaactttcaaaatctctgacaagagaacttggaaaaggtttttcaaggtcgaacctacagaatatgaggtcattttatttgaaatatccaatttgccagtcagtgactggcaaattgacatggacacattattgtgaacttttatctatatccgatgatgataaaagaagtttttacgaaaaagaatgtatcaattcaggatggtcagtacgggaactaaagagacagattgcaagttctttgtatgaaagacttttactctcaagaggagatgctaataaggaaactgtacttgaattggcagcgaagggtatagaatatgctaaaccggaggatgcaataaaagatccatatgtatttgaatttttgggtatttctgaagataagccggtattagaaagtgatttggaagcggctttagtccgtcagatagagaattttctgcttgaacttggcaggggatttatgtttgtaggaacccagcagcgtgtgccagtgggaaataccaagagatatgtggatatggttttctataataagatatttcgtgcatatgtgttgattgaacttaagactgttcccttttcaccggaggcagcaggacagcttaatatgtatctgaattattatgcaactgaggttaatgatgtagatgataatccaccgattggtcttattctgtgtacggataagaataatattgatgtggaatatgcacttggtggcttatcaaatcagatatttgcttcaaaatatgtattatatttgccggataaagagcagcttatatcacaggtggaaaaggtattggaagcgtggcatagaaaagaagactaataaaaattgccagcctcattcggggctggcaaccagtgatgtattatttttcttcatccagaacaaatagctcttcaacagctacatcaagatatttggagaggcggagagccaactccagcgaagcactccgttcgcttcgttcgattcgaccgatggtgcgaccgcaggagccgatagcaatagctaaatcttcctgacagatgtttctttcggttctgacttgtctcagagtattagatacagccattattatcccctctttcctgtgaattcgcccagttctcaaatgagaaacctgccgatgataaaattctatactttatagtgtccaaaaaactggacttatcccacaaccttgccaaaaactttgaacgagttgttatctgtaaccggtataggattgtatttgctgttcagagactgtagtagcaatcgaatggtacagtttgccttcaagaatacaaaactccgtgaatggggatatcctacattcacagagttctatttgaaaatatgtgaaaactaaagaaccgccgtataccgaacggtacatacggtggtgtgggaggtcggtagataaaataattatctacctcctacccaattataacagttaaaacgtatatagagattatggattactgttgattaagatatgggaccggcacccgaactgccggagaagcactagacatatctaatggtggtgggcatgtaatattcgcacagtatactgaaccagagaaaatagaaatatttatggattctgttcataaagctgaggagcttattaaagataaaacaattggcacccttttagaaaatgtaaatgtatatgaccttttacgggctcacgaattttttcatgggattgaatataacaagagaagatatatttacacacagacagaaaaggtcgagctttggagacgtccattttctaacaaatcaaaaattattgcattaagtgaaattgccggaatggaatttgcaaggaatattattagtatttcatattcactatttttatttgatgtggtgttaatgtatctatacaataaagaagcggcatgtatgttatacgaagatattataattgaagtggaacgtttacatggtgtaaaatgaaagaaaacagataaaggagatttgaattatatgaattatattacattaaataatggagttaaaattccacagataggtcttggtgtttttagaacaccagacggagctgatacagctaatgcagtaaaatgggcgattgaggctggatacagacatattgatacagctaaggtttacggcaatgaaaaaagcgtaggcgaaggcatacgtatgagtggcattgacagaagggatatatttgttacaactaagctttggaatgaggatattagacagggaagaactaaagaagcatttttacagagcttggaagacatgggacttgattacatagacttgtatcttattcactggccagctaacggttatgagaaggcgtgggcagatatggaggacctgtacaaggctggcaaaatcaaggcaatcggtgtaagtaacttcaatgttcaccatcttgagactctcagtgaaaactggacagttgtaccagcggttaaccagattgagattcatccttattacgctaatattgaaaatgttgaatatgctaagaagaatggtattgcaatagaagcctacagcccacttggaggcaacggagcaggaacacttgaaaatgaggtgattattgcactggctgacaagtatggtaagacacctgcacagattgttttaagatgggagcttcagagaggaataattgtacttccaaagtcaacgcatcaggaaagaattatttctaattttgacgtgtttgattttgaattgcctgagggtgatatgaatgccataaatgagcttaacaagaacgaaaaacacggttctgacccagaaacatttaatttttaagaggaacttgacttttgaatcggtttaaaaatcgaaacacggcacaaagcaccgaatattctaatcaaccagtcccttgttcttccactttccgctcttccagcgcagcaccatgccgacagccctgatgcactcgtcacttgcgagtccgatgtaagcaccgactgcgagaagccccagatgcagtccgaagaagtatgttccgccgaccgccgcaaggtacatgaaaacggcaccaatgacaaccgggaaaacggcatcaccgcttgtcttcagtgcctgaccatagaccagattggtgactcttccaagctccagcacaacatcaatggcgagaagctttgtgactaggtttatcatctgtacatcattcgtgaagattcgcacaatgtagttacccaaaagcgcaaatgtgatagaaaggcaggatgccgtaatcacaccatagatagcggccttgcgagtgcccttatcgcattcgtcatactcctttgcaccgatatgccagccggtcagaatggcatttgcctgagctaaggcagcaccgatacagtacgaaaagttagcaatctgtgaggcataggaacgcgctgtgacgtttattccgtcagcatccatctggttcatgaaacgcactacaagagtcatggcgatattgtaaagtgcggtttcacaggcagacggaaagccaatctttataatctgtccgagaatttttccgggagctatgcgctcaggactgttctttgccttgatgagcacagcgcccattgtggcaacaataatcagattgacaatacgtgagataaccgttgcagtggcaacacccataacgccccagtgcattacaaagagaaaaacagcgttaagtataaagttaatgacatttccaataattgatgcccaaagtgactgctttgtgtagccgaaaactctcaggtagcttgaataaatcggtatgagagcatttaaaaagcaggcacctccaacaatgcgcagataagtatttgccgaatcaaaaagcgccggtgcaatgctgaccattttgagaatattttcggaaaaaacagccagaaaaacagccatgagcacacctattacagcgttaaatataagcccaagctgccttgcctgatatgctatacccggttttccggcaccgatattctgcgtcatgacagcaaccataccgcttgagatgacaccaaacatgatgatgaaaacggagatgtatgtatttgccgtgccgacagcaccaaccgcctggtcgctcacggatgacagcataagagtgtcaaccatgcctgccagcatgtaaaaaagtgtttcgaagcatattggaatggaaagctgtgtaagtgtttttctttgaacctgcatatagattttacctcatttataatgtatgtataccttgtgatattaacagaatgaaagcaaacttctcgttataagcttcatttgggagaggaagatataaagaagagaagcttgcatgtatcaatatattacattatcacaaataattcttgtattatttcaaggaaaaattgtactatttctactttatctattactaaatcctagagaacaaataaaaaaatgcacaccttatgcatgcaatatgttaaaatatagaacagttgatatgtaattattacagcaaacaaaccggatgggaattaaaagagactaaggaatatgtagaaaaatgtattttgaattaaaagaaaaccggccacacggcacaccggaaaatccgttcagtcaatatcatatcagtgatgtaaagcgtgcattccagattccggtacactggcatgatgagctggaaattatatatgtaaagcagggcaagctgcatgtgaccatatcaggtgaaaactatataggaagcccaaaggatacatttgtggtatctccgggcagtctgcatttcatgggctcgccgacaggagatgcagattattacacatttttgtttcctcttgaatatatatcatttcagacggatgatctcatggaaaaatcaatcctatcccctctcaaacgaggcagacttatgattagtcctcagataaatgatacagcagcagatatatgcgagcggctgatagagataaatgcacagatatcagggaaaaacgcagaaaacacagatgctgcaaatatagaggcgcaatttgaaaccaaaataactctcatcaaattcatccagaaaatgtggagcaataatctgatactggaaaatggcacaaatggcaccaacacaatagaaaaagaaatgataacgtatatccggcaaaactataaaagggaaatttcactgaaggaatttggtgcacagtttcatttgtcagaaaaatacatatcacgctactttaaagagcattttcatattactctgtcgcagtatatcaatcatctcaggctggagcatgccagacagctattggaggaatcagcaacttccgttacagaggttgcaatgtgcagtggatatcagaatgtgagctactttatacgcagcttcaagaaaatgtatggggtatcacctcttaaatacagaaaagcttcctgtataatttaaacataggtcaagagattaaagaaaaaatccgcaatttagcggatttttttaatacattcattaaataaaagcaatctgttatccttatcagcagatattttcaatgaagattgttcattaagcttcataaccaaagaaagaacatcactaaccgaatgctgcactggtcatatacgccggagcagaaggaagaggtgaaaaaagcacttgccgcaggagttccgaaagcaacgattcttacttacttttatccggaggtcactgtggagaagatgagttcatatcggaataagcattaaatgatatcgcataggcacaggaaatgtggtatactgcgcctatgtaaaaaagaatgtgttttgcaaatcggtatttatcatttgttaaggaggaatagtaaatggttggaagaatatatcatgtaggattgacggtttcagatttagataaatcaattgcattttatagagatatacttggacttaaatatcaaggagaaatcatgatggttggcgaagagacagataaaatgtttcaaaagaaaaattgtaaggcaagggttgcttatttgaatggttctgagaatattgaaacaccgcctgttgaattgattcaatttgtagacagcaaaatccacaaagaacaatcagacttgtttacgacatctatctcggaagtatgcttttatacggatgacattgattctgtctacaaagcccttatcgaaaatcatgtggagtgcttgtctgaaccgcagtatttcgatttcagggcagatggatttggggaaagcagagcgttttatttcagagacccggatggaatcattcttgagatgatgcaaccgttataaaaggacactaaatcggaagttggaggatacacgcatgaaaattgtaatcattaatggaagtgccagaaacaaaacagtatagggagtattatgctcattaaatgatgtataaaaatataaagtggtgtctactttttgttgactagtacagattggatgttgaagcggagttaaggtatgctgaagtccaaaggggatgagcaagcgtggcagattggacattgaagagaatgtaaggtacgataaagtccaaaacaccaggtacacttgccacacaatactcaatagcgtaaaataagtacaatcacataagtaaggaggagccagctatgaacagagctgttgtttattattcattatcaggaaatacaaaggaagctgcaaaggttattgcaagaaaattaggagcaaaaatctttgagatagatttagttaagccattacctaagaatacagtgagacggatgcttgttggaggaatgcagtcaacatttggaaggagacctaagataaaaggtgttcctgataacatagattattatgatgaaattatattaggtatgccagtatgggcaggaatgcctgcgtctccggtcaacacatttataaagaattacggcgtggcagataaaattgatgctgtgtttacattcagcggtggtggtgacaatgacagatgccttctgcagctgtcaaagagtcttaaaaatctaaaaaatcaggttgcgttagcagaccgcaatagtaatgctgcaaaggataatcaggagaagcttgaaaagtttgttatgagtatcaagtagaaattatacaataatatggcaggtttatgatattagtcaggggtagaatatgaggtttaaaaatgtgttttgtacacaattatataaagatacattttctaaagttttaaaagaagatgagtttacacacggagatgagattctggttgatatggaagaaccagatggagacaggatatcttatattataatgcaccatggacattcaatatctgattgcaaggcatttgtcacgacaactgatgaaaatgttctaattgctgtgtttgacttgtggggaaagttttataaatgttatatcataaagaatgatagtataagaaatgttgaagttgaaaatgttcttggcggtaaggagataaaatttgatggtgaatcacaatatggaaaaatatctgtaaaaatggcagcggtaaacagacagtttggcacagatttaaagtttcaacgggaacatcttcagttatttgcggcgaatctgcaaagaatttctgaaaatcctaagtgctttatacaagataaagatcgggtaaacagcaacaataatattgatagtgatgaaataagcatagatttaagtctggttgaattgacagatactcagagaagacaactgataggtaacagaaaatttgaggatttcaatcttgaaagccataatttaaatattgtttatggagtttatgaagctaacagagatattgtattaacgctaacaagatgtataactccaatattgaccagagatggcggtgacgatagttattgtattttgtacaaagaaaaaaagtatggcgttacatatggttataactggggtgataaaaaattaaatggtatacataacagaacaccattttgtcagaatgtagttgaaagcatggtcagatattatgaagattcatttcacgaaagatcggagctggaagaaaatgttagaaaaagatttgagaaagaatataatatggagatacatgatttccttaaattttatatagaaaatgttatggataattcataagaactacatttattttgttatgaagcataaaggaagtaaaagaatttgtgctataataagcatactaaatatttacatagactggaggatacaagcatggacgaaaatgtaaagaaaagaaacgaagtactggcacagactgtaattaatggcttacagtcacgaaatatgtcaggatattatgcagaggataaagaagcagctttaaagcaggccctggagttaattgatgaggaaagcacaattgctatgggcggctgtcacagtgcacaggagattggacttgtggaggctttgaaggagggcaattacaattatatagaccgttcaaagatgactccaagagagggacttctggcttcatatgacgctgatgtgttcttatcaagtgcaaatgcgatgacaagtgatggaatacttgtcaatattgatggcaattctaaccgtgtttcatgcatagcgcagggaccaaagaaggtaatcttcatagttggaatgaataaagtctgttcagacctcgattcggcaatgaagcgtgcaagaaatatagctgcaccaactaatgcacagaattttgatgtcaagacaccctgcaagacaaccggaaaatgctttgactgcaaatcaccagacacattatgctgccagttcctgattacaagatattcacgccatgtcggaagaatacatgtaatacttgtaaatgacacacttggctattaaaaggagacactatgattaacagacttcatatggcaatgattgaattatataaaggagacgctaagagaatacagcatttttgcaaggttcacagctacgccaggttgattgcacagatggaaaatgttgatgaccaaagtctttttataattgaaacagcggcgcttacacatgatatcgggattcatatatgtgaagaaaaatatggtgagtgtggtggtaagctgcaggaaaaagaaggtcctgctattgccgcaagacttcttgacaggcttggctttgacagtgaagtatcagaaagagtgcagtatctgataggacatcaccatacttacaataatattgacggcattgactaccagatacttgttgaggcagatttcttggttaacatatgcgatgataatcttgcaaaggatgcagcattgaaagcatataataacatttttaagacggaaagcggcaaaaagatatgccgggagatgtttggtttgtagataatgagaattaatgttacaattaacaaaaatgtgcgtgggaagtggagtttatgagcgataataaaaatgttaataataaggaaaaaggctttgttgtcggcggatatacttttaagacgaagcaggaagcgcaggaagcaaaagatgagatgaatgctattaagtatctgtctggaaagacggacagtaaagatccgaaacaggtatatgtgttgtataataagataattgacagacagttattttatacatccattggacttaattatctcaagaatttacagcaatttctgtataattcaccagatattccagatgataagattaagccgattccggtaaagagtgaaacacagattgcgattgacagaagacgtgaaagaaatgagcatagaagtgagctgcatactctctcaattcaggtggcaaagtacaagaacaattatatgagaattatgattgtaaatgtgtttcttgttattgcgctaattgcaatgttttttatccttaagacaggttctaattctaatgtcattaattatgaagtgaatgtacagaataagtattcttcatggcagacagagcttgaatctaaggaagccaagttaaaagaaaaagagaaagagcttaattcaagggaagcggagcttgaatcaaagcagtctttaaaatcatcatcacagcagtcaacaaagtagtcataatataaatatatgaacagagtacacattttaaacatatttatcagatagtatatagataattaattcaccgtgaaagtgaggactacatatggataagatgaagattttagtagtagatgatgaaagcagaatgagaaagcttgtaagtgattttctgacaagaaaaggctatgctgttatagaggcggctgatggtgtagaagctgtagatacatttatggagaataaagatattgcacttataattcttgatgttatgatgccaagaatggatggctgggaagtgtgcaggcagataagaaaggattctaaagttcctattataatgcttacagcaaagggtgaggagatggatgaactacaaggttttgaatgtggagctgacgaatatatagccaagccattttcacctaagatacttacagccagagttgatgcaattataagacgagcatatggtgttgacagcaacgagataattgagattggcggaattactatagataaagcggcacatatcgttaagattgatggtgaagagatagagttaagctataaggagtttgaactgcttacttattttgttgagaataaagggcttgcgttgtcaagagagaagattcttaacaatgtatggaattatgattactatggtgatgcaagaactatagatacccatgttaaaaaattaagaaagaagatgggggataagggcgattacatcaagacaatctggggtatgggctacaagttcattgttgactgattctgcgtataaggaaggcaattaaagatgaagatacattcaattaagtttaagattacacttcttctggtagttactgttacatgtcttgtggcaatgcttattgggtttaacagcattttttcagagaaagtgtatatgaaccgtaagcagaagagcatgattaattcttatgagaatgttaatgaaatcatgcagaaatatactgatttacagatagataaagatactatgtgtgctgatatggagaatatatctacagcaaagggaatatctgtgcttgtagttgacagcagctggtgtaccatatatgtaagtactcagggagatgattcaatgatggaacgtcttcgtatgagtatatttaatggagatatttttaagaataatggctcacaggataaagcaccggaacctaaagatcaggaagatgattcagataacccggcagacaaggatgataagaaggagcatagaaagcgtctggaagatattattgatatgtcaggtacatcacttgttgagaacaggacaatcataagttccaatgataattatacgttacagaaggtgtatgatgaaaggcttggagattactatcttgagatatggggtacacttgacaatggatattcaattatattaagaactcctatccagggaataaaagataatgtaaatatatcgacaactcttattaagtatgttggaggagcaattcttgctgttggtataattgcagcatttgtagtatcaacatatattaccagaccgattaagcagctttctaatattgctgagaagatgtcagagatggatttcaatgcaagatatgagggaagtgataagggagagattggtctgcttggaaagagcatgaacaatatgtctgagaagcttgaacaaaatattgcagagcttaagaaggctaaccttgaacttaagaaagatattgataaaaaagaaaagctcgagataatgagaacagattttctttcaaatgtatctcatgagttaaagactcctattgcacttatacaaggatatgcagagggtcttaaggaaggcataacagatgatcctgaaagcatggaattttactgtgatgttattatggacgaggcaaacaagatgaatacaatggttaagagacttcttacacttaatcagattgaattcggaaatgatgagcctgagatggagagatttgatattaatgagcttattgcttctgtagcagatgccaatgcaataagagcgggacaaaagaatatgagtatagtatttgataaccgtaatgagcataattttgtgtgggctgatgaatacaagacagaggaagtgcttactaattatatatctaatgcacttaatcactgtgatggaaagcgtgcaattgaggtgagaactgaaaaatcagagaatggaggaactattaccgttactgtatataatagtggaaagaatattgctgatgaagatcttgaaagaatatgggagaagttctacaagactgataaagcgagaacaagagaatatggaggtaatggaataggactgtctattgtaaaggctattatggattcaatggggcaggaatatggtgtcagaaatgtatctgatggtgtagaattctggtttaatcttgattgtaaatcataatatgatataattgttatcagtgtatgagaataatttgtatattcatcatgaacggtgataataattataaagggaaattgaggaaatatatatgaaaaaagttataacaggtctgcttgtgcttttgtgtatatctgcactcacaggttgtggcaaagatgatgtaacattaaccaatgaagataatgatctggttgctgagtatatagcaggaacgcttcttaagtattcatatgataatgaatggaaatatcagaagcttaattcagcacagaatggtggaggtacaataagttcgtctggtaaacagaaaccgtcacagacacagtctgcaattacaggacataataatacaatacagactactaaggcgtcaggtaattcagcgaacgcatcagcagatttattaacagggctgccaactgcacttggatttaatggtgtgacacttacatataaggattatactgtgggaaatcagtatccggcagagaattatgtggtttcagtgccgtcacagacaggctgtaaggttgttgctgttgagatgacacttactaatacaagtggttcaacagttaatcttacatcatcaggtggtgttgtattaaagctcacagccggctcaacagctgtaagcaattatgcttcaatgcttaagaatgatattacaacacttaagaatgtttcacttgcggcaggagagagtaaagaagtagttgtattatttcaggtaaaagaaagcgatgccaattcattagccggtttggttatgtcggcaacatcatcaggaacatcgcttggttcattaacaatcaattaagaatgcataacattttcaatgttgtaaaaggcagcttgtgcttcatctaactgatgaacataggctgctcttttttcaggcttatatccatcgccatgtccattatattcagcataatatacagtttcatgtgattcaggcttattccagtcagtgaagccctcatcaataatctggtcggaatattcacagttaagaagaacaaccttagcatggattctccaaggtctgcttaaagcaacgcttttaggcggacagtttcctgtaaatgtgcaattatcaaatacataaccgaaagcctgaccttcatatgttgaaggtgcagtataataagagttgatgggttcattccggtttaatgcaaaaagtgtgcagtttttaaaataagctgtggcacttccgaaaataaaatcaatttcaccacatataaagcagtcttcatataactggtgaacgagctttctttcaccgtctattgttggacctgtaaaaccacctggttgtttttctttaagaggcagcggaccggtaaataaagtgtcctgatgaccaagaattttacagtgcttaaatgtgatgttgtcaccttcagcgtatacagctattgcctgaccgacattatcaccaaatccggcactgttttcgaatgttatattgcttgcagagaaattatcggcatatacaagaaatgtataggaacggaaagttccacgcttagagccgtcaggcataatcattcttgcatagaagccctcagtaataatagtttcatctgtatcttcaccaattaaggtaatgttatttttacggatttcaatgcgttctttatatattccctttttgataaatatggtttctctgttattatcagaaacagaatcaactgctttctgtatggaatcaaaatcaccagaattgtctttagctaccgtaatcataaaaatgcatacctcctatttttttgctattatagcacactggacattaataaataaagcgagtataattccattcgttaaaaaaattgtaggaaatagagattatgataagaatagtagaagatatgagagatgttaatatatatctttcattaagaaaacaagtcggctggattaagttagatgaaaatcaggctcagagagcattgaataacagcgtgaaagtatttacagtatatgatgatgacaagcctataggaatgggcagagtggttggagatatggctgtaataagctatatacaggatttaataataataccggaatatcagagtaagcacataggaagcatgcttatagaacatataatagcttatgtcaaaggaattactcaggaaggcacaagaatgatgctttgtctgatgtgtgccaagggcagagagatattctatgaaaagcatggatttatcgcaagaccgacaccagaactgggaccgggaatgatacagtatatattacaatagcattgtaaaatgtaatgttaacctaatgtcaacctgaattaataacaggttgacaatgacttcttaagtgtgtacaataacaaatgttgtattactacatttgaaaagaggactttaattatgaaaagcaaaaaggttactatttatcagctgacatttatggctatgatggcagcagttacatgtattcttggaccactttcagttccaattggtcagattccaatatctcttactaatcttgtgatttatttcacagtatttgtactgggcatatgggcaggaacaggaagctatggaatatatctgctgcttggtgctgtaggacttcctgtattttcaggatttgctggtggattaggaaagcttcttggaccaacaggaggatatcttataggtttcatattcatggcacttattggaggagctgtgattgagctttcacacagaaatatttttcttacaatgttaggctgggtagttggaactgctgttgcatatgcatttggtacggtatggtttgtataccttatgaaatgttcagtcacatatgcacttacagtatgtgtatatccatttatcggatttgatattgtcaagatagttattgcaacacttcttggaaagacagtaagatatgcaataaccaaagctggtcttatacagaaagcagcataataagtaaaagaaaaggggctgtcgctttaacgattgaaaatcgttaaggtaccagcctctttttcctataaaaatacgatttttaagttactatttattaaaataaatgggatgtcccaaaaattggcgtactttaataaacctatataagtttttaaaatttttattttgatatttctaaattcaggcactttttaaaggaaataaatgtgttcctgtcttcccgttctgaatcttattatgaagtatatttatgtttcttgcaattgctaaaagagtactttcagcgagtacattcgcagtacctttgcttaggtatcttctgaactgcatgtcctgttttctgtctccaaatgagccttcagcctgaatgctccggttcatccgatacaatacccacttcatcagatatgattcgttccaaatcctcttttctgtgttttataaatgtttttgcaacttgtaatagcttggttctttctcctaatggcgttttgtagttgtaataataacatttgtaagtcggcaaacgggatgattttgacttgtccgtgtttttattttgtctgtaattcaaccccgacaaataaggtattcacaaggaatcccttatttcccttccctaatcttgtgggtaatggactaccgaaggtaacaagtcaaggagtggtattgccttgcggtatggacatgaaaaaatttcttgccccttgcttgctttaaaaattatattacttatatagaaagacgaaaggggatgattctatagcataaatagacaatgtaaaagctatacctgaaaaattagttcctgataatggtgatatgaataaaaattatatgatgcagatggtgcgtgaagttaattcaacagaagtcagaccagatgaaagcatacttaaccatccagaatatcttccagatgataatgctatatctgacaatgataaatcagaaaataaagagcatgaagctgacaatgaaaataaggttagaaatgaatatttgacagacaagctatccggtgtaaaagcaatcggacgctgtcctaagtgtttaggtgcagttgcatatttgacaaatcctatatgttgtgggaaatgtggatataagcttgactggacttttgaaaaatagattttccgggggcttccccggaaacataattattaatctataagaacgaggagatattaatatgagctggattattactttaattattgttggaattattatatttttattacttattatggcattaatgcgtgcagcatcagcatctgatgaagcgagcagacacaccatagaaaatctgacacgaaaggaagatgataatggtgtcatataaaaagaagatagaagagtgctacacaaaatgcagcacgtgtggacggatttttaataatgaaaaatatgatatggcttcttatggatactgcgataaaaaagaggggaaaaagatatatttctgcagttattcatgctttatgaagcataagaggtctaaaggcagatatgctgaatcagaggaacaaagtgtaaacagtattgatactgaatcagataagaaaaaatctgcaataagggtgtattcaccctgtgggttgcagtttaaataatcattttgtgacggaatccgtcacagccataaggcagaaaggagttcattatggagaacattaatgaaaacagaattgaaaatgaagttgaggtgcaggtaagaacggaaaataatgctgtaacggagtatgcagcaagagttgcagagcttgttaagaagaaaggtggtaagacagatgagaagtagggaaatagcatcatttacaattgaaaatgcacaaggaagagtatcggtagctgtcggagatacagtaacgattcatacattaaatggtggaggcatgggtggctgcactatcgtaaagcttaccaacagaagcgttcattatacccaggatgaaggaaagcatgttaagacgattgcatacgacaatatattcagcatagattagaggtggcttatgaagaaacttatagaaggtgacaaaagggtaagcaaagcgacaatcagaaaggcagtagctgcagttattcttatcattctcttttttatatcatttaaggttagtctgccatttccagataatgtaaatacatttatcaaggttggaacggttgcaggactaatatatatacttgccacattcaggggtgatgaataaaaatgtgacggattccgtcacagatacagagaggtgagaagaaaaatgaaatttgatttctattacagtgaagaatcggagcagtacagcttttatagtgttcctaagatgttctttacacttgagagatttaccggattatcggcaatgtcaaagctgctgtacggattcctgcttgacagaatgagcttatcaaggaagcgtaactggatagatgataaaaacagggcatacataaagtacagcctgaacgcaataactaaggatatgggtgtcagtaaaaattctgttattaaatacatgcgtgagcttcaggaatttggtctgataatgaaatttcaaatcgaaggaatggaagacataatttatgtgatggatttttcaagagttaagcaggcggataattcatatagtaataacaaaagcagcaataatggggatgtgttatatctggataaccagacagccgaggatgaatataaaacagatacaggacaggcatgtaatgccccgccagactttaatgcaacaattgccttaagcaatataaatgacactaaaaaaatacaagatacagaatgcaagggggagtgtacccttggaggtggttcaaaatctgaaccagttcaaaacttgaaccggttcaaaacttgcactggttcaaaatctgaaccggttcaaaatttgcaccaccctcataaagagaataataataatatatataataatattaataatatctctgacaagacagatagatatttatataataatcaatctatccatcaatctaatccatctatcaatccacatgagaggatggataagacagataagatatatacagacaaaaatgcagctaaacagccgagtgcagataagctctatgaacacatgagtgcgcttgtcaggaaaaacattgattatgatatcatgactgaaagacctgaatgtgcaggctggtacgaagaatattacaacctgattgtagaggtgcttgtaagaaaaacagaccattttaggatttcaggtgaggagtattcagccaagctggtccagaacaggtttattaatcttcatgcgtcagatttgctgtatgtacatacccagatgagcaggacgacatctgatatcaagaacataaaagcatatctgataaaggctctgtttaatgctccgacaacaaaggattcatactggcagaacagagtgaatcaggatgcggctaaagcataaataaaatgtgacggaatccgtcacggaaaggataacatgaaatacagaggcattgagttaaaagaaaacacagaggcagagatattgattgccctggaagtaacaggaataacagatgatgaagaacttgaaaactatattgatgagatttcagaaagactagaaatggaagtattgcctaaaataaaggcagatgtatacatagatgtagtctatgataatcttatcaatgtaaggattaacgaccagacctttgatgagaaaggtgtgtacatagtcacaagcctttacaatgaaatcagaagtaaagcatatgataatgtcaattgttccataggagtaaatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaatataatagtctgaaaatgattcttcacaagcgtaaatatcagaagctgctaagaaatattcatgatatgaaagaactccgggagaagatagaagaaaataagcagattgacctcatgtattttacaggaacatacagaggggcgatgagtggaatagcagatgatgtattatcaagcatgaaagcggtatggattccgatcatgatacttgttgttatctatttggttgtagtaggtattttttacataatgtagtactaatgtgacattggaaaggaaggtgctttatgacaggtatgtcattctttggtctttttgtaattattttgatattaatatcattttcaatcattatagctgaagaattgaggcgtaaagaagaaaagcgagagcatactaaaatggaaaatataacaataatggttgtggggtggggattaatgatactcgcaattccattaacaatatatctttttataagtacatcagatgattggaaacaactttttattactatactaggtgctttaaagatttatagataatttagttcggaaaggagaaaggcaatgtatgaaaatcttaataaaaattcaataatagatgttgcaagtacactaataaatgaaatgaactcatatacgccagagcagcagaatcaattgcttgtagagtatattattatcccattttttttctatattgtaatttggttagatatttcaattatttttggaaaaagaataaattttagggaaattataaaagtagtaataatatcgttatggtttacaccgacaattttgtggacgcttataacaagccttatagatgcatcatttatagttattttcgcaccaacaatccctataattattatttggagtattaagaaattgataatgctgtgtagaagaataaaacatcagccggatgggataaaagcataattaaagatataaatattatgtcacagttattttgaataaatttaaataagtcttttttataacattaaaatatggtacaatataactagaaatataaatatatttaaatatgatattgtacctgatatgtgacggaatccgtcacacggaaaggagcagatatgagacagtcatggactaaatttaagaactgggtaatgtcttttacatatcaggaaagaagaaataagcagttagaaatattcagaactaaaatagaacattattcatcaatggataaggatgaattaaactttgaatattttaattgcaaggcagaatatgaacataaaaagaatattcttactttagttataataacaattgctgtttcgttgattatgaatatatgggaaaaactattttcatttttgaacatggcaataaaatatgataattacatgaatgattctcaagacacttttgttgtttgtttaatgattgcattagtaattggattgacattagtggtggttattgtaattatattatccgccatttttaatgacataaaacaactaaaaaaagagattgaattaatagaatatgtaaaagcagaggaagaaaatgaaaattaaaagcttgattttaaggaactggtacaaattaatatatatactgattactataatatatattattttcttaaaaaggcttgataaaaaattactggctaagaattttgcaaattcaatacaattacttaaatatgatgattatatagcagtaaagttttttatattggcacttatcatagctatatgtggttgttggttgataataaaaacgattctcaattttaaagataaacatagtagctttgatgacataataatgggatttgttttaatagtgattatcattatattgttgatattgttattaaattatataacagtgcctatattgagagcaatattaacagttatggctgttgttataagtggagcgtattttatatgtcattattagatatgtgacggaatccgtcacccggaaaggagcagatatgatatatacgatagaacagattaaggataaatgccggaaagtatttgacaaacagaattttatcaaagaagcatatctgtttggttcttatgccagaggcgaggcaactgaaaaaagtgatatagatttcatgatagtactgaaccgtactgttggattggagttttttggattataccattttcttcaggaggaatttggaaaaaatgttgatgttataagtgaaaaggaagcgtatgaaataatgccaaaaagcatagaaaaagataaggtgaaagtgtattaaataccggatacaaatgtgacggattccgtcacaaaaaatagtatatcgttcaaccagtcaggaaaggagaaccgtatgattaagatagataagattagaaaatgtatgataacagcacttatggcaatgtcacttcttacagtaacagcctgtggtgcaaagaaagatatggcaagtaataaagcagctgcgaatattgagcagtcaacagagactgcaactgtggcaaaggctaaagatatgcagatgcaggtaaaggatgcagatggcaataccgtaacacttaccggagacgcaacaatcaatgaagccggggaaatggtattcgagggaaaggattcagctggtaatgtcgtaaaagtaacaggaacggcagaaaagaccggggacggaagctttaaggttaaggaggctgcggttgccggaacagcaaaggttgtagcagataacggacaggagacagaggtaagcaatgagaacaaggaaactgtcacagttgacgagataaaggatacaaccacagaggtagttaaaaatgatacttctgacaataagcaggaatcaggtggtactgataccggaaagaacgataatacaacagatgtcacaaagccagcagaagattcttaagagtaatcggatgaaagaattttaatgtgcagttttgaaagagcaatctttcaattttataatcctcgatagctcaatggtagagcactcggctgttaaccgagttgttgtaggttcgagccctactcggggagttataagaatggatataggacaataggataattgttccaattcattcttatatttttttatacggctccatggtcaagcggttaagacaccaccctttcacggtggtatcaggggttcaaatccccttggagtcatagagtagaacataaaaggaaattcaaattgccgacttggctcaatggcagagcagctgatttgtaatcagcaggttgttggttcgactccgacagtcggctttttggacctttagctcagttggttagagcaaccggctcataaccggtcggtcctgggttcgagtccccgaaggtccacttgttctactcgttatggcctggtggctcagctggttagagcgccgccctgtcacggcggaggtcgtgggttcgaaccccatccgggtcgctgctatcattatgatggcaataattaataatacaccaagccggtgtggcggaactggcagacgcacaggacttaaaatcctgcgggacttatactcccatacgggttcgattcccgttgccggcactaaacacgaaagtgtttaggaagtacgtgtagctcagctggatagagcgtctggctacggaccagaaggtcgcgagttcgaatcttgtcacgtacatttattaaccttgcatagttgcaaggtttttttagtttcacgaaacaataattgaaagcattttcatgtatgaataaaataagacaaaatagcaatactacattaatgtaaaaatatttatggaggttgatattatgtcaaagaacacatctaaaaattcaacaaattcaaagaattctactaattccagcaattcaacaaactcaagaaattcttataatgaaactaattcaacaaacagcaagaatcagtcatctaagaattccaagaataagacatcaggttctgatgagtccgactgctattagtcagaatataggtcgcatatgcggccttacataacaaaatggtaataaaaaatactaattaaagtataatatattaaattctatattgtgtgggtaaactatgtcatgtgaaatgataagttcaagaaaaatagattattatgtaaatgatccatatgtaacaataattgatataagattgaaggaaaaatatgtatattcgaggataaaaggagcaatacattatgaatataacaagctggttgatgatataaataatatatataaatgcggaaagatttcttatgaatttagaaaaatatttggtaataaggaaaaaatatacatattttattgcgataaaggtgctatgagtcttgttatatgcgaaaagatgtctgggcttggatatatatgcaagacagttgtaggaggatttgaggcatataaaggaatgtgtgtaatcaattaacggattgacactcatttgcgtaggcattaatatatatataaatgtacatttggaggatatatgaatacatatgaattaattgccccctgccattttggtctggaatcagtattaaaaagggaaatatatgatcttggatatgatatatcatcggtagaggatggaaaggtcacttttgtaggtgattctgaagccatatgccgtgctaatataaatttaaggactacagagcgtattttgattaaagtgggtcaatttaaggctgagacatttacagagctgtttgacaatactaaagctcttgagtgggagaattatatacctaagaatggaaagttctgggtaacaaaagctaattctgttaacagtaaattgttcagcagttctgatatccagtcaattgttaagaaagcaattgtagagagacttaaagaacattatagaattggatggtttgaggaagatggtgattcttatcctataagagtaactattatgaaggatattgtgactattgcacttgacacatcaggtgattcgcttcataagagaggatacagaccggcagctggaaaagctcctatatctgagacacttgcagcggcgcttattatgcttacgccgtggagaggcgacagaattcttgttgatccattctgcggaagtggcacatttccaattgaagcagctatgatagcagctaatattgcaccaggaatgaaccgtaagtttactgcacagaagtggactaacataattgacaagcaattgtggtatgatgctgttgatgaagccgaggatatgattaatcttgatgttgaaacagatattcagggttttgatattgacgcagatgttataaggaaggcaagaagcaatgcggagaatgccggagtagagaagttaatacattttcaggaaagaagcgtggcagatctaagccatcataagaaatacggttttattataactaatccgccttatggtgaaagacttgaggataaggagacacttccaggaatatattctgcatttggacgacagtttgcaaaattagattcatggtcagcctatatgattacttcatatgaggatgctgtcaaatattttggcaggaagccggataagaatagaaagatatataatggaatgttaaagacctatttttattcattccagggaccaaagccgcctaagaaggagaagggacaggaaagataattatgactactattattttagcgtctaataataaggacaaggttaaggaagttaaagagattcttaaagggtataatgttatctctcttaaggatgctggaattgaccttgatgtggaggaaaatggtactacatttgaagaaaatgcgttgattaaggcaagagctgtatgcaaacttacaggacagcttacaatggcagatgattcaggacttgagattgattatcttaataaagagcctggtgtgtattctgccagatatatgggacatgatacatcatatgatattaaaaatgcttctcttattaaacggcttgagggtgttgaagggcaggacagaagcggcaggtttgtatgtgctatagcagtgtgttttcctgatggaagggaaattgttaaaagaggcacaatggaggggcttataagcaaggaaatcgttggagacaatggttttggctatgaccctatagtctatctgcctgaatatggtaaaacatcagcacagcttgatcctgaagagaagaataagataagccacagaggtaaggcacttgaacttataaagaaagaactggatgagtgcctctaattggctcgttctggaggttttatgcagaggataatgattgttagcgattcacatagaagacacggtaatctggcagaggcaatatataatgagcagccattcgatttacttattcatcttggtgatatcgaaggggaagaagatataatacaggagcttgccgggggtgaaacaataatggtaccgggtaataatgatttcttttcacctcttccaagagagcgtgagatagaacttgcagggaaaaaagtacttttgacacacggccattattattatgtttctcttgatttgcagactctcagggaagagtgtatagcaagaggaattgatatagttatgtttggacatactcacagaccattgatacagatagaagatgaacttacattcattaatcctggaagcatatcatatcctcgtcaggcagataaaagatgtacatatattatgcttgaaattgacgataatggagaaatgacttttaatttaaagtatgtataaatccagtaaatatgcgggtttacagacttgtagaaagaattttgaaaaaaattgaaaaaaattcaaaaaaagtgttgacagatagtacaccttataatataatcattcttgcgttgcggaacagagcaaacgcaagaaacaaaaacggggtgtggctcagcttggctagagcgcttgatttgggatcaagaggtcgcaggttcgaatcctgtcaccccgactttacaacttaataattatgcgggtgtagttcaatggtagaacactagccttccaagctagatacgtgggttcgattcccatcacccgctttgtgtgttcgtagctcagctggatagagcaacggccttctaagccgtgggtcgagggttcgaatccccccgggcacacttttttttatgagtcatggccagtagcttatgacttttgcattatggtgggtatagcacagctggtcagcgcgtcagattgtggctctgaaggtccagggttcgaatccctgtacccaccctttttttatttcttgggctatcgccaagcggtaaggcacagggttttgatccctgcattacgctggttcgaatccagctagcccagctcggtagttataatccgaggctggatgtttgatatagattgttactcataattgtatacattgagggctcatagctcagttggtagagcactagacttttaatctaggtgtcccgggttcgaaccccggtgggctcattaagatgggaatggttgaaaaaccattcccttttttcttttcgtgcctagtgactaggaggggaacgggcgacttgtgaagaaattcattctttattatttccatgtattaattattgtgattttgaaaacccgcataaacactgggaatgtttgtaggcatgttgggcacttttgtggcacttggtgtcagggggagtggaatgattgagaattgtagttttaacttaggtgagttttatgttaaaatgggtaaaacaaatcgaaatttacagaactacaaagaaaggatacatattatggaaggaagattaatagcatttgttatttgggtaataatcggcgtattatttattgtaatgggcatttatgattttaattccaagaaagcaaaacctttcggtttttgggcaaatgctgaggtagcgcccatagaagatgtgaaaggctataatcgtgctttgggcatattgtggtgcgtgtatggtgttttgtttacgttaattggattgcctttattagatgggcagaattcgggtttgattattatacctatattgggtgcaatgcttattagtattgcggctatggtagcgtatgtagtaggtattgaaccccaataccgcaaaaagaaataaatggaaacttcaagtttgtagattacatcttacagaatatctgtaaatcaccaacctacaactatatataataactttgatacaaagaaacagagcaagtacttgagtaacaaaacttaagtgcttgctcttattttatttataggaggttgttatggacgacagaatgaatgatgtggttgatgaagtgcagaaaagacttggagaagaatatgaggtgaaaagtgttgaagttatgaaaaacaatgacacaaaactgaaaggaattcaggtcaggagaaaagacatgaatgttgcaaagatatgttactggactagtgaatcagttgacgagattgtagctgtgattaatagaagcctgtttcctaagtttgattgtgaaatcaatctggagaagctaaaggacaggattgtctatactttggtaaatgcagattctaataagagcagactaaagactataccttacaggatgttggaaggtacggatttagccattacatataagctaatcattgatattgatttcaatgctacggcttcatcagatgttacaaatgcattgatggagcatttgaaagttacggaaaatgatttgtatacatttgcaactaagaatactcagaaactctatgctccgagtattatgtcacttacagatattgtatcaaaaacagataatcagtctcaggaagatgtcagcaacactcctgagactatttttgtactgactaatttcaaaaagtttcatccgattactcttaagaataactctctttgttctatccaaaccgtcttaaccttttctcttggttaagccctcgacctattagtacagatcagctccatatgtcaccacacttccaccttctgcctatctacctcgtcgtcttcaaggggtcttactaacttacgttatgggatatctcatcttgaggggggcttcacgcttagatgccttcagcgtttatcccgtcccgacttggctacccggctatgcatttggcaatgcaaccggtgcaccagaggtcagtccatcccggtcctctcgtactaaggacagctcctctcagatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcaatcccactttcataccaccggatcactaagtcctactttcgtacctgctccacccgtcggtgtcgcagtcaagctcccttctgcctttgcgctcttcgaatggtttccaaccattctgagggaacctttgagcgcctccgatactctttcggaggcgaccgccccagtcaaactccccaccagacattgtcccccagccgggtcacggctgcaggttagaagcccagtactgcaggggtggtatcccaacatcgactctgatgcatctggcgacacatcttctcagtctcccacctatcctgtacatgcaataccgaaccccagtatcaagctagagtaaagctccatggggtctttccgtcctggcgcaggtaaccagcatcttcactggtatttcaatttcaccgggtgcattgtcgagacagtgcccaaatcattacgcctttcgtgcgggtcggaacttacccgacaaggaatttcgctaccttaggaccgttatagttacggccgccgtttactggggcttaaattcaatgcttcaccttgcggctaacatctcctcttaaccttccagcaccgggcaggcgtcagcccatatacctcacctttcggttttgcatagacctgtgtttttgctaaacagttgcttgggccagttctctgcggctccatctctggagcaccccttctcccgaagttacggggtcattttgccgagttccttaacaatgcttctcccgccggccttaggattctctcctcatccacctgtgtcggtttacggtacgggtacatcaaacactatagcggcttttctcgacacaagctccacatgcttcgctactttggttcgctccacatcgcgccctcgagttgacagacggatttgcctatctgtcctctgctgcgcttgtaccggactttccttttccggctcatgcttccctcatgtgtccccacatttctgatttgatgcagtacaggaatttcaacctgttatccatcgactacgtctttcgaccttgccttaggccccgacttacccagggcagatcagctttaccctggaaaccttagatattcggccttgaagattctcacttcaatctcgctactcattccggcattctctcttcaagacagtccaccattcctttcggtatggcttcgttccgtcttcaatgctcctctaccaattcattagaattcctaagcttcggtgttgtgttttagccccggacattttcggcgcaggacctctcgactagtgagctattacgcactcttttaatgtgtggctgcttctgagccaacatcctagttgtcttcgaaatcccacatccttttccacttaacacacactttgggaccttagctgtaggtctgggctctttcccttttgaccacccaacttatctcgtgcagtctgactccctggcatcatctgtccgccattcgcagtttgatattcttcggtaggctttgacgccccctaggaaattcagtgctctacctgcggcagactaaccagaggctagccctaaagctatttcgaggagaaccagctatctccgggttcgattggaatttctcccctatccacacctcatcaccacccttttcaacggatgtgtgttcggtcctccactacctcttacggcagcttcaacctggacatggatagatcacccggtttcgggtctatgataagcgattcaaccgtgcttttaacactcgctttcgcttcggctccggaccttaagtccttaaccttaccactcatcataactcgccggaccgttctacaaaaagtacgccgtcgcacttgcgtgcttcgacagcttgtaaacacagggtttcaggttctctttcactcccctcccggggtccttttcacctttccttcacagtactatgcgctatcggtcactgagtagtatttagccttacggagtggtctccgctcattcccacaaggtttctcgtgtctcgtggtactctggatcctgccttgctgctttcgatttcggatacgcggctttcacgctttctcgccggacttcccagaccgttctcctatcaattgcagatcaattatgcagtcctaaccccaaaggataaatcctctggtttgggctctttccctttcgctcgccgctactcaggaaatcgatgtttctttctcttcctccgggtatttagatgtttcagttccccgggttccctctcatacactatgtattcatgtatgagtacgcaaggtcttcttgcgtaggtttccccattcagaaatctgcgggtcaatggatatttgctccttaccgcagcttatcgcagcttatcacgtctttcgtcggctctcagtgcctaggcatccaccctatgctctttatagcttaacctttaaatgatgtatagcgttacaccattcggttttggttgatttctcaaccttggtttgtttcttggtttgacattcactttaagtttatgtcgcacctcggatgtctaaacattatttaaaacaatgttttataagatattttaatatgcagttttcaaagaacaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagtcatccttgatgactcaatagaaagacaacctttactttttcttccttagaaaggaggtgatccagccgcaccttccgatacggctaccttgttacgacttcaccccagttatcaaacctgccttcggcggctccttctttcgttaggtcaccgacttcgggcattttcgacttccatggtgtgacgggcggtgtgtacaagacccgggaacgtattcaccgcagcattctgatctgcgattactagcgattccagcttcatgtagtcgagttgcagactacaatccgaactgagacgttatttttgtgatttgcttggcctcacgacttcgcttcactttgtttacgccattgtagcacgtgtgtagcccaagtcataaggggcatgatgatttgacgtcatccccaccttcctccaggttatccctggcagtctccctagagtgcccatcttactgctggctactaaggataggggttgcgctcgttgcgggacttaacccaacatctcacgacacgagctgacgacaaccatgcaccacctgtctccactgtcccgaaggaaaggacacattactgtccggtcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagcccttatgggccccgacacctagtattcatcgtttacggcgtggactaccagggtatctaatcctgtttgctccccacgctttcgagcctcagtgtcagttacagtccagtgagccgccttcgccactggtgttcctcctaatatctacgcatttcaccgctacactaggaattccactcacccctcctgcactctagccttacagtttcaaaagcagttccggggttgagccccggattttcacttctgacttgcatggccacctacactccctttacacccagtaaatccggataacgcttgctccatacgtattaccgcggctgctggcacgtatttagccggagcttcttagtcaggtaccgtcactatcttccctgctgatagagctttacataacgaattacttcttcactcacgcggcgtcgctgcatcagagtttcctccattgtgcaatattccccactgctgcctcccgtaggagtctgggccgtgtctcagtcccaatgtggccggtcaccctctcaggtcggctactgatcgtcgccttggtgggctgttatctcaccaactagctaatcagacgcgggtccatcttataccaccggagtttttcacaccatgtcatgcaacattgtgcgcttatgcggtattaccagccgtttccagctgctatcccccagtacaaggcaggttacccacgcgttactcacccgtccgccactcagtcataaagaacttcaaaccgaagtaatctgttctaaatgcttcgttcgacttgcatgtgttaagcacgccgccagcgttcatcctgagccaggatcaaactctcataaaaagtttgcctcgtcagttataaactaactagcttaaatagttttaccaaaacttactgtttaggttcgtgtatctttcgatactcgcaagattcattaatgaatcattttaaaattctcaaagaatttcaaggttgtctttctattcagttatcaaagataacttacgtcgttaaacatgcatcttacgacaaaccgcaaaataacagtcttgtgctttaagtacggggctgttattctgtttttaagagataagtacttatttaaaataatttaacaggaggacaaaatatgatatgtaaaaaagccattaaaaatgctgtcatattcacagcaatgctgctaattgttggtattaattcaacaccattaatatccaaagcaggcaacagctttggtgttgcttttagtgtagatggtgaaactacttttacagatacacaatccaaaagcacatcatcttcagttcagatgttatgcaccgataaagatattgatggttcatattattacggcaaagtatatgcttataaaagtggacaatattatgatgtctcacatggctatgaatattatttcgatgttaacgaaactcataatatgcttaactgggtaaacgaggaaggctatacacgcgctgctgtaagatgtgaggcgtattctgtagacgattatcatggtgcatggtttggtggttactggtatccagatatctaggaggcttaataattgaaactgaaaaaaataactgtcttttcactattattaactgtgttgtgtggctgcacaacacagccttctaatgataccaataatatgttagaaactaaaacatatctatatagttatgattatgaaacagaacctaatggagaattaagcacagcatatcatgaggaaaaaccatctgttgatttgaatgaacccagagatgttgtaagagcaactgtcaatttcaaaaaaaatgctgttacatacataaaaatgaatgaaaaatattcatttggaagttgtgaatgtgctattacacaagcctatgtcacctcggattctaattatttttacacattagttaatgaaaattatcacaatattttatcagatgaaatttcaaaacaacgcgatatttctaaagaaactggaaaactcattgacgatacttctcgctttttctgtgtaaaagtacatatgaagtataccggtaaagaagccatgactatggatatatactctacaatattcagcaaagacactaataacgaaatactttttttaggttttttaatgtttattgataaatctttttctatccataaacttgataatatttatcttgaacctaatgaagaatatgacatgtggtttttctataatctttcaaattattctagtgacaacacttattatgttaaaggtaattttcaaaattataacgacaataatagttataatggctacttgattgaactaaatgatttgactgaaattgattagtcttactactttaagaggagatatttaatatgaaatttaaaaagataattaaaaacacaataatatttgctactatgatgctggttattggtgtgtatactgcacctgtgatatcaaaagctggagatgatgtttggtacggagcatcctttgattttgatggagacacatattacacagatagaaaaagtaaaaacacgtcatcatctgtttggatgtcttgcacggacaaagatattgatggttcttattactatgcaaaagtttatgctttaaattcagcgggaacaagaatagatgtctctcatggatacgagtattattttgatgtaaatgactcacataatatgcttaactgggtatatgaagaacattacaatatgacttgtgtaagatgtgagggatattcagttgatgattatcatggtgcatggtttggaggctattggaatccagacatttaaaacaaatcacatataaattagtatttatatatgatttattattaaagctacgttgtgtctatgcacaacgtagtcttctaattgtaaaaaagttaacctatggaggtcaataattgaaaaaaaaatatataataattataccactattattaactgccttatgtggctgcgcaacaaataccaataacaacacaaatgacatagccgaaaccaaaacttatctttataactacgattatgaaacagattccaatggtgaagtaagcactgcttacaatgaagagaaaccttctgttgatgcgaatgaaccccaaataacagaagaaccaatcgtaaaattaaacaaaaattctataaaatacataaaaatgaatgaaacatataatacaggctcatttgattatacgatattaaaagtatattcaactatatctaaatcatttgccaccgaattagttgacgaagaatatatccagcctgtaatgaatcagcttaatctatataggggaatttatgatgaaaacggcaatctattttatgagggacatagatttttctggataaaggttcatattaaatatttaggagaaacaacttcaaaatttcaatttacatcaacaattatagctgaatatcctgacgggacaacatatgaattaggaggtataaattttatagacaggtctttagctgaaaacaacgagcaacacctgactttgaaccctggcgatgaatttgatagctggtttttatatgaagcataccgttattctgatacaaataaatattatattcaaggttcgtttcagaaacttcttggcggaaaccattacagtggttaccttgtcgaacttaacgacattgaagaagtcgaataaatccatgttttcataactatactaataaaatatgtaacttgcgtcgttaaacatgcatcttacgacaaaccgcagaataaccgtcttgtactttaagtacagggctgttattctgtttttaaaagataagtacttattcaaaataatttaacaggaggataagaaatggttcacaaacattttattaaaaatactgttatatttacagcaatgctattaattgtcggggttaactcagcacctataatcattgtcagatatagcattatcatctggaagatattctggatggttaagtatgctatcctgtcctggcaactgttcctccggttcgttctttgtgacggattccgtcacataatcatatggcttgtacaaacctagtttttcagcccggcttacaaaatcatgccatgttatttctttcctgcggttgattgcaaccccacgcagagaacagtcaaatgataaccctgtgccgccataatattgatgagttcttccacatctgtctttcagatagttttcaaaaacacttcccggaacatattttttcatattaagaccagatgttatatgatgatatgcaagctctatatccttgttagatggttctttaagctctgcaacagcctgctttatctcatttgtcttaacagctccggtactaaggacctttgcctgctcctcattgttaagagctgcaagcgtttttgcagattcctttgtaatctcatcttttttgaacttttccatagcatcagatgatagattgtttgcaatagttttatactcctgcactacggttttgctcatattcataatactggcaagcttctctaccagtctgccacttgcagcttccggaaacagctccgggttctcctttaaaagccttgacattccttctacttcacgcatgatttcgtagtcagttttacggttatatccgttagtactgtatacggcgaactctgcctgtgcatcagacatagcttttacatagcagggaatcattgaaaactgttccaatcctttttctgtcagatatctgcatgctctgtatcttttgtgtccggcaaggatttcgtatgtatcacccccggcttttcttactaaaagaggctgcaatacttcaccgtccagctctataaggtctgcaagtttttctacatcttcctgtgggatatccctatactgcagcttggattcttccagcttattaatagatacaagctgtggatgcatcttctttgtcagtatcttctctactgtttctgtcttatcaaaaaagttattcagcttaggcattattccacctccacaatctgcagaacttcatctgccaaatcttcgtaatcacggtttacaaggcttttgcttctgtgcataaacagtggcttatgtttaaggagtgcgctctggatacctgaataatcagatacgcttgtttcaagcaccggataatcatgattcttgaccaagtcaccgtaaacaatcttctgtgattttaaatttttaagcttatttacaaaaatcttaaaattaatttcaccacattttgattcaaggtctataatttcacgaataacaaggttaaggttatctcttgaaaaaccgtcaagggatattggaataagcacaaggtcagatatggcaagtgcattttcagttaatatacttgcgtctgggtgtgtgtcgataacgcagatatcataatcatcagcaatcgtggcaagatgtttaccaagtatgtctatatctgcaagttcaagaaacatgatatcgttagagccttttatgaaatcaaggttactaaatcttgaatgatatatagcttttctgatatcaataccgcctcttatcacctggtcgatatccggcttactgcgcttatgctttgatatgtctgtgtcaaagaaggatgtaaggttagcctgcatatcaaggtctaatacaagcacctttttatcctgtgctgcgtaagtggcagctaagttaaatgttgttgtggtctttcctgtaccacccttaagattccatgttgttattatgttcataattcgctccttttctttctttttctgtgtgacggattccgtcacattatctgtatttattctgtccattttttaaggttagaccgtatagctcaagattcgactggttgctgtcgtacatgttcttaatctctcctattgcctcttttctgaatcgcaaaattgatgctcggcttctatccagttctttcattaatacctgcatgccctctttaaatgacattttcacatataaacattcaagaacatatctcatatcagtttcaagattgttgtaacatgccattattctgtaaatcgtctcctgtgactctagaagtgtcctaacatttgcataaacacttattctccactcttcacttaggcgaaaatactgttcaagtacattctgcaggtcagttaaagaattggtcggtgcacttccatccggctcttttcttgtcattgatgccgactcaatcattccgacttcatccttacttttgaagatgtttactagctcaatctgacaattaagaacaagctggtcatgattcttgagcacattcacaatatagtcctcactgattcttcgcagcattttctatctcccactttcttcgtctcgcaatttttgcagcccgcttacgattaaggcaattatcctgtgcaattgtcgcattatagtcatattcagtcatgtcgtttaggcgaagctccctatacagtgatgtataagatatatcaaccttggctgcagtttcctctattccatatccatttttaaacaaatgttcaatctccaaacgcttttcagcgtttagtgacacataaggttttctctctattggcacaattatcaccacctttcatgttttcatatcctgctttatctcatttgtcttaacagctccggtactaaggacctttgcctgctcttcattattaagagctgcaagcgtcttggcagattcctttgtaatctcatcttttttgaacttttccattgcatcagatgaaagattgtttgcaatcgttttatactcctgcacaactgtcttgctcatattcataatactcgcaagcttctctaccagtctgccactcgcagcctctgggaacagctccgggttttcctttagaagccttgacattccttctacttcacgcataatttcataatcactcttacggttatatccgttagtactgtatacggcgaactctgcctgtgcatctgtcatggactttacatagcaaggaatcattgaaaactgtttcaatcctttttcagtcagatacctgcaggctctgtatcttttatgaccggcgagaatttcgtatgtatcacccccggcttttcttactaaaagaggctgtaatacttctccgtcaagctctataaggtcagcaagcttttctacatcttcctgtggtatatccctgtactgcagctttgattcttcaagattctttattgatacaagctgcggatgcatcttctttgtcagtatcttctcgactgtctctgttttatcaaaaaagttattaagcttaggcattttattccacctccacaatctgcaacacctcatctgccaggtcttcataatcacgatttacaatacttttacttctgtgcataaacagtggcttatgcttaaggagtgcactctggatacctgaataatcagatacgcttgtttcaagcaccggataatcatgattcttgaccaagtcaccgtaaacaatcttctgtgattttaaatttttaagcttatttacaaaaatcttaaaattgatttcaccacattttgattcaaggtctataatttcacgaataacaaggttaaggttatctcttgaaaaaccgtcaagggatattggaataagcacaaggtcagatatggcaagtgcattttcagttaataaacttgcgtctgggtgtgtgtcgataacgcagatatcataatcatcagcaatcgtggcaagatgttttccaagcatgtatatatctgcaagctcaagaaacatgatatcgttagagcctttgataaaatcaaggttatcaaaccttgaatgatatatagcttttctaatatcaataccgcctcttatcacctggtcgatatctggcttactgcgcttatgctttgatatatctgcgtcaaagaaggatgtaaggttagcctgcatatcaaggtctaatacaagcacctttttatcctgtgctgcgtaagtagcagctaagttaaatgatgttgtggtctttcctgtaccacccttaagattccacgctgttattatgttcatagtaattcactccttttccttgtgacggaatccgtcacaaattatctgtatttattctgtccattttttaaggttagaccgtagagttcaaggttcgactggttgctgtcgtacattgatttcacattctcaattgcgtttttcctaaaattgagaattgaagttctgctcctgtctaattctttcattagaatttgaataccctctttaaatgtatgtttaatgtataattgctctaaaacataacgctgttcttgttccagattgttgaaacatgccattattcgataaatcgtctcctgcgtctctatcagtgtccttacatttgcataaatgctcatacgccattcttcattaagtcggaaatactgttcaagtacattttgcaggtctgtaagagaattggtcggcgcacttccgtccggctctttccttgacatggacgctgactctatcatcccgacttcatctttatctttgaagatattgagaagctcgatttgacaatttaggacaatctggtcatgatttttgagaacattaacaatgtaatcctccgttactcttcgcaacattttctatctcccatttctttcttctcgcaatttttgcagcccgcttacgctcgatataattatcctgtgcgactgtcgcattatagtcatattcagtcatgtcgtttaagcgaagctccctatacagtgatgtataagatatatctaccttggctgcagtttcctccattccatatccattcttaaatagctgttctatctccaaacgcttttcagcgtttagtgatacataaggttttctctctattggcacaattatcaccacctttcatattttcatattattctgggagacagcgataccggaggataatggcggagcaggaaattcagaactgaaagtatatctgccggataacagcctgtatgatgatataagcaggcttgccggcacagcaggcacgacaggctcatatataagcaatattctgacggataagtatacacaatatcctgatataacagtatcttatacaccggagcagacaggggatgatgaactgatatcacttgtaaatctgtctgtaagatattctccggtaaaatatacggtaaggttctatgattatgataaaagcactgttctgtattcagaagaagtgctgccagagggagctgttacacttccggaatctcctaagagaagtgatacggtaactgatacatcagttatttcatacaccttttttgaatggagagactgcttaacagacagtccggctgggcttgatgcggttgacagagatatggatgtatatgctgcatacacagaaagcgtaacttatacaacaaagcttacactggaatactacaccattgcagaccttgaaaaaggcgtgtatgatacagttccgtatgagacagtggttacggattataatgaagaaataaagacgagcagttatataccggaagacattgttatacatacagccacagcagctggctttgacaatacgcagacatggagctttgataaatggcttcctgatacagaataccagcttacaggcagattcaccggaacagataatgtaacagtcaagctgtatgcagagtataagcttgcagatgaatcatatataagcacagaggagcttgacagcatacagatagcaagacagccggataagatcgcctacatcgtaaaagacagtttcgataagacaggtcttgttgtggatgcagtctataagcagacatggaatgacggacatgtgacatacaggacagaatataacacatcatacgatgtagatactgaaacagagcttaagcttacagatacatttgtaaccgtaagcaagactgataatggaataacaagaacagcggatgtgggaataaccgtgtcagatgagatagtaagtacagaattagaccacataagcattgccagacatgcagacaggcttaattatatcaagggggaatgctttgataagaaaggtcttgttgttgatgctgtatataagaatacataccgttcaggtcgtataacatacactgtacaggaaaatgcagcgtacagtgttgatacagaaaagaagcttatgcctgatgacataagcatggatataagctttactgacaatggcatcacaaagcatacagaggaggcagtcaccgtaaaggatgtcttctgtgttaattattactcatatgaccgtacaacacttataaagagtgacatggtagtagaaggacaggattccgcagctcctgcagtaccggacaggaaagactttgtaactgatacatcaagaacggcatatacatttcttgaatggagagatgccattacagatacagcggcagttcttaaagacataaccggaaatatgaatgtatatgctgcatatacagaaagcataacatatacaacaaagcttacactggaatactacactgttgtagaccttgaaaaaggtgtgtatgatacagctccgtgtgaaactgtggttacggattataatgaagatataaagatgagcagttatataccggaagacattgttatccatataactactgcagacggtgagaagatacagacatggagttttgataaatggcttcctgatacagaataccagcttacaggcagattcacaggaacagataatgtaaccattaagctgtattcagagtataagcttgcaggtgaatcatatgtaaacaaagagccggaagacattgaagaagcagaggaaacagaattatatccgcctgctgtaagtcactaatgcctcttataacgattggattatcaccatatactttttcagccgacctgcagcccatgaacattctcactcccgcaataaccgtatcaggtatggctggaagctctgtcatggcatagcagttataaaaagtgtaataaagattataaagctctgtctccggatatatgataggacaaagctccattgcgttgcacttttcaaatgtttccataagattcttacatgttttaggaatgacgagcctttttgaaggattaaatttaatgtcatttctgaaagccgagttcatgttgattactccatcaggaatctgcggaatatcgaccagggatttgcagccctgaaaaatctttcccatatccttaagttttgatgggaggtttgtaatacttacaagttttttacaatccctgaatgtattttccatcttcactacatcatcaggaatgttttctactttttcaagagaagtgcatccggcaaacatggctttcatgttctgaccttcaactgtctctactgtactgttgccatacatatcaagcacccctggttcgtcaagtgcattgtatacagtagagtcagctattgactttatactgccatctacgctgctgtaatcgttaagggtatctgcacacactacaatatctttggatgtatcactgccaattttaaccccatcaagaaactttactgattttatctttgtattatttacaaacggtccatctgcatcatatacttctgaattttcccagtcatctgtatcataatctccgtcattataatattccgttttgtactgcgtaatcttcatatgggtattatagactgttcctgcaatggaatattggggataaagaacgatatccttattagttcctatgtacttacccagtattaccgtatcacctgatatttcatattcccattctgctgctgaaagttctggtatctccaatgctctgtagtctttctttactgttccctttacttcaagctgaatgttgtaggctacattatatgcatagttgcttgcagcatataagagagtgattatatctccatttttatatgtcatttcttccttatcctcatcgtcaacaaaggtaacatcaagcgtacagccatttgtatcccttatatcattgacattaagaactatgcattgttcatcctgtattcctgtgaccagcagttttgctgttccttcatatcttccggttgcagtattatactttaatactgcatcttctgatatctttgtcagtatattctcctttttcgcatcatcagctcttgatactgtagtcatcactcctgacggaaaacagcttattataagaattgcagtaagcagagctgctgttattcttcttttcataaattatattatatatttcatgtcttatctgcatgacattaacataaaatatacctttcccctttcttgtattttgtctttatactgccttaaacaatctgttcatggtgggtctcttacgcttctcatggctgttctccttcctgttttttgcaacaaaaaaggaaacctctgccggcatatatccggtaaagatttccttaagatttattattcaattggttcttgtcatattaaaatacatgtgacggattccgtcacaaagaaagaccgaagcagtgttgcgaggactgcttcggcgagctgaattactattccgacaattaacaaccaactcggaaacaagaagtcatttcttacacttcttgcaagtatagaataccacatctaattagtcttatatgatgcagatggtgcgtgaagttaattcaacagaagtcagaccagatgaaatataatggtaagaaataattgacgtttagcactatgtgagttagcatagtggtagataattatttctttgtatcacgcaaatctaattttccgaaattcttcataaaaaaggaaatataatttttcaaaaagaagcaaggtgaaaagaagaaaatgaatttatttaatgcaaaactggggaaaagaaagtgaaaaataaattccattttggggctaaaaaatggaaaaatagtttcccatgatacaaaagcctgtttagaacatatatccataagaaccttaaatatatcgtcctgttttggatattgtaaaactatgagtgatttatatgacagaaagaaggttaaatatgataattgaaaaggaatattttgattcagaagaagtcagaaaagcgaatgccatgaatgataagacgatggcaccaccaagaagaatacgtcttgcgacaacggacagtaacaaatattatgccaaagctgtatttgtagccgataaagaaaatataattaccggtgagcttctttacagaccagattttcaggagtcagaagagggagtggcattcagtgaggttgttgttaagcagacagcagatgtggaagaatatttcaagaatcttataaggtttgaaggctataaagtgattccggaagaatatgatgagagtgatatgcttatgcattatgatgagctgagcatacaggctaataagcttttgtttcttgagagcagggatgagtagacatgacagatacgcagaatgaggtgtttaagacaccagtaaacaagataaggctgtttgagcatggggctccgggttcgcagaaccttaagcttacaagaaaatattacactgaagatatgcctgatggaagagtaaagcatatagtgcagaacattacagatccggatattgttccttatatacctgatggtattggtaacagtacagacagacaaaggattccggcagtattgattattccaggaggtgcgttcagacgccttgtatacaactttgaaggtgaagatgttgcaaagtggcttaatagtatgggaatagctgcatttgttcttgaatgcagacttccatcagatgaacatgataatgcagaggatgtcccacttatagatgctatgcgcgtaatgagagttataagaggaagggcgcaggaattcggtatagatgaagctaagataggcgttatgggcttttcagcaggaggctttatggcagcgttattatcaacagcgtatgaaagtgatgtgtatgtggattataagtataaggatgaatatgataaactatcagcaagaccagattttgctgtttgttcatatccggttataagtattgacgattgtattgaagcaggcaaaagatatatgtctgaggaacaggtgcttgagagaatcagtgacagtaaggcaaagatactgcataagtataatccggataagcttgtaagaccggatatgccgccagtatttatatgtgaaacggatgatgacagaacaacattgtctgagaacagtgtgggcttttatatggcagcaagaaaagccggggtaagtgctgaacttcatatattcagaacaggtggccatggttatggctgtggtgatgattttgcacagactggtgagtggaaagtactttttacaaagtggattaagagtattggaattattagttaagatggatatagtatacgaggaacaagactgttattttgcggtttgtcgtaagatgcatgtttaacgacgtaagttacatattttattagtatagttgcaaaaacatggatttattcgacatcttcgatgtcgttaagttcgacaaggtaaccagtatagctgtcatcatcaatatagttttgaaaagaacctcttaaatagtaggtcttatcatgactatatcgggaagcttcatagagaaaccatgcgtcaaattcatcatctgggtttaatgttaaatgacatgtggaattttctgacaaagctctgtcaatgaaaccaagtaatccaagagaataatatgtaccgtctggatatttacatataattggtgatgtaaattgaatttttgaagtagttttacctgaatattttaaatgcatcttaacaagaaagaatctatgtccttcgttgaatagattaccattttcatcataatagccacgaaatttatttagatagtcaagtaatagctgtgaatattcttctccaaatgtatcagcgcaaaactgcttggaaacagttgaatatgcttttaagacagtacattcacatgcacccgaattataagtttcattcattttcacatatgtgacagcaccttttttgaaattaacagtaggttcaacttcttcgtgtgattcattcaaatcaacagagggtttttcttcatggtaatctgtatgtacttcaccattggaatctgtttcataatcgtagttgtatagaaaggttttagtttctgttatgtcatctgttttatttgatgtagatgatgaacagccacttaaagtgaataacattataaaaataattattattttctttttcaataatttttttcctcccaataaaattattgtttatatttacaaattcggtaagctttataagatatttattattaggaagctgcgttgtgcagtcgcacaacgcagctagtataaaatagagaatatataagcttatatttcaatatttataattttaaatatctggattccagtaacctccaaaccatgcaccgtgataatcgtcaacggaatagccagtacatttaacagttgctttattgtaatgttcttcataaacccaatttaacatagtatgagtttcattaacatcaaaataatattcatatccatgcgatacatcaacaggattatcagatacattaacagcattaacacgtgcataataatatgaaccatcaatatccttatcagtacaagacatccacacagatgatgatgtgtatttaaattgtgatggtaaatatttttcatgaccatcaaaatcaaaggatgctccgtaccaaacatcatctccagcttttgatatcaagtcaagtccaaatttgtgtgtaaattcatctttcagttatgtggttttatctacgctacttttatcttcaagagatttgactgaatggagcttagtttatcatagtactctttcatatcaaagattttatgacctacactccattcattatgatcatcttgaaggactgcaccaattaatctaataatagattctgtattaggaaaaatctgaataactttttcgcgtcttctgatttctctgttctcgcgttctattatgttgctggttcttaatgctatacgatattttgagggaagtgccatgatggtaatactatcttcaaatccttcatcaaggacagtcattgcttcatttgcaacatcctgatattcatcgtatatagattcttttaaacgacgggcctcttcaatagtagctgcgttaaacatgtctcgtaactcagaagctaaaccagtgctgtattttttaggacacttatctatgatgtttcttgtaaagtgagcctgacatcgctgccatgaagagccagagaaactctcctttattgcttcaacaagccccgcgtgtgcgtcagatattacaatatctacaccgcgcaaaccgcgacttttaagattttcaaaaaagtctctccaggtgttcactttctctgaatcataaacttcaaatcccaggacttctttgtgcccggtattgtttattccaattgcaacaaacaacgcttttgatttaacacgatgatcttcacgagcttttaaatatatcgcatcaacaataataaacggatagtgttccggcaataagcgctccttgaaatgcttaacagggacatctagttccttgcagatttcagaaacagcagattttgaaaaagattctccacaaagctcttcagttactttttttatatttctggttgatacgccttgcacaaccatttccatcattgttgtaattaaagcctgttcattacgctgataattttcgaacaaggaagttttaaatggaacattacgatgtcttggaacctgtaattcaatctttccaatacgggtggttaatgttcttgtcctaactccatttctataatcagaacgttcttgagatcgttcgtaattacttgctccaagctgttcagtagattcagcctgaagaacctgattaagtaaagcttccataagtttgccaaaagcttcatccttagtttctgaaaaaagtcctacaaaaaaatcactatctaatgtaaaatgtaattgagccatgagtttcatcctttcaattatgtttttgtgtggtaacttaattataactgaaagatgagctctatctcttaaaaacagaataacagccccgtactcaaagtacaagactgttattttgaggtttgtcgtaagatgcatgtttaacgtcgtaagttacatattttattagtataattataaaaacatggatttattcgacatcttcaatgtcgttaagtttgacaagataaccactatagctgtcgtcatcaatatagttttgaaatgaacctcttaaatagtaggtcttatcatggctatatcgataagcttcataaagaaaccatgaatcgaattcatcacctggatttaaggttatgtgatgagattcattttctagcaaagctttgtcaatgtaatcaattcctccaagggaataatatgtaccatctggatatttacatattattggggaatcaaattgaatttttgaagtatttttacctaaatatttcagatgcatcttgataagaaagaaacgatgtccttcgttatatagattgccattttcatcataatagccttgaaatttatttatcttatcaagtaataattgagaatattcttctccgaatgtatcagcagcaaattgttttgaaactgttgaataagcttttaaaactgtacattcaagtgttcccgaggtataagtctcattcattttaataaaggtaagaccagctttacttctgaaattgacaataggttcaacttctctatgagattcattcaaatcaacagatggtttttcttcatgataagcagtacttacttcaccattggtttctgtttagtaatcgtaactgtaaagataagttttagtttctgttatatcatctgttttatttacttgtggtgatgaacaaccacataaagttgttattaatataaaactaataactactattttctttttcaataatctttccctcccataaaattattgtatatgttttcaagtctattatgttttataaaatattcattattattagaaagctgcgttgtgcagttgcacaacgcagttattacaaggaatatttaaatttcatattaaatatctcctcttaaagtagtaagactaatcaatttcagtcaaatcatttagttcaattagataaccagtgtaacttttatgatcattataattttgaaaatcgccctgaatataataagtattttcactggaatatgttcctaatacatgatagaaaaaccataaatcatactcttttccaggttcgagatataaaacatctttttcctcatttgctaaagctttatctataaaaataagtaaacccggatcatacattaaattattttcattacttgtaagatggaaatcattaaatatctctgctttgatccaaccattgattgcttccatggcagcgttatctgttggagtaccagctcgagacattgaatgaactatgttatatagtggcaataattcattgaaactttttgaagaatatacagatccttgatcagtatgtaacaccatttcaagatctggatttttcttcttaagttcaattaatccttctaacccgtgaatatatgtcatacgatcaccttttcgtgatgaaagtgaatatgaaagtatttcattgttccataaatccataaaaagtgttagttcataataacttccttttaaatgaaatgcggtcatatcacttacaacacactgtaaaggtcctgttatatctaatcctgtcagtagaagatttggataaatgcgataaggatctcctggctttttgtatcgataatgcttggaaacacttgctatgcccgctgttttacatagcttatgagcatactgatctgataccataagtcctgtatccagacgaatttttgcatttaaccatctatatccatgtgatggatatttactatgatattccttaaataatataagattggatactaaagtttttaatttgtcagaaggtttttctaaacgttttttccatttataaaatccacttctgttaatatccagaacatcacatagatgcttaacaggaaattgagatgacatttccattatgatttcgtattcttgttgtttaaaatactgtactccttgtttgcaccagctcctttcacttcgtatcctttttttgcccttaattcattcgctttagctataataagttcatttattaattcttctttggacatagccatatatgtatcaatgtcaggtgaagacaatgattttaagactgctgaatttttcattttaggcactgtattagcaagaggaattccttgtgctttcttataatctgtcatgtatttatgtgcacaggattcactaagaccataaatctccatagcctctttataagtaatctcgtgtaaatacatacgtcgtcctatatccattctttcttctaaactgtgcttcatgtgacacctccatgattccattattgtataagtgactaccttataaaaaatggtactcttatatataaataatgtctacaataattgggttggtgtctacttttagattaccacttca
